United States Patent 10,407,724 (METHODS AND COMPOSITIONS FOR SCREENING AND TREATING DEVELOPMENTAL DISORDERS) - sequence listing, part 57

SEQ ID NO: 1481 - DNA, 240040 bp, Homo sapiens
tttcctccctctcagggctgcgcgcccaggtctgcgccgcgctccgcctccagccgcgcgcagacttgcgcacgcgtcgtgagagcgaccgcctccgtctctcgctgggctcgctagggctgcgcgttgggccagcgggggcgccgcagctgaagccgccccggagccggtgaaccgaattacctcgagggaggggcgtggggaaggcggcgggaggaggagcgcacgggccggctgccgtgcccaccacggctgaggaacatggttttcgagtcggtggtcgtggacgtgttgaaccggttcttgggggactatgtggtggacttggacacgtcccagctctctctgggcatctggaaaggtaaggaggccgccgccgccgctccccggcctctcgtgcttcccggccgtctcgctgcccgagcggcgtcctgcgttctcggggcttcgagcaccttgctcgccgggtgcagccacctgccgccgcccgcctgtgggtcaagttacgtaaagccgggcggcagttccctggcctccgccctcgagttgtttatattttgggggaaaggagagggtcatgagtgcgggatgaaaaggtctatattttccgagcggagcggacttgccgtgggctccgtgggtctggcgttcaagtcccggcgaggggccgttctctacccctggccccgcacggtccggctttagccgcgcggggcgaggaggcgagacgacgccttcctgggctgggtcccatccctgtcctttgcccccctgggtttatgacgaaggccccagaaatcccccgcgtgttgcatgctgcctcgcacgtgaaggcagggcgctgtgaccggggacgcccgcttccttgcttccccagcctcaattcctggcttcacccgtggtgctttctgctctcccccttccggccctaggacccggacgccggctctctctcgcctgggttcggcggataacaaaaaggaaactcaagtgcaaagtaactcaaacagttgcttgtgtggttgcagttaacagcctgacctaggaatgtgtaacattttcaagactttaggatatgtgggtcagagtgaattgccgaattttaaagaaaaaccagggcgtgcggtgcaacgtctcagacctgcaaaagaccgggctgaacagggccctacgctgcctaggtggtgaaggaccgagctttccttgtgtccgtttagtgtggtattctgccttagtgagagcctcatttttagtgtttccatctgtttttgcattatgcgcttgtttattttaaacacccgctagaaattagactcctttgtgaaatgaatttcccaggccaaagtgagggttaattttgtgtgtgaagtgtgtgtgtttaaatatatatttaaagtaatttattcttgtctgtgcacacacttccagtcttcttctaaaatacttaccttgactcttctcgtttatgagataatgtaaacaggtagtttagtttgattttaaagaatgttactaccgtggggacctagtatcatgatggagagtgagtggactacaaaagctagggatatagtgatagctgctcagcctgtttgattagtacaagaaacttgcagtctgtttatgctgcttcttagttgcaaagtgaaaataaaatttgtctcccatgtacctcagaaggaagccttaagaatacttgaggtgaactttgatctgtagtggagtcttgcttccacattcagggtggaggtttgtctagagtgtgattaatcaacttatttatttgtttaaaatttacatgcagtaaaattcactcttgtgatacagttctgtcttgacaaatgctaagaggcatgtatgcaccaccacaataatggcacataaaaggttcatcaagcctcccgaattctctcagctgctcctttgcagttgatctcaccccgccaccacgcccggctaatttttagtagagagggggttttgcaatgttggccaggctggtctcaaactcctgacctcaagtaatccgcctgcctctgcctcccaaagtgctgggattacaggcgtgagccactgcgcccgcctgactgtaagtatttatctgtttgctggttgaagaatatttcagtttttggaggttataaataaagccgtcataaacattcacgtacgggtgtttgtgtgaacataattgttatttctcttggataaatacctaagagtggttttaaattgggttgtacgttttttttttttttttgagatttatttcatataccataaatttcactcttttaaaatgtacaattcagtgttttttagtatagtcacaaaattgtacaaccatcaccactctctcattccggaatatttcagcaccccaaaattaaatcgtatgtccattaggagtgactcccaatttcctcccttctcactactccacctctggcaaccactaatctttctgtctttatggatttggtaattctggacatttcatttaaatggaattatatgatatgtggccttttgtttctggcttctttaacctaatgtattttcaaggttcctccatgttgaaggatgtatgactatttcatttgctcttagggttgaataatattccattatattcatagaccacaatttatttatctatactcaccagttgctggatgtttagattattcctaaacatccaccttttggatattatgaataatgccactgaacattcatgtacaagtttttttgtggatgtatgttttaaattctcttggatatatacctagaagtggaattgctgggtcatatgctgactttgtgtaaccttttgaggaacagccaaactctttttccagagtgtttgttttcttatggttgagttttgagagttctttaaatattaaggatacaatttcttcatcagatatgtaatttgaaaatactttctcagtcttttcccattttgtcttttgcagagcatacatttttgattttgggaaaagcccagtttataaaacatttcttttatgaatcatggcttttggtattcatatctaagaaatcttttcccaacccaaagtcaaagatgttctcctgtgttttcttaaggaagttttgtagttttaggttttggatttctttttgtataaggtgtgtgatatgtgttgaaggttgaggttcatttgtttgcatgtggatgcaaatatccaattgtttagcaccacttgctaagaaagaggatcctttctctattgaattatctttgcatttcgtaaaaaaaaaatcagtagacttaatattgtgtggctttagtctgtctcaatctgtgtgtctatcatttcaccaatactacactgtcttgataactgtgtctttgtagttagtctagaaatcaggtaatgtgatccctctaactttagtctttaacaaataatttaaaaaataacaagtcattgtccaggtgtggtgctcattcctgtaatcccagcactttggaaggctgaggcgggaagattgcttgagcataggagtttgagattacagtgagctctgatcatgccactgcattccaacctaggcaacagacagcgagactctgtctcaaaataaaataaaataacatgtcagtgttttatttatagaaattggttatgttttgataaatgaaactttaaataatagctggagtatttttttaaaatattctttgagaatttcaaaagtagtaatttgataaatttggaggattttttaaaaacattgtttgaaaatttctgtaatagaaactaggtggccaggcatagtggctcatgcctgtaatcccagcactttgggagactggggagggtggatcacttcagaccagcctggccaatgtggtgaaacctcatctctacgaaaaaaataagatacaaaaattagctgggtactgtggcgctcgcctgtaatcccagctactcaggagactgaggcaggagaatcacttgaagctgggaggcataggttgcagtgagctgagatcacaccattgccctctagcctggccaacagagcgagaccctgcctcaaaaaaaaaaaaaaaaaaaaagaaactggatgctgcataggaaaattttaagataatattttatggtctaacgtgaaggacctattggtagttgtaaatgtgtgcttttgctaggcttctgaaataatccagcaaatttcaatattagcatgttactataatagtatcaattagtattcagtcattgctaataatggatggtgctctgaaaatttgttgctgagatggattctttggaaatcagaatgcatttttcccatggaagcattcttatatatgaatgaggacttttccaaaaacctgtttaactataatgcagcagaagagtgctactgtactgggttcaatacagtaagtagactcactgctagaagactctgtcttacaggggatgaaaaaggaattgagcttcattccaggactgactcttggcaaattttgatgttggtaaggtatactttttatacacttctatttataattctcccttcccatatatcatctagttagagaggtggtaatatttcatagactcatctgaaatttatcttcccaactttctccagcaattttctttttctttttcttttctttttgagacggagtctcgttctgtcacccgggtgggagtgcagtgacgcgatctcggctcactgcaacctctgtctcacggcctcaagtgagtctcctgcctcagcctcccgagtagctgggattaaaggtgcccaccatcatgcatggctaatttttgtatttttagtagggacggcatttcaccacgtcaaccaggctggtctcgaacgcctgacctcaagtgatccacctgccttggcctcccaaagtgctgggattacaggtgtgagccactgcgtccggccatttcacatattttctttaagagctaggctgcatcagaatcagccataggtgcttattatgaatacagaacctgcccccagagattataaattatttatctggagtaggacatgaaaatatttttttaaacaaatgacactggggacttgatgcacagttgggtacattttaagagaacattaaggggaaaagtattagaattttaaatagacaaaagcagtagtaaaagtggcttgtgtgatagaattatcatttgtaacacaggaagtacctgtacttcatagccccttcttaagttagcctcctttgtctctattttgttttctccgaaatcacaatacttggacaaatttgtaatttttttttgataatgcctgacatctttatgtaacattagaagttcagatttcttgtctattaactaacatacgtattctgtttttgaaatgttaatctcccagttttccctttataatagaatcatgtgtttagtggccacttagctggataccgccatgataccagaagcagtacaaaagatgaagattcagttaggatacagttttcgatttttaaggagtcattcttctgtgcccagaatacactagggagccaaacaaatgattcttacagtctggtgttaatgaccaattctaattccttatgtattatttttatatttatgttctaagatactttaataaaactttaaagactatgaaacattttattataaaaagtgttaggagattttacagtgcctctccatatacccattatctagattctgtcattaatattatgtattaacagctttattgacgtataattaacatgcagtaaaatacacgttaaagtctacaatttgataagttttagcatatatgtgcatgcaggtaacaatcatcacatgataatgaacatatctgtcatacctagaagtttccttgtgcctttttgtaaaccgtatcttctaaccctccttgtcccttatacccttcttgtccccaggtttttgctgatttgctttctgttactgcatattagcttgagttttctagacttggataaatgggattgtacagtttgtattctttcagtctggcttatttcagcataattattttgagattcatccatgtggtagtacaatcaataatttattcctttttattgctgaccatagcaagtggtggtgaggatgtgcaaaaactggaactctgttaatatgtctcctggggatgtaaaatgttaaacaacttgggaaaacagtttggcaatttcttaaaaagttaaacatacatcaaccatgttatcaagccattgtgcttctacatgtttacccaagagaaatgaaagcatatgttcatacaaagatttgcacacagatgtgcatagcagctttatttttaatagccccaaatgggaaacagtccaagtatccaccaacaggtgaatggataaacaaactggcatatccatataatggaataccattaatatttaaccacacatgttttgtcacatacctgtccatctgtccatctctctatccatgcagcaattcatattattaaatgtatttcagaataagttgtagagatgagctcatttcctcctaaatacttcagcatgtgtatcattagagtgcaatatttgcttagtttttttccttttgaggtaaaatttatgtagaagaaaatatacaaatcttaagtgtacattgactgagttttgacaaatacatacacacatgtaactcaaacccagtcaagatatagaacatgaccatcaccccagaaagtctttttcctgacctttcctaatttattcctaccctcatcttcagaggcaacaaatactctaatttttttctttctgtcatacatacacatctattctgctttgctgagagtgttttcttttccttcaagaatgttggagccaggcatgatggctcatgcctgtaattttagcactttgggaagctgaggtggccagatcagttgaggccaggagttcgagcccagcctggccaacatggtgagaccctgtctctactaaaaatacaaaaattagctgggtgtggtggcgggcacctgtagtcccagctacttgggaggctgagacacgagaatcgcttgaacatgggaggcggaggttgcagtgagccgagatcgtgctactgcactccagcctaggtgacagagcaagactccgtctcaaaaaaacaaaaacaaaagaatgctggattttgtcaaatgtttttttctgcatctattactattatcacaggatttttttcttttttaatctgttggtgtgatacattacattaattgatctttgaatgttgaactagccttgcatacctagaataaatcccatttggtcatgacgtgtatgtttagcactcagtatctccaggggtttagttccaagacctgtgcagataccaaagtccacaacagggagggcatggaagctccccaccaccttactttgctctgtccatctctttatctgtatcctttgtaatatcctttatgataaactgttaaatataagtatttccctgagttttgtgagttatcccagcaaattatcaaaccaaataaaatcaggtgcgaaccctgatttatagctggtcaatcagaagcacagatcacagcctgcgacttgtgactgacatctgaagtgaggggcagtcttatggaactgagcccttaccatgtgggatatgacattatctctttttttttttttgagacagagtctcgctctgtcgccaggctggagtgcggtggcgcaattttggctcactgcaacctccgcctcccgggttcaagtgattctcctgcctcagcctcccgagtagctgggactacaggcgcctgtcaccacaccaggctactttttgtatttttagtagagacggagtttcaccatgttgaccaggatggtcttgatctcttgaccttgtgatccacctgccttggcctcccaaagtgctgggattacaggcgtgagctactgcgcccggctcgatatgacaccctttctaggtagatagtgtcattatttaattgaattatagttagtgtctgttggagaattgtttagggattgggggaaaaacttcacatatctggttatctaagggttctgtgtcgaatatgagagtagagagaaaaacctttattttcctttgacagtgtcttatcatatttatagctgttttctgttttgttatacttgtttcctttttaaacagtcttcccctcctcttttgccctctctggttttaattgatcatgtgatatgatttaatttttttctcctgtcttagcataccaattatgcttcttaaacaatttatttaagtggttgtattacagtttgtgctgttcacttaaaactagtccaagtccacgtccaaataacattataggtcaggtatagtggctcacgcctgtaattccagcattttgggggactgaggctggcggatcatttaaggttaagagtacgagacctgcctggtcaacatggtgaaaccccatctctactagaaatacaaaaaatttgctgagcatggtaatgtgcgcctgtagtctcagctactcaggaggctgaggtatgagaatctcttgaactgggaggcagtgagccgagattgtgccacttcactctagcctgggcgacagtgcgaaactctgtctcaaaaaacacaaaaacaaaaatcccactatactacttcatggaaaatggaggtagtatatgtaatactctatcttacaatacagtatacagattcctcccttctgcccattgtaacattgttgtcattaatttcacttacctataagctgtaataatccaatgcattgctgctattagtattttagacatttttctattaatttaagaataaggaagaaaagacttaatttaccttcatctcttaattctctaatgctcctgtgaatctgagtttttggtttaaatcattttccttctttctgaagaactcctttatttatttgttttttttaatttttgagatggagtcctgctgtgttgcccagcctggagtgcagtggcgcagtctctgcttactgcaacctctgcctcctgggttcaagcgattctcctgcctcagcctcctaagtagctgggactacagatgcatgccaccatgcccagctaatttttgtatttttagtagaaatggggtttcactatgttgaccagaatggtcttgatctcttgacctagtaatctgcccgcctcggcctcccaaagtgctgggattacaggtgtgacccaccacacccggcctatcttaaccattttaagtgtacacttcatgtcattaagtacacttacattgtgcaaccatcaccaccattcatctcctgacttcaccattattcatctcctgaattcttcatcttgcaaaactgaaccacttacccgttaagcaatgactacccattccaccgtcttcccagaccccagtaaccgttattctacttttgatgtctgtaaattcgaatacttgaagtataagtggaattatacagtatttgccatttgttattggtttcttttacttggcataatgtcctcaaggtgcatccgtgttgtaggaaatgtcagcatttcaataatttttcaagctaaatagtatcccattgtatgtatatactgcattttgtttctccattcatctgttgatgaatagttgggcagcttccaccttttggctgttgtgaataatggtgttatgaatgtggatatttttctttgaagttcagtctgtgctgtcagatttttgggttacatacccagaagcagaattactggatcatatagtaattccattatcaatttttttgaggaattatcatactactttctatagtgactgcaccattttacattcctaccaacagtgtacaaaggtcaccatttctccacatcctcaccaacatttattttctctttttttgatagtagttatcctaatggatatgaggtggtatcttgtagttttcatttacatttctctaattagtaatgttgaacatcttttcatgggcttattgaccatttgtatatcttaattggagaaacatctatttaagtcctttgtccatcttttaatcaggttgtttgttttttgagttgtaagagtttacatacaaacatacacacacacacacacacacacacacaatgttagctgcttatcagatatatgatttgcaaatatttcccattttgtgtgttaccttttcttcctttttttccctgctaacttttattttaggttcatggggtacatgtgtgggtttgttgtgtgggttaattgtgtgtcactggggtttgatgtataaattattttgtcacccaggtagagagcatagtacccgatagatagttttttgatcctcaccctccccacaccctccaccctcaagtaggccttggtgtttgttgtttccttctttgtgtccatgtgtactggatagagtttgaatacatgtccccaccaagtctcatatttaattgtaatccccattgttggaggtggggactggtgggaggcagttgggtcataggggtggatctttcatggcttggtgctgtccttgcaatagttcttgcaagatctggttaagtgtgtggcacctccctatgcactccccctcttgctcctgctgtgaccatgtgatgttctggctccgcttttgccttctgccatgattgaaagcttcctgcgtcctccccagcagctgggcagatagatgctggtgccatgcttcctgtacagcttgcagaaccatgagccaattaaacctcttttctttgtaaattacccaggctcaggtatttctttatagcaacacaacaatggactaacacagtactcaagttttaactccgtcttgtgagaatatgcagtatttggttttctttttctgtgataactcgcttaggataatgctctccagtggcatccatgttgctgcaaagggcatgattttgctccttttcatggctgtgtggtagtccatggtgaacatatactgcattttctttatccagtccactgttgacagacatctatgttgattccatgtctttgctattgtgaagtggtgctgtgatgcacatacgcatgcatgtgtccttatggtaggacagtttatggtcctttgggtatatacccagtaatgggattgctggttctaatggtagttcttaattctttggtagttcttagttcttaaatctccagactgcattccaaagtggctgaactaatttacattcccaccagcagtgtgtaagtgttcccttttctctgcagcctcaccagcatctgttatttttgactttttaataatagccattctgactggtgtaggatcgtatctcactaatcattaatcctctaatgattagtgatgttgagttttttttttccatgtttcttggccgcatgtgtcttttgagaggtgtctgctcatgtccattgcccattttttaaatggggttgttagttttctgcttgtttgtttaagttccttatcgattctggataattagatctttgttggatgtatagcttgcaaatgttttctcccattttgtagattgtctgtttactctgtggacagtttcatttgctgtgcaagagctctttagtttaattaggtcccacttgccttttttttttttttttttgtagttctggaattttcatcatgaaatctttgtcagggcttatgtccagcatggtattccctaagttttcttctagggtttttatagttttaggttttacatttaagtctttaatctatcttgagttgattgttgtatatggtgaaaggtaggatccagtttcagtcttctgcatgtggctggccgttatctccacaccatttattgaatagggagtccttttcccattgcttgtcagttttgttaaaatcagatggttgtaggtgtctggctttatttctgggctcttgacctgttccattggtctacatgtctgtttttgtatcagtgccatgttgttttggttattgtagccttttagtataggttgaagtcaggtagtgtgatgcctcaggctttattcttttggtttagggttgctttggctattcaggctacttttttgggccagtatgaattttaaaatagttttttctaattctgtgagaaataacattggcagtttgataggaatagcattgaagctgtagattgctttgggcagtatggacattttaacaattttgattcttcctgtctatgagcatggaatgtttttccatttgtttgtgttgtctctgatttctttgagcagtgttttgcaattctcattgtagagatcttttacctctctgattagctctattcctaggcattttattctttttgtggcgattgtgaatgggattgaattcttgatttggctctcagcttggatgttattggtatatagaaatactactgatttttgtacattgattttgtatcctgaaagttggttgaagttattagttctaggaacctttgggcagagactatggagttttctaggtatagaatcataccgtctgcaaacagggatgatttgacttcctctcttcctatttggatgtcttttatttctttctctttcctgattgctctggctaagacttccagaactatgttgaataggagtaagtgggtatccttgtgttgtcctggttctcaaggggaatacttccagattttgctcattcagtgtgatgttagctgtgggtttttcatagatggctcttattatttccaggtatattcctttgatgcttagtcttttgagggtttttaacatgaagggatgttgaattttatcaaaagtcctgaatctgaaaagatgatcatgtggtttttgtttttagttctgtttagtaatgaatcacacttattgatttgtgtatattgaaccaactttgcataccaggaataaagtctacttgatcatggtagatgtgctgctggatttggtttaccattttgttgaagatttttgcatttatgttaatcagggatataggcctgaagtttcctgtttttgttatgtctctgccaggttttgttatcagaatgatgctggcttcataaaataaaatgagttagggaggagtccctccttctcaattttttggaatagtttcaataggattggtaccagctcttctttatatgtccggtagaatttggttatgaatccatctggtccagggctttttctggttggtagactttttatacaatttcagaactcattattgctctgttgaggtattcagtttcttccaggttcaatcttgggaggttgtatgtttccaggaattcatccatttcttgtagattttctagttagtgtgcatagagatgttcataatagcctctaaggattttttgtatttctctgggtcggtggtaatgtcccctttgccatttctaattgtgtttatttggatctcctctctctctttttttttctttgttagtctggctggcaatctatcttatttattctttcaaggaaccatcttttgtattttttttgttcagttcaactctaattttggttatttcttttctgtggctagctttggggttgatttgctcatttttctagttcctctaggcatgatgttagttgttaactttatatctttctaacattttgatgtgggcatttagcactataaactttcctcttaagactacattagctatgtcccagagattctggtatattgtatctttgttttcattagtttcaaataattcctttcttttcttttctttttcttcttcttttttttttttttttgagacaggttcttgccctgttgccgaggctgaagtggagtggcatgaacacggctcactgcagcctccaccttccaggctcaagcagtcctcccacctctcagcctcctgagtagctgggactgcaggtgtgcactcctacacctggctaattttttttgtattttttgtaaagacaatgtttcaccatgttggccaggctggtcttgaactcctgggctcaagtgatccccccacctaagccttgcaaagtactgggattacaggcatgagccaccgtgcctggcccaaagaatttctggatttcagtgaaattaagatttcgttgtttacccaaaagtcattcaggagtggtttaatttccatggaattgtatggttttgagagatcttcttggtattgttacctatttttattgcactgtcatcttgagaacatggttggtatgattgtgggatttttaatttgttgagaattgctttatggttgagcatgtggttggttttagatacgtgccatgtgcatatgagaataacgtatattctgtttttgttgggtgaggtgttctgtagaactctgttaggtccatttggtgaagtgttgactttaggtctgtctaatactgtcagtgggtttttgaagtctcccactattattgtgtggttgtgcaagtctctgtaggtctctgagagcttcttttttgaatctaggtgctccagtgttgggtatatacgtatttaggatagttaagtcttcttgttgaattcaaccttttattgttttgtaatgcccttctttgtcctttttgattgttgttggtttcaagtctgttttgtctgaaataagttacccatgcctgcccttttttgttttacttgcttgatagatctttctccattcctttactttgagcctatgggtggcattgcatatgaaatgggtctcataaagacaacatacaattggttcttggttcttcatatgaattgccattctgtgcctttgaagtgggatgtttagcctgtttacattcaagatgaatattgttatgtgctgatttcatcctgttatcgtgttgttagctggttggtatgcagacttgattgtatagttgctttatagagttagtggtctctgtacttaagtgtgtttctgtggtagccggtaatggtctttcatttccatggttagtactcccttaaggacctcttaaaaggcaagtctggtggtaatgagttcccttagcatttacttgtctgaaaatattttatttctgattcacttatgaagtttagtttggttagatatgaaattcttggttggaatttcttttctttaaggatgctgaattaggcccccaatttcttctggcttgtaggatttctgctgaaaggtctggtgctagcctgatgggattccctttgtagtagacctaccccttctctctagctccctttattatttttttctttcacattgaccttggagaatctgatgattatgtgtcttggggatggtcatcttgtatagtatcttgcaggggttctatgaatttcctgaatttgcatgtcaacctctctagctaggatggggaaatttttgtggacagtatcctcaaatatgtttccaagttgcttgttttctctccctctctttcagggacaacagtgagttgtagatttgatctcttcacataatctcatgtttttgggagatttttttccattgaaaagttatttttcctttatttttgtctgagttgatactgaagaaccagtcttcaagttcttgagattccctcctcagcttaatctgttctgctgttaatacttccagtgatattgtgaagttcttgtagtgagttttttagctctgtcagatcagtttggttgtttcttaaaatgactatttcatttttcagctcttgactcattttactggagtccttaaattccgtggattgggtttcaactttctcccgaatttcggtatcttctgagttttatgcccatcatttcagtgtgattaagaaccatcactaggctgggtacagtggctcacacctgtaatcccagcactttgggaggctgaggcgggcggatcacttgaggtcaggtgttcaagaccagcctggccaacatggtgaaaccctgtctctaattaaaatatagaaattagctgggtgtggtggtgggcacctgtaatcctagttacccaggaagctgaggcaggagaatcacttgaacccggaaggtggaggttgcagtgagccgagatcatgccactgcactccagcctgggcgacagggcaaaactctctcttcaaaaaaataaatatataaaataagaaccattgctggggagctactgcagtcattttaaggtaagaagacactcaggcttatagagttgctagaattcttgccctgattctttctcatctttgtgggctgatgttcctttaatctctccagttgctatcctttgaatgaggctttttgcttttatattcttggatgccccaagggtttgaccttgatataagttgagtttagtcgactggcatagtttcttgatgatttctgggtaccaaggctcagctcagcactcctggcatgcatgctataaccctggggtgttaggactaggcacatgactttgttctctgtctcctcgaggttaagcacccattgcactggtggggccaaggtgttcccggtctgctgggcaacaacactctgatggtggggccggcaaaagtgcttggttggggtggtgacagtagggtggtaaggcctgcatatacattggaaaagccgtcgggggaggctgtgggtgacggtgtcctggcaaaacagtgcggggaagctgtgcgtgggtggatgctggtggaggcccatgtgcaggtgctctctggtggttacctggggcttgccagcaaaggagctatagtggtggctgtcgggaagtgctgcggttgggcatcagcgtccattgcaattggatgtggccaggcagggactgtggaacaggcaaccagggatgggggttggggggggcgctcaaatctgacaagccctgtgccatgggcaagatagttctgttctgtctaggtccaatagtcagcaaagaccaaagctacctagaggtgtgtggtgagctttgggagatggacatacctggccatgctccactgcagccattcccacaccaggccttctgggctccgtgcagactggagtcctgtttctgccaacttcccaagcagctgtctttgcaacctcaaatgtctgtaggggtcatggagcctccttcagctaggattctagaggtccatgacaagaacaggctactccatgcctgtttaactcatcctttccccaggagcatttggggtcagaatgagtcatggtgctaggggagctccctgtaaggttcccagctttctcctccttcagcccaggatccgcatcctccttctgttcactctcagtgccttccttccaaagatctgctcagagtgtgctggtcttcttgatggcctggtctcttggtggtggaagctcttcctgactctgtgtctacttggccaccctgactcctctctgttgtctgttcactgtatatagtgtcatgtgaggaataaaagttttaacatttgacgaagtccaattcacctattttttttcttttgttgcctatgcttttggtgttatatccaagaaatcattgcaaaatgcagtgtcacagaactttctccctatgctttattctaagttttatagttttcagttttacatttagctcttggatccattttgagttaatttttgaatatggtataagcctgtcacacaggctggagtgcagtggcgcaatctcggctcactggaaactccgcttcccgggttcacgccattctgctgcctcagcctcccgagtagctggtactgcaggtgcccgccacaacacctggctaatttttttgtatttttagtagagaccgagtttcaccatgttagccaggatggtctccatctcctgacctcgtgatctgcctgcttcggcctcccaaagtgctgggattacaggcgtgagccaccttgcccaacctattgatctttttagaaaactaacagtcggtgtcccggtgcagtggctcacgcctgtaatcccagcgttctgggaggctgaggcgggtggatcacttgaggtcagcagttcgagaccagcttggccaacatgacaaaaccccgtctctactaaaaatacaaaaattagctgggcatggtggtgggcccctgtaatcccagctactcaggaggctgaggcaggagaatcacttgatcccaggaggcggaggttgcagtgagctgagatcgtgccactgcgctccagcctgggcgacacagcgagactccgtctcaaaaaagaaaaaaaaagaaaacgaatgctttatttttatttttattttttttccattctctttcacttatctttgctctgatctttattattttctcccttctgctaggtttgcattttgttttgtttttttccctatttccttaaggaataaatttaggtggtgatttgggatgtttcttctttttaaacataaacagttacagctttatgttccttctagcgctgcttttgctgtatcatactaattatgatggtacagtctttttattttcatctcgatattttctaatttttcttggggttacctttttgacccgtttcttatttaagagtgcttaattttcatatatttgttcattgttctgtttccatctgttatttccttatttattttatttatttattgttactagaaaagataccttgcataacgtcaatcttttataattttacaattttgtttttaattgacatgtattgtgcatatttattaggtacagggtgatgtttcaatacatgtatacattgtataaaaatcaaattggtatttagaatatccatcaccttatacattcatcatttccttgtggtgaggacattcaaaatctttcttctagctatgttaaaacatgcaatacagtattgttaaccatagtcactctgctgtgcaatagaacaccagaacttattcttcccatcttactgtaactttattctcattgaccaatctttacctatttcccctctcgccagtattccccagcctctggcaaccactattctatacactacttctatgagatgtcaacttttttagatttcacacgtgaaatcatgcagtatttgtctttctgtgcctggcttatttcccttagcattatgccttccaggtgcgtctgtgttgctgcaaaggacaagattatattgttttgttttgtttttttttttaaatggggaatagtatttcactgtgtatatatataccacattttctttagcagtgcatctgtttgtagacacttgatttcatatcttggcttttgtgaaaagtgctgcaataaacataaagtccaggtttctcttcaacaaactgatttcatttctttgggatatttatacattagtgggaatgatggatcatatggtaattttatttttaaattttttgaagaacttccatagtgtgttttataatggctgtactaatttatactcccaaaaacagtgtgtaagagtttccctttctccacagtcacaccagcatttatttttttgtctttttgatgatagccagtctaataggttgaggtaatatcttcttgtggttttgatttttatttatctgatgatgggtgatgctgagccttttctcatatatatacctgttgaccatttgtatgttttcttttctctttacaaaaattttgacacttgttttatgacctcacatatatcctggagaatgtcccatgtgcacctgagaaaaatgtgtattctgctgttggtgggtggagtgttctgtatgtgtcttttggtccagttggtcaatagtattaagtcctatatttccttattaatcttctgtgtggttgttctgtccattactgaaagtggggtattgaagccttctactgctaatgtagtgctatctgtttctctcctcaattctgtcagtgtttgcttcatatgttttgctggtctcatgtttggtgcatacatgtttataattgttacatctttttagtgaagtgtcggttttatcattatataatgcccttctttgttttttgtaacagattttgacttaaagtttatatgtctaatattagtataggttgaatatgccttatctgaaatgcttggaatcagaagtgatatggattttggattttttttttcttcagattttagaatacgtacatatacataatgagatatcttggagatgagacccaagtctaacacaaaattcatttatgtttcaaatataccttgtacacatagcccaaagataattttatacaatattttaaataattttctgcatgaaacaaagcttgtgtaccttcaaccatcagaaaggaaaggcgtcactgtctcagctgcccatgtggacaatctgtggttgtttggcatcatcgttattcttgactgaatttatatgctgatcagcaataattttctcacatttattcacacgtaagttgttaacagtaagacatatgaggtaccattaattcagtgaaaatacagtgtgttcagggtgagtaagcagcacagtagcatcactgggaatatatgtatccactgttaaacagcagcagcaacaaacagtggcaggcaggctctcagtctccacctacaatgctgtgttttgattaaaaggtaactgtagaatgtactgtatttatttattttttttttcaagtgagaagaaacattagaagcagttgaggggcccggaattggatcctcaggggatgaggaggcattttgctagatggcttttaaaaatgtttcctccagaaccatctgcctcactaactcttttttgtctgagaagtctctgattttataaactgtcataatttattgttctgttatgaatgcctgctgctccagtcctttaataagcccatcacacattttcaccatgtaccatgtggtctataggtacctttttgcattggtaacatcatcatctttatcttcatcatccacttgtggtattatgtctgcactcagaaagtttccgattttggagttttggattagtgatgcccaggtatctttgctcttttggttatttttgcatgggcttacttttttttaaatctttttgcttttgacctatgagtgtccttagagccaaagtgagtttcttgtagaccacgtacttttattttttttgtctctctctctttctctctatttatttattttgagatggagtctcactctgttgcccaggctggagtgcagtggcgtgatgtcggctcactgcaacctccgcctcctgggttcaagcaattctcctgccttagtctcccaagtagctgggattacaggcatgcaccatcacgaccggctaattttgtacttttagtagagatgggatttcaccattttggtcaggctggtctcgaactgctgacttcaggtgatccacctgcctcagcctctcgaagtgccaggattacaggcgtgaaccaccgctcccggctgggatcctgtttattttaatccattctgccaatctgtctttttgtaggagagttaagccatttatatttgaagtagttacagatagggaaggacttaatattgccattttgctaattactttctatgtgtcttacagcatttcttctttctgttttaccccttagtgcctttcctttggtttagttaattttttatagcaactttgattcattttgtgtttaattaactaataacataattaatattaacatcaagatagcaatgaggtctcgctgtgttgcccaggctggacttctaggcttgtgtgatcctcccacctcagcctcctcaagtagctgggactacgggtgcctgccaccatgcctggatgacttttgtgtatgttctaaaggtattttctttgtggttacgatggggttacatgtaacatcctaatgttatagcagtgtattttaaactttcattaatcccattacctgtatgttacagcttttgcaattgtcctatagttcttagacattctgttctattatttttctcattttctttttttattggctttgaattgggaagtttttatttacgtatcttggggcttactgattttgcattaaataattttttctcaatggtttattgcaagtatatttaaatgtagtttactttttgcatgttgatcttgtatcatgctactttgttagactcatttgtataattctgattaaaatgtttgtatatattaacattgagctacaattgcagaggtcaaaagatacaattagtgaagatttggtcaagcatactctgttagactatgtagaagaatgaaggtgagataataagattataggcagattatattatctgttatgcacattatttatatatttttcctgattatgacaggaatgaagcatacatattaactttttaaaatgaaaaatatttgattgtttgaatcttttttttaatcttttttaggagctgtggccctcaagaatcttcaaattaaagaaaatgccctggtaggttttgactatgaaaaatttgtaaagttattgcatttaattatgtataattcttcctgattcagtttgtcaccttaaattatttaaatttgagaaagttttttgtaaataatttttgcaaaatgtaaattttgctaaatggagttttaatctccctgaaagcacaaatggacagtgtgattttttttctatttaaaaatacatattgttttaggctgggcatggtggctcatgcctgtaatcccagcactttgggaggtcaaggcaggtggattatttgaggtcagtagttcgagactagcctggccaacatggtgaaaccccatctctactaaaaatgcaaaaagcttcgccaggcatggtggtggacgccagtaatcccagctgccagggaggatgaggcaggagaatcgcttgaacccaggaggtggaggctgtagtaaatggagatcgtgctactgcactccagcctgggtgacagagtgagactctgtctcaaaacaaaacaaaacaaaaacaaacatacaaaaaatacagatgtttttatttcaaatttttaacttgttttctgattttttttttaagacaggctcatgctgtgtcaccccaggctgcagtgcagtggtgtgatcatagcttactgtaggcctcagctcctaggctcaagctgtcttcccctttcagcctcctgagcagctgaaaagtttttaatctgataaagactagttcatttttttaattgcttgtgcttttattgtcatattcaagaagtctttaccgaatctaatgtcgtgaagattttcccttatgttttcttctaagagttgtatagttttagctcttaggtttagatcttagatccattttgaggtaatttttgtatatggtataggataagggttcagtttcatgtttttgcgagtggatatctagttttcctagcaccatttatttaaaaggctattctttgaatggggagaacgttttgaaagtttattttttacaaaacgcgtattttgcaaaatagagttttaatctccctaaaagcataaaatgacattgtaattgccacttctttttcttaaaataatataaaattggtaatgatttgatatgagtagattttctggtcatttttactgtagacctttatccccaattattattaaaagagcagcttccctggattttatggatttgatagtaatattgcagttatatgtttatatatttaaataaatgttgatgataaggaaatgtgtaagtttattaaaaaatcccttgaaataatttttggaagtaaagagtattcatttatgttgttaaactctatatctactaatgttttgtgtatatataaattttttctgtagagtcaactggatgtaccatttaaagttaaagttggtcacataggtaagccatattcattattgggatatcctccttcctggacatgcagccagaataatttgcctaatatatctattatgtgatatttttcatgtttctgagcatcaattaaaaataatcatgtgtttttgtctcagtagagctttgttgtgcaacttaaaaatattgtccgatacatatatcccttgcctagtatttgatatcctaatacattacatatctctttaggtggtaaattgagttaattcaaaggattacctctaagggagagcttaactgtttcagtttcctaggtttctgtctagttaccactgctatattttgattaacattggatatattgtgtaaagaataggttctgcatcatccaggccctgtgactaggggccgatttgaaaactaatttctgctctgcaagtttttgtatggtttcagaaaatactgtgctttttcttgtttggtattatttttaccagtgtttactgtttatatcttaaatatattggttgagcagtaaatgattggaatttgaggttttaacatctttaataaaaacttatctgtcatgtttcttgtgttacagttttactggtttaaatattgtgcaagataatagtgtctttagttgggacttggagatatttttgttatatagatagttttgtggtaggatgtatacattgttattgaagctatactgttgtcacttggggaacaaagtattctgaaaggttacctagattacatgataaaggtcttcataattatgtgtacttatggttggtattagaccacataccatagaaaactttcatcatcatatgttactgacagtagaattctatcctccccactcctaccttttaaagactgtttactgtaagagggggagaatgtcacccatttttatctacctaacattttaattttttcatatttctgattatttacatgtgtacattttaaatacttacaagtttatatgtattgaaatacttgtaattatgctatttttacagttttatattttttcattagcgtataaaaaggatttctcataatctgagttgatttgatctcatttattctgtaccataataatccagtgaatgcatatttggatattgtagaataattttatttttccattggtacagaagtattacaatacatatttttatataacttttaaacttttaccaaaggtcattgaattttacagtgatgattgtcgtatttcagtgtatgtaaatttaacctcaattcaagaacagtcaaaaaatatatcaggagagtagatagactattttctttagaatctgcccgccttctcttttcttgcctaatcttgtttaaaaatgataaggtaatttttagtgataatataagatagtagaaagtacactgaactaaacccaagataattttgagagtcatttaaggtgttgtgtacctctgtcgtagcacctgtcttttaaaaatatcactgttttttcccccttctagtagacatcgagtttcttgagaagaagtgggtttaatttttaatgtatcctcaccacttagcacattacttggtatatatagtaggggcacaatttattgtatgaaagtaatacatgtttccaaatgaatgatacagtagtacaatcagttttataggaatgtatgtccccttgctattattgggtattgatctttcaaaatttccctcgtttagaatgcagaattatagatatatcaaatataaatacacatgtacatattataaaagaggttgtcttctgtggaaggtttttggaattacatctgtgtatttttttgaaatttgccaaattttctactaggagtctacattttataagggaaggaagaaaaggtttgtttgtttgtttggtttttgagacagcatcttgctctgttgcccaggctggagtacagtggtgcgatcttggctcattgcaacctatgccttcctggctcaagtaaccctcccacctcagtccccgagtagctgggactacaggtgtacgccgccatgcctggctaatttttgtagtttttgtagagacagggttttgccatgttgcccaggcttgtcttgaactcctggactcaagggatcctcctaccacagccacccaaaatgctggggttacagatgtgagccactgcgcctggtcaagtttggattttttaaaaaaacatttgtggtgaaaatggcacactgttaatatgtgtttattatttttacagttttgtaattgctctttgtccttttgttcatttactttttttgaagtattactgtatgtattttaagcagtctgttggtacatttataaataaattaaccgtgtcaaatttgttacagttttttcacaatcttattatttcattttggttatatttttggtctgtacagaaatttgaaatgatccccatgttctctggtttaaaaacttagaaagttattcctcttttagaaatcagatagtttagaggccgggcagggtagctgatacctgtaatcccggtactttgggaggcagaggcaagaggattgcttgaggccaggagtttgagaccagcctgggcaaaatagtgagactgtgactctacaaaaaatataaaaaagaaatcagatagttcatttttctctgaagtgatattatatgatgaaatctttttctcagtttgaagttttctacacatggagtttataaaatatcatgagatggatctaagtggatttaaaaaaatttcccaatcactaaccagttttagcaacatagtatatttaataatctattccttacacaattatggcagctgtataaatctagacactcataccatttaaacaattctaaaatattttaaaactctctattacgaaaatattctcaagatacaaaactagagtgagtagtataagaaaccccatacatagtgtttttgtagttcaagaacccttacgcttaaaaaaaaaattctttgctgtttgattttcttaggatgttttcattagtttgcataattttcaaatattacccagaatattttattattactttatgtgtagttttcatatatatagtttatatgtatgattattaccatatgtgtatatgtgaattactatacatacatacatacgtatgtaacacacatatacataatgaaaaatatacatacacacacttatttaaagtatacaatctacctttcattgcggggaggtaaaggtctcactctgtcacccaggctggagggcagtagcatgatcatggctcactgtagtcctgacctcctgggctcaagatcctcccacctcagcctcccaggtagctgggactacaggcacatactgtcacgcctggctaatttttttagtttttattcatagagacagggttttgccatgttgcctaggctggtcttgaactcctgggttcaagcgatccacctgccttagcttcccaaagtgctaggattccaggtgttagccactgcgcctggcctaatctaccatcttaaagcattaaaaaatataggtttagagtaagaactggggaaattcaaagttatgatattaaggattgttgattaagggaagaagaacattgttttgtttatggtacagagaactgtaaatagaaacttgtatatttcgaatataatctaggttttccaacagtactgatataaatacaataatttcaaatcattacaacaaacacttgttgtttgtagttgtaaaatagctttcaataaagtgattaaacgcttaaggacaaaggccactttattatctcttcaatgcctgacagaaaatagactaaccataaatgcaggttgaaggagtaatattttttgtcctttttttttttcccaaaaaaatgtaggtaatcttaaacttataattccatggaaaaacctttatactcaacctgttgaagccgtattggaagaaatttatttacttatagtgccttcttctagtaagttaaatttaaaaaaattataatttaagttattcttttttatggatggaaaaatatttatattcaaaatacttttggaatttttttgagattttaatatttaaatttgatatttgttaattcaaattaaattggtttttactctacatttttggcaactttgaattatttattatttatttattattatttttttttaagatggagtctcgcactgtcacctgggctggagtgcagtggcaccatctcagctcactgcaacctctgcctcctgggttcaagcgattctcctgcctcagcctcctgagtagctgggattataggcgcctgccaccacgcccagctagcttttgtatctttagtagagatggggtttcaccgtgttggccaggctggtttcgaactcctgacctcatgattcgcccagcttggcctcccaaagtgctgggattacaggcatgagccaccgcgcccggccaattaatgattatttgtaaggatttttttggaatgactatatttaaatttaaggtagttatgattcttcctttttaatcttcctataggaataaaatatgatcctttaaaagaagagaaacaactcatggaagcaaagcaacaggaactgaaaagaatagaagaagcaaaacaaaaagtagttgatcaaggtaaagaaaacagtaaataacaatgctaataagagaagtagaaaagacctaaatatttatcataattgaatattatttttctctggagatgctgagattatttcagaaatatgatagaatctcattgcatggggaattttaatgtggtttgtatgctttgttatgtgtacaggaattttaccttatggaaatttatcttaaggcaaataatatgtctagcttattattattattaggtttacatattttttatatatatatatatacacacacacacatatacatactaggtaaggtcagtttttaatgatagcaattaattttatcaagcatattttcttaattttctagcctttgcttttgtattccttttatatcaattcttcacccttttggagatacttagtttcttgacatatttctatttgcctctatctgtttatttaccctctggcttcacatattttccaattaaacttagacaatatgttccattactgcaacctctttttcattattggaagcggtgtcctgaagaaatctaattccttttcacctgttctctgatccttactgccagctactttttaaactctcacctagtgggttttttgccttggcatgtaaatacgctgttctttatcttgaaacatgaagtcattttcttaacctagtcatctgtttatgttcttctcctctgtcattcatttaatagttaaacatcttaaaattaaaaagtttactgacttcactgtctctgaaatgcattgattttcttttaataaaaaataataagcttcaataatgttttacttgttggcaaacattaatagagatttaacatgtaattcttggcaatatctcttgtaattctgttttttctctgtaacagttactttatattatgtgtagtcatttatccttacctccagtcctctttcctaagtctcttaggccttttctttttaaaaattatttttattttatcaagataatatatatacatagctttaaaagttaagcagtattatagtgtccggattaaaaaaaaaaaccaactgttcctggcccaggcccgcacctatattactaaatatggtgctcaaacctctgtgtcttgatttatttagatattatatatatatatatatatatatatatatatatatatataaaacgtgttatatgtaacataacatgcatattatctataacataacatattttataacatataattaatgacattacatattttaaactcatctcgtgtttcattggcatatatatgacatatataatatataacgtgtaatatatatattacacacacatccttttatgatgtactatgaagattgaccctattttttcatcttctctatatagttctgtcacatttttggttaaatcagaattcattgttaatagtatcatggctatatataaatgttttatttatatataaataaagtggctttaagtatgactgtttattttgtaggcttttagttaacctccctgttctcccatgtacaaaatttggatcctattagggccattttctctaaaataaacccttgtgttctcactagggtgggaaagggatgttgcttggatattgggctgggagagaaggggacctaacttaactgctccttatacagatttaaatcagttcttgtgttatcttcctctctctccactgtgttccatgtttgctattttttgtttggtggggtttccagttcctgtgtctttccagggttctgtgacttggatttttgttgttgttgttgtttgttttaaactcatcttgtgttttgtttcattaccctgcaagatataggcattgatatgcttttcatgtaaaatggatagttggttttattcaggattggtactttattgacagtaatatgcaaaaaaagagcaaagggatttaaggtgttggtaaaataacatatcatggaatctgagctgcataaggaagtcaggaggaagtagtgggtagagaaagaaagacaacatttaatcgaatgactaaatgaatttataaaagaaaagattttattaggtagtggtgagagtcaaagattaaaatatgatcctctgtctttaaagagcttgtattctgttgtctacttaattctataatctatttatatgtatatatattcatttaactctggtgtatttgaggtacatatgattagtatcttcagctttcctttatctaaggcctcctgggccagctgaatttgagagtaataggcaattagaggaaaagatagatttatatgtattatttctatataggagtagaaatatgaaaagaggaacagaattagaaataaagaatatagctttcattggcatttttaaggggagaaaaaggataataactatgattatcaaaggcatatttcaaaaaaattaggaacctcaattctttattcttctttattcttggtttttctttttttttgagacaaagtctcactttgtctcccaggatggaatgcagtggtgtgatctcggctcactgcagcctccacctctctggttcaaacgattctcctgcctcagcctcccaagtagctgggactacaggcatggaccaccatacctgcctaatttttatatttttaatagagacggggtttcgccatagtggccaggttggtctaaaactcctgacctcagatgatctgcccaccttggcctcccagagtgctgggattacaggtgtgagccaccttgcccctccaattcttgattctttctatttctttggaaagtaatggaacttgagatagttaatgctgttttctgaacatgaaatagttgatgaacttctttcatccttgttcaaaagaagaaagaagatcttatttcctattttgtatttactgggggaggaggatattcaactgttttacacatctatacacaggcaacttaatggtggtatcactaattttgagagagatttctgctttgctgctgttagtggattttctcatttaagtctattgtaattcttacccaataatcttcatttttaaatatatttttgtactcaggcataggttaacagaaattataaaatttaatgccagtaaattctacatggtctgctttagtctcatggcacaataaactagcttttgaaaaatgtttacttgcttttgaaagacttttggaaagcaagctattagtgttctatttacatatatatgtatatttcagcaaggcaacgtaagcatgttacttcagtatgtggatatttatagagtatatttttcattcaattttaaaaaaggaatatttgcaattgtagaacaacatctgccggaaaaacaggacacttttgcagaaaaattagttacacagatcataaaaaatcttcaggtgaaaatttccagtatccatattcgttatgaagatgatgtaagtattttaatatgtgatatttgtttttatatttatatgtaagttattttactatttaatgacacctactttttaatggccaatctgttaaatcccaaaaggttacagagctaaagatgatgtgatccttcttttctataattatagttgtaatttgcagtccttagtgttgagtgcttgattttacactttcccaaaatgttcagacattagatcatgaaggaaatgccttgggaattatgaatttagcagttatgtatttttaaaatactttaaagtatgctatatttacctcctggatggagtactggtctagcaattagtggagctagccttaaataattccttgatcctgaataggtcatttgttttctcttaaccagataattatttgctttataatcctattttgttagtcttttttaataattttttttgtaaactggaaaacatgcagtataatattcctgtgtaacacgaatacattaataattagtattctaatttgttttaggaaaaatataggaatgaaagtttttctggaaagtaataaaatgtttctgaatgtttgaaataagttacttcccaaaaagttatccctccctcccttcctccccccacctccctctctctctctctctctctctctttctctttctctctttctttctcttctcctcttctctcccctcccctccccttgcctccccttcccaagacaaggcctcacactgtcgccaggctggagtgcagttgcccgatcatgactcattgcaaccttgacattccttgctcaagtgatcctcccacctcacccccacccacccaccctgcagtagctgggactacagttgcaccccaccaggcctggctaattttcttaacatttttttttgtagaggcaggatctcactgtgttacccaggctggtctccagagctcaagcagtcctcctgccttggccttccagagtgctgggattacagatgggagccgctgcacattgacagttttttctataaagtggattttatccaactactaaaaatctgaataaattttactttctttcctctttagatcacaaatcgggacaaaccgctgtcatttggtatttcccttcaaaatctgagcatgcaggtattttgtttataaaagaatcttaaccatatttaatgtgcaatatagtctattaaactgctactatttgtatatgccagcatcagaaataggtgtctatgtagaacgggtgcacaaagggtcttcattggattggaatcgagggtatgtagattcacatttcaaaaaatggttgaaaatcaaattcagaaatatgaggtcctattattattggtaattatgatgttagatgcttttgcttactttaagaaatccatttccaagtttgtaatgagtaagtaccaaatacaagtaataaatgttcatatctgaaacttcgataagccttgaaaaacaaaaatcttcagtttttctcaatatcattattaatattgtagcatagtgttttcctgtttaatttttgaaattgaggaattttaaaaatataagaacatgtagagaattttgaaacatatgcttgcctccagaatggatggctgttaaattaagagcctattaaaatagcctatttgcttaaagtcttaaatatttttataggaataagctgttttggataaagtttgaatcccttttgttttctacttccacccacccgtccttccccagagataagtatcctaaattttaaaacttttatataatatatctattaaaaatgtaggattataaaagtttacgcgttttatatgactcttttatgagttcctttttgcactttccagtgttgttgacatttatctgtgttaccacatgtaacaaaattcattcagtttaactgctgtgtatttcattgcatgattttatttgttgtatctattgggttttgtgtaagatttctttttaattttattattatttttaaattgggcagcctcccaagccagagcaggctcagagagactccacagtttctttttaaaatgtggccccactgcaacgaaaaaagaaaaaatgccctccaaaaagttactcaaatactctcattaagttgaaaaataagaatggagaattagccattggattgggcaatgtgaagatctttggtaaccgtgataacagtagttactaatcatcacctttggaaacttgtctgccagcctagacctgttcagttagaaactctaggatttggttgcagcaatctgtgttttacaaagccctctaggtcagggttcctgggccacagaacaggaggtaaggcctgggagtgagcattaccgcctgagctctgtcagatcagaggtggcattcgattctcgtaggatcctagcgaaccttattgtgaactgcgcatctcagggatctaggttgtgcccctgatggaaaagttatctcctatgaaactggtcgttggtgccaaaaaggttggggaccactgctctaggtgatcctaatgcatgctaaactttgagagctactattctaattatccattcagttcgtctccacatagaaacgaaaaccatctttctgaaataaagatctgatcactttattcctctcagtggcttttcattgctcttagttttatccttaaacaacttataaaccctttttaaaccgaccccaggcaatatacctggttttactttttttctctgtctgttttgcattatattctcctgcatactgagctacttcagttgcctgaatgtgccatatatttgtgtacttttgggctctgcctgttgtgaatcatattccctgtcgaccttagaatcaataatttttagttacatgttatatattaggttatatataacatctctttatccatcacacccctgaattggatgctcctgccatgccctctcaatgaaatgagagggcattttttttgtagagacaaggtctcactttttgttgcccaaatttgtctcaaactcctggcctcaagcaatcctcccaactcagccttccaaagtgttgggattacaggtgtgagccactgcacccaatgatacctgcaaatctaaatagctcctagaacattcttttataagttaaatgagttatgagttttagaagttaaatgagtatttaacttctgctgtggcacttacctgttggaagttgcctgtttctttgtttgcttttctgacccgcaatgagctccttccttgaaagcagacactttactgtggtcagttagtattttttgatggagtgatatgtctttaaaggcattttcatgaaagggacattggtctagggtatggtagataatgatttattactctgctgtttcaaatggaatgacctttttactgccattgttttttttccttttcagacaactgatcaatactgggttccatgtttacatgatgaaactgagaaactggttcgtaaggtaaataaatactgtgtttgtcaactcatggacttaagagaattttggaaagccaaatgataatatatagataaggatgtatgtgaattttgcttatttgtttaactctgtgatatggctcacttaattatttgagacttctgaaaatagtgtatgataaaaattcttcaaagaaaatgagacatctaataaattttattttcagttaatccgattggataacctgtttgcctattggaatgtgaagtctcagatgttttatcttagtgattatgataactccttggtaagtaaattttttctgtatgtatttgttggtatcatattttgcatgaggtttaattcattgtcatttatctaatatactgtagtcagtattttttcctaggcacaatctattagcagaatttacagatacaggtgaagatgtgtgtaactatacacaaacatgaatacatacccccatatctttttttttttttttttgagacaaggtcttgctctgttgcccaggctgaaatgcagtggcacgattatagctcactgcagcttctaactcttgggctcaagcaatcatccttcctgcctcagcctcttgagtagcgaggactataggcacacgccaccatgcccagctaatttttaaatttttttgtagagacaaggtctcactttttgttgcccaaatttgtctcaaactcctggcctcaagcaatcctcccaactcagccttccaaagtgttgggattacaggtgtgagccactgcacccaatgatacctgcaaatctaaatagctcctagaacattcttttataagattagtttggtgagatgttgtttaactactttaatattttgccatagctaagttctaagtttgaattggtttttaaaattgcttttaaacatttttcttttgcagataataggattttttaggataaagacatattggcatgaatatggctaggcgtggtggctcacacctgtaatcccagcactttgggaggccgaggcgggtggatcacttgaggtcaagagttcaagaccagcatagccaacatgttaaaaccctgtctctactaaaaatacaaaaattagccaggcacggtggggcacgtctgtaatcccagccactcgggaggctgaggcaggagaatcgcatgagtccatgagacaggggttgcagtgagctgagattgcaccactgccctccagcctgggtgacagggggagactccatctcaaaaaaagacatattggcatgaatataaataaaagcaatttgtcttttaataggacgacttgaagaatggcattgtcaatgaaaatattgttccagaaggttatgattttggtaagtacattttataagataaaaaaagtagttaaagtaattggtataaattttaaattagcattgttgctatcactgtgctagttcctgttaaatttccttctatatagttaaatgtatttataatgtatatacaaaagcaaataatattatattttttagtaacgtattttattgttatgaagcttttgactatatttcaaaactataggggaaaatgtccaacaaaagatgttaataaattatgataaacctctaaggattattcagtaacaattagggtaatatttatgaagacatttcaaaatggcaagtaaaatttaataaggctagctagtacagcctttttcgaaatagtaagatcacgctgcatttaaaatttttttaatttatacttttctatgttttcctaattttccaaaatgagcatccattacttttacaatcggaaatgaattactaaaacagaaagaaaaaaatcagtgctgtttctcagtttcccaagtagctgggactatgggcacacactgccacacctggctaatctctttcgtattttagtagagacggggtttcaccatgttgcccaggctggtctccaactcctgagttcaggcaatctgcccgcctcggccttccaaaatgctaggattacaggcatgagccacctgggaacctgggaggtagaggttgcaatgagccaagatcacgccactgcactccagcctgggtgacagagtgagactccgtctctacaaaaacaaacaaaaaaaagtgctgttttttctatgataagggcacttaataaaagttggtgatggataacttaattattgaatttgcatgcctgatgtcattaaccatagaatatccttcctgaaagtatttcctttcttggctcagtgatacttttctgtctatattatacaccttcatgactactcaagtgattcttctttttgtgcccactcttaaaataattatttttattggtttgaatttagtttcattttcttgattctcttctcataggaaatattcagaacagatgagttatctgtcatatgtgtttatgattttcaaatccataatcgtaaattcgacttatttctcctttgccctgaagtcatttttgttgtatcagagttcagtgaggagagagaaagtactgagtaatttgaagaggacaaatttaatataaagaattaccaactataagaggagactggagtaacaagggactgtctcataaaaatgctaaagatatagacagaagaaacatcccctaccctagggctaagacggggtgcccaaaagagagggtccccctccttcaggactgagttgtagaccttgttggaggacatagcgtggcttattgaatggcaggaaattatctgtggtgctgtgccagcaaaacctgttggtacttcactctctggaactttctggaaattacttttagggagcctcatggaggggtgtctctctgaatgcactccagtacaaaactgccttagcaaggtgctgggggaagttgctggcatctggctgcatctagctgccatgtactgcataaggccggtgctgaagaactccgtgctggaggaaccagacactgcagaagctaccggttctgtaggagctgggtgtgggagaagccgtgttcttgcaggagtctattgaatgaacatactggaaccaggcagcataactctttcctcctgcagtgtctctccagtgtcctctactgataaagcttaacattacgccagctggaaaaagaaaaaaaaattttttttctctacattctctgccttcaaaggaaacatatttaaagatccccaaatcatttttcagagcaggctatgaaggagaagtttggagctcagaagtaaaaaattgataactggcatacctgttggagagcgaagggggaatgaagggtttctttttgtttgtgtttatatttaatcagggagatgacagcttgtttttaggctgagatgggaatgatccagtagaacatgacaaattgacgatgcaggagaaacgggggacagtttctggattgatgtaggtgaaagagaatggtgtctagtacgcaagtgaagagctttgctgcatataggagcatagttaatttatatgatagagtttagttgtgagagaagtccttatactgagtagatgagtagatatggtgataagagttgatgtaaattctcttctgagctcttcaattaaaaaatatgtatctgaggtatgttagggttctctagagggacagaactaataggacaggtgtatatttaaagatgagtttattaaggagtattgactcacatgatcacaaggtgagatcccttaaataggccatctgcaagctgaggagcaaggaagccagtctgagtcccaaagctgaagaatttggagtttgagaagaagaatttgaatgtttgagggcaggaagcatccagcacaggagaaagatgtaggctcagaggctaagccactctggtctttccatgttcatctgcctgcttttattctggccatgctggcagctgattagattgtgcccacccagattgagggtgggtctgcccttcccagtccactgactcaaatgttaatcttctttggcaacaccatcagacacacccaggaacagaagttgcatctttcaatacaattgagttgacagtcaatattaaccattacatgagatgttggaggtttttggagggaaaagagggtatgaaataggaatgctaggggagtgagagagtgaaatgacgagggcagtattctcaaagtatggttcaaactagcaacatcatttagaaatgcagatttctagggcctttcccagacctcctgaataagaacctctggaggtgaagctcagcatttgatgtttttgtatttaattttttatttgtataaaattgtggagtacaatccttacatggatatattgcatagtagtgaagtctaggctttcagtgtttccatcacctgaataatgtacattgtccccattaagtaatttcttatcatccacccctctcccatttctctacctttctgagtctccagtgactgtcattccatgctctatgtccatatatacacattatttagctcccacttacaagtgagaacatgcagtatttgttgttctgtttctgcattgtttcacttaagataatggcctccagttccatccatgttgctgcaaaaaatgtgattttcttctttttttggctgaaaagtattccatgatgttcatgtaccacattgtccggttacctgttgatggacactttggttgataccatatctttgctattgtgaatagtgctgtggtaaacatacaagcgctttttttttcttttttttttttggatagaatggtttcttttctttcgggtagatacccagtaatggaattgctggattgaatagtagttctgtttttagttctttgtgaagtatccatactgttttccacagaggttgtactgatttacattcccaccaacagtaatcccttttctccacatcctcaccaacatgtgtcattttttgtctttttaataaaaaagacattatagttttaattttcatttctcggatgatgagtgatgttgagcagtttttcatacacatgttggccatttgcatatcttcttttgaaaaatatttatgttctttgcccacttttttttttttttttttggagacagagtcttgctctgtctcccgggctggagtgcagtggcgcaatcttggctcactgtaagctccacctcacgggttcatgccattctcctgtctcagactcccgagtagctgggactacaggcacctgccaccatgcccagctaattttttgtactttaaatacagatggggtttcactgtgttagccaggatggtctcaatcttctgacctcatgatctgcctgcctcggcctcccaaagtgctgggattacaggcgtgagccactgcacccagccctttgcccactttttaatggagttgagttttttgttgttgctgtttgagtttcttgtaaactctggatattagtcccctgtatgattgatggatagtttgcagatattttctcccattctacagtttgatattttaataatctctccaggtgattctaatgaatactaaagtttgagaaccactcagatagactagggttcaataaggttctcatactttgagaacattgccttttttttttttttttggaaagggacatgtagtaagttaaatattttacattttgcaggccatatacagttcctgacacattcctctttgtttcttttaaacaactctaaaagtgtatgaatcatctttggctcactggctatacaaaaataggctgtagcatggatttggatgattcctggactgaaggactgttgtgtaattgctcagcagcattaaggatgcacttgagatttatgacactaaagtgagacccagcagtatgtttttacccccggccgtgttcagctccttaggggcactgtggagttaagttggttactccacactgacgaagtgagaagttaaggagtctatgcaaaggaatgattaaaataactgatggtggaacttcagtaaggtggggatggactgaggatgtgaagcagaggtgaagggcagagaaaggttggaggatcagtgaattgtaggtccagggtagcttctgtcaccagccactaaatttatttatttcttctgcttttttttttcaatgtaagaagaaatacagaagaaagaacaagatctttaagcatttatttatattcaaatgaacatattcttgaatgtttaatgtttaagaaattaaatgttagtccatatcaatgattaaaataaaaggaatatatcatctttatatacagattagcttataatttaatgatggatctttgtctagattctgctattactggtcttcctctgaattgttcttattctttttggcaccaaacacaaagagttgagaggaatttatcttagattatgggttcagccaagcaggtaatccagagcaaactttcactcttcatctctctccttttaccaattaaaaggaagaacacagatggatctagagaaattgatcagaaattcagaaattataattatataatggaaaccagtgttaatcctcttagcatttctaatgttcattcattctgtaaaactgtgtacttgtattaaaactatttttttgattttttttttcttaaaatgtttctgcttttaagtatcatattggtattttgagggggagttcaatttgcctttattgtatttatggaagacagtgaattttaagtaggaaaaagataaagaatcttctccacacatggttcatctgactgaaccatggcagtgtgaacatctgggaactgtagaaggggtataaaataaatggaaatcagtgttttcaacttcatcactttattgccttgagactttggaaatataactcagttttttttccatttttattatttttcagtatttcgtcccatatctgctaatgccaaacttgtgatgaatcgccgatctgattttgacttttctgcccccaaaataaacttggaaattgagttacataacatagcaattgaatttaataaaccacaggtgattttctttaatataattttcaattgtgaattattgtttgataaaagcaaaactaagattttaaatgtttcactaaaattcatgatgttatatggtagcatttccctaaaaagtcagtaatgtaacttttatcttcagcaattgaacaaaaaaatgtgatacatttaagagctttaattttccattctttagtatttcagtattatggagcttcttgaatcagttgatatgatggcacaaaatctgccatataggaagttcaaacctgatgtgcctcttcaccaccatgccagagaatggtaaatgccttgatttttttttttttttagattttaaaaatacaacataaaaataaatttctcgacttcaagaataatctttaagatataccatttttaaggtctgatacaaaccataattgatttatagctagaaatatatgtagctgctttagcttattgagttaatgaaactgatttaagggattcttgctaacacagtttacaactcgagatgctcgaataccatagttttcatttactatggacgggtcagtatatttagaattattacaaaaacaaatcctggtttgttttcttgcattgtctctccccaacccccacctcagcttccctatcagatacactgaaccaatattattaaacctgtattttaaaagctaaaaatgttacggagtctatgcaggataatcccattttaaaactcaaaagtcttgttattccagtttttaagctattccctagtttctagaagttacaattactctttcagttgactatttcagttattattcagatgactaaatgttatttgccaattaatgccttaacagttcttgtgtagaactatatttaacaaaatggagtgattttgcttattttcacttaagaaagaggaaagattaatattgaatggattattaatgcaaatggagttgggtaaaaaggaagtactcagataatatatcattttcctaatctttgtattatagttatgtatgttgttagagtagaagcaatgtcagtaatgtttcatactgttgatttgagggtgttaaatgtttttctttttttaactaggtgggcttatgctatacatggcgttcttgaagtaaatgtttgccccaggttatggatgtggtcatggaagcatattagaaaacataggcaaaaagtgaagcaatataaagaactgtataaaaaaaagttaacaagtaagaagccacctggtgaacttctcgtgtctttggaggttagcatttaaaatgaaattgttgagtgttttatactacatagctccttattggtcttcagtgactgatactccctacctttcattccaatttttattgaccttttcatctcttttacttagacttttttgtgcttctgttcttaacttcagctgaataatacaagatttgttgaaattctccagtgagcttttgaaattcgagattattctcaatcggaaggaatttgggttcatgcaaatagtatgattatgtcatttttaacctcaaaagtctaaatagtgtttgctacattgattccaacttctctgtgttggtttcaaagccttttatgtgtcaccactacattttccctatgttacaatctgaccatgcactaatttaatgtttcctgtactctgtatatttaatgctcattcttttagccacgcctatgctcataaatgctacctgcctttatctctctacctactcaattctactcatccctgaagttctacttaagtcttagtgcttgcatgaatgtctctgaattttctgcttatacagagccctttttctcttaatttttgtggtatctctagtctctaccagtagttttacatttaattatctatcttgagatattatttttgtattaatcttgtcttttagcattatgacatatttcaagagggactcttttacaaattgatgaactatagcttagagagattaaggggagttagtctcttgaagttaatgtaaacattctgaatccagaatgaatttctaatttatagattagattgacttttacttttattttcaatgtgggagactttctgaagacctagggctgttaggaatgcctgggcttagagtctttgggggatgggttcaggttgtcttagtcttgaatcataacctgagtcctccaagtctggataggagaaccctgaataagttattctgaaataataatgggttgtagttacttctcttgggggaaacatagtttgatcatgaaattctcaaaagtaattatgggtatgtcaagatagctgtgatgaaagatttagctaatctcagcttatttcaatagctatgacaactatgaaaagtgttaagtattaaaaacaagttttaagtgtatctgggtctacttgaaatacaggcatacttcactttattgtgctttgcagacattgtgttttttacaaattgaaggtttgtggcaacactgtgtctagcaaatctgtcggcaccatttttccaatagcatttattcctgtctatgtgtcacattttggtaattcccacaatatttgaaactgtttcattattattatatctgttatgatgatctatgatcagtgatctttgctgttactgttgtaactgttttggggtgccacaaactgcatccatataagacagctgttaaattaagtttagactaaagctgcctccttacatattttaagtttggccaaaaggtttctttgtacgccataaactatagcttaaatggaagtataaacagactctagtctactcttgtgccaatcaccaagttttggccaatcacatgtggccagttgttcaaaccgtgttcaaataaggtgaacactaagctataaccaaaccagctgtttctgtacctcacttccattttctctatgtcagtttcctttttctgtccataaatcttccaccgtgtggctacaccagagtctctgagcctcttctggctctggaggctgcccaatttgcaaattgttcattgcttaattaaatcttttaaatgtacttcggctgaagtttttattctaacacagcaaacttaataaatgttgtgcgtgttctgactgttctgctgactggctgttttcctgactccctctgcttgggcctccttattccatgagataaaatattgaaattaggccgattaatagccctacaaaggcctctaagtgttcaaatataaggaagaatcatacgtctctcactttaaattgaaagttggaaataattaagcttagtgagaaaggcatgttgaaagcagagataggccaaaagctaggctgcttgtgcccaatggttagctgagtcctgaaggaaattgaaagtgctattccagggaacacatgaatgataagaaagtaaaacagcctgattactgatgtggagagtgttctagtggtctagatagatgaaatcagctacagcattcctctaagccttatccagtgcaaggccctaaacatattctcttcaatactataaagactgagagaggtgaggaagctgcagaagaaaagtttgaagatagcagagattggttcttgaagtttaagggaagaagctgtctctataacaaaagtataaggcaaagaagaaagtgctgatggagaagctgcagcaagtgatcctgaagatctagctaagatcattgatgaaggtggctatactaaacagattttcagtgtagatgtaacagccttttactgagagaggatgccatctgaactctcctagctagagtgaaaaagttaatatctggcctcaaagcttcaaaggacaggctgactctcttgctagatgctgacgtagctagtgatttcaggttgaagccagtgattctttgccattctgaaactcttagggcccttaagaatatgctaactctactctggctatgctctatacacggaacagcaaagcctggatgacaacatatctgtttacaacattttaaacccaagctcagacctactgctcagtaaaaaaagatttttttcaaaatattattgctaatagacaatgcacctagtcaccaaaagctctgatagagatatacaaagagatgaatgttgttttcatgcctgctaacaccacatctgttctgccacccatggattgaagagtaattttaactttcaagtcttattatttaagaagtacattttgtaagatgatagctgccttatgaagtaggcagctatcattcctctgatggatctgggcaaagtaaattgaaaaccctctggaaaggatttgccattctatatgccattaagaatatttgtgaatcatgggtggaggtcaaaatatgaacattgacaggtgtttggaagttgattccaaccctcatggaagaccttgagaggttcaagatttcagtggagaaagtcactgcagatgtggtggaaatacgaagagaactagaagtggagcctgaacatgtgactaaattgctacaatctcatgataaaactttaaccaatgaggagctgcttcttatagaagagcaaagaaagtggtttcttgagatgaaatatactcctggtgaagatgagaacattgttgaaatgacaattagaaatttacataaaattagttgataaagcagcactgctgtttgagaggattgacttcaattttgaaggaaattctgtaagtaaaatgctatcaaacagcgttgtacgctacagataaatcagttgtgaaaagaagagtcaattgatgtggcaaacttcagttaagagattgcaatagccaccccaaccttcagcaatcaccaccctgatgagtcagcagctatcaacatcgaggcaagatcctccatcagcaaaatattacaactcgttgatggctcagatgattgttagcattttttagcaatgaagtattttaaaattaaggtatttatgttgttttcttaagacaatgccattgcacccttaatagactataatgtagtaggaacataacttttatatgcactggaaaaccaaaacatttgtctgacacttgccatactgtggtgatctggaactgaatctgcagtatctctgaggtatgcctgtatcttaatgataacatacaggctgtacacataatatgaaggatttacgattatatatctttgtatagattttttttgagacagagtcttgctttgtcactcaggttggagtgcagtggcaccatgacccctcagacttaagctgtcctctcatctcagcctcttaagtagctcggactacaggcatgtgccaccatgcctagctaatttgtatatgttttgtagaggttttgcagtgttgcccaggctggtctggaactcctgagttcaagtgattcgcctgcctcagcctcccagagtgttggggttacaggcatgagccactgtgcttggccttgtaattatatttttagttgaaaatgtaactaatatgtttacccttatctgtagtttaaacccaaataaaatcattttaaacaatgcatgtacatattttaatatgtgtttataacttgaagagtttggaactctttatgcagaatatgtattatttcatttttcaaaaaattactctctaatttactaatttccatgctgatatatgttcaagcattgcttcccagaatttaacatatgtattatattgatgaatgttctgttgtttgcttcctattatatcttttctttagtgcagccatttgatagattatgtgcttaagttaattatgtaaagttatttttgtaaagttaacacatttttgtttatatttttcaggagttggaaaaaaccttggatgtctttaatataactatagctagacagacggcagaagttgaggtaattcttggcttttcaattagtaaaaataattctgaattccatatagatatgacagatgtgatattattaatcttatactgtaacatattgtttccaaaaagtggttcaatttgctttttagtattataagaaaattatttaatattttttggcacatccatttaaatcagacagatttctatgggaaaaaatctttctaaatatttgggcttttcaaatattcagttatgaaggtaaaagccaatttattttttttcaatcatcatttcttataagatggtggaaaaactatgtggtactcctaaattcttatgttcgactaatgttgcagtttctgtgttctgttattaatgtgtatattgtttacattcattttgctcaagaggataagttctcagaatgtcttgcttatatttgtttcagttgctaaataaaggataatgtgtcatttatttgaaaatttattcattttaggtaaagaaagctggatacaaaatttacaaagaaggagtaaaagatccagaggataataaagggtggtttagctggctatggtcttggtcagaacaaaatactaatgaacagcaaccagatgttcaacctgaaagtatgtccatttcattttacagcatagttaatcactgggtgtcaaaataaagttttgccattttttgcctaattaaagtaaatagacattgaaatatatttatttaattatatataaagttattacaaataaaactattaaaacattgaaaatgtgtattagtttaaaaataaaaaataatttaaaaatcatgctagtgcttacaaaaagagctttatgcccagagatttagtgaatgcatatagcacagtaataaataaataaaaattccaaagtgttctccattgtaaatttttattgaagttgtttcttggaaagatttttgatttttaactaacagcttaagagtatagctttggaggtttagagacttaggtatatgttttagatctatcacttattagcagtgtgtctctggcaagttatttaagtgcactaaacttcagttttatcatctataacatgggaggaaattacaatgttaatactacctactttttatactaaatgtgttgattagcacagtgctattgtctaatatagttagccgtttttgagctcttgcttaatacaaatattataaattaatgttgctaaacttacatatttagcaatttatattttggataattacttgtaaaattgccagccccattcaaacattcagtgtttataatttcttaagagcgttcaagaaagtaaatttcacattctgtttattaaaggcagatacattgtgttaattttattgtttttatttaagaacataaagcacttctttctgatttgtagctcttgaagaaatgttgacacctgaagaaaaagctttactctatgaagcaattggctatagtgaaacagcagttgatccaactttactaaaaacagtaagatgttttcttgccttataccttagaatatatttatttatttatttgtttagagacagggtctcactctgttgcccaggctggactgcagtggtgtgatctctgctgccagccttaacctggcctcaagcaatcctcccacctcagcctctcgaatagctggagccacaggcatgcaccctcatgctagctaatttttgtggttttttttttgttttttttttttgatagagatggggtttcgccatgttgctcaggctggttttgaacttctgagctcaagcaatccgcctgcctcgacttcccaaagtgctgggattataggcatgaaccactgctcctgaccttatgctttggaatttaatgttacatatgtccatttttaatcctttcaaaaatatatgttactgacttgttctgtgatcttttttctgggtctgtaattgcatttattttaatttctaaggtagggataaatattgtctctttttttggggtcaatgtgatgattcttgaagaaataaaatgtccttaaaatatttggtggtttttgaaatgaatgtactataagaatatttgttatgcttatatatatatatatgttttcattttattcttctgaatataccttagtttgaagccttgaagttttttgtccacttgaaaagtatgtctattgttctaagagaaaatcatcaaaaacctgagctggtagatattgtaatagaagaatttagcaccttaattgtgcaaagaccaggagcacaagcaataaagtaagtattaatttatctttttttatcatatatgaaaaaacttcactgtgttcttagacattaggtcacaatcttagtcttttgtaaagagcactatagtttcatatatccttttgtggtttcaggaaaaaggttttttttttaattgttaagataatacatgttcaatagaaaaccacattccagtgaaacatagggcattaaagaataatacaaaaatgatcagcaactacactacacaaaaagaaacagcattaacaatgtggtttttatctgagagtttttagttttattttttttaaagtagctttgagatgtaattcacataccctacaattcatttaaagtgtgtggttcattgatttttcacaactatattatatagtaatttcacattggtatatttacgaagctgtacaaccaccagcactgtattagtccattttcatgctgttaatgaagacttacccaagactgggaagaaaaagaggtttaattggaccaacagctccacatggctggggaggcctcagaattgtcaggggaggcgaaaggcacctcttccctggtggcagcaagagaaaatgaggaagatacaaaagcggaaacccctgctaaaaaccatcagatctcatgagacttattcactaccatgagaacagtatggggaagccacccccatgattcaaattatctcccaccaggtccctcccacaacacgtgggaattatgggagtacaattcaagatgagatttgggtcgggacacagagccaaaccttatcaactactatctaattctagaactttattttattttatttattttttttgagacagggtttcactctgttgcccaggctggagtatggtggtagggtcttggctcactgcagtctctgcttcctgggctcaggctaacctccagcttcagcctcctgagtagccgtgactacaggcgcgagccaccaacaccttgctaatttttagaatttttgtagagatggggtttcaccatgttgcccaggctggtctggagcttgttggctcaaagcagttcgccagcctcagcctcccgaagtgctggaattacaggtgtgagcctggctcattcgagaatatgttaacaactcccaaagaaaccctgtaatcattagcagtcactcccaagtgcccccttacccagcccctggcaacaactaatttactttctatttgaaaggatttgtccattttggacagttcatatgaatgtagtcatacaatatctggtcttttctgtttggcatttttcacttagcatgatgttttcaaggttcatcctgttgtagcatgaattagtacattcctttttattgcctagtaatctctattatggacgcatcacgttttgtttatccatttaactgttgaggatatttaggttgttccttctttttggctcttctgagtattgcagctatgagtattcatgagtaatattttgtttggaggtgggttttaattttcttgggtagacacctggggtggaattgctgtctcatatgctaatactatttaaccttttgaggaactaccagactgtttcccaaagcagcctcaccattttacatttccatgaacagtatatgatgtttccaatttcttcatatcttcatcaacacttgttattatctgttcttttgattacagccattctagtgagtatgaaatggtatctcactgtggttttgatttgcattttcctgatggctaaggattttgagctttttttctttgtgcttattggccatttcacgtgcatatcttctttggagaaatgtctattagattttttttcctattttatgttgggttgtctttttattatcgatttgcaagagttctttatatattcttgatacaaatctcttattagataaacaattttcagttattttctctcactgtgttttctttttatttttcttaatggtgaagtcaaatttatattttttttgctacacatgcttttcattataactcagaaatctttgcctactccagtggtacaaatatatactcctatatattcttataagaattttatgctatttcctcttatatgtagggttagaatccattttgagttaatgttagtgtgtggtgtgaggtgggggattcagcttcattctttttcatgagattattcagttgtcctagcaccatttgttgaaaaaactattttttcccattgaatgatcttggcaggcttgtcaaaatttataagttgatcataaatgtaaggatttctagactcttaattctaatcccattgttctatatgtctagccttatgccagtaccctactgtcttaattatggtggctttatagtagaacttgtaatcaggaagtatgactcttccagttttgtttttttgttttagctgtcctgatttccttaaacttctgtataaattttaagattatgttgtccatttatgcaaaaaaataagctcagatttgataaagattgtgttgaattttgtggatcaattttgggtgtactgaacaaattattcagcacaaattattcagctacttatctaaacaatattaagtcttccaatccatgcacattggatatcttttcatttatttagatttttaaaatttgaacaacgttttacagttttcagatacagtacacctcttaggttaaatttatttgcaagtattttattgtttttgatgatataaatggaattgttttcttaatttcattttggattattatgtgtatagaaatacaattgagttttgtatactgcacttgtaccctgcaaccttgatgaacttgtttcattagttcaatgagtttttttagttgattccttaggattttttatatacatgatcatataatctgcaaatatagttttacttcttccattccgatgtggatgccctttcttttgttttcttgcctaattgccccggctagaacctccagtagtattttaaatagagattatgagagtgggcttctcttcttgtttctgttcttcgaaggaagtgttcatcctttcaccattatgatgttagatgtgagttaggtgtggtctgcatcattttacaatcccaccagcaatgtacgtggattcatattttttccatatcattcccaacacttgttattttgtttttttattttaaattatagccatccttatgggtgtttagtatcatattgtggttttgatttgaattcccttaatgactaatgatgttcagcatcttttcatgtggatattggccctttgtataagttcattgggtcttttttttaattgagttatttttcatttgttgttgaggtgtaagaattcttttgtattctggatactaaactgtcaccggtacatgatttgcaaatatttccttctattctttattttgtgatttcacttcattgatactgtcctttggtgtacggaagtttttaattttgaagctcacttcatccggtcttatattttgttgttcatgcttttgatgtcttatctcagaaggttcacctaagccaaggttgtgaacgtctactccagtattttcttctaagagttttatacttctgtcgcttacatatacgtttatgacctgtattgagttaatttttgtaaatggcataaggaattggtacagctcatttcatttgcatgtggatatcccggtgtcccctcacacttgttgaagacactattctttcctcaatgaacactcctggtaccattgttgaaaatcaattagccatagatgtatgtatggctttatttttggactctcaattctatctcatttttattctagactttcactgtgattatcattataccaatatcgtactgttttgattactgcagatttttagtaagttttgaaattgggaagtgtcttccctattttgttctgctctttcaagaatgttttagctgttcaagggttgcttacaagaccttatgaatttgaggattcacttttccatttctggaaagtgtctctttgaaatttgatagggattgcattcagtatgtagattgcttttggtagtattgccataataacaatattaagtcttctgtgaacatgggatatctttccatttaaataaatgctaaatagatgctttttctgtttttatgaagagtttcagaaggattgttattaatccttctttaaatattttgtagaattcactagtgaagccatttggtccttgtattagtctgttcttatgctcctaataaagagatacctgagactgggtaatttataaaggagagaggtttaattgactcatagttcggtatggctggggtggcctcacaatcatggcagaaagcaaatgaggagcaaagtcatatcttatatggaggcaggcaagagagagcttgtgcaggggagctccctttataaaaccatcagacctcatgagacttattcactatcatgagaacagcactggaaaaacctaccctcttgatccagttacctcccatcaggtctctcccacgacatgggggaattatgggagctacaattcaagatgagatttgggtggggacacagccaaaccatatcagctgaattcttctttgttgagagtttttggttactgatttactccttactagttataggttttactataagtaagtttaaaaggttatagtaagttttactatactaaagtttatagtaaagttttactgatagtttataggtttataagtaggatctgtaggttacagtaaagtttactataggtttttaaggttatagaaaagttttacttcctattagttatctgattttctatttcttctcgaggcagtttttgtaatttatatatttctaggaatttgttcatttatctattttgttggtactgttttttgcagtactcttttgtagtactttttattcctctatggtgtgtcataatgcctccactttgatttctagttatagatatttgcatctttagtgttttttttcttattttaggtaaaggtttgttaaatatgttaaccttttcaaagtggcaactttgattttttttcattctctctggtgtttttgttttctgtatttcatttgtctccactctgacatgtattattttattcatactgtgagctttgggtttaatttgctcttctctttttagttctttaaagtgtaaagtgaggttattgatttgataatctttcttttttaatgtaggcatttgcaaacaaaaatttccctgtgagaactgctttggatacatcctgtatgttttgtaatattgtgtttgattcgcatccatttcaacgtattttctgatttctcttgtggttttttttttaacctgttgcttgtttaagagtgtttaatttccacataattgtgaatttttcagtttttcttctattgagttctaatttgattccattgtggttggagaagatgcttggtgtattattaaacttgttgagatttgctttgtgacctaacatttggtctatcctggagaatgttccatgtgcttgcacttgagaagaatgtattttgctgttgttgggtagagtagtccatatttgtctgttacatgtagttggtttataatgttgtttaggttctctgttactttattgttcctctgcctaaatattcctcatttaatggaagtgggagattgaaatttctaagtgttattgtgagctatttctccctttaattctgtcaaggtgtgattcatatattttgaggactttggtgtataaatgtttataattgttgtatctttgatgaattgagccttttaatcaaactataatgaccttttcttcttgtcacagttttctattgaaagatatttaagttaattaattaattattaatttagatacagggtcttgctttgccacccaggcttgagtgcagtggtgtagttatagcctcactgcagccttgaactcctgggctcaagtgatcttcccaccacagcctcctgagtagctggaattaaaggtgtgagccaccatacctggctaaagattattttatatgttagtataaccacccagctctctcttggttatgagttgcatgcagtatattttttcatcctttcactttcaacccatatgtgtctttggatgtaaaatgagtctcttttaggcagtatgcctatggtccctgacttaggctaagtatattaaatacatttttgacttggaatattttcgatgggtttattgggaaataattagtcataagttgaggagcatctgtattgttgtatcatgtttttttcatccattctgccagtctctatctttcctttgatgagtttaatttcatttacatttaacatgtttactggtaggcaagaagttctgccattttgctatttgtttattgtatgtcttataccttctgtaccctcagttcctcagtactgtcttcttagtgtttgttaattttttgggggatatatttttatttcttcctcatttctttttccaaacatattttagtcattttgttgagggctactatatagggattacaattaacagtccaaatttaagacagtcaaatttgaattgacactaacttaactttaatagtgtataaaaactctactcttatgcagctccattcttcatctttacgttatcattttcacaaattactgctttacatacttgtgttcattagtctaggtttatatttgtttttatgtgtttgtctttaaatcatagaggaattaaaaagaggagttaaaaaccaaaaatgcaatattactggctttcttatttgcttatgtagttacaattacaacagttctttatttatttgtatggctgcaaattactatctaatatcctgtcattgcagtctttaggacttcctttaacctttcttgtagggcaggtctactaatgacagacagactcagtttttgttcatctggaaatgtgttcatttttccttcattttagaaggatagttttgtcatatatagatttcttggttgacattttttttcatttagtgctttaagtacatgatcttgctgccttttggactgcatggtttctgaggagaaattagctgttaatctattacatatcttgttatgtgatgagttgcttctctcttgctgctttcaagattttccttgttttagcttttgacagttggattataatatgttgctgtgtgagtctctgagtttatcctaattggaggtctttgagcttcttggatgtataaatttgtgttctttatcaaatttgagaagtttttggccattatttctcccagtatttttaatgtctttttctttttctcatgtccttcggagagtcccgtagtgcatatgttgttccacttgatggtctcccactttaggcactgttcattgttcttcattattctttatgctccacagactcaataatttcagttgtcctgtattcaagtttgatgattctttctttgggctgcttagatcctctgtgaaacctctctgcagatggttcccaaatcatgattgttcagcttatgatttttttgattttagaatggtgcgaaagtgatccatatttagtagaaatcttactttgagtatccatacaacctttgtttttcacttttcagtacagtactgaataaattacataagctatttaacattttattgtaaaataggccttgtgttagatgatttttcccaacgtagactaatataactattctgagtacatttagggtaggctaggctaggctatgatgcttggtaggctaggtgtgtcaaatgcattttaaacttatgacatattcaacttacaatgattttattgggacataaccccattataagtcaaggaacatctgtagtgaagttttcatattggctgttgtacttttcaccttcaaaatttctgtttggttctttttaataatttctgtcgatttatattctgtgctcaaatgttattttcctggttttctttagtctttgagtgtaagcttatttaacatgatggcttagtgaacataatgctagtcttcccttttctgtgtaagctttgtacatttttgtttaaaacttgatgttttgagtggtataatgtggtaactgtggaaattagatgtcccccctctccatggttagttgttgttgattgttgaaggatgtagttttccatttgtttacctactgtagtgggtagaattgtatcatccaaaacattgtcaatttctaattcccagtacctgcaaatatagccttatttggaaatagcctttgcagatgtaatcaagttaaaatgagttcatgctgtattagtgtttgctctaattgaatgatgtgtgctcttcaaaggaaagagaaatttgaacacagactcagaaaataagacagactagagaagacaatttgcagacagacataaagaggagaatgccatgtgacgatatcttcttagctgcgcccatattaatgtagattttctgtaacgtggtgtggggattagaggtgggaaatgatcatagctcagatgccacaggctctccctgttcttatcaagttttagtagatttttttgtttgttttgagatggaatgccactctgtcgccaggctggagtgcagtggcacaatctcagctcactccacctcctgagttccagagattctcctgcctcaggctcccgagtagctgggattacaggcatgtaccaccacacccagctaatttttgtatttttagtaaagacagagtttcaccatgttggccaggatggtctcgatctcttgacctcgtgatccgcctgcctcagcctcccaaagtgctgggattacaggcgtgagccaccgagcccagcctagatttttttgaataaaagtttttctgtttgctgtatgcccttagattgatttccagagattttataattttcaccagttctttccctgtttggtttgctggggagaagagttgctgagctcctcacatagtcattctcgaagtcctgcctcatccttggtttttaaatgtttattaaattgttttatttttttgagacagagtctcactctgtcacccaagctggagggcagtggcatgatctcggctcactgcaacctccacctccctggttcaagcgattttcctgcctcagcctcccgagtagctgggactacaggctcatgcccccacacctggctaacttttgtatttttagttgagacagggtttcaccacgttggccagtttggtctcgaactcttgacctcaagttatccacctgtcttgacctcccaaaatgctgggattacgggtgtgagccacatgtctggcctttaaatgtttatttttatttttagaagaaaacatgtttatagacttgtgttaaatatgcaaaacttttcagttttacattaagcattgtagatttactgtcattttaattttagcttatcataacttttttacatataagtcaacacaaataggattctttgtgaattaatctatgtcaatttagaggaatcattgtatgtcttctttgatgggaatggactggagtcagaaatgcaaagtgaagttgtcttcattaattttttaaatcattttcaatttttaaaatccttcacaattttactgatcgctgacttttttcttttttttttaatgcagatttgaaactaaaatagattcatttcatattactggcttaccagataattcagaaaaaccccgcctcctgtcttcattggatgatgcaatgtcacttttccaaattacatttgagataaatccattagatgaaactgtttctcagaggtgtatcatagaagctgaacctttagaaatcatatatgatgcagtaagcatttttttaaattactaagttttaatataatttagtttgctttgagtttgtgttaatgatgtttattttaacagaggacagtgaatagtatagtggaattcttcagacctccaaaagaggtacatctagcacagctcactgcagcaactttgacaaaactggaagaatttcgcagtaagacagcaacaggtaaatgccaatattaatgttggtgaattaaatactgtatcctatattaaacttttatttatggtagaatgtttttagtaaagtttattttaaatttattatatttctagactggttttagtttaacagaaactaatttagtacttttatgtttaaaggcagataaaaccataatcattttttacactcagaaagttcatacctagtaaccacatttaagttagttgcaaaattttgcttaggatacttggacctctatttatgacaaaaactggcctctcgttttcctttcttagaatgcgttccagattttgatatatcagcctcagggaaaaaagttctatccttttttattctctaggagagtttgaataaggtcgggtacgatttcttccttaaatatttggcagagcttaatggtaaaaccacttggttttggagatttctttgtgggaaagtttaagattacagattgaactttttaattaaatagttgaccatagagattatctgtatgattttaatgctttgtaattggttgggacttgttttctagctcaatgtatgatattaaaaaaaatgttcctcatatgctgaaaaggctgtcttttcatatctatacctattcattaggtatggattgttaatcctttacttcaaattttttgtatccttactggattttttttttccccttttgtcaccttgttctaacagttattaagagaaatacatgaaaaatgcctcattatcaatgtagatttttctatttctaatagatctgtcagtttgtttaaaaaaataaatttggctgggcgcggtggctcacacctttgatcccagcactttgggaagccgaggcgggtggatcacctgaggtcagagtttgagaccagcctggccaacatggcaaaatcataatagagacggggttttaatagagaccaggtttcaccagcctggcgacagagcaacaccctgccacacacaccaaaagtaataataataaaaattaaaaaaaaaataaattttaagactgtcattaagtacatgcaggagtaaattatttttcctcctataaaccacatctttaatgctttaatttttttccctttgtacttttttattttattttatttttgatctgatgtcagtatgaagtacaaagtttcttttcgttagaatttacctggtatatattttttcttatatttttactttttccctgtgttttcagatgtgtcatgtcaacaacatgtaataggattttttccaatctagatttatggtccttattttttatttatatctactttttgcatttaattaatttatttaggcttatgtctaacatcctattttgtgcttttgaatttggttttccttgttttatttttcttgccttcctttggataaattctaggatacctttcttcccccttccctacaatctactattgggaagttaaatattctctatctctttttattttataaattacagtatacatttttgtaaaaatataaatttaatgaaaaattttatattctcctagtcattatatggactttagtactcttgaactttatataccatccccatatactattttttttacttaaaaatactttattgtactgtatgtatatagttcatggtagtttacaattacttgtgcatttactaccttctttgctcttcatttctcttatagcttacactttttatttgattttattttctttctgttggaagttcattttttttttttttcaacctctgcctcctgggttcaagcgattctcctgcctcagcctcccgagtagctgggattacaggcacccaccacaacgcctggctaatttttaaaaaaatttttaatagagatggggtttcactgtgttggccaggctggtctcaaactcctgacctcagatgatctatcctcctcgacctcccaaagtgctgggattacaggtgtgagccatcggacctggcctggaagttcatttgtaaacttcccttgtaaatattttctcttgtaagaatctgctggtggcaaatctgtggtttgtttttgttatgtttttgttttttttttttttttttgacagtgtcttgttctgtcagccaggctgggggtgcggtggcataatctcggctcgctgcaacctctgcctcccaggttcaagcaatttttttgcctcagccttctgagtagcttggattacaggggtatgccaccacacccagctaatttttgtatttttactagagatggggtttcaccatgttggccaggctggtctcgaacttctgtcctcaggtgatccatctcagcctcccaaagtgctgggattacaggcatgagccaccatgcccgttgcatattagcttgacatgatactactgtatgtagaattaaaggttgatgttcattttctccttaacacattgaagagggcattctgtctttaggttttcattactgatgttgagaattcaggtgtcagtgtgtctgctgtttttttttgtacattatctacccttttcttttacatataagaactttttatcttttgtattctgttgtcgcaatttggtgtatccagctatagatttgctttatatatcctttttgggattcactggatttcatgaatctgagtactgggatttttaatgagttctagaaaatctatctggaaaattcttagccactaactctttacatatattctcttctggaattctggctaaatgaattttagcctttcttactccatcttccattctccttaacttctgtatcctgctttctttccatctgtttcttctctgtgttacatgctgggtaatttcttctaatttatcttctcatttactgagtccttctgtagccatgcccaatgtggtatcaaatctcttcattaagtttaatttcagtgattatatttttccctttaggaattctgttttgttaaatttaaaatctgtgttgtcattcttttttggttttgtatttcccacggatatctttacacttgtcttttttttttttttcagagatcataagtacagtattttatattctgtctcaccagttaattctctctcttcagatagtccgttatatgaagacttttgtggttctgtttttcctatcttctgtcttttgtttttgttggtacttacttatggtaacgtgtgtctttttatgcttggtaatttttaattgtaatctgctcattttccttagaatattatttgggagaattctctgaagcctgagataagtgggccttcatttcgggaagatttatatttcttctgccaggtaccttgggtatgttggtggcatagctaaattaattgcttaagatgttctggactgccaaagaattcttgggctacatacctccttgaggaatatatcatacttatcattcacagaggtattacctttttctcctaatttttctcacagcctttgtttgcatccccctgtgagagtgttttagggagaggaaggttttacttcacaattattctttctttgagtgagtgtcctttaagatttcagatttgtgaggagaactcttgcaagactctccatctttgtcttctgtttcctgtgttctgagaggctgaaattatctttggagtaagatccaatttcattgtcaaagttttaaaattctggttttgttaagcctgggagtacacttctaattgaactcagaatttgtcccattttggtggctataaaacctggcatgaaattatgatttttctcttgccatttttattatattcactttatccttattggtagatatgagatatactatctgtcattttcctttgttctctttcctaagataaaataatttagatgagtcaagaaatcacattttgataagaccttcaggaaatgtctaactagttgtcttttgttaggcaatattataataggcatcttgattcattattaatttttcttttttcacagaaaagtgtgtgttatattcttcaaaatatatgtgtcttctctggcttttgctcatttttctctactatttttatatctgaatagttttaaattagattgtacatgaataccttacctctagaaactgtagggtttgcatttattcctgtattctttgttaaaatctgggaattccattcctagtttacattctgtatattggtatattatatactgagtagaaaccaaagcataagatcaggctacttctagtcagtttttcttgattgatagaaactcatagttaaatacaaattaatcatattggaaatccactatagacattcagattttgagattttttatctctaagatttatttacctcaacttttattacttaaaaaaattaccaaacagtaaatatccacaatataaagttcacatgttacagaaatatgttttagaaagtggaagtcttcagtattttaccttctgtacataataacctttaaaatttgaagtctgttcttccaactttgttttcttttctataccaatagtataaaaatgctaattctatgaaaaaaaatggaaagcttctatgataggtttttgcacttaatttttaaaatttaatatattttggattttttctagaaagttaaaatttacctatttgtgaagagactcatatatattataatgattctggttacttaggttctttccttccctcatattcctcctttcttccttttattttgttacattctcctctattaacatcctggtttctttcttgtattataggttgagtatcccttagcagaaatgtttgggatcagaaatgtttcagatttcagatttcttcggatattggaatatttgcattttacttacttgttgaacatccttaattgggaaataggaaattcagagtattctaagcagcattttctgtgaatatgatctttgaggatcatgttattgtggtgctgaaaaagttttagatcctggagcgttttgattttggattttcagattagggatgctcagcttgttattttccccttcctttctaagaactcaaggtctttcaggtctttttgttgtcaactatggcatgagcttacagagcctgctcaactagttatcctttgtctctggcaggaaaacagatgtggtcgtttgctaaaactcttctttcagagtacaaggttctctgataggatcatagtgaatcattttctttcagttatttcatttatttactcatttaaatatatatcaagagcctaatctatatgtcagacactatgctaggttttagggaacatagcaatgatcagaatggatgtagttcttgcctattgatagatgttatactcttatggataggacaaatataaaactaagagcaatatactggaaatttttgattaatgctgtatgggtccaatcaggaaagaaaaaccacacagtaattttgataggtatgtttaatgtaatgaattattaactgtaatgagggactgttttgttactccaaagagtaactttaaagaatgtaacaagaggccaagcgccatggctcatagttgtaatcccagaggttttggtggccgagcggggaggaacacttgaggtcaggagttggagaccagcctggacaacatagtgagaccttgtctctacaaaaaattacaaaattagtcaggtttggtgacgtgtacctatcgtcccagctacttggcaggctgagactggaggattgcttgagcccgggaggtcagggctgcagtgagctatgatagcaactcctacattccagcctaagtgacagagtgagatgctgtctccaaaaatacatatatttaagaagagtagttatgaggaatatagaactgagacagcgttccctaggaagaggtctctctcttccctgagaattgaaatccacactttgttgggagaaggaacctctgtgagtcattgaatggtagaaaagccattcttgtgtctttctggtaatctgctctctaaaactttctggaaatccatcctctgaggtaaaaaggaaaaatattcatggggcaatgtctcactgccctcgttctgctgtgaaaccacctgaggagggttctaggggcagaatactggcttttgagtgctgttatgtgcacattatgcattgtgttggagaaaggcacagtgttacaggatattgctaaatgagtgtactggaaccaggaagccagctcttttctcctgcagtgtctctcctgtgttctttatctatttcagtgctagttggcaaaggaaaatcatttaagcaactcagatctactttcacagagcagacaagtgggtgaatttggagctgagtgaggaaacaattctataatcagcccaaatgctgtgaaagaaatgagaatggatagatgccccaatttagtcttggtggtagtgtcagagaagatctctgaaaattcaacattaagatcagatatatatgtaggatccacactgctaaagggtataagaaagagccttcaaggtgatggtccactgtgaagagcttaacttagcaaacaattgggtgaatttggaagttgtagaaagctgaattggttctaatgtaatgagtgaggggagagtggagggatgttaaagatgcatactcttgattatgcaaatatgaaagtcatattaagcagttaggattttgttgtaagtgcaatggaaaataggggagagacccaatcaacctaaggtcaaaataaaatactccccactcccttccattaaaaacaacttagagaaatcattgtgtcctggtatcaagaaaggctttgttgaaactaaggcttgtggtaggacttccagggagtaccagaacttagatttgtagaagccagaatacttgaggaatccttagactagagatggaaatgaagatagagaaatgcttaacagatagtctctggagaatcttgaatgtcagattgacccttctggatgcttcttgttactttagtaaaatcatgccatctgtgtttgaatccaaatcatttggggaaaaagaatgaataactgtttgagtcaattctgctcttaagtttcaggctaattggatggtcttcagaatttttgatgatctgtcagtctgttttcaaacctctatctcacctcaccttccatcctcattttaagagatttcacttgaatttgcttcttacaggctatgggaaatgccagggttttttcttcctctctctactagagtcttgcttgggctacctgtgcaaggccgttggaatcccttaaagatgacacagttttgataacagtttctcatatttcaaggaagagctgtcccagatgtaatttattagtgttatttttataaagactactggaggcagcgtaatttgtgaagaaaagaggtttatttgtttcatggttctacaggctgtacaagaagcatgactccagcatctgcttttggtgagggtttcagaatgcttccactcatggcagaaagagttggggagcccacatgtgcagagattacatggcaagagaaaggaaggaggtgccaggctcttttaaacaacaagctctaactaaaagagcgagaactcactcattaccatgaggacaacatcaagccatttgtgaggactctgcccccatgacccagacaggtcttattagggtcccacctccagcattaaaaatcaggtgtcagcatgagttttggagggctaaaatcccaaactgtagcacaggcttaggttatttattttctattttaatttaaatagatatttaaaacagaaggtattttaattacttttaatttattcattttctttctgttggcttgtatatcaagctgattatgtgttggcacttgacacttgctcaatgtctgcttttaagctttataattgtatatgtattttatttgtaattttaagtacattaaaattgttgacatattctttaatttgaacatgtattctttaataataaattcttaactttaaaggttatattcaaatatactgacctgcctacattttgtgtgtgtgtgtgtgtgtgaaaaaatgtgcctttttgtttgagtgtcagatctttttaaactttttaagtcaaatatctttcatttactctaactgatttgatggctgctcatataattttttctttaagaaagggttcacatctcatagaaaataatttgtttagatttaaaagctgatgctgatactggacttagggacataaaatagatgaatttggtatactaatcacatgcaagtgaatgaattaaatttattagactaaaaaactccaagtgaatgaaggacctagggaatggaaaactctggtttgttgccttttctggtttgcatatgattttattgaagatgatttgataatccaggattttttatattctcagaataatattaagatcaagtgttattgttcagtatggtaaatgtagcttatgaagtttatgaattgagaagtatctatgtagattctaagagttgttgtgagtaaatattttatgccactgaaactttttttttggtctgtatcttcccaattttacccaaattgagtttataggttaaaaattttttttggaagaatcactccaattttgtactcagctatatttaaataggagtacatgcattggcaggtattttaaattttatattggaagtattttgctgaggtcattttaaaattaatactaattttacattaagattgttttatcagttcatatatttagtgattctgtatttctcgagtaatttgtgaaaagtattcatagaaaagatttacatttttccaggtctactgtatattattgaaacacagaaagttcttgatctcaaaattaatttgaaggcttcatatattattgtcccacaagatggaatttttagtcctacatcaaatctgcttcttttggaccttggtcatctaaaggtatatactaataatatttgatttatgatacagcatttggggtgtttctttgttttaaatgtattttgttttttaaacagtttgatttattgctttttttcctagatttgtggtagataagtaagatttgagaaatctccctttctgttaaataaagtgaagtctcaattaggtagttttcctacacttatgaaagcaaaatgaccaattaaactctgcagggcaggtttgaatctaagcttgattgactgattgattgattgattgattgactgattgatttgagacagagtctcactctgtcgcccaggctggaatacagtactgcgaccttggctcactgcaacctctgcctcctaggttcaagtgattctcaggcctcagcctcctgagtatctgggattacatgtgcccgccaccacgcccacctaatttttgtatttttagtagagacggaatttcactatgttgcagactggtctcgaatgcctgtactgaagtgatccacttgcattggcttccctaagtgctgggattactggcgtgagccaccgcgcctggcccgaatctaagatttatatttgtagtatttgagagttgtgcttgagaagcttatttctttctcaatttagacctattacttgattacttaaagtatatagaatgatagagaattgtggaaacaatcaaatacgtcttcatctttctgaaattttttgtgcataaaactatatatatattgacattttaatatttgtatttaataattctaaattgagaaatggccttcttctgtttacctaagtcatttccctttttttctttcttttttttttttgagacagagtctggctctgtggcccaggctggagtgcagtggcacgatctcggctcactgcaagctccgcctcctgggttcatgccattctcctgccccagcctcccgagtagctgggactccaggcccccgccaccacgcccggctaattttttttgtgatttttagtagagactgggtttcaccatgttagccaggatggtctcgatctcctgacctagtgatctgcccacctcggcctcccaaagtgctgggattacaggcgtgagccaccatgcctgaccctttttttctaattatatacttttttctttccaaattttcagtagagaatacatttttttggcggtattctagatctgtgctcttcactatagtacccacttcccagccacatggggttatttaaattaattagaattaaaattaattcagtttcttagtcatattagccacatttaagagtttaatagtcagaagtggctagtggctactgtattttttgtttttgtttttgagacatagtctcactctattgtccaggctggagtgcggtggcgtgatttcagctcactgcaacctctgcctcccgagttcaagtgattcttctgcctcagcctcccaagtagctgggatttcaggcgtgtgccatcaagcccagacagtttttgtatttttagtagagatggggtttcaccatgctggtcaggctggtcttgagcccctgacctcaagttatctgctggcattgacctcccaaagtgttgggattacaggtgtgagccaccgcgcctggcctgtatttgacagcattgatatagaacatttccattattgtagaagttctactggacagcgttgctgtaaatcattaaatgtagaggaatatctatcacaatttaaagaaccaagagaggtggataatattagaatgctttttctggccacttaacaaaaatacgtgcctgtccttgatactgacatcttcccttatcctatttttaaaaattctgcatttgttaattgtgtaaacgcccactgggtatatatttataataaaatttatacagcttattattcatatttgaattttattcagttgtttcaagggcagtgtggtataatagagcataaggttaggagtaaggatatctaattttgtgactttaggcaatttgcttaacctgttacctaaaatttattacttttcaaacagagataatctttttttgagtgtttacttcacatgagctatatagagggaaaaaaagttaaaaaatgtatgtgtacacacatgtatttttatgagtaagatctttatgtactattgtggagtcatctccaggatgtttaagtgaaaaaagtaatgcgcacagtatgccaataaaggagagatacaaatataacttgcctggagttgcataaatggcagagttggaactaaaattcagctatcctatttaattctggactcttttacttcttattgtacagccatgtcagtatttgtcatcatgccatagaaacattttataagctaaatttgtctcttgatcttgctcttaatcagaaggcctcttatcacatttaaaaaatttgtagacatattattcttcaggaccatcttggtttcttttaatgcaagtaaatgggaaatatatcctaatatgtaaaaatttactttatcgctctccttattattatatatctcatcgatgaggacctttctaatagccttattatgtatgcttacttgtgaatttatcctctcctattaacattttataagtctaaaaattaaacactttatacttacattttgaagtattttgcatagtctaaactattaaaattaacttgaaggtgacgagtaaaagtcgttctgaattaccagatgtgaaacaaggtgaggccaatcttaaagagataatggatagagcttatgattcatttgatattcaacttacaagtgtacagctgctttacagtagagttggtgagtataaaatgcattatttgttgattgattttgttgaagtgattaattaggtttttagacactttgaagaccttcctcttaaatgtgttagaacgtctatatttttgaattagaaatgatagtaaatattgtctagctgttcttaccaggagcagtcttgcccccccaagagacatttgtcaatatctggagacatctttggttgtcacaggtagagcatgagtggcactcctagcatctagtgggtaaaggtgagggatactactaagcatcctacgatgttcaggccagtccctcataataaatatcagtagtgctgaggtcgagaaatcctgatctgtaccaatgttttccagcctttgaccaaagttggcccatattgaaaatgatattggtattactacacagttggataaccagaagacattgctcagggccagaagtaagcagcctaggggctctgacagtcatggacagccatacaaagacgagggtcactctcctagacatacttgtatctcattcactgtggtataccagtcaggagtctgatttagagctagttttgaagatgaagtcaaagccagaaattcacttgccaagagccatttaagtagttagggagagaccccagactcgttcagctttcttttcgttctgtcatactgcttttgaatccctagagtgttagtgaacatgcagataattcagtaaaatttgatctgttgaagagatccatatgtagagatctaagtgtttgtatgcagtcagattttaattacctgagctaaccaataaaaggagaaacaatgagaatccaaagtagttgttatcaaaattgttaatttgtataggactgaaacattttatttcttcaattatatttgcttcaggatagtgaatgtagtttgtatttttatcatattctaattgtggtggaggaaacccaaaggtatagtgggtggcagaagtacgttattttcagaattccacaaattctttttcagggaataaattactgggtttggttttccttgactgggattttatctgactcatagaattattatgttcaaatgagatagtatatatgaaaatgcattatatgactgagatcccattaatcttgttatgaatttttaaagttatttctttctgattatacctatttcagaaaatctgaacaactgagaaaccaaaaagataaacctttatgttactgcttaggcaggaacactattgatattttgttgcacatccttttagtatgtttttcagtgtgtgtacctgtgaatatatgggatgtgcttgtttggtgtttatattggaggtatttgtgaatgtattttttttacatgatttatatagttttatatccaggtattttttcttttaccagtaatattttggtcacttgaactcatggtttttattgtctatattatgctatatggctatggtctcagttatttaaccattcccttatggaacatttaggctcgtaactctgcagtgattgttgccaatcaacaacatccaagtagacttggatgtgaatttcagttttatcactagcagattgatcataggcaaattataaattcttttgagtctcagttttctaaagtgggattattatacagaattttgagaattaacatttaaacattacctagaagagtagaaattataaatcttgaataaatggtagcttttattagttactgttaaagaacctcactttttactaccttttgcattattgctttactgccatgttacttttttgggtaaggtatgtggttggtgtagtgattgtcagtggatgcgcagtagatttgataacctactgattgtatgtacctgagaatgtgacattaagattacctagatgtggggaaatttcctcatataatggaatgtgtgactatgaagtattaatagttattttaggttttgtgtgttatagttacgttaaatatgaactattttctgtacttaggtgataattggagagaagcacgaaaactcagtgtatctacccagcatattttggtacccatgcacttcaatttggaactgtctaaggccatggttttcatggatgtaaggatgcccaagtatgtactgtttgtttcatgtgaatatggattttctgggtaattctgtagctagggaaataccatacttaactgactcttccttgtgtgtgtggtgaaatgtatataactgactcttccttgtgtgtgtggtaaaatgtatataaaatttaccattttgataatttttaagagtatagttcattgtcattaggttcacgcatgttgttatgcaaccatcaccaccattcatttccagaactgtttctcttccaaactgaaactctgtactcaattaaacaataacaccccatttcaccctgcacccagcccctgacaacaaccattatatcttctgtctttatgaatttgactattttaggtgcctcatataagtggaatcatagaaaatcagattttgtgtgcctgggtttcttcacttagcataatgtcttcaagattcatccatgttggagcatatgtcagaatttcatgtatttttaaggctgattaatattccttatatgttgtatatactatgtttttatttattcatccttcaatgaacatttgtgttgttaatgctgtttggctgttgtaataatgctgctgtgtacaaatatctgcttaagtccctgatttcagtatttttgggtgtatactcagaagtagaattgctggatcatattatagttcagtgtttaagttttagaggagtgctgtgctgttttttatagcagttacaccattttactttcctaccagcacaagagtttcaatttcttcactgcctctacaacacttggtattttctgtttttttattttaatagtcatcctaataggtgtgaagtgatgtcatttttctaatgcttagtgatgttgaacatctgttcttgtgtttgttgaccattcatgtatttatttggagaaatacatattcaagatctttgcccatcttttaatctggttatttatttttttctgtttttcgagatggagtctccctctgtcacccaggctggagtgcagtggcatgatcttggctcactgctacctccacctcctgggttcaagtgattctcctgcctcagcctcctgagtagctgggactacaagcgcatgccaccacgcccagctaattttttgggtttttggtagggatgggatttcaccgtgttagccagggtgggcttgatctcctgaccttgtgatccacccgcctcagcctcccaaagtgctgggattacaggcatgagctgccgcacccggctgagttgtgagagttttaaaatatattttggatattaactctttatcagatatatgatttgcaaatattttttctcactctgtgtttccttatcactctgttgattgtggcctttgatgtctaaaagtttaaaatttttattgtccagtttatcttagttgcctatgcttttggtgtcatatccaagaaattattacaaaatccaatgtcataaagcttttcttctttgtttaccttaaagagttttatagttttagcttcttttatttagatctttgatccattgagttaatttttgtatgtgacatataggataaggaccggcctttattcttttttttttttttttttttttttttgagacagagtctcgctgtcgcccaggctggagtgcagtggcatgatctcggctcactgcaggctccgccccccagggttcacaccattctcctgcctcagcctcccgagtagctgggactacaggcgcccgccaccacgcctggctaattttttgtatttttagtagagatggggtttcaccgtgccagccaggatggtcttgatctcctgacctcgtgatccgcccgcctcggcctcccaaagtgctgggattacaggcgtgagccactgctcccggccttattcttttgcatgcaaatatctcatttcctctatacaatttgttgaaaagactgtccttttctcattgaatggccttggtaccctagttgaaaatcatttatccatatatgcaagagcttatttttgggctttctgttttattccattggtctctatgtctttattttcctgtaccacactatttagattactgtagctttataggaagttttgaaatcaggagatgtgagttatttaactttgttctttcgattgtcttggctattcgggatcctttggtattccatatgaatcttagcatgttttcttttcttgtaaaaaatgttatagagattctaacaaagagtgtatcaaatctgtagatccctttgaatagtattgacatcttaataatattgactgttatagtccatgaacatggaatatctttctatttatttgtgtctttgatttcagcaacattttctaggtctcagtactaaagtctcttgcctcatttcttaagtttattctttgtgatgctattgtaaatgaatttaaaaattttggggggattgtttattgttagtatgtgggaacttaactgatttttatatcctgcaacttgtgaatttgtttacaattctaagttttaggattctaaagttctaacagatttaagattttccacatataagatcctatcatctgtgtatggagttaatttttttccctttctgatatgggtgccttttatttctctttcttgcctaattggtctgtctagaattttttagcactctcttgaatagaagtagtttaggttggcatcctcaccttaatcctgagcccagaggaaaagctttcagtatttcaccattgagtatgatgtcagctgtggggtttttatggatgacctttattatgttgaggtagtttccttctgttcctagtttgctaactttttattatgaaaacgtgttgaattttttcaaatcctttctgtgctttgagatgatcatgtgatcatgtaaaaaatgatcaagatgatttttttccttcattctgttaatggggtatgttaccttaattgctctctatatattaaatcatatttcttgagtccagcaaaaaatccttttattccaggaataaatcctcttattctaggaataaattccaagagtaaatgatatataaaccatgtaatgggctattgatttaggtttgcttgtgcttttgggttttgcattaatatttttcagatatattggactacagatttcttttcttctagtatctttgtctggctttggtatcagggtaatgctgtctttatagaatggattagaaagtattcctgcctcttcagtttttgattgtttggtagaattcactattgaagcgatcagatcgtgggaggttttctttattgggaggtttttgattactgattcagtctccatagtagtttatccagattttgtttcttcataattcagtgttggtagatttgtgtttcttggaatttgtttcatttaaggttatccatttgttggtgtaaaattgtttgtaattgtctctctcttaacagccctttttgttttgtaaaatgagtagtaatgttaccactttcatttctgatttaaattgagtcttttctgtttttttctcagtctaactaaaggttttcaatctcgatcattttgaagaaccaactcacatttttgttgatttttttctctattgtttttctatattttatttatttctgctttcatctttgttattttttttatttcgggtagctttaggtttagtttgctgttctttttctagttccttaaggtgtaaagttaggctattgattttaggtctttcttctttattaatgtaggtgtttacagctataaagtccgcttttggcagacttttgctgcatcctatgaattttggtatgttgtattttcattttcatttgtcttgagttattttctaatttcccttgtgatttctttgatctcattgcttgtttaaccatctgtttttaaatttctatacacttgtgacttctacactttttccttctactcttgcattctagactcatttcatcattattggaaaagatacttcttatgatttcacttttttaacattttttgacgcttggttttttacctgacgtataatctgtcctggagaatgtttcatatgcacttgagaaaaatgtctattttcctggatggagtgttctatatatgtcattttagtccagttggtcaattttattggtccagtcccctgtttccttattaatctactgcctggtgtttctattcagtattgacagtgagatattgaagtctcctattattatcaaggaactgtctgtttcttcttcttaattgtgtcagtgcttgctttatatatttttgaactctgatgtttggcacatatatgtttataattgttatgtcttcttggtgaagttatactttcattatcattatgtaatgtccttctttattgcttgtaacagtttttgatttgcagtctattttggctgtttttgttacaggcatccctgctctcttttggtgattatttgcatggaatgtctttcttcattttttttttcacttttaacctgtgtgttttctatgagttaacgtgatctcttgtagacagtatgtagttgcatcctgttttttaatccattttgtcacttgaagtttttaattgagaaaaaatatatttacatttaaagtaaatacagatggggaggacttacttttgtcatattgttatttgctttctgtatgtcttacagcttttttgatccctcatttcctcctttaatggtgccctttgtgttcagtggatttttgtgtgtgacatgctttgattcctctctcatttccagttttgtatattctacaagtattttctttgtggttaccatagagattgtgtataatatcctcaagttataacagtctatttatttattatttctttatttttttagacagggtcttgttctgtcacctaggctagagaacagtgttgtggttgtagctcactgcagcattgaactcctgtgctcaagtgatcctcctgccttgtcctcctgagtagctgggactacaggcacacgtcactacactcagctaatttttaaatttttttgtagagatgggtcttgctatgttgcccaggctataacagcctatttaagattgaggcaggttgcatagtcttatacctgtaatcccagcactttgagaggccgaggtggtaggattgcttgaggcaaggagtttgagaccagcctggccaatgtagtaagaccctgtctctacaataagtaaataaataattaaataaaattagctgggcataatggtgcatgcctatagtcctagctacttgggaagttaaggtgggaggatagcttgagcccaggaggttgaggctacggtgggttatgattatgtcactgcactccagcttgggtgacaaaaattttaaaaagtgaaaaataaaactgataccaagttagcttcaattgcatgcaaaaactctacttgtttcctgttttgccccctccagtttatcttattgatgtcccagattatatttttatgtattctatacccattaacaaagaattgtaattatttcttatgcatttgtcttttaacttatgtagaaaataaatagtagagttataaaccaaaattctaataacatttgctttatactcatccatgtatttacatttactgggattattatatttcattgttagctgaagctatgtgcctgagatcctaagtagagaagtctgttgaactagactgggccatttagattatttatttctaaatagttttagactgtaggtagtcatttaacttcttccttgtaacagcaccttttttctcccttacaaatattcagacctcaggcacagatctattttaaaatttaaccaaaggcttttctcatctaacatctaccaaacacttccaggagagttgctactagcaaggcaacatgagaaggcttcatgcctagttaaagtgtactaggaagaatagagggaattagagagactctggccttttcctatatggtacatggggtggacattgtttttaatacttattatacttaacatgtaaaagggagagacccacactcttttttgttgacctttacctcatagtgactctatctactaacaaatattgtccagggccctaaatcttactctcctagattttcttttcttagaaaatcaaagcatgcactgagagtcttgaggcagaggaatggctagaatttggtttaagagacagaaggaaagaaaaccatgctacgcattcccttgttttttttcaaatccagctttagatatggttcaatttaaagagaaaaggcttaattcttttcatttctcccaaattatgtctgctgcttgtttactcttttctactgtttcttgtaaagtttttcattctgtgataaagattaaagatctgtgcgatttcttgttgtaagcatatgactaagaattgattttttttagcatagtttaagtacttttcttcttggtaagtatgctataatcttggaagttacagggtaccagaaaaagtaggtgatatttctctgagggaagaaaagggcagcttttatcttggtttggacttgctctgtcagtatatgcttaggaagaatttatgtcttgtgatgcagggaatatgtacagcatagcaggaattaaaatagctgattataagggtacagggcagaaatgacaatgacttaacttagaaagatgaaatcttagaagttatttggtttctattttataatattgtgagcagtataaagtggatatgatatgtcaaatcctgaaactccacaggtgtcaggaacattcccttgaaagttgagctgcgttaagttgaaggcaaataaaaggatgcttgctatttggtagatactgttttggtacccagcatctttagactgcgcaacttgcagatttttcaagaaagtgaaaaaaagtttaagtgcattaagagaaccgattcataatgtttaacaaagttaaactactactacgcttgtgattaattacaaatatttaaggtattggaaataaaagaaagcttgtaattttctgtaggactccagtacatttttagaaagataacgtaagtaatcagtgtgcgtacgtggaaaaagtaatttttagggaaaatgcagggataaaaatggggagtgaaaactttctctctctctctctgatagtgaaaactaactttctgtctctctcaaaggagactgtcaaggcaattaaaagaataataaagcactctgatgtggttttgctcaatgatctttgatacatagtctcatgagcaggctatttgcactgccaaaccttagttttctcataggaagcatgtacatataggaacttaaatagagagcaaaaataggttgtctgcctcatagattgtgaggactgtttacaataatgcatgtaaagtgctttcctcagtgcctgtcacatgagaaacacttgattagtagtaattgtcaattgtatatagcaaacagtagaaggacattacatgaaataagaacataaacctctgaaaaataatgagtttagcccatctaatgaaactggttaatacggtaagacggaaattggaatagagatttttagtgtttaaaatcacatttgattcagataatttgagaacagtctttttaattagtgcacttaaatcagaataattcctttataattacttatttttatcttttcaaaacagattcaagatttatggaaagttacctcttatttctttacgaatctcagataaaaaactacaagggattatggaattgattgaaagcattccaaaacctgaaccagtaactgaagtatctgcccctgtcaaatcattccaggtaatgttactttcaaaattaatataagcatgaattaagaaagtccacaaatagtatttcaaacaatcacaggaattttatataagacaatttgcaatttgttttgaatagacattaagaaaattactttttttttttttttttttttttgagatggagtctcgctctgtcaccaggctggagtgcagtggcgtgatctctgctcactgcaagctccgcctcccaggctcacgccattctcctgcctcagcctcccgagtatctgggactacaggcgcccgccaccacgcccggctaattttttgtatttttagcagagacggggtttcaccgtgttagccaggatggtctcggtctcctggtcttgtgatctgcccgcctcggcctcccaaagtgctgggcttacagacgtgagccaccacgcccagccagaaaattacatgttgagagagaaattgaaatggtaaaaagtataaatagttaagaaagatataaaataataaatctacttttctaatttctgcagcctccaatccctctcctgagcaataacactgttaactactgcttctctagtttttaaaaaaatttttgtggcatatactagtacacacatgcacaagaacatgcatgtgtgtgtgtatgtagtatgtgtgtgtatacatacatgtatatattcattttttttttttgaaacagagcctatctctgtcacccaaggtggagtgcagtggcgcaatctcggctcactgcaacctctgtctcttgggttcaagcagttctctgcctcagcctcctgagtggctgggattacaggcgcccgccaccacgccagctaatttttttttgcatttttagtagagacagggtttcaccatcttggccaggctggtcttgaactcctgaccttgtgatccacccgcctcggccttccaaagtgctgggattacaggcgtgaaccaccgtgcccggcctgtattcttttatttttaaaattaaatgaaatcattatacacactattctgaatctgtattattttcaccattattatcatatatgccttagataaatttttatgttagcacatacagatctacctcatttgtttatggtgatatagtatttcattttctgcatataccatcttttgcttaatatatcttcttttgatggatattcacattatgagtgtttacagttatgaaaaatactgctttgaacttcctcatatatatacatatatatgtgtgtatatatatatttgcttatacttttattcataggataaattcctagaaatggaattgttgagtaaaagaggatgtgaattttaaattttgattattttgccaaaaaaaaaaaaatttttttttttttgggacgaagtctccctcttttgctcgggctggagtacagtggcacaaccttggctcactgcaacctccgtctcccaggttcaagcggttgtcccatctcagcctcccaagtagctgggactacaagtgcgtgccactacacttagctgatttttgtatttttagccgagatggagtttcaccatgttggccaggctggtcttaaaatcctgacctcaagtgatctgcctgcactgggctcccaagtactgggattacaggcgtgagccactgtgcccagcccagatttgcttaacttatagtttgctaacagtgaatgaatatctttctctgctttcattactgagtattagcaaatgttaaaattttattcgaagtgaaaaaaatgtcttctggttttgatatgcttttttaaataagtagaacatactttcctaagtttactattttaatttctgtttttggaaactgctgttcatgtcttttttctattgggttatggttgtctaattaaggaagtaacctgcttgtcatttaaaattactgttttttcctcattttattgtttggttgttttttatctcatatgtaaatttatttttgccaggcagaagcgttttattttttacatagtcaatttttttttccttcatgatttctggactttgtattatgtgacttttccctttccaagagaatttcagaaagaaaaaaaatatattcacatttccctccattttcgggggtaacagggggttctttactcatgtttaaatgcttttcttttgaagtagtttcaaacttgaaacattccaaaaatagtgtaaagaaggtttttttttattattatattttaagttctgggatacatgtgcagaacatgcaggtttgttacataggtatacacgtgccatggtggtttgctgcacccatcaacccgtcatctacattaggtatttctcctaaagctatccctcccctagcccccgacccctcgacaggccccagtgtgtgatgttcccctccctgtgttcatgtgttctccttgttcaactcccacttatgagtgagaacatgcagtgtttggttttatgttcctgtgttagtttgctgagaatgatggtttccagcttcatccatgtccttgcaaaggacatgaactcatccttttttatggctgcatagtagtctatggtatatatgtgcagcattttctttatccagtctatcattgatgggcatttgggttggttctaagtctttgctattgtgaacagtgctgcattgaacatacatgtgcatgtgtctttatagtaggatgatttataatcctttgggtatgtacccagtaatgggattgctgggtcaaatggtatttctggttctagatccttgaggaattgccacactgtcttccacaatgctggaactaatttacactcccaccagcagtgtaaaagtgttcctgttttgcaacatcatctctagcatctgttgtttcccaactttttttttttttttttgagacggagtctcgctttgtcgcccagcctggagtgcagtggtgcgatcttggctcactgcaagctccacctcctgggttcacgccattctcctgcctcagcctcccgagtagctgggactacaggtgctcaccaccacgcccagctaatttttttgtatttttagtagagatggggtttcaccattttagccaggatggtctcaatctcctgacctcgtgatctgcctgcctctgcctcccaaagtgctgggattacaggtgtgagccactgagcccggccccttttcccaactttttaatgaccgacattctaactggcatgagatggtatctcattgttgttttgatttgcatttctctaataaccagtgatgatgagctttttttcatatgtttgttggccgcataaatgtcttcttttgagaagtgtctgttcatatccttcgcctactttttgatggggttgttggtttcttacttgtaaatttttttcagttctttgtagattctggattttagtcctttgtcagatggatagattgcaaaaattttctcccattctttaggttgcctgctcactctgatgataatttcttttgctgtgcagaagctcattagtttaattagatcccatttgtcaattttggcttttgttgccattgcttttggtgttttagtcatttagtctttgcccattcctgtatcctgaatggtattgcctaggtttccttctagagtttttatggttttaggtcttacatttaagtctttaatccatcttgaattaatttttgcataaggtctaaggaagtggtccagtttcagttttctgcatatggctagccagttttcccaacaccatttattaaatagggaatctttcccccattgcttgtttttgtcagatttgtctttaaatagggaatctttcccccattgcttgtttttgtcagatttgtcaaagatcagatggttctagatgtgtggtgttatttctgaggcccctgttctgttccattggtctatatctctgttttggtaccagtaccattgctgttttggttaccgtaggcttgtagtatagtttgaagtcaggtagcgtgatgcctccagctttgttctttttgcttaggattgtcttggctatacgggctcttttttggttccatatgaactttaaagtagtttttttgaattctgtgaagaaagtcaatgataacttaatggggatagccttgaatctataaattaccttgggcagtatggccattttcacaatattgattcttcctatcagtgagcatggaatgtctttccatttgtttgtgtcctctcttatttctttgagcagtgttttgtagttctccttgaagaggtccttcacatcccttgtaagttggattcctaggttattttattctctttgaagcaattgtgaatgggagttcactgattatttggctctctgtttgtctattattggtgtataggaatgcttgtgatttttgcagattgattttgtatcctgagaccttgctgaagttgcttatgagcttaaggagattttgggctgaggcattggggttttctaaatatacagtcatgtcatctgcaaacagagacgatttgatttcctttcttcctatttgaataccctttatttctttctcttgcctgatttccctggccagaacttccaatactatgttgaataggagtggtgagagagggcattcttgtcttgtgccagttttcaaagggaatgcttccagtttttgcccattcagtatgatattgtttgttgctttgtcataaatagctgttagtattttgagatacattccatcaatacctagtttattgagagtttttagcatgaagggtgttgaattttatcgaaggccttttccgcatctattgaggtaatcgtgtggtttttgtcactggttcagtttatgtgatggattacgtttattgatttgcatatgttgaaccagccttgcatctcagagatgaagccaacttgattgtgatggataagctttttgatgtgctgctggatttggtttgccagtagtttattgaggattttcacattgacgttcatcagggatattagcctgaaattctcttttttgtgtgtgtctctgccatgttttggtagcaggatgaggctggcttcataaaatgagttagggagaagtccctctttttctattgtttgggatagtttcagaaggactggtaccacctcctctttgtgcctctggtagaattcggctttgaatctatctggtcgtgggctttttttggttgataggctattaattactgcctcaatttcggaacttgttattggtctattcagggattcgacttcttcctgatttagtcttgagagggtgtatgtgtccaggaatttatccatttcttctagatttttgtagtttatttgtgtagaggtgtttatagtattctctgatagtagtttgtagttctgtggaatcagtggtgatatcctctttagcattttttattgtgtctgtttgattcttctcttttctttattagtctggctagcagtctatgtattttgttaatcttttcaaaaaaccagcacctggattcactgatatttttgaagggtttttcgtgtctctatctccttcatttctgctctgatcttagttatttcttgtcttctgctaccttttgaatttgtttcctcttgctcttgcttctctggttctttaattgtgatgttagggtgttgattttagatctttcccgctttctcctgtggggattttagtgctataaattttcctctaaacactgctttagctgtgtcccagagattctggttgtgtctttgttctcattggtttcaaagaacttacttctgccttaatttcattatttacccagtagtcattcaggagcaggttgttcagtttccatgtagttgtgcggttttgagtgagtttcttaatcctgagttctaactggattgcactgtggtctgagagactgtttgttatgactgccattcttttgcatttgctgaagcttgttttaccttcaattatgtgatcaattttagaataaatgtgatgtggttctgagaagaatgtatattctgttgatttgggggtggagagttctgtagatgtctattaggtccacttggtccagagctgagttcaagttctgaatatccttgttagttttctgtcttcttgatctgtctaatattgacagtggggtgttaaagtctcctgctgttgttgtgtgggagtctaagtctctttgtaggtctcttaagaacttgctttattctttaagaatgttgaatattggcgcccactctcttctggcttgtagggtttctgcagagagctctgctgttagtctgatggtcttccctttgtgggtaacctgacgtttctctgtggctgcccttaacattttttctttcatttcaaccttggtgaatctgacgattatgtgtcttggggttgctcttattgaggaatgtcttagtagtgttctctgtatttcctgaatttgaatgttggcctatcttgctaggttggggaagttctcctggataatatcctgaagagtgttttccaacttggttctattgtccccgtcactttcaggtacaccagtcaaatgtaggtttggtctttgcacatagtcccatatttcttggaagctttgtttgttcgttttcattcttttttctctaatcttgtcttcatgctttatttcactaagttgatcttcaatctctgatatcctttcttccgcttgatcgatttggctattgatacttgtatatgcttcacgaagttctcatgctgtgttttcccactccatcaggtcatttatgttcttctctaaattggttattctagttagcatttcctctaaccttttttcaacactcttaggttcattgcattgggttagaacatactgctttagctcagaggagtttgttattacccaccttctgaagcctgtttctgtcaattctgcaaactcattctccatccagttttgttcccttgctggcaaggagttgtgatcctttggaggagaagaggcattctggtttttggaattttagcctttctgcactggtttttccctaatctttgtggatttatctaccttgagtctttgaagttggtgaccttcggatggggtttctgtgtggacgtcctttttgttgatgttcatgctgttcctttctgtatgttagttttccttctaacagtcagacccctttgctgcaggtctgctggagtttgttggaggtccactgcagaccctgtttccctgggtatcaccagcggaggctgcagaacagcaaagattgctgcctgttccttcctctggaagcttcgtcccagaggggcacatgccagatgccagccagagctctcctgtatgaggtgtctgtcgacccctgctgggaggtgtctcccagtcaggaggcatgggggtcagggccccacttgagaaggcagtctgtctcttagcagagtttgagtgctttgctgggagatccactgctctcttcagagccagcaagcaggaatgtttaagtctgctgaagctgcacccacagccgccccttcccccaggtgctccgtcccagggagatgggagttttatctataagcccctgactgggctgctacctttctttcagagatgccctgtccaaagtggaggagtctagagaggcagtctggctacagtggctttgctgagctgcagtgggctccgcccaatttgaacttccaggcaactttgtttacactgtgagggaaaagctgccttttcaagcctcagcagtggtgattcccgctccccccaccaagcatcccaggttgacttcagactgctgtgctggcagtaagaatttcaagccagtggatcttagcttgctgggctccatgggagtgggatccgctgagcaagactggcttcagccccctttccaagggagtgaaaggttcatcttgctggcattccaggtgccactggggtatgaaagaaagctccttcagctagcttgatgtttgcccaaatggttgcccagttttgttcttgaaaccctgggccctgttggtgtaggcacccgagggaatctcctggtctgccggttgcgaagactgtgggaaaagtgtagtatctgggctggagtgcaccgttcctcatggcacagtccttcagggcttcctttggctatgggagggagttccctgatccctttgtgcttccggggtgaggcaaagccccactctgcttcagctcgccctccgttggttgcatctactgtctaaccagtcccactgagatgagccgggtacctcagttggaaatgcggaaatcactggccttctgcattgatattgcctggagctgcaggttggagttgttcatattcagccatcttgccagccaccagtgtagagaagttttatccccagtctgttagagagtatgttactacctgggcgtggtggctcacatctgtaatcccagcacttagggagcccgaggcaggcagatcacttgaggttaggagttcgagaccagcctggccaacatggtggaaccccgtctgtactaaaaatataaaaattagccaggcatggtggtgggcatctgtaatcccaactgctcaggaggctgaggtaggagaatcacttgaactctggaggtggaggttgcagtgagccaagattgcgccactgcactccagcctgggcgacagagcgatactccatctcaaaaaaaaaaaaaaagaaagtgagttaatgtcccattactcctgaatactttagtgttttgttgtattcttttcctagtctgttggtgagtttttttgtttctttaattgtcttttggagggcaaaagtttaattttgatacaattgactttagcaatattttctctagatattgagctttttgtatcacatctctgcaatttttgcctaatttaaggtcaagaagatttttccctatgtttttttctagaaattttttagagttaggttttatacttaggtctctcatccatttaatttttctatatggtgcttgtgatgggatcctctttctagttttacatctgcacttagttatttccattttgtttgttaaaaagactattcttttactattgagttgactatatatgtgtaagtctatttcagactcttccagtgatttctgtgtctatcatttccatctgtttctgtccttttgttgatatcatactgtcttaattatactataacttcatgtcttgaaatccagaaaggttagtcctccaactttttgtatttccaaaatgttttcgactgattcctttgccttttagaatcaacttatcaatttccacaaaaattctggctgagatttggatagaaattgtatcattaatttgggagaattaacattttagcagtattgagtctttcagttcattaacatggtatatctctccatttgcttaggtctttttaagtttttaaaaattggttatttgtagcttaagcatccgtttgctaatatatgttgttaaatttgtacatagtgtatgggctgaattgtgcccttcaaaatttatatattgaaccctaattctgctatttcacattgtgactgtatttacagataggttctttacagcagtgattaagttaaaatgagaccactagggtgggcgctaatccagtttgactggtgtctttataagaaaaggaaatttggtctcacagagacaccagagatgcatgcacactgaggaaagcccatgtgaggacacagaaaggaggtcatctgcaagttaacgatagaggtggcctccagaactgtgagaacatagatttctgttgttaaagtcacccagtctatgctattttgttatggcagctctggcaatctcatatacgttttggtaccaagcagtgagttgttgcttaacaagcacttagaaatgttgaagtggctttagaactgggtaatgggcagagactggaagaattttgaggcacatgttagaaaaaaacctagattctatcgtttaataaattattgatataaaatatggacgttcaagctgtttctgttgagacctcaagtggaaatgaggaacatgttatttgacattgaagggaatgtggtccttgttataaagtggcaaagatcttggttaaattatgttctagtgatgaagttggatatttagctgtggagatttctaagtaaaatgttgaaggcatcgtcttatttctcattgcagctggtcaaatcacttgaggccaggagttcaagaccagcctggccaacacgatgaaatcccgtctctactaaaaatataaaaattagctgggtgtggtggtgcacacctgtagtcccagctactcagaaggctgtggcacaacaatcacttgaacctgggaggcggaggttgcagtgagccgagattgtgccactacactccagcctgggtgacagaaggagaatctgtctcaaaaacaaaaaaaaaattgtacaatatgtggttaatatgtgtttgatttattacaaagatgccagcctagctaagtgggggaaggatcaccttttcaacatatggttctgaaacaaccggatttccatgtggaaagtaaattaatttcaacccttatcttatatgcggaatttaacttgaagcatagacctaaatataaagtccacaagtgtaatttctggaacaaaaaatgtaggttaaaattttgaatccttgcagtaggtaaagataccttaggatataaaaagcgcaaatataacaggagaaaaaaataaataaattggactttataaaaattaaatttttctgctgtttggaagacattgttaaaaaaggtgaaaaggcaaaccatctaaccatccacttgggaaaaatagttgcaaaaatatttttacaagtccagacttgtatctagaatatatgagaagactaacagctcaataataaatgactaaacaggtagcatgaaaagatgttcgactttattactcaccagaaaaatgcaaatcaaagccacatagaaatactactacacaatggttagaatggctaaaaataagaagaatggcaataccatgtcaaggtgttgccatgacaaggatttaaaactctcatatgttacttgtgaaacttgaaaatagcataaccctttgtaatttagtttggtagtttttaaaaataaggttaagtatatacttaccatatgacttgggaattctactcctaggtttttacccaagagaaatgaagtcacatgcctaccaaaagacttgaactagaatactcacagtagggttattcataatagtaaaaagttgcataaaacccaattgtctatccagaagtgaatggataaggaaaaatagtatattcatacagtagactactactcaggaaaaaaaatactaatacatgtagcagtgatgggcagtgattgagtgtagggggagcttccctcaaaactccagggcattttagggaatagaacgcaggattacttggcaattcatttaagaacttaacaaaacttgtattctaaaacctaacaactacattataaaagaggaaaataatagcccagtttcactaataaatgtaagatacaaaaatttcaaaacattaaaagttgaaattaaggtaacatagttgttacttttgggaggatgcctaatgattgcaaggagcttaagggaggcttatgagttgcttgtaatgtttcatactggacctgggtggttggtaggttgagtgtgtttactttctgaaaatgtattgaactttagagtttatgtacttcgtgtagtagattataatgtgcttaaaaaaaatgctgctgctgcttccaaaatgagcagaatttcacagaatggcaaacacaaataaccaaggaagctatttgtgtttgatatgatatgtaaccgttatgcatttgtgaaattgtaattaaaactaggatgacatggccaatgagactgatataatttgaaatctttgaacaccctaagcattgtgaggatatggagagatagaaactgtgctgctggtgttagtgtaatgtcttatcaccacttttgaaaatggtttgatagtgctcaataaggtgaacatatataattttactgtttgggaaagttttatccacaagcacctatgggcatatcaaggatgtttatagtagtgctacaagcaaaagcaaaaatctataagcaacacagatactcaccaacagtatagtggacaaataagtagtggtttcttcatcagtgcaatacaatatcacagtaaaattcagttaactatcagtgtggttaaaatttaaacattgttttgtaaaggaagtcacaggaaaatgtatgtcatatatgctacagtttggaaagaggcaggggtaaacgatgcattatttagataatcattcataggtgctttagtacaaacaactaaataaaagcaagatcatgatgagaggtagggaacgtgacaaggaggaatgagatccgggaggaacacataagaagatgcttctaggtcaggatgtggtaatgttttattgcttggctgggttggaaaattcagatgtgtcttttattattatttttttaaactgcaaaatttgtttttatatatgctgtatttctccaaactgtaaaaaagtaaatttcctgaaatacctttcagagatcaaaaataaaagtaagttcctcaattctagaggctttaagtattgtgacttgtgtgttcctcacagatgtcctgatttaatactatgttgacttaaaatataagatctgtttctactcaaagcctgtcatcaaggacattattaaaacagttctacaatttttatttagccttaaaattgtaaaactacttctttaaaatctgcgttttataatgtatttttctaatttaaacctgattatcttctcagttaattcaaattggatagctttttgtcaaaactgttgtagaactttgaataaacattttttgaataagcggtgaataaacatttttgtgctaatcaacattgaattacttttctttcagattcaaacatctacttctttgggaacatcacagatttcacagaaaataattcctctcttggaacttccatctgtttctgaagatggtaaaatgaaactgcttaaggatatttttcttattttattaaaataatttctgttttgaggcatatttttctcaaaggaccacacagaggaaggaaaatatcttttccttttaaaatctaggttcttgactgaggctctatgaatggaagacagattaacatgagaaaacaagcagatttactagcattcatatttcatgggtacatgcaagaagctcaggaatgagtaactcaaggtggtgattaaaatttgggtttatataccagtttgggcttaaacaaaggaaaagaggttttgggcttcagggataggggttgctggggaggcaaggtatatgggaaggcgaccagaaaaagtatggtacacaagggtaaagtttgttacgcagatatgtcagtgttttctccgttgataagaatgtcttgggagtaagagtcatcttccctggtacagaaaggaagatacctttacaaggtagatttctcttataaatgttaatttcccttagaaaagggaaacttaggatctgtcttcagagcttttcctgtgtctgctgtttcttaaaataattgactcagtgtaatccttatgccaaaaagacatgttttcgagtggcgtattttggtcttctgtagtcatataagaaatttaaggcaatagcagatatttgtatattttcaggaaattttaactaaaatttattttaaatagcacaattccttaaagttgcttttgcaatgggatttttttggtataaagttgaacagaaaatgacaaggaccagccaggcgcagtggctcatgcctgtaatcccagcactttgggaggccaaggcgggcggatcatgaggtcaagagatcgagaccattctggccaacatggtgaaaccccacctctactaaaagtacaaaaattagctgggagtggtgctgcacacctgtagtcccggcgactcgggaagctgaggcaggagaatcgcctgaacccaggaggcggaggttgcagtgagcagagatcgtgccactgtgctccagcctggtgacagagcgagagtccgaatcaaaaaaaaaaaaaaaaaaaatgacagggaccactaataagttaattatctttatttggctgtgagttaaaaaacaccacaaaacttcacagatgtcttaatttctaatgtgttttttagttatttggaaaattttgctatagtatatttaaaacatttttaaaaatataattattaaaggaaaatcatcaataattatctacatttacatataaaaatatataactattctgataccaaatatgtgctttttaatgaccgtattagaaaaggtgtatgtctatatttttaagactttaaaaattgataaatgttaaataacagaaactgccatgtcgattcttggtttcttagagaacaatttttctttatttatagtcaccagagagaagttgtttgtgagatcatctactttaacttcagtcttagtttattagggatatacttctgattgtttcatttaaacctagttttaatggttttactaagttatctaatgctttttcagtcctttttaatatcagcatatgtgtatgctgatgtgtattacatatcaacgtatatgtacatatacctatatttgtgtatatatatgtatacaaagtagtgcttgatctcagtttacttcattcagactctgctgctaatattgcagagtttatacctaagtcctgttacactatccaggtagagtgagcatattaacatattactttgagtattcatggtgtgtataatcatcggcattggcatttcctgtaaaatttaagcaattttaaaatagactatttcaaaagatgggcttcttaagctaaagattacatcttaataatgttccatgcttctttataaccaagaatgttatttaaaagtagagtatccctttgtttaaaatggacaataaaaaagtacagtaatgtctatattattttctgtttatttcggttctcatgttaatatttgatatttaaaagagagccttagtgttttagtgttcatatttatttctattgaaatactgttaaattgatcattttaattattgacttaaataatgttctgtgaaatgtagattcagaggaggaattttttgatgcaccatgtagtcccttggaagaacctcttcagtttccaactggagttaaaagtattcgaaccagaaagttacaaaagcaggattgttcagtaaatatgactacatttaaaataagatttgaagtaccaaaggtaggtactacggtaaaattaacatggcttaatttgtttgctgtttctatatttacagcttactatatagtctcattgttaagaagcactatctttttcaccctaattaaagtaattccagacttgctgtgtgattcttggtcactccccgccccccccttttttttttaaataagattaacttccttaatcaagagtgaaggatttaaatttattcagtacatgtttttgtgaaaacgattatttatgttgtgtgtgtattgtatgtctgtgtgggtataaaatctctcctaaattttaaataataatatatcaattgtatgtatacctcatatattcacatgtaaccactatgcacataaacatgtttttgttttatgtagtggtaatttcttttttctttcttctccaggttttgatcgagttttatcaccttgttggagattgtgaactatctgtggtagaaattcttgttttaggattgggtgcagaaattgagattagaacatacgatttgaaagcaaatgcctttttgaaagagttctgcttaaaatgcccagaatacttgggtaagaatctctattttttaaaataaataaattaatttcattgtttgactacctgctagagagttttcaattctttaggctctgaatcagtacatttgctgaaatattctcagagaaccattcctttttgagttaatctttaacttttatagttggtaatgtggggggcacaccggagataaaatgaagataattttattcattatggaaaatcagatgataatggttgaattttaaatctacttaactgagtattggaacacttaattagttttctattgttgctataacaatttaccacaaacttagtgcttaaaaacaacacaaatttattatcttagagttctgtatgacagaagtctgacacaagtctcactgggcaaaactcaaggtgtcagtaggacttccttttaggaggctctagaggagggtccatttcattgttcagtcaggtgttgacaaaattcatttacacatggtttaagtctatgtttccttgttgcctgttagcggatggctgcccttaggcctcagttgcttttttgcacgtagctgctaaccacaataaggcatcagatcctcctcatgttgccatatctctaacctcctcttctgtgttttgcttccactcttaaaactccagtgattagattggacacacctctataattcaggataatatacctttaaccttaaccttaatcccattttccaaggcccttttgccatatgagttaacatattctcagattccgggggattagagcgtaggtatctttgttgggggcagagggcagtattctccttactgcaaaccttttgtgttcgtaatggatatatgatccctaagaaactattctgtttcctatgttaggtaattaggagggttgtatttatatttcttcatttacattttttggatttttccttgaaagataattgtgaatagtagaggcaattattaggacaccagtttcattttattaaactcctttgtagcataataatattatgtatgagcagaggtggaaataaaattttttaaatagactattttttagagcagttttagatcatgggacaattgagcagaaggtacagagatttcccatatactccttgtacccacacctgcatagcctttttcattatcaacatcctccactagagtggtacatttgttacaactgatgaacctacactgacacatcgtaattaccaagagtccacaatttacattaaggttcactgttgctgttataccttctgtttggacatgtataatgacatgcatctaccattaccttctcatgtggagtagtttcactgccctaaaaatcctctgtgctccacctatttgtccctccctcccacttaacccctggcaactggtgatccttttagtgtctccatagttttaccagcatgtcacataattggaatcatatatatccttttcagattggcttctttcacttagtaatatatgctgaagttacctccatgtcttttcataactgggcagcccatttcttttttagcaatgaatgatattctcttgtctggatgcaccacagtttatttatccattcatgtactgaaggatatcttggttgcttccacggtttggcaattgttaataaagctgctgtgaacatttgaatgcaagtttttgtgtagacataaattttcagtttcactgggtaaataccaaggaacatgattgctaaatcatcaagaaacagtttgctctagtaattggaaagaaaagtaaaccaacgtgacagtgttccctagtaacccaggaactttatagcagttactaagttttttttattattattagttttatttatttttattttttgagatggagtctcgctctgttgcccaggctggagtgcagtggcatgatctcggctcactgcaagctccacctcctgggttcatgccattctcctgcctcagcctcctgagtagctgggactacaggcgcccgccaccacgcccagctaatttttttttttttttttttttgtatttttagtagagacggggtttcaccatagtctcaatctcctgacctcgtgatccgcccgccttggcctcccaaagtgctgggattacaggcgtgagccaccgcgcctggccacacttattaagttttatgtttattcttatgtttgctttgccaagaacaaaggattaaaaaacccttgcaaacagaaaaaagagtatacaattattattgcgcttatttctgtaatatttttgtttctgttttctcagagggagtgaatagcagtttcttgcacaaagtaaatgatcagtaaatggttcaatgaatgaataaatgtgtaaacaaagtgggaacttttttaaggcttcaagtgtggctagcacttggagtagaaaacaggtttatgtgctaagcattaggtttggagaactctgtgcaatttgtggcatttttttctcaggaattgtaggattagtttgtagtcctttcttccagtctttagatactaattttctagcaaccgtaagtcatttggtgatgagagttttaaaagctttctataaattctcttctacactggttttcttagtatagcacattttgagcagaagcagtaatattaaaatgggagagttcctttattcccctcgcaggacatgccacaggggtgtgtatttccctagagggagcatgcagatgggcaggtgcagaggctgtggggagtgcttttgggctccggccccaggacagcatctaggggtaggtgtctacaacccctgaagcccaaggggcatgtgttacagtatgctctttcaactttgccatctgcagacagcttttgttaatcacctcgatagaccgtcttccttatcgcaagggcagggggccattgtgactgcctgagttcttgcccagtgtaccagaagaattggatgacatgtgggctggaaggatgagtgcaaggttttattgagtggtggaggtggctctcagcaagacggatggagagccggaagtgggggatggagtgggaaggtggtcttcccctgaggttgggccacccagcagatggactcttcactgacagcccctagttgaactaccccagcgtccggacgtccacgtccttcctcttctctctttttctgccatgctgccctgccactctctgccactctccaccactcttttcctctgctcttctcaatgctcagctgcttgtatctgtgcccactaaggccttgggcttatatgggcacaggatggtgggtatggtgggccaaaaggcaacttttcaggtgcaaaaacagaaatgcttgttctcgtttagggcctccagtttttaggcttgagggtggggcctttgctggggaactgccctcttctacccagtatttccctgtctgctgtccatatcagtataactaataaagactgattacatggtaatagggtttattttaatctaaactaatatacagaaaacttaatgtttcatctcattcccggtctgtcttctgaacagctgggttttcaaggactctgatgatttcctttttagttatttcagtgatccagggccagaattctcttcctgccctttcattgttcctaaaaaccattctagtttctctttagttgattcctgttttttcttaccttacctcctatctaggtttagaagggtatgagacttcagtgttgtggcacatgaggaggtaagggaattgtgaggagaaattaaatttttagagtttaaagaacaaagaagtaacttgacttgggtgaggtagaatccaaggtccagaactcatataggaaagccttcttttgcaattacataattaataagattgcttgcatttattttcagttacctttccgatgaaaagataatttttaaaaaattatttttagatgaaaacaagaaaccagtttatttggttacaaccctggataacacaatggaagacctgttaacgctggaatatgtaaaggtaagcagtttcatttatatctgcttaatatggtaagtatgctgctgaaatgttaagttttgtaagtttggtattattcagtttatttaatcttcactgtaacataatctctttgtaactcctaatactaaggttttttttattttgtcatcttgtattaaatagttgtgatttataaatacttcatatagcaaaataagaagattgtgttctaagtagaaatgacctggagtttgattttttttttctcccaacaggggtactgagaaagaaacacactttttagtcttgttagagtgtattgttttatgtgatacaagatgatgctttcactttcttttccactgttttgtgaagttacttgatattcctagggtcaataactccattccttttttattgatttatgatattcattttatcgtttgttaagcttttctatgtactatggtctatttctaatttttccatgtttctgctgacttccgtgtttctgcgtcagactattttaataattactttataataagaataatgcagaaagcatttaatcactttaaaaccatttttgctatccattattgactagatgtcttaagatttttgttgtatatgcattatatagcttttatgtagcaaaagtattctagacctaaagaaaatggataaagaaaatgtggtatatatacaaaatgaaacactattcagctttaaaaaagggggggaatcctgtcacttatgtcgacatagatgaatgtggaggacattatgctaagcaaaataagccaagcacggaaagacaaatacctcatgatcttctttatgtgtggaatctaataaaactgaacttatagaagtagagagcacagtgatggttaccagagggtagcagggatgggagggagggaaggagagggaatagagagttgtcaatcaaatggtacaaagttccagatagacaggaagaataatttttgagatctgtatacagcaggggaactgtaatcaataataatgtgttgtttattttaaaacaaccaagaaagtgaatttcaaatgtctcaccacaaagaaagataggaaagcgaggtgacagatatgttagttagcttaatttaatcatttaacattgtgtacatatatcaaaacatcacattgtcctccataagtgtatataattatgatttgtcaatcaaaaatattaaattttttaaaaagaaaaagaaaacacagagtatttggatacttggtggacaattctgtcacaaattttgtttttaaatacaggaagaattaggaagaaccgtacagagttgttgatgaccgaatgattattctccacacttgataatatccaacatttcctctcttaataataagaatgatagtacgtaacatttattgaatacttgctatgtgccagagagtccaatacttacattttcttttgttctggtgaagcggttgcttatttaggtaattatatgtgtgtgtatatgtgtatatatatatatatatatgtatatgaacagctggaaaattatataaatgtgtattaggactataatgtgattgtatatgtatgtcttcctaacgtgttctaacagatttgttttctctttggataggctgaaaagaatgtacccgacttgaaaagtacctataacaatgttttacaattgattaaggtatgagtagataatttattttttaattatgtactatttcttatggaaattattttctaactggaattgtaagatccttaaagataagaaaatattataaattatatcctttatgccacaaagcatagtgccttgtagagagctggcaagcaaatatttattgacctatcactaaaatcagctttgttctttaggtaaatttttcctctttggatattcatttacacactgaagcacttctgaatacaataaattatcttcataatatccttccgcaatcagaggaaaaatcagccccagtgtccactacagagactgaagacaaaggagatgtcattaaaaaattaggtatgttttttaaaaatttagcatcaactttttttttttttaaccatgtaggtcaataaatctagaccctgactttattattaacttcaaatattggcttcagaattctgttgcctaggttaatatctagaaggattcattatatgccaggataattttagaaaataaaggaaactactggcgaagaaaatgttgcttttgtttatcgtatataataattgtttttagtttaagattatatagtaggagtattagattaaaaaattttttttcttccacctcccagtaggaggattagatttaaattaaaatttatgcatttcatgacattattttagattagacaaatatgactaacaaaatttgagtattgtcagctgggtgcggtggcttatgcctgtgatcccagtgacccagggaggtgagcgctgtggggattgaggctcaaggatcacttgaggccaggagttcaaaactagcctgggcaacatagcaagaccctgtctccaacaaaattttaaaaattagttgggcatggtggtgtttgtctgtagacccagtttacttgggaggctgacacattagaatcactggagcccaggaattcaaggttgcagcgatctttgagctacaattgcaccactgcactccatcctgggtaacagagagagactctgtttcgaaaaaaaaaaacaaaaaagagtatcagagcatattttaaaatcagagtatagtactttcgaagcagtgaaaagttgcaattttgataatgacaagtatcacctagtaattattggttctcaaaaaattttgaaatttatagctacagtgttttagtttcaaatgtttagtttcttcttgaaacagtgttgtctatttgcttttgtttttgttagattttattgttttttagaattttcaattcagtagggaatatcataccttgctttcaactgaattgcagatcaggttttctctgatatcactatttgtggtgatatttcagttactttataagtatagtgaggtaactactaaatgtttttcctcatgttttataatatgaatttttttttgcagctttaaaactatccacaaatgaagatatcattactttgcagattttagcagaattatcgtgtttacagatctttattcaagatcagaaatgtaacatttctgaaattaagattgaaggtaataaaatttcacaaaaagcaaattaaaagacattaaatgaaagaaaaggcagtcattcttttgttcccttagggcttgattctgagatgattatgaggccttcagaaactgaaataaacgcaaagctaaggaatataattgttttagattctgatataacagctatatacaaaaaggtaagaattcttttaattaaataatagtacatcattaaataggattgtcctttaagagtggtcataggtatcatttggacatttgtcagaatttagtagtatggcttattatgtgcatgggttttggagtcaggcataattgggttcttagctctactccttagtagctgtgtgaccattagcaggttacctaatcttggactctgtttctttatttgtaaaatgaggattacagtatctcataaatgagataagtacgaataatgctgcaggaacaaagttttgggagagaacctagtaaatacctttttcactttttttttttttttttggttcatgtactctgaatcttgtaatgcattttagatacatttgagggtctgaagtctgaggaagtgagattttttataaagcttattgtcatcagcgatcactagtatcgttgttgtaataatgataagagagtcctttgaactggatgattagttgttgaaggttaggtaatttgttactggttataaaacagtgaggttcctgctgcagagttgaacaggcaacatcctacctgaagcaggcaggattatgtatttaaggaggttaaaggaatatcagatagtaggatcaggaaaaactgaagtacttgttgagtcaggaagtcagcatttggaatatgttgagaagaaaggaaatagataaatagattttgccagtaatactgtagtgatgaactgatttttatgtttaaaaaattcttatttctaatatcttcttgttatggcttatttagtgggatagaaaaacagttccaacatcaaaaagaagtgactcatagcaataaggaacaagaaattttccagaagccgtggttttatttgcttctattgcttttattttaaaaatcataagtatcagagtatttaagaaataggttatccattttattttccctatctagaaagtaaagctcacagaaataaagtatctacgaaaagttatacagaactgagagcatgatccaacccattgatttttttctctgtaattttattttattttatttttttattttttttgagacagtcttgctctatcacccaggctggagtgcagtggcgcagtcttggctcactgaaacctccacctcctgggtttcagtgattctcgtgcctcagcctcgtgagtggctgggattacaggtgcgcacaaccacacccaactaatttttatatttttagtagagacagggtttcactgtgtttggccaggctcatctcaaactcctggcctcaagtggtctgcctgtcccggcctcccaaaatgctggtattacaagcatgagccactgtgcccggcctgtaattttatttttaatatatctacaaggttaaaaattcagtttacagaaagttacaaaataaaaaaaatctttctccttgtcttcttgcacgattttcatttccctttccctgtttctttgattccattgtacatggtttttaaacaaactgccttgtttagtaactttccacgtgtcaaagaaccagagaggcataaggtttttgcccttatgaaatcagacctgattatgaatcagtttcataagccttgtacagcgatatatattattgtgccagttttaagtgtactgagacattgaggccctcaactttaagggtgggagcccccagaccatttgtttgactctgtcttggagcagcatcctccatttactgtagcaccattggacaaatactgtttttatttatatatgccataaggtaaaaaggattcttgctgacctgatagtctcatgaaaaacatatcatagtaaattagtttctgatatcttcttcataaaaaatattttgaaagtaaaggcttaaaaaaatccaatttttaatgcttaattcttggtgatgggtacacaagtctttctaattattctcaacttttctggccttgttattaggccaacacttgcttcatgaaatgagttgggaaatgctttcttcctgttttctgaaaaatttgtatagaatttgcattattccttaaatgtttgatggaattatcagtgcaaatattttttgtgtatagttgagtctgggattcactttattttattttccatatggcattcagtatccaaaggagatccacacactgcatttgattgatataccacttaagtctgttatagtttatgaatttcctttagtttcttctctgcccttgtgttagccatttgttgctatcttatttattctgtacaattttccatagcctgtatcttgctgattatgttttcatgctatttaacatgttactgtatcctgtgtttccttaaatcggtatttaaatctcagggcacagtgagattcagggtttgggagtaggggttggcaagatacttcatagttggtagtgtgtgttttcataggaggcacatagtgtgtagctgtcttttttttcttttctgttttgcactgtcttggaatattttcttttttttatgttagaagctatttgttgttatttcctgtaatttggtcttgaagtctgtgtctggagagtggccataagccaaaatagccactttctagcttgcaggcatgttggtcagatgggacatcggggaggcaacacaacaaaacaccctcgaggggtgcccaccagggaggctgacaggaagtctggaggcagtagggacgtttcttcatttattaaatgggagagttcaccagtctttatgctggtatcaccaatcattttggcttttcaaaagtttattctccagtagatttcttaggcagggctcataggaacaataatccttatttatatttgcagggtagtttgactggattttaaattcttgccttgaattttcttttctagatgatcttaaaacatattactccatgtcttatggcctagtattggtgttgacagttctgatgacagtttgactttctttcgcttctaagaactttgccattttccccagacattcagagctaatttgaagctttatgtagggactttggacaggtagacatcacagttgatggtcaggaactggtctagcaattttatgggttctcagattgagagtatctcttgttcttaggctagttagtttccgttgagaaaaatactattaagtataagcctggcagcctacattccagaagccaattggttgaaagaagtggaggcctcatcatttagtttatagatttttgcttaaaataaccactttttaacatggtgttttattaaccgtctttctgtacctgaagtctcctagaccacagcctttctgctctaaactctgtcgagcaaatctgttctgttgaactcggagaggaacagtcatatagtcctactcatgtgacatgcagaggctattcggtttattctaaactaatttaccagtatttatataattatatagatacaatttatacattaatatatatgtaaattatatatgtataaatactggtaaataaattaagaaaaaactaattatatatattatataataatatattttatatatacataaaattctctctctctctctctctctctctgtctccaatcacacaatcacagctcactgcagcctcgaccttccctggcccaggtgatcctcccacctcagcctcctgagtagctaggactgcaggtgtgtgccaccaggcccagctgatttttgtagagatggggtttcaacattttgctcaggctgccctcaaactcctgagctcaggcgatctacctgcctcggtctcccaaagtgctgtgattacagacatgagctgagccacagcgcctggcctatttgagatactatagtcagcaaaagataaaaagcccttctccacgtggaataaatagtagttaatcagtaatataaaacaatattagagagtgatatgtgctttgaaaaccaagaaagcagggtaatgtgacaggtaataattcacgtggcgtattaggattatcaagaaatgcttttttacagtagaaacatttgacagaaatctgagctgtggatttgagccctgttgaaagagctttccaggtggaggaaagagcaactataaaagccttgtagcaggaaggtgcttgctatattctgggaggttttagggccctcagtaacctttgggtagaattatttattagtttctgttttggtttagtttttactttttaaagtaagatttattgagacaatttacctatagtaaaacttacctcttttagttataattctgtgagttttgacgaacatatactgttgtgtaacttaccttcagcatatacaatgggtctgtcaaccctaaatattcactactgccctttgaggttagcccttctccccatcctagcaccttagaatcactgcactgtttttcgttcctgtagttttgcagtttccaaagtatcaaataaatggaatcatgcagttatgtagtctttcacgtttttttttcttagcatgtgagattataatttttgtctttttatgtcttgatcagcctggttaacgatgtatcgattttattgatactttgaaagaactggcatttgtttcaattgaatgttctctgtttttaattttatttatttatgctcttttaagattccttccttctgcctgctttggatttaatatgctcttcttaaggtggaagtttaaattattgatttgagaatgtctttctgttgtaagcatttgctgctataaattttcctttaagcactgctttagctgcttcctgtaagttttgatatgtcatatttttattttcattcaattcaaagtattttctaatttctcttctgactttcttttacccattgtttatttagaaatatgttatttaacttctaaatattttgagattttcagatccctttctgttactgatttctagtttaaattcattatggtcaggggagaaaccgtttcagttcgtttaaatttgttgatgtttgttttatggcccagaacatatatgattaatcttggtgaatgtttcaagtgtacttgaaattaatatgtgttttgctgggttgaatgttccatttgggcaagtaggttggtggatagaattattcaggctactgattttctgtttactggttgtgttgaagcctctgattataaccattgatttgcctgtttctcctttcagttctttaagttttttgctttgtatgttttggagatctcttgttaggtacatataaatgtgtatgaattttatgccccttttgtgattatgtgatgtgtctttttatctgtggtaactgtgcttgttctgaagtctactttggtagtaatatagccattccaggtttcttcggttaggtttgaatggtctatctttttctgtcctttagcttttaatggatgttttcttgtttaaagtgggtttctgttttttgatgcaaagtctcactgtgttgcccagggtggtcttgaactcctgtgtttaagctcgcctcagcctaagtagtaagtagctgggattatatgtgcatgccaccacatctggcttaaaatgggtttcttacagtcagtgtatatttagatctttcttttttatctaatctgacaatctcttggcttttaatttgtgtttagactattttataaaactaattattgatatgattggattgtaatctgatatctctaattgttttctgttctctaattttgtttatcctattgtattcctccttttggcctgatttttgattaattatcatttattttatggtttctctagggtttacaatgtatatatctttaatcatagtctatcttccaataatattttattgttgtacatatagtgtaagaatcttacaataccatgcttccaattcccatttcctatctttcttggtatcatcataatttgctttactttggtgcatgttgaaaactcacaatgtgtacctattgaatttggtttagtcagttttctttggagcaattagttttctaaagatgttttatatttttcttcattgcaactctttctgtaactacttcatgtagtttctgtctattgtttgtatttctctctgaaatactttctcatttcttttttttttttttgagacagagtcttgctctgtcgcccaggctggagtgcagtggtgcaatctcagctcactgcaacctctgcctccggggttcaagtgattcttctgcctcagcctcccaaatagctgagattacagatgtgtgccaccacacctggctaatttttgtatttttagtagagatggggtttcaccatgttggccaggctggtcttgaactctttgacctcaggtgattcacccacctaggccccccagagtgctgggattacaggcgtgagccaccgcatctggcactttctcattttttataatgcaggtctgccagtaatgacttctctcagttttttgggtatagatgagaagggagctgggaaaaacctttatttcaccctaatttttctgagtgacatttttgctgggttgtgttttccccctttccaactgttaaaagatgtgatttcattgttctttgttacacatacttttgatgagaaatctatgacatttcttatttttgttcctctgtacataattggtcatcttttttgactgctttcaggatttatatatggtgtgactagatgagtttaattgtgttttgatatttgtcctgtttgggcttttctgagctacttggatggatctgtctttcaatatttttcatttttttcttcaaatagtttctttgcctctgtctccctttctctcccccaccccctggctcccctgttttctcctcctccactttttccctgttcctcttcttgaattcctgaaattcttgctggatttctgtttatagtcccacagcctttggatgttctgttcaagttttttccccattgttttcttagtgccttttaattcaaataatttatcttgacctattttcaaatctactgattttgtccttggctctgatgagtgtactgacaaacccactgaaggtattttcatttatgttaccatgttttttaatctttaatatatccctttgactcttcttttttccattttctctgctataataatattcaccatctattcatgcatatgttccactagaagcctttaccatattaatcatagtaattaaaattaaaaattttagtttcaacattgatgttatagatgagtctgattctgttgattcctttattatttgcttgaattttttcccttgcttttatagggcatctcataattattgatcgaatgtcagacatcatatcatgcatagcaggagtccccaacccccgggctgtagaacggtaccggtctgtgacctgttaggaactgggccggacagcaggagttgagtggtgggcgagggagcattattgcctgagctccgcctcctgtcagatcagtgggggcattagattctcatagtagggtgaaccctattgtgaactgtgcatacgcaggatctaggttgcatgctccttgtgagaatctaaagcctgatgctctgaagtggaacaatttaatccccaagccatctccccaccctccaaccccccagccccacttttgtggaaaaattgtcttccacaaaacagctccctgttaccaaaaaggctggggaccacagatgcatagcataatagagactgaggtaaatatcatagtatttatgtctggaaacggggatgcctcttttctgctaagctattagcttggggtggggggttgagcttaggttggtttgaattccagattaatacgatttccttcactacattactgcttcagtttcctttagttgtaccttgtgcttagggtggctggaggctgtgttgctcagattttgctccgtgctgagcctttgacctttcttctactcttgtacctcagaaaattctctttccacattcttagctctttcctagatgttagaggctcctgctgcttgtttcttagtgcttgtgagcttgatgtatttggggagaaggcaaggtggtttggataggcttgttagtgttcttgtccattttcactcctagccagggctgtttctgtgagtctcagaaatggagtattcttggccatcctgcccctcctcctcatggcatctgattgatatctctcgtatttcctatgtgggattgactatccttcccttccccagcagagggagacctctaatcatctggccccaggagagttcttgttcttcccctagagttttattttattcttgtccctaggatactgtatcttcacctgtgccctgagggaaacaaggtttactgcccttcccctagtttcttatggctattgttttgagtagttgataatcttggtggtgctttgggccttttctgcagtggaggctcctcaccttttccagggtcataccaaggaaagccttctcttgtttcccacttgcacccatctcccgtctttctcaagagctcctcacgtgtgtggctctcagggattctgcatctcacattagtccacacttatcctttatcattttagctgaattattcttacctatattgtatagtatctgacatctctttctcctctctaccacaagtgagctggtgcttattttctctctctccctgaaggtacctgtttgtccttagatttttagggatctttgttgtcctgtgacctcagattgctaatggttttaagaaagttatgatatcatagtttatcgggttttttttccttttcttaaggtttggaggggccctcactccagctttgtgcaccctaggcagaagcaggactgtagacttcttttcagccctgtcttgtacctcagccttcggaggtcacttatacctctggttctggaggattctttgttctgtagttgtaactgatttgcttgttgatggctcttcagctccctgttcttgcttgcttctagcatttaggagaattgagaaagttatgagcttagtgctctgtccctcttccaaaattttttttaacattttacatctcctgttgtcgccaccatttttaactgttattgcagagcttgagatttttaaccactgtaggtaatttctggttggcaattaagatggccctttacaatctgataaggaacagaagtatagcaataggaggagactcctttgaagaatccagaaaaatctattcacatacctcaaatcaggaatagatttcagtaaggtgtagatatacagtgtttttcaaatttttgtcagtcaatcaagaaatacatggttactctcattacgaaagtatacttgcaaaatgaaaatgcatattcagatatttcctcttctccattaaaaaaaaaagaaaaaaagctggagccacacctactaccttgattttatgacccacaaaggaaattgccaccaccaatttgtaaaagtttgtagtgtaggttccaataaaccagttacagtagaattgttgcctcatttgtacttggcttgtgaatacttgggagattttctaactatgttttgttattttttactgttttatttttgtactgaaaatacatcatttcaaaaatggattgtgataattaaattttctcttattaaggctgtttatatcactggaaaagaagttttcagcttcaaaatggtttcttacatggatgcaactgctggttctgcatacacagatatgaatgtggttgacattcaggttaatttaatagttggttgcattgaagtagtttttgtcacgaaatttctatattctatattggtaagtattttattaaattattatttattttatactaattggaaattgctatatgtcaaatatggatgaagactagtaagaattccttgcttgagattttttctgattttttaaatcttctgggtaccatttattatacataataaatgtgtagttccttatttatataacatcgttttgacataggaatattctaattaattgaaatatatatttcatatagtaacattaagtttatgtgcattatatatcataaatatgttatatattaattagaaccttcgttttatatgtcattggcttaagtcttcgttttacctgacttgcaactataatttaaaaatactgaatatataattgaagtttgttttggtctgaagtcatcattaagaaaaggttattttaattttctagagacaaggtcttgctctgtcacccaggctggagtgtagtggcatgatcgtagctcattgtaaccttgaactcctggattcaagtgatcctcccgccccaacctcctgagtagctgagactacaggcacatatcaccatgcacataccaccaagctaattttttttttcttcaagtttttatagagatggggtcttactctgttgcccagtctggtcttgaactcctggcctcaagtgatcctcctgctttggcctcccaaagcgctgagattacaggcattatgtctggcccaagaaaatcatattttcgattgcattgtcattctgtgaatatcagggactttaaggagttagatttaacccctatatgactccaccctaaggcatttcggttcttatttcggcttttcttgtttcattttgtttcggtttttgtttttcccttgctgtcagctgatattttttcctgtgggtgtcacacctatctccataacatcactattcattcttttaaaatgctgtctcagtgttttagtgtatgaactaggtaatcaaatctaaggctgtagtggaataaataggccaagtgtggcaattcttataagcaagaaaagtatttgcgtgttcatttgaatgtatttgggaatgtggagccctcttttgttatttcaaaattctaagttaattccatataatgttgctgttttgtgatcttttaagccataacatcattttgtacacaaaaatgtaaagataaacaagtattccttgttgaatttcttctcttttaaaaaaaattagagttgggttcttgctctgcagcccagactggagtgcagtggcgtgctcctagctcactgcagcctcaaactcatgggcacaagcaaatcccatctcagcctcccaagtagattaaattagtagggacaacaggccctgctaattttttatttttaattttttttttaagacacgatctcgctgtattgcccaaactggtctagaactactggccccatgttatcctactacctcagcctcttaagtagctaatttatttttataaccaaaaaaatcatgtcacttgagccctcttgtacttatacttagaaattactaaaatgttaattttttctttgaacatgaaaattaggtataagagtataaatatagataattatattttatgtcattgaagtttttttttggaatttggaaattggaaaattattttgaaacttcttaaacatattttatttatttatttaccttacaaatataaataagctctctgtccactgaggttgtatagagaaatagggttgtttttcattagggaaagtgagataagggaagtagatatctgtaagacattccagtgatcccatttagctttgttctgaggactagatttttattttatctgtgtctttgtgtttctcagtttttgtggcagaaaattaagatttaatatagacagtaagattttgaataaataatgcttggttgtatcaagtaaaagtttttttttaaatggaggtaaaaccataaatatcaatatatatttaataagtcgtatttattaataaccttaagaatataattctgttatcttacaggcttttatagataattttcaggcagctaaacaagccttggctgaggcaactgttcaggcagctggaatggctgctactggtgtaaaagaactcgcacaaaggagttccagaatggcactggatattaacatcaaagccccagttgtggtcatcccgcagtctccagtttctgaaaatgtttttgttgctgattttggactaattacaatgacaaatacctttcatatgataacagagagccagagctctcccccacctgttattgatttgataacaataaagctgagtgaaatgcgactatacaggtaagcttttcacaagtatatttgtgtggaatgcaatatttttctaactttttaaagactttgatgtcttgagtagtctgtttacagtgagattttattttattaattatacataacttagtgattctctcttccttaagtatattttggcaaaatcaattatagtctttgcattttaaaaaacctagaaagtgtttgaaaatttctccttaggtaattaggaaaactataaaatttattatctgaggaagtatatttgtgcttttttgtggttcattataaattacatggctatggaaaaaatgaggaatttctaatgtaatatgtttattcactttgcaaatacattatcatcttatcttctctgtcggttgttgctgtggctctgatgctgtaatttaaacgaacatgcagtagcatacaaccttattcgttaacctgtattcgttaagcatagggttaggaattaggcggataaccaaatgttcaaatagttcgagagcttttatactgtgtcctctgtgtttctgtgctatttctaattgcccattctgaatttatgccctattttccaacttgaatccttctctatttatacttctcaactgccctcttccttctttctgtcatttttctttgatataattctcttgcttgtctcttcaccttatttttgtctcattttttacttaactaactcccattctctacttctctttagcttcctatgagtctgtctttccctcctgtgctttctttgatcaattgtatatttttaaagcagctttattgagacataattgacacagaataagttgcatatctttaatgttataccattttataagttttgatatgcatacatttctgacagtttatgtacagttgtattacttcttccttaagtattaggtagaatttaccagcgaagccatctcgtcttagagtttgcttgtgggagatttttaaatgatagttttcatttctttaataaatttggggctattcaagttattttttcttgagcgatcctccctaatttcttaaaagaatttatccatttcatctaagttgtaaaatttaatggcataaagattttcataatgctccttatttattaatatctgtaatgatgtgtcctccctcattcctgatatttataatttctgcctttgtactgatcaatctggttagcgatttatccgttttattgatcttaagcagtttttggttttatttttttttctttttttgttttctcattcattgatttctgattcaatatttattattctgcttactttaggttcaattttgctctttttataagtttttttaggtgatagctaagattattgatttgaaacatttcttcttttctaatatatgacgtgctataaattggagtactttataatattgtgctatgaattttaagttactctataagtctgtgtagctctcttctctctggtattttatcatataaactagctaccttggtttctcttggactctcagctcttatcttctctactctggggctttcctggccttcccctgggtcccccctccctgtaccatggcctgttaattatggtaaaacaatagtaaactgggacaatcgtagggctcacctcatttttttttccaactctttggaatcactatccatttttgatgtcttgtgtcttgaaaactatttttaagtcaattttgtctgtcttttttttgggggggcagggttgtttcaagcaggagtgttaaaccattcatgttactccatcctagatggaaggagaaatttctgtcacttgagcatttattaagcaccaaatctatcccaggcattgtgctaagaataagaaatataatagtgagcaatctttataagggattaataagtaatccctacctcattgggttgttgtggtaggtactgtttaataaatatagtgggctggtgcataaaatgggatcacattttgaaaaggttctagaaattaggtcaaaaggagacaaaactagaggttggaaggataatttggtaactattgcagtaattcacataagaattataggtgacttagtctaaggtaagggagtgaagtagtggagagctaaccagaatttatagtaactgatggttgaatgggtgtgggagttaaaggagaagagaaattaaaattcactttaggttacaggcttggaaatcagcgtttgatgatgatacacttcactgagataagacagaacaatgcagaaaaacccagtagaatagagatagtaattatttctctaatgggcaaagtagcctgaaagtggttgcatgacttctacatggagagatcttgaaagaaatccagaaggcagtggaatatatgtgcctaggtgatgcacataggtgatgttgtttagacttctaggtttaggagttcttagtaataatttgtgctagtcactgaagcctttggaatgagcacagtcacaaagaaagcttgtagagtgggacatatgaagaagaatgctgaggaataccagtgtttaaataattgacagaaagaggaaccctcaaaagagacgaagtaggagcagacagagagatgagaagccaggaaaatgtatttgaggcagcagtgagggtcctgctgatattgttaaccatgaattaatagtgtatcatttttttttcatgcagtacttggtattttgtatttggaatccaacagtcagttggattgagacaaaactgaattttttgccaagcaagtgtgaccgaaggtagtggaacaggattttaatgattgagaatcatgttgatggataatagagaggtgatatagtttggccatgtccccacccaaatctcatcttgaattgcagctcccataattcccacatgttgtgggagggacctggtgggagataattgaatcatgagggtggttcccccatactgttctcatgatagttaataagtctcacgaactctgatggttttaaaaggggaaacccctttgacttggctctcatcctctttttgcctgccgctgtgtaagatgtgccgctgtgtctcctttactttctgccatgcttgtgaggaaggggtccagtttcagttttctgcaaatggctagccagttttcccaacactatttattaaatagggaatcctttccccattgcttgttttttcaggtttgtcaaagatcagatggttgtagatgcgtggtgttatttctgaggcctctgttcttttccattggtctatatatccgttttggtaacagtactatgctgttttggttactgtagccttgtagtatagtttgaagtcaggtagtgtgatgcctccagctttgttctttttgcttaggattgtcttggctatacgggctcttttttggttccatatgaaatttgaagtagttttttctaattctgtgaagaaagtcagtggtagcttgatgtgaatagcattgaatctataaattactttgggcagtatggccatttaccacagtgagataccatctcacaccagttagaatggcaatcattaaaaagtcaggaaacaacagatgctggagaggatgtggagaaataggaacacttttacactgttggtgtgcgtgtaaattagtgcaaccattgtggaaaacagtgtggcgattcctcaaggatctagaaccagaaataccatttgacccagccatcccattattgggtatatacccaacggattatgaatcattctcctgtaaagacacatgcacacgtatgtttattgcaatactgttcacaatagcaaatgcttggaaccaacccaaatgctcatcaatgacagcatgaataaagaaaatgtggcacatatacaccatggaatgctatgcagccataaaaaagaatgagttcatgtcctttgttgggacatggatgaagctggaaaccatcattctcaacaaactaacacgggaacagaaaaccaaataccaccacatgttctcactcataagtgggagttgaacagtgagaacatatggacacaggagggggaacatcacacagcggggcctgttggggtgggaggcaaggggaaggatagcattaggacaaataattaatgtatgtggagcttaaaatctagatgacgggttgatgggtgcagcaaaccaccatgccacatgtgtaacaatgtaacaaacctgcacattctgcacatgtatcccagaactagtataaaaaaaattagaattatattgttttgtgctgtaaatagcttttttcttaataatatgctgtaagttttcatgtcattattttgagtgcataaatttttccaaatattcctgtttttagaaaatctaaatctgccttttgttagaaatttgattctaatatatatacagttttgctattataaataacactatattgatgattgatatctttattacatcagtacttttgtaattgtctactcatttctttgggataattcatttcctgaggatgagttcctagaaatagaattactcagttatagagtgtagccagtttttcctgaaataattttaaaataattgataattgaaaatgcagttgctgggcacgttggcttacgcctgtaaacccagcactttgggaggttgaggatggcagattgcttgagctcaggagtctgagaccagcctgggaaacacggtgaaaccccatctccacaaaaaatacaaaaattagctgtgtgtggtggcatatgcctgtcatcccagatacttatgggactgaggcaggagaatcacttgagcctggaagattgagactgcagtgacctgtgttaatgccactgcattccggcctggatgacaaaatgagactgtctcaaaaaaacaaaccaaaccccagaaaatgcagtttagttacaacttcttagaaagtgcataaagaaaaataggaattcatgtttgtgactaggttctttatacattaatccaacttgactgcaatttagcaaatatttattcattatatggcacatgccaatcatctaagtactgacaaaaagcaaagaataagatgaacatagttcctgccctcatgaagctttcattctaattaaaaatatagaggacataataaactattaaaatgcaatatattaaatgcagtgatggaaaaagtataaggtgcatgtgggagcacgtaggaaaggtgtattttatccatatattgggtagtactgataagaaaagtttttccagagaaagtaatcttttgacataacagttttctttctcatagtttgtccaaaggacagaaatttactcaaagatatatagatgaagatatagatatagatatataaaatacaagtatttattatggtgaagaattggaaaatatgaaattttaatcatagaaggttaattaaaatactagtatagccatttattctgatatggctattaaaattatatatgcatcctagcctaactgaaaaaaagaaaagaaaacctatgtgtgcagcattccctatggggcttttagattccttaacctattaccattaagcggagactgcaagcatgcaggcatatgtaagtttggtgtcactctatcattcattcattaaatggcttggtacaaggcattttgggagatccctgatgaactctcatatttctctcctattgattaaatgattgccaaaattctacagtcatggtgttatatcttagtttaaggatttgctgctaattaaaatataagtacattattgaggagtaacactttgagattgtcactttgaggtacaatgggaggcttctatggtcacattgttacttgaaggggttcaattgacctacatttttcttcattcctgagcatcagtcttacctttataagtgcttggaaaggcaaatatagttcaatttaaattgtatgtattcagctattttaactcatagaaataaaaattgcatatggtgctacttattttttataaagtaagggaatatgtgatattctgttacttacctaaatcagtgagttaaaatgtttttataatgatgtcttatataatgtttgtttacaaattacatagagatattttttttttttttcccgagacagtgttttactcttgttgcccaggctggagagcaatggcatgatcttggttcaatgcaacctccgcctcctgggttcaagtgattcttctgcctcagcctctcaagtagctgggattacaggtgcccaccaccacgcctggttactttttgtatttttagtagagatgggatttcaccatgttggccaggctgatctcgaactcctgacctcaggtgatccacccgctttggcctcccaaagtgctgggattacaagcatgagccaccactcctggcctacatagagataattcttattttaatggtttactatacaacttacaacttatatacttttgcactttttaccatattccaaaattgtatcgaaaaatacatatttttcccctttttttttttttttttttttggagacagagtcttgctctgttgaccaggctggagtgcagtggtgcgatctcggctcactgcaacctccacctcccaggttcaagcaattctcccacctcagcctcctaagaagctgggactacaggcgcatgccaccacggccagctaatttttgtatttttagtagagatggggtttcaccatgttggccaggctggtctcaaactcctaacctcaagtgatctgcccgcctcagcctctcaaaagtgctgggattacaggtgtaagctactgtgcgtagctctatttctgtataatatagaacactcagctcagtgtaagtcacccaggtttctagtgggatagaacatcactcaactcattttgacagataaaaaaaaagtctgatagatattttccctttatacccaacaaattattgatttctgctatttgcatataaaaggataaatttaagttaatctttttttaactacctgaatgtatatgaaacaatttaaaagaatgttatctctacttatagatctcgatttattaatgatgcataccaggaagtactggatctactcctgccattaaatcttgaggttgtggttgaacgaaatttatgctgggagtggtaccaggaagttccttgttttaatgtaaatgctcagctgaaaccaatggaggtaactttttttggatacttatcaatttttgttttgcttgttgaaaaatactgcttggggacataaggcatcatttgagtggaatttgtatatacataatcaccttggtcagaattgaaatagtgattatattaaactagaattcattttaaaatggtcttgatttattcttttaacaaatattactggagataaagtggcaaggaagcaatgacattgtctctgacttcatggaacttgccagtctaatgcaggggttggtggtgatggtgatctggaaggtatagtagtagttagatagtaaaaaagtaatcagacacataattaaaatagttataaattgtggtaaatttaatgaagtgaaggggtggcctgcacctccacacctgtgggtatttctagtcgggtgggatgagagactgagaaaagaaataagacacagagacaaagtatagagaaacaacagtggacccaggggaccagcactcagcacaccaaggacctgcactggcaccggcctctgagttccgtcagtttttattgattattattttcattatttcagcaaaaaggaatgtagtaggaaagcagggtggtaataaggagaaggtcagcaaaaaacgtgtgagcaaaagaatctatgtcataattaagttcaagggaaggtaccatgagtggacgtgcacgtaagccagatttatgtttctctccacccaaacatctcagtggagtaaagaataacaaagcagcattactgcaaacatgtctcgcctcccaccatagggcggtttttctcctatctcagaattgaacaaatgtacaattgggttttataccgagacattcagttaccaggggcaggcaggagacagtggccttcctctatctcaactgcaagaggctttcctcttttactaatccacctcagcacagaccctttacgagtgtcggactgggggacggtcaggtctttctcatcccacgaggccatatttcagactatcatatggggagaaaccttggacaatacccggctttcaagggcagaggtccctgcggctttccacagtgcattgtgccccaggtttattgagactagagaatggcaatgacttttaccaagtatactgcttgtaaacattttgttaacaaggcacgtcctgcacagccctagatcccttaaaccttgatttcatacaacacatgtttttgtgagctccaggttgggtcaaagtggctgggtcaaagtggctggggcaaagctacaaattaacaacatctctgcaaagtaattgtttaaagtacaggtctttttcaaaatggagtctcttatgtcttccctttctacataggcacagtaacagtctgatctctctttcttttccctacaatgaaggacacaaataataggcatggtgctgtagtcaattagatatattaatatagaatttattggaaagatctaggttagaaatactaattttggtgtcaccagcatatagatggcatttaaagccatggaaatatatgaaataatctatacaaaggaagagaaagtattagaagaattcataagttgaaaatgaaaatggcaaatgtgtcaccaccttagttttactttcttattggttgacattgcttcaaagatctctcatggaactgcccacaagttcatatttttttcccttgactggatgaaagtcaaaagtgtgtcataggctttgctgaagtgatagcaacatatgctctgggaggtttctttaagaaacctacttaacaaatccttctccccacctcacagtttccctttctatttctttctgtaaaaattttattgattatgagaaaaccatcattttagagatttcagactttttttcttttttttttttttgagatggagtctcgctctgttgcccaggctggagtgcagtggtgcaatctcagctcactgcaagctccgcctctggggttcacgccattctcctgcctcagcctcccgaatagctgggactacaggcatccgccaccgcgcccggctaattttttgtgtttgtagtagagacgggatttcaccgtgttagccaggatggtcttgatctcctgacctcgtgatccaccccccttggcctcccaaagtgctgggattacaggcgtgagccatcacgcctggccgagatttcagacttttaagtcaaacgtatattcagagcataaaacatgatggcattatgaaaatcttagtgtgtaagataataatggctgctttaacttacagggtaggagatggaagttatctttttaagataaatatttgaagtctatttatattggtaagataacagatagaaactcataaaacatatagaaacttataaaacataaatattatgttccacccaacatgctggggcagttgctatcccactgggcccagttattaggcatatttgtgtggggcagcaaagacactgctttctcatgctcttcccaggtagaatccatacagaatgtcctggtgatgctgccaacaatctgcaagtgcccagctgccttttgaggccaaccctctagggtaaagttggggcttcccttactctaattcacctgagtagttggttagctgctgttgcagctcaccccagagcccagatatttgttctctcctgggcctcatcttctgtgccagggagaggctagaattggttgtgaaatcatttagtctaatgcatccagaccaagtggagcagcttgtgatttctgacttgtcagattttcagtggttgcatacacagcctgtcctgacatgtagatactgcagatcagcagccccaggatccttacagttctttgaacttcctccactgagctcctggcaaaagtgaaggaagagtgccaattaataatcagtatttgaggtgcatgcgatagacagatactaactggaagacatggtttagaagttgtaatatttattttcatcttattatatgaactctttttgcagtgtctgctacatagttacaaactaagtgtcatgaataaagaatgaaggaatgaaagcttaaaaaaaaccccaaacattagtagtatgtataaggtacacatggacttaattttaaaacactaaattagtgtgtcatctttgaaatgcagtcaaagaaagcttggttacaagtaaaacttgttaaatattgtgggattcaaattatctccttggggtcataacagctaaaaattctttttgttgttttgacaaacttagaagtgagccaaactcaaagatcttttttacattatttctgttgtgttagggttctccagagagagagagagagagtgtgtgtgtgtttgtgtgtgtgtgtgtgtgtgtgtgtgtgtgtgtgtaaagagagggaaaagggagagacttattttaaggaattggtgtacatgattgcggatgccaccaagttcaaagtcagtctacagggtaggccagcaggaaggatatccagggaagaggtagtgttggagctcgagtctgaaggcagtctgctggcagaattcttgcttagaggaggtcagtctttttttattgaaggcctccaacttcaatacaaagcaattggatgaggtccacctacattatggagtgtaatctgatttacctagagtctagagatttaaatattaatttcatctaaaaaatattttcacggaaacattttatgtttgaccacatacctaggtactgtgactgagccaaagtgacatacaaaattaaccatcacagctattaaggcaggtcttatgctgttgatttgggactaaatttgtaacagctaggatttgaaattggctctttattttttttttttttttttgagacagagtctctgttgcccaggctggagggcagtggcgcgatctcggctcactgcactctctgcttcccaggttcaaacaattctcctgcttcagccacctgagtagctgggattacaggtgtgcactatgcctggctaatttttgtattttcggtagagtcggggtttcaccgtgttggctgggctgttctcttaactcctggcctcaagtgatctgcctgcctcagcctcccagagtgctgggcttacaggcgtgacccatcacacctggcctgaaattattagctctttgagttagttcctagtttatgtgtggacctaagcatattaaccatttagcttcagtgtcttataaatataaatatcaggattgcattagctgggcatgttggtacatgattgtaatcccagtttcttgggaggctgaggtcagaggttgagcccaggagtttgaggctgcagtgagctaggattgcaccactgcatgccagcctgggtgacagaatgagacccattcactaactacctaactaaataaatacatttcaggatcatattccatagacctaggactttttcgaggttcaaataaaatagttcatgtaaaacacattgtgaactctaaaatttttggtaaaccaaatgtatcattttttattctacatttgtaaaatgaggtgcttactaaccaaaaaaatccaaagtagacagataactactgaaagttcattttaaaggtttaaaattactatattatttggtacattaataacaaatagttctttattcataacttcattggtattaacacctaatttagttctatatttcacaagctactaaagagcacatggtcatttagaaaactgaatattcagtttgtaaaaatgtttaattggtgtggtagaggattgaaacagtctttcatttttctcctctgagaattttaactgcagttaaattctgcaatgaagtagcagtgctaaaaagaacaaatcttttttttttaacagttcattcttagtcaagaagatataacaactatttttaaaacattgcatggcaatatatggtatgaaaaagatggtagtgcctcacctgctgtaacaaaagaccaatacagtgccactagtggagttactactaatgcttcacaccattcaggaggtatgtttttaacttcaaatttctttctgctttcctctttctctcttttttcttctatcttcttccctccccttccttctgtcttttccctccttcctcccctctttctccctcctttccttctttctttccttctttttgtttagtttgggcaaaataagatttgtaaatctgtttctaatcagctaattccattcagacatctctaaattgtctatgttattagtcgttgtgttgattttttttctttgaatgaaagttcctagttctgttgtaacaaaattcctcagtatatattcatgttttcctgacttccctgtagctcctcattttccatttttctccctttcccccatcttctccctatccctagtgtggcatatatcccaaatgaatcttttatattgatattaggaatatcaaagtattagaggtgcaaagagaggatgatcattagtagatggtggagtttaacaaatatttgggagatggatggaacagagtagaaggaagcagaacttagaaagagccttcatctaatgttggatccagtgtgctctgtggaatgtggctggtttctgagctcagcaccagcgcatacagagggtcagttagtgctgggatgacattgctgcataagcataaagttctcattctggcattataggggatcctcagacctacctacctcaaaatgaaacctactagttcacaagactcacctttgcaaagccctgaggtgttacacagcatttttactcagggagaatcctaacagaaaaccagctttacatttacagcattgtaggaaaccccacccttactagctggaataatcaaactagtcctttattgttaaatatgaatggtcagatatgaagaaaattgtaaaaaccccaagcatgaatgaaattaagataaatagaatcatgttttctgaaggaaacagacaattgaggtgacagaaaaggaagtagacaaacaaaaaagaagctctgacattctaagaggattttgagaagataatataagaaatggatcccaccaccaccagctcacccaaggataggagagttgctggaaatccaaatattattgctgaaaatttgaaacaaaaacactgaacatgtaattagaagtattgagttggaatatttggttgaggcaatctcccaggacggagaataaaaaagcacagggatggaaaatgtgataaaacttaagagtgatgttttagttcagaaggtccaattccagaatgagtgttacagaagaaataattgaggaaatggaaggcaattctttaaagaagtatagtactctccttttatctgcagggaatatgttccaagacccgtcgatgcctgaaactttgggtattaccaaacctatgtttggatagtacccaaactatattttttcctatacatacatatgtatcataaagatgaatttataaattaggcacagtaagagttgaacaactaataaaatagaacaattataacaatatactgtcataaaagttacgtgaatgtggtctgtctctccaagtatcttaatattttcagacaccagttgacctgaccacaggtaattgaaagtgcaggtaagggtgagctgctgtaaactgtccagacctaagtaaatattgaaggaagctcttagctataatgaatctactgagtttccagcagattgggtaaactaagattccacatacaaacacattttcatgagatgtcagaatggtaaagctaagattttctgaagtttcagaaaaaaaaaaggctgcctgtcagggacttagaaaaaaaatgattgcatgattgatttttgttgttttttatttatcatcaataaaacatgatgaaatagaatccctggatggtagaagacaatggaggaatctattcagaattctaaggaaagtggtttttgaagctcagattctatacacagccaagccatcacccaaaatgtgaaaagaaaataattctcagatttcctgtgactcagttttcttagacttcttcatacccattcgtaaaagaaattagtttgaaagtgtatttcagaaagtcaggaaatctaggaaacagaaaaatatggggttaaaaaaacctaggcctactcaggagtgcactgaaaaggaatctccaaattatctatgtgaataggctagaaattaactggctttcattaaaaagtaaatgagaatgctttaaggaaagaaaaaaaaagccatatggaagaatgtcttatagaagaaaaatagcatgaattccacatagtatgtaggatacagagttagctatattatataactgatacagacaggaaagtgttttctgcgcttaagaaagaaatttctataccatggtgcagaagtgaagtggactaaattttgcataattttgagccattgttagaatgtgagaagagaacctcttatttttcagagatgcactcatcgtgacagtgtagcagcagaggcagtattactgtaaatctcattgaaaaatactacatggtcatagttaaacaacacatggaatacttcttatgtaaataaaaaagtaaatgttatgaactatgataacttagaagtaaagacattactaaccaaagctgtaaagaggaagatggatcaggggaaacaaatagtaaagccttaaagagtgagagaaaatgtctgcaattgatgtaacaagaaatagatgtttgaatatgtcattttaatcgttttcttctggaaatttttacacatataccaaagtagaaggaataaggtaatgaacccacatgtactcatcacccactttcactaattttttttttttttgagacagagtctcgctatgtcacccaggctggagtgtagtggtgcaatctcggctactgcaagctctgcctcccgggttcacgccattctcctgcctcagcctcctgagtagctgggactacaggtgcccaccaccacacccagctacttttttgtatttttagtagagatggggtttcactgtgttacccaggatggtctcgatctcctgacctcgtgatccccctgcctcggtctcccaaagtgctgggattacaggcgtgagccaccatgcctggcccactttcactaattaatatcatatggctactttgttactgcccacactctgctcttcccccttcttcctccagcccataagattattttaaagcaaatcccagatactataccattaattgctatttttccataagcaataaggacattactttttaaatatagtaacatcatcaccctaaatattagcagtgcttccttaagaccatgaaaatatccagttagggttcatctttctcctaaatgtctcattacaaggcctggttttttttaaataatgataaaagtgtcaattcacaaagaagatgcaacaatcctaaatgtgtgtatacctaataacagaactttaaaatatatgcagcaaaattgacagaactaaagaagaaaatacacatatacagaatcatagttggggatttgaacacaccactcttggtaaatgataagatatgaacaaaaaaatcggaaagaatatagaagatttgaacacagtcaacaaaattgacataattaatgtaatacaatgttacactcagttgcagaatacctttttgtttttaaacacttcctggaatgtttacaaagatgcaccattttgtggaccattaaattttctgaccacattggattaaattagaaggtagtaacaataggatgtgaaaaagcttgaacaatttctaaataacccatagatcaaaaagaaatgacaagggaaattaagaagttgtttgaactgaatgatcatgaaaataaaatatatcagaatttgtggaatgcaactaaaacagtggtgaaagaaatttgtaactgtagagtaagatattagaaatgaataagttttaaaatcaaagattaaatcttctaccaccagaaactagaaaaagaataggaaattaaacccaaagtaaatgaaaagaagacagtaataaaaataatagaatccaacaaaagaaaaacagagaaaatgtttaaatgtatattttttcaaaattttagatttctgttcattaaagatacagtaacaagataggagaaacccaagcctcagacttgatgtatgtatcttttatccagagtacattagcacttttataaattaatagcaactttttaaaagcaaaataatgaccaaaagatttggatacttgagagaggatgctatgtaaatgggcagtgaacacatgaaaacttgttcatataattttttttttttttcttttttgagatggagtctcgctttgtcacccaggctggagtgcagtggtgtggtctcagctcactgcaagctccgcctcccgggttcacaccattctcctgcctcagcctcccaagtagctgggattacaggtgcccgccaccatgcctggctaattttttgtacttttagtagagacgggttagccaggatggtctcgatcgcctgacctcgtgatccgcctgccttggcctcccaaagtgctgggattacaggtgtgagccaccatgcccagccgttcatataattatttatcaggaaaacttcacagttcaccagatgagataagttgtagaagactgacaacatcaaaggttgacaagaatgtggaacagctgcaattctcacatacgactgataggaatgtgaaatagtattaccactttggcaaagaatttgaaagttaatatgtacctacctttaacagagcaattccagacctaggtatctactcccaccccaccccaaaataagtgcatatatacacaaaatgactcatttaggaatacgtatagcagacttatttatagtagcccaaatctggaaacaactcaaatgttcatcaataggaggataaactatttcattccatagagtgcatgactagctataagagtgaactacttgtacatgcagcaacatggttgaatctcagaaacattattttgactgaaagaagccacacacaaaatagtacaatctgtattactccatttatatggaatttaaaaaatatacaaaattcgtctatgatgattgaaattagaatggtagagaggttgggaattggctagcaagtgttaagagggaactttctggagggatataagtgttcagtatcttaattgaagtagtgactatgtggaaatatacacttatcaaatttcatcaaatagttcatataagatacatgtatttcattgtatgtaaatttttatcacaattgaaaatacattacctggcataatggtacttttctctgaagttagatataatgagaattagaaagtgctgcgttttcattttaagctcatttaatatgtgcatataatgccttgattcaaaattcaaatgtagaaaacaaattttgaattcttctgattagtagaaaaattttaaaaatgtctcttggttttagttttttaaagtaaaatttgaatactgaattatgtgccagttactgtaatatgcattttacatgtgctattttacttaatctccaaacatactcagtgattagttctatttttccttggaacagaacagaagtaggaacagaagcatcaagaggaaatagaaacaccaagtgttcaattaatattcccaaattattatggaaagagtcctaagccagaagttactgagttttacatctgaattttctaatattttattttcttgaatgtcattttactatacctgtttaataattctattaaatctatttcaagggtattttaatgagctacttttcatgatattttcttttattaaataactttaattttttcaaggagcaactgtggtgacagctgctgtggtagaagtacattcacgtgccttactagttaagacaacactaaacataagcttcaaaactgatgatctcaccatggtgctgtatagtccaggtcctaaacaggtaagtccaggaagaaaagaaaatgtattttcacatgtgaaatttgcataggttgatgtttttaaagtaacaaatgttaatatttaacatttattttgtagtatctgtccctctgagaaaaatgatctttttactttaataataattataactatttcccttttaaatgagttatctatcatatagctaatgtgaaaaataaattgtaaaattaaagtgatatgtatatatttttagcctttcattagagcccttcggagacagaattttgatgtttgttataagcagaggcaataatttgtagtagttcatatcatgaaatacactttagacttgtgtttctttgtaattttgtgttggtttctcctttcataggcttcctttacagatgttcgtgatccttctctgaaacttgctgaatttaaattggagaatattataagtactttaaaaatgtatacagatggctcaacattttcttccttctcattaaaaaactgtattttagatgataaaagacctcatgtcaagaaagcaactcctcggtatgtattgtaatgatgttctaaggttttacttgagaaatcgttgatatattttacagaattcatctccagaattgcacgttcattttctgagtgcatcctaggttctttaaagcttcaattcagtcagctcgtagtactcggttaacatttaaaatgtcctggttctgttatgtactattcttactggataattgatagattggttgagtaactagaaataatcagtgcaattaaattggtttttacattctttaaattacattctctaatataaatctaatataagttattgttaatccatgctaattgcaatgggaagtacataaaaaattgaaaagaaaaaatatcctgagattcaaactcttataatttattgaacatacacttcctcatttatgatacatttgtgttccagaagtttgtaagtttgttatttggaacactttatggatcttcccaagagacatgacttcagaatgcttttttttgtcagtaaaagagataagaggtctttgagttttactcatatgtttgattacttctaagttactcatacataggaattgttgttattgtgttttccagaatgataggactgacagttggttttgacaaaaaagacatgatggatataaagtacaggaaagtcagagatggttgtgtgactgatgcggtctttcaagaaatgtatatttgtgcaagcgtagaatttctgcagactgttgcaaatgtctttcttgaggcctacaccacaggcactgctgtagaaaccagtgtgcaaacatggactgctaaggaagaaggttagttattggctaaaatatttaatatttgttttattgaagtgctacaacaggacttaaccttgattagccttttagatcatcaaagtaaatgctttaagaaattaaaattttatttttcagagtagaaggaaaaccttaatgtgttttcttggaggatgtatagtttgcattttttaaaggtgtcagtatatattgcatttaaaaattatgaaacctatgttagaataagtaattgtacttctcttcaggcagtaatttgaaggaatttgtctagtggaaaaaaacaagcagagcaaataatgaaccaaccataccttttcacaattaagataatatttcaatttaaagcactcatttatttttgttgtatttattcctagcttttaacgtacggtttctctattatctttttataatatgtgatttactgtggtatagtagaaagagtatcaagttgagagttagaaactagattagtttctaggctttccaattaaatagtggagatttcccctcatttaaaaatgttcttatgcctatagcttcttcaagtctttactaagggttgtagttgattcctttgggatctaagattcttttgttttactttttactattatttcattttaatattttcttataaataataaattattcataatatatagcaaatattttaatctatttttatttgttttagtacctacacaggaatcagtgaagtgggaaattaatgttattattaaaaatcctgaaattgtgtttgtagctgacatgacaaaaaatgatgctcctgctttagtcattacaacacaatgtgaaatttgctataaaggtaaccttgaaaatagtacaatgactgctgccattaaagatctccaagtgagagcctgcccgtttcttccagtcaagagaaaaggcaaaatcactactgtgagttaactatttgatcatctgcttaattgtaactattttggatgtagtgtataccattttaggaaacaaaaactacctacatgctttccaaccttgctctgtaaaatgtctttctctctgcttagagagcttaatttagaatattatttaccagctttgaaactctttcattcttccagatgctgctcattattgttagtatttgtgggaatattgtcactaagaagttgggttcatcttgacagttttcagttaagatctactttgactttctaaccatgtcaattccaaattgctctttggacttttaagactttctgccagttgtttgctgtgttgtttcaattttattgtttcaacttttttctcccgtttggatgtttttgctcaaataatgagtttttccttgtctccatgtaacttcatttgaaccttcagccatttgctttgacatacttcacattgatattttactctctagtaacctcttggccttcctcctcttcataactctacttaaaattcattcctttacagacatcttttcaagttaactggctgacttccagcgaatacttacaaaaatatttgagcttctgaaggagtaatagaagcataagtttttgtttgtttctttgtatttttttcctgatgcttggtatgcatctatagaagcataaatgttctaaacattgtcaccatagaaatataagatgtaattttgatacaatgaatacatatatattaggatataagataaactgttgcccaaatttgcaagacagttggccctccactaagcaaagagagagaatagaaaatggagggtataccaattctctcttagtttttgacttagaagttttaaatatatatttcttctattcacatcttttttggcttgaatatagctgtatgaccacactttacttcagtaaaggttggagactgtggtatttttttctgagctaccttgtgctcagataaaacttctattactgtggaagaatagaacagatattaggttctagatgtcctttatatgggataattaaggagtgtattattaagtcactttttaaatagttgtttttattaacttgtttatttgacatacctattactaggaaagtctttaaatagaaatatttttatatttaaacattaatttagtggtattgatttttctctcataggttttgcagccctgtgacttgttttatcaaactactcagaaaggtacagatccacaagtgatcgatatgtcagtaaaatccctgacactaaaggtaaattaaaatataatcatttgaatatttagtgcacttaaaaaaagtagtaaagcctagaaagttattatagcaagtcttttaattgttatgcaaacaaaataggtgtgtttttgaaaatacgtttttatgagatatttacaaagtaatattatttaatacacattttatgaatgttattctatattttattatttacatttgtgtggttaacatctaatatccctaataaatattattgaaattactttatacttcatcagtttaataatatctgcaattcatgtatattaataatatcatgtaattcatggaataatatctgcaagattcatgtaaatatctgcaagattcatgtaaacacataacaagaattatggtaatttaaaaaattttataaacaataaattgtatcttctattttgtggtagtaatgttaattcagtatttaatttctcataatatatatttaatatttcttgacgtagtatgtttgaaagtgttttgtatagacttattaatttttttccatttaggtttcaccagttattataaatactatgattaccataacttcagcactgtatacaactaaggaaaccatcccagaagaaacggcttcttctactgcacatttatgggaaaagaaggatacaaagactttaaaaatgtggtttcttgaagaatcaaatgaaactgaaaaaatagctcccacaactgaattggtacccaaaggcgagatgataaaaatgaacattgattctatttttatagttcttgaggctggaattggtcatagaacagtacctatgcttctggcaaagtcacgtttttcaggggaaggcaaaaactggagttccctaataaatctgcactgtcagcttgagctagaagtaagcatatttttccagttttataacagataatgatacgtatggaatattatgacagataatgatacatatggaatattatggaatcttgtgtagctatttaagcttattgtaaatatgatattgggtcaaaaacttttagaaaaaagttttcaaattttgcccttgaataattgcttttatgtatacattccttttacttttaaagtacatgtccacattaagtttatatttcaactgattttatcaacttaaagataatatattattcgacagttgttgattagattcagaatattttttttaaagagttaaattgaggccaggcccagtggctcacctgtaatcccagcacgttgggaggccaaagcagaaggatcgcttgagcccaggagttcaagatcagcctgggcaacatggtgaaaccttgtctctactaaaaatacaaaaaattagccagtggtggtggctcacacctgtagtcttagttattcgagagactgaggtggacgatcacttgagaatacctgggaagtcgaggctgtggtgagctgagatcttaccactgcactccagcctggggttcaaagtgagacccagactcaaaaaaaaaaaaaagaaaagaaaagagttaaagttgaatacccttttttttttaaggatatagacagaatttctgaatatgtggataataatctcttctaatagaaatatgaagaattagaaatatatgccttatacttttatgtaatgtagaatcaaggaaagatgcttaaaaaggggttttatctggactaaattgtgaagagcgaatatgtactatgaagttagccaggtgaggaaaatgctgagggagtgcttataggaagctactgaatggcatgtagactggtttttatatagaagaaataacagggctaaaaaacatggtgggaaacaggatggaagatcatttttaatttaaaaaattctctctgtaggtgcattattataatgaaatgtttggtgtatgggagcctttgcttgaacccttagaaattgatcagactgaggattttagaccatggaatcttggtatcaaggtatatctatatatgtctatgtgtgtatatatatatatatgtattttaaaagactttatttttttaagaacagatttaggttcacagcaaaattgagaagaaggaacagagatttcccgtataccacctacttctgcacatgtatagcctccccctttattaacattccctcatcaacgtatatttgaagactgaaaaaattttccaaaattgagaatgtttataccacactcgacactttattttaatcacaacaaggttcaggttgtctcatcatgagccttgcccacatgcttccttgtttgccctctgaatataattttcaaatctaaggccaatgttgcctatgcttctaatacaattatgtaacaagtattatgttacttgttacataatttagaacaatttagaacataatttagaacacagtttagacattgttctaaatattttaatccttacaacaactcttggaggtagatacagtttttatttaacatgtgaagggactgagaccagggaggttaagagacttcttgaagtaataatagctacaaagtggaaaagatgggatgcaaatccagctgcagaggcgttaaatccactctaaaccactatgctataatgcctgtgtcatcatcttgtaggttgttgtctatcctgagtttccttcatcctttggatgtttgcatgtgtgcaggaatgtatattatttgtttgaaatatattgtggatttatataatcatgagaatcggggcctttaggtggatgaaattttgcttctgaagcaagagactgcagaattactcacgtgtttcctacctaataatgacttggtcaacctgcagacagattttcagtggcttaaagccagttaaagtaacaacagaggtgactagcttagcatgttgagctcttttcatattagatcacttaattttattttccagatattttagatgaaggatatgaaaaggaattccttggtggtttttaggttagaatacacatggtcagcagatctgtgactcctaaaaaatggtaaagggtattgattcttatgagctctaggtttataacactgttctgctactattgtctgcctttgtaagtctctaggtttctgttctttattattagcatgaccaatacattaagttacttttttctgtctgagtttttatgttgctttgaagtatgtgcttttatattcagatcccgggtacacatagtaattttaggtttttatttttccttctaaattgtgtctgccattttactatcactgatgatgacatgatttattttctctaatacttctgtcctttatgaccttagttggctgatgtccaagtaatttcaataaggcaatagaacttactgaaattagaaaagataaaatgtactgacctttctaatgttggtattgggatttgtctagttatgttgtgttcttagaatttttccttatatttctatgatttatcattttagatgaaaaagaaagcaaaaatggccattgttgagtcagatcctgaagaagaaaactacaaagtgccagaatataaaactgtcatcagtttccattcaaaagaccaattaaacattacattatccaaatgtggtcttgtaatgttaaacaatttagtcaaggtaagaaaagaaatttgaaactttaaatattgagatacttgtctgattgatctgtctgttgaataagaagtttaataacttagttgtcatttgtcctttactgttctccttgtcatttaattttacacatttcattttatttagcataactctttcttattaggcatttacagaagctgccactggatcttcagctgacttcgtaaaggatctagcaccatttatgattttaaattcccttggacttactatttctgtttcgccaagtgattcttttagtgtactcaacattcctatggcaaaatcatatgtattgaaaaatggagaaagtttaagtatggattatatccgaaccaaggacaatgatcatttcaatgcaatgaccagcctaagcagcaaactcttcttcattcttcttagtaagtagttgaaaaattaccttcctggggctattttgttttaaattacaatttacatgttattttactcttttgtagaatcttagcaaggttttttttgtttttgtttttgtttttttaaaatatcctttctaataggtcaagaactgttttttgtctttgcagtgtcttggttactattgttactaaaactttgtattccaaactctttctttatcctctgcattatttagagcatggcaatttactgctttgttgttgggaggaaaaatattagatctcgccctcattctgcttttatagaccgtggatgtttagatgtttgtgggggttcttttattcacatttggtatccgttgatagtattccaccagttttgcaactgaaagaattctaagtgtgaattcatgcagatggcaatttttaatggctttaggatttataaatggtttttttttttttatgttctgcctgttgagatgaaggttttttcctttgtcttttctgcttcccaaaagtttttcatttttattggaggtgaaatatatacattcttaaagtatcataatatgtagtcattgtgaagttaaatagtcccagagcctcacctacaccactttttgatactctggcatttaagtaattattgaggagggcatcatttaaaagattaattagacataggggggtaggctactaaaatagcttgtgtttctagttagaaaataacatgtaacaggtgtttcaggtgttgtcatagcgttgtaattaatgttcttataaattttacgtctttttttttaacatttttatggatgggatggtaaatgaaatttatgcaagtaagtaattttatccccaatacaacatgtgttttaggtaaatatatataaaattttatttaatcaagtccaagatataaaggaaaagtgacacaagttgttggaaaaattaaaaacaaaaattgtagtcaccttgatatttaccaatgtctaccaaaaggtattatgctctggttattctgacagcaaaccagagatcagtattcttgtattttatagtacttgctctcattactcatttttgaaacgtttgctattgttgtcttgggttaaactcctgaatgggagttttttaattaatgctgtggaaatatatgctggcttcttaaaatatcccttttatggactatatccaaagactctagtgactattatttataagtttaagaatcatctgaaatttctaatatgtaacatatgtaaaattaatatgtaatgaattataataaaaacttttaaacatacttacttaatttagcacctgttaaccattctactgctgataagattcctttaacaaaagtgggacgacgtctgtacactgtaagacacagagagtctggcgttgaaagatctattgtttgtcaaattgatacagtagaaggaagtaagaaggtcacaattcgctccccagtgcaggtatgaaatgatcaattttgggggatgtcctgttatgcatatctgtgtgctaataaaattaaaaacaacaacaacaaattattactgaaagaatataaaccgtaacagtaatacagctgatatcaaaaagaagactcactaccaccagttgcgctacttggttatgacgggtggtaggaatttgttcaatatacttcttataattttttaataggaatattttgtaaaatcttcttacggtattttttataaatagtcatcagtgttttgctttaggtctttgtaatgtatttatatcctttctatttgattagataatttttagagaaataaaaaaattttacagctttattgaggtatgtacaataaactgcatatatttaaagttgatgacttttgacacaaaaatgcacctttgaaactgtcatcacagtcacggtaatgaacatatttatttcttagaaaaattttctgtttccccactttcccattcccaggcatccactgatctgtcctcattgtacattagttatatggcctaggattttacataagtggaatacagtacagatggagtttgactttcattcagaaaaattttgtatgtatgtgtcaacttatgtgtatccatgttattacatgcagttacttgttgttgctcagtagtaatctattatatgtatatgccgcatagccattttgagtgaacctttgtatacagtgtgaagttaagaattgaggttttgctttttttttcaccatatggattttttttccagaggattttaggtccttctcatttttatataaatttgagaatcagattatcaattttataaaaaatctggataaaattggcttgtcctttaatttttaaattctgattactcattgatagtatttagaaatacaggttatattaacctctacttgcagatttaactagacttacatattctagtagatttgtgtagatttagatagttatgatagctgcaaatgaagacatttttactttttctttttcaatctggatgtgttttattttatcttgtttatattgcctatcacactggctagaatacaattcgagtagaagtggtgagagcatgtttttgccttgtccattctttcacctttaaacatgatttgtgttgttttgtagatgccttttcttaggttgtaaacgttcccttctattcctagtgtgctgagagtttttatcagagttgattttggattttgtcagatgctttttctgtacaagaggaggatatattttttaatttgttagtatgatgaattacattcactgattctttttaaatattagatcaaccttgcattcctaggattaatctcacataatcatgacgtcttactaaccttttagtatattgttggattttgcatttatattcatgagggatattggtctagagtttcaatgtctgtctttctgtctttcttttcttgaatcttgctctgtgtccaggctggagggcagtggtgccatcatggctcactggagccgcatctcctgggtttaagcaatcctcctatctcaacctcccgagcagcaaggactgtaggtgcacaccaccacacctattctcccatcttgctccgcctctcattgtttaactttttaactcattaaagcagcagtacccaacctttttgacaccagggacctgtttcatggaagacaatttttccacgggtggggggctggggcatatagtctcaggattcctttcttaggaatagaaagctccacccatgtgtgttcccatcccctgcagggacaccaagttaacaactatctacacagaaaaaacaccttcataagaaccaaaaatcaggcaagtactcacagtacctggatttaaccacagatcatcaggcattagttaaattctcataaggagcatgcaacctagatcccttgcatgcgcagttcacgctcctatgagaatctaatgctctggctgatctgacaggaggcagagctcaggtggtaatgctctcaagcctgctgcttgcttcctgccgtgcagcccacttcttaacaggccacagaccggtacagcccatggctcaagggctggggacccatgcattaaagtatatttaacgtggggtttctgtagccaccatgtagttagaccttgttttttttttttttttttaacataatctgaaaatctgtgccttttaacagggataattaaaccacttatatttaaagttgttgttgatatggttgggcttaaacttgctattttttttttctatttgtctcatttgttctttgcttccatcttccctttgttttctctttttttttattaattgagcatttttgttatggattcattttatttccttgttggcttattggctgtatctctttatacttccttgtctttttgttgttgttgttgatactttagggctttattacatacatattgtattagtctaccttcaagtagtattttgccccttcacatacagaatcaaaactttagaccagtatacttccacttctcatctcccacattcgtataattatgttcatacatttttgtgtctatgtatgctagccaccccataatacaagttactatttttcttaaatgaattatttatgttttaaataggtttaaaatacaaactgtatttgatatttattatcactttttcttctttcagtaatctcacagtgtggatctgctggtgatgaattctttcagttttttcacatatatgtattacagatattttcactgggcatagaaatctagattggcagggtttttccccccatactttaaaaatgttgttctgctgtctgctgtattgcattgtttctgatcagaagtctgctttttttcctatatttgcttttctacaaaatgtgtcaatcttttcttcagcagcttttgagattttttttctttatcattggttttgagcaatttggttatgatgaatcttactgtagttttttttatgttccttgtatttggggtttactgaccttaaaaatgtggatttatagttttgatcaactttagaaaactttttgccattgtttctaaaattttttctgtctttgccctctcttctctcctttaggtaccagttagatatacgttagggtgtttgaacttgccccacagctcagtaatgctctgttcatttttacttttagctttttcctcgtttcttttttcatagtttctcttgctgtgtcttcaatttcccttctctttttcagtggccaatctgctattgaccccatctgatatatttttctcaatagtagtctggatttttttgtttttttattttccattgtctctttttaacatccttagtcttctaactttttagtgatattggatataattttaataaatgttttaatgtccttgtctaccaattctattacatgtcatttctggtttgttttattgatgtttcttttcattatggtaattttttcattcctttaatgtacctgataattttttattggttacctaaaactactgtatatatcagaaccagacttcattcttcctgtttcttttagacggatctttactgagccttagataatctacacatgtcctgatcattactcagctgaagttttgacagggaggggacactcagttttccagaattctgtccgtacagctcttgcctctccatgcaggtctctcccctcaagtacaacatgctgtgaatttcagtcacgttggcttccccagattttcagatcttgtctcttcaacttggctgcctgctcctcacacagcagactagaaactcactctccagacagcaagctgggtagtcatagggcttatgtagtttttttgtttttgtttttcccttgtgccgcctcttgccccgtatcggaaactgtggtttgatgtttgttgtttttcttcctgctttttagttgattagggtgggaagctatatctggtccccgttattctagcatggctgaaaacagatatcccttctctttcactttttatttagttaactattttaaaaggtgactaacagctgcactcattactgctgattattttgccatttaaatagttgaacatgaattttgaatttcttacaggtactatgtgtagaaatatttctgttgcttcaaatgtatagagcaaatagtttttctagaattaaaaatatagtacagttaagattattcatttatgaaattcttagttctcatgttttatatgctgctatgaagtttttaaagtagattttggtaagatatagaaagattataagataattgttttactaaacaacttgttattatctattccaaagataaatatgagtatttggaggttttctgatattattattattattattatatattaatcagaataatacatttttgcctgaccattatttgctacttactggatgagataatcttcatacttttctctctaaagaaaattgcaacaattcagtcacctcttcaggctccaattctaattctagttctcttgctatatccaccatatctgcagtgacttgctccattgaagtcctgaattcctcaaagtcgtccatgagggttggaaccagctgttaattttgatattttgacctgttctcatgtatcacaaatgttattaatggcgtctagatgatgaatcctttccagaaggttttcaatttactttgcccagatccatcagaggaatcactatctatgggagctgttgccttaaaaaatgtatttcttaaataatgagactaatattatttaagtcaaatatacaatgttacatataatattaagaagttgaaattactccttgatcaatttgctacagaatagatgttgtgttagcaggcatgaaagcaacattaagctcctgtacatctccatcagaactccagtgacaatgtgcatggccaatgagcagtagcattttgaaaggattttttttccctgagaataggtctcagtagtgggctttaaaaattcagtgaaccatgctgtaaacagatgtgctttcaaagtcagtctttgtttttccatttatagagcacagagtagagttagcatattcttaaaggccctgggattttcataatggtaaaagaacattggctaacttcaggtcactagcttcattatccctttaagaagagattcagactgtccttcgaagctttgaagctaagcattgacttcccttctctagctatgagagtcctaaatgtcatcttcttgcaacagaaggctgttttgtctagtttggaaatctgttgtttagtgtagccatcttcatcaatgatcttagctagaccttctggataacttgctgcagccacttgccacttcatcttgcacttgtgtgttatgcaggtggtttcttcccttaaacctcgtgaacaaacgtctgcttccaactttttttctgcaacttgctcatgtctctcagccttcatacaattgaagagagttagggcctatcttaggagaatgttatagctggtttgatcttctatcctgtattaggccgttttcatactgctgtaaagaactgcccaggacttagtaatttataaaggaaagaggtttaattaactcatagtgcagcatggctggagagacctcaggaaacttacaatcatggcagaaggcaaatgggaagcaaggcactttcttcacaaggcagcaggaaggagaagtgaatgcaggaagaactaccacacacttacaagaccatcagatctcgtgagaactcattcaccatcacgagaacagcatgcaggaaactgtccccatgatccagttacctccacctggtttctcccttgacacatggggattgtggggattacaattcaagatgagatttgggtgggggacctagccaaactgtatcatatccagaccactagagtattcttcctgtcagcaataaggctgtttcactttcttatcatttgtgtgttcactgggttaggacttttaattttattcaaaaacttttcctttgcattcacaacttggctgtttgatgcaagaggcctaccttttagcctatctctggttttgacatgcacttcttaacattaatcatttctagcttttgcttttgatttaaaagtgacagacatgtgcctcttctttttatttgaaagaggccattggagggttattaattgtcctaatttcagtattgttgtgtttcagagaatagggaggtccgaagaagagggagaaagtggggagaatgtccaatttgtggagcagtgagaacacacacatttattgattataacacatatagttaaaatgaaaagattgaaatattgtgagagttaccaaaatatgacagtgaggcacttagtgagcacatgctgttagaaaaatggcaccaatagacttgcttgatgcagggttgccacaaacctttaatttgtaaaaaatgaaatatctgcaattcacaataaagcaaaacattataaaacaaggtatgtgtatatatgaatttactacttttgatagtcaggagaaatggtattattcaaaataaaatttgcccacagttacacagctagtaatcagcactgccagtatttatctcaggtttttttcagtttaacatctatgttcatcctgctatcatattgctgttgtgtagtcataaactttaggaattgttccagcaggatagcttaccagcttacctgcaacacgcttctgtttctttcttacctttgtagtttttgagacacagggtcttgctctatcgcccaggagtgcagtggcatgatcagtgctcactgcaaccttgacctcccaggctcaataatcctctcacctcagcctctgcagtagctcggactacatgtctgcaccaccatacctggctaatcttttaatattttgtagagacagggtctcactatattgcctaggctgctcttgaactcctgaggtcaagtgatcctcctgcatcagcctcccaaagtgctggaattataataggtgtgagccactgcgcccacccacttttatacagacggatgcttccttttcctctgctcccttagacttttcaagcttatgctcattccgttttccagacttttgatctttccttgaaatttcaactactagttattctcagcttccaaccaactttttccgcactaaatttgaaagggaaaacaaaggaagcaatatcagactttggtaactaacttcacattccaaacaggcaccatttagaagcatgtgtttcttaataggctccatttacatcagtgataagttgaatgtgaagtttatttggaattatatttataatcagaaaatatgttggaaaacttgcagttaatgtctgttgtggaatgctctggatgttggttattggtttgatagtggactttgaagtttattgtaatacagatgtctccatccacaccatggaatttaaaaaatatagacatttaaaaatgtttccctcaaattaaaaaaaaaaatacatgaagttgaagtcagctgttttgtttccctcttagtccacattccctccttccttcttccttgaggtaatatcaatttggtgatacgttgtgtatatttccagtaccatattttaaaaactattattcctgtccagaaaatatatacttgtgtttttagtgtcttacagaaatgttacactgttcaccttgttttgctatgttctgttttcattcagatattcgaagtgtaaccatatactgatatataggtcattattttaatgatgttacatgattatatggatttgaagaaaattttcttatttttctattattgagattgttttcattttcatttttttttataatgaaagtggtgtggtgaacatcagtgtcttgaatgaatgtagtgaacctgaatgaatacacatgtgtaaacatttctctaggtatggaactaggagcagaattcctaagaagaaagtacattttcatttttactaagtttttgctgaattattcttcaaagttattttatcaatttacattctaccagtagtgtatgtgagttcctgttcacatcattttcaactgttgatatcaccatacttctgattttttttgcagtttgttggtattaaaagatactccatgaatataatttgtattttcttgattactaggaatgtcaagtatcttttcatctgtttattggtcagtttttccattctgtgaatcatgtttacattctgttcctgttttcctcttgattgcaacttttttaatgatttttaggctttttgagtgtggtggttataaaccctttgtcaagtatattacagatatttcccagcctgtagattgtcacttttatcatataaatatttaaaattttgatttttttctgtgaatttttttctactatttttatctaaacaaaaacttatctttaaacaaattagtccctatcctaaaatcaaaaagatattatcttattcccctgtaggatgcttaaagtctgtttttgagattcctattatataaaactatagagatttttcttgtatgttttaggataaataatatgtttgtttcttttctaatttatataagcaagatgaatattgcctgatagttcctttgttaagatagttacatggacatattttttttacacatctttagattcttagattaatgatactaaatattatttgtttttctttcccagataagaaatcatttttcagtcccactgtctgtttacgaaggggataccttattgggaactgcctcacctgaaaatgaattcaacataccattaggatcttaccggtattttgtctttatcattttatttactctaaaatctcttgtagaatttttagtttctgatttcacatggataactttgatcaaatccatcctgctaatagcttatctaacgtatttaggtttcagtgcacttagatcttaaaaaagaagtattatttaatttattgtaataacttataccaagcacactatatatgcttttctcttaaatataattatattttgattgcaatataaccgtcataagcatagtcatatgattatgagttttaaaaatgtctaatagatcatgcctggtggtttctgaatttatatatactattatgaagtaatttgtacttctcaaaggttttataatacaatttttttgaaattcctttagtaaacaatattttatccttttcttttcatatttgttcattgttcagggttggagttgtaatataaatagaagtatatactatattaattttaaatttttaaagtaattaaatttgatacaatatgttttaagaaaatattaaaattataacaaaatatgagctagtcttatagattttatatcataacaagtaagtattagtcaagatatgtaatctggaattgaaaataatctcttatgtggaaattgaaccttattggagaataaaactgttctcagaattaagcattgtagtttgtttaaataccattttagaatacacactagaaataggtacttacctcaatgctacagaaggacagaggcaaaactgcaaacagtgcttacctgttctcttgtccagaagttcagaatgggatcctcaatgctccgaagacaatctagcagttttaggcacctattttcacatagatcgacctgctaaacctaaagagtgttttattgcttagttcagacttgctgagggaaagaattgtattgttgagagaacaacaaaatagtcatttacagtatctgaccttgctctagagaggatttggggtgggttacaagactagattaaatatggcatgtaagatatatttaaaaatttctgtgaagaactttcattttcttcttggataataaaagttaatgatattctactttttaatacatttctgctatatattttgtatctctgtccatagtagagaaaacagtacctttatactttttccaaggctgaatattaatttgttacatgatagttaatccatcttaatgagaattagtagtgattaattcatcttaatgagaattgttactgactaagtacttcatcttaagtagaattattagtgactaaccagcttggatttctcattaggcattttttttttttttttttttttgagatggagtttcgctcttgttgcccaggctggagtgcaatggcgggatctcagctcccaggttcaagcgagtctcctgcctcagcctcctaagtagctgggattacaggcatgtgccaccatgcgcagctaattttgtatttttagcagagacagggtttgtccattttggtcaggctggtctcgaactcataatctaggtattcttttaatctagtacttcagtataggtgcacttatatttaagatgtgaggttttaaattaacaaatggctatctttctctattctatttctattcttagattaatgatacagataaatatagatgcagataaacacaggaaaacaatttatattttattaaaatatttaagtagaatttaaatatactgattcttttattcatttaacaaatatttatcaaggttttctgtgggtgagacactcaataccaagatgaattgcatgtggctattgccatcaaaagatggatatattacataaatgtataaagtaggaaacagtgggttatagagagttatagaaagtgttagagttgccaaaaactgtggaaaacataaaagggattaatgactgactcctgggcaagatacatgaagtacggtaacatctgtaatatagtaatatggagattagaaggaaaaggctatctaagaggaaggcatgcatgaacaaagataaggaagcatgaaagcatagtgttaaaaggaatagttgggaatttgttggaatgtagagtgcatgttggaagataaaatttgaaagataagttcacagttagatggttgctccctcattttcttgctccatttttataaattttatctccatctattagtttgatctgtttttttcttcttgtctcagataatttgatgttctgtttcaagaccattcacactaccatatcttctcatttaaaacctcctgtcattgattatctttctttcctgttttccttattcattccttgaactttcctttgacgttttatatttctcttactcagattttctcttcagaacaccctttttgggaaaattgtcacttggcaaataccttgcagtctgtctagaaagagccaaccactctgccctcagtctactctaaacatatgttttttggtacctatcacaatgcagtagttatcttttaacattttaacatttcccacctgattatgatcttactcatttgtttgttttcaattttgccttcttgttggtacataataggtccaataaatgttttgataaactggataagtgtattacgattagtttaatttggaaaaaattaaggttttgtctttaagtattagaagtaagagtggaaaatagaatgaaaattatagaaggaatgtagaagtagaataggctatatctgttaactgttttgacaaataatttatatgcttcagtcaggtaagaaggaagtctaattgtttcacagtccagggtgccagtagctggaagtcactgaaaaaggacatgcagaaaagtgggtagagtgggttcagtgttcagtctagcaaatttaaggtgccatcagaaattactacagaaatacatcatagatatttgacattttaggagtagagcttaggaaaataatcagggttgaagatagttttgaccattgttcatctataaaggacagtgttgtctcataactatagctaattagttttacaaatataaaaatatttatgaaatgtttattcttggctacagtgtgggttcaaaaattaagtataaaatattgctgaaatgtaaacaatgtaatattcaaatataaagattaaccatgtgacaaccaataattttgtcaccattttcttaaaactactcttctgcaatggcaaaaaaatccaaaattgacaaatgggatctaattaaactaaagagcttctgcacagcaaaagaaactatcatcagagggaacaggtaacctgcagaatggggagaaatttttgcagtctatccatctgacaaaggactaatatccagaatctacaaagaactgaaaaaaatttacaagaaaaaaacaacccatcaaaaagtaggtgaaggatatgaatagacacttctcaaaagaagacatttatgtggccaacaaatgtatgaaaaaaagctcatcattactggtcattagagaaatgcaaatcaaaacaacaacaagataccatctcacgccagttagaatggcaatcgttaaaaagtcaggacacaacagatgttggagaggatgtggagaaataggaatgcttttacacttttggtggtagtgtaaattagttcaagcattgtggaagacaatgtggtgattcctcaaggatctagaaccagaaataccatttgacccagcaatcccattactgggtatatacccaaagaactataataaatcattgtactataaagacagatacacacatatgtttattgcagcactgttcacaatagcaaagacttggaaccaacccaaatgcccatcaatgatagactggataaaggaaatgtggcacgtatacagcatgaaatactacgcagccatagaaaagaatgagttcatgtcctttgcagggacatgggtgaagctggaaaccattctcagcaaactagcacaggaacaaaaaaccaaacaccgcatgttctcactcataagtgggagttgaacaaggagaacacatggacacagggaggggaacatcactccctggggcctgttgtggggtgaggcgctaggggagggagagcattaggagaaatacctaatgtagatgatcgattgatggctgcagcaaaccactatggcatgtgtatacctctgtaacaaacctgcactttctgcatatgtatcccagaacctaaagtataattaaaacaaaaacactaaagcagaaaaaaaaataataaagtaaaatatcatactgatgtttaaaaaaaaacagcactgttccgcatctattgactacgttttaataacattaaatattgattgaaaactttcatttgattaatgttggaaagcttgcgattattttttcaatagtaattttttttagtttatgaattcagtcatggcatttatttccttttaggcccatgtatccagaaaagccaaattctttcagttatatatgcaagtcacagatgattctatgtggttttctttgcatatataactgatacgattcatgtatttttatatgaaaccatttataagtgtacttttaagatagtaagtttgtaagaaaaatattctcctcttaaaagtcaaacaacttgatgagcttccagaaagttaagatgatatctatttatctatcttttttttttttttttttttttgaggctctgtcgcccaggctggagtgcagtggcgcaatctcggctcactgtaagctctgcctcccgggttctctccattctcctgcctcagcctcctgagtagctgggactacaggcgcccatcaccatgcccggctaatttttttgtatttttagtagagacggggtttcaccgtcttagccaggatggtctcaatctcctgacctcgtgatacgcccgtctcggcctcccaaagtgctgggattacaggcatgagccaccgcgcctggccttatctatcttacttatatcgtaaaaagtatatgaaaatataaaaatgtactacaatattatgaaaggaggtaagtttgttattctaaagctgtaattatatagtttaatatgttttcctttaaaacattttaaactgtatcatttaatctcatgcagatcattcatttttctgaagccagaagatgagaactatcaaatgtgtgaaggaattgactttgaagagattataaaaaatgatggtgctcttctaaagaagaaatgtagatctaaaaacccttctaaggaatcatttctcattaatattgttccagaaaaagataatttaacatctctatcagtgtattcagaagatggttgggatttaccatacataatgcatttgtggccacctatcctgctccgaaatcttcttccttacaaaattgcttattatatagaggtatcggcaaactgatttagtgccttcctgtttttgattttgtagtttcagttttttaagattaagatcaataaaaactattttaaagatctaataaaaattagaatactagtaaagaataggtaatgcagatattcttttgcaacaagtatgagaattattattgaaataacatttaagaactagacttcagtgacaaaaaagcatgctacattatgttgtattcttttagtgctgattttcttaaaagattgtatactttgtgaagttgctttttttctttcatactctgtgtggtttcttcctgttgttataggaatccatacatcttaagattttatgtaaatatttcatttgcagtgcttatcaaatggaagaaagtagttcttcattgtcatctattataggtttattttacttttagaattaccatttgctttttaaaaaaatttttttgagactaggtttctctctgttgctcagactggagtgcaatgatgcgatcatagctcactgtagtctcaaacttctaggctcaagtgatccttccacctcagccccccgagtagctgggactacaggtgcatgccatgcctggataatattttttaatttttaattttgtagggacagggactcactatggcttgtcttgaactcttgggctcaagtgatcctcccgcttcggcctcccaaagtgctggaattacaggcatgagccagtacacccagccgtttacacttttctgatacatgtctcttttggaggaaaaagttaacatatttatggttttaaatgtgtatttccatattgaataacaaattatcatagtggttaagaatttgtactttgctgtcaggtagatttgaaattgcatcctagctctgtcatttgctagctgtatgttcttaagcaggctttattgcttttctaaatcttttgctgtggtctgtaaaatgagaataataataaaatttgcttggttaagacatgggggaaatcaaattagattgtgtatgtaaaggatttggtacagtgcctcccagacacagggttgccatttatttatcactctagcactaccaccaccattgttattttgtggaatattatttaacttgtaaagaatcaagaactccttacttttgctttaattaatttaaaatcatgagatgaagagattcctatattataataataggaaaagaataggatagagatgctggaaaaactggtgagatattcagatgtactgtcaatttatatttctgttctcatagaacttttaattggatgctgttagtgatcacattctgtctgccagtttccaaagggtgtgatcagtttttagaaagacaattgagccatggtgtggggaagggactagaggggacaagagcggttaggggactcttaaactgagacgtcatatagtgacatgaactaagataatagaagggagggtcgagggaaatgagcagtttggagagatacatatgacgtaataatataaacagtgattggaaatgggtgatgagggattgtggaggtagtagggattacttattttggattaccatcagtttttgcccacattttacgttgttttgtagttttcaaaataaaaatcacgagtggttaagattgtctttttgtcgttgttttaccaattatagtgttttatgtttataatttccaggggagtttcccattatgttatttaatcttcacagtttgtcctttgaagtaagtcatttagaccattttacaaatacagtagctcaaatctcagattaaataccgtgtagaggtttacacagttgacaaagttagaacttgaatgtaagtcttctgacttgttctgataggtatttcaaaagcattttttgcagcatttggaatacataaatagaattttgaggcatattattctgcaacattttaaattttgttttgttttttttttttttattacagggaattgaaaattcggtttttactctaagtgaaggacattcagcccagatttgtactgcacagttgggtaaagccaggctacatttaaaattacttgactatctcaatcacgattggaaaagtgaatatcacataaagcctaatcagcaagacattagttttgtcagttttacttgtgttacagaaatggaaaagactgatttagatattgctgtccatatgacttacaatactggtcagacagttgtggcatttcatagtccttattggatggtcaataaaactggccgcatgttacagtacaaagcagacggaattcatcgaaagcatccacctaattataaaaagccagttctcttttcttttcagccaaatcacttttttaataacaataaggtatgcgatgtttattctgtttttcccttgtctttagctacttgtcactttttagtttttaaagttctgagtaataaatattatgaaacttggatagaaataacttgttaaatatttgaggccaaaaagattagaatttaatattataaaggtttagtgcattaacaatataatattttgtttatgctaaaaagtaatttatcagtttaagcaggaatttttaaaggtacctaaattgtgatgtatttggaatatttttttcctaggttcaacttatggtaactgatagtgagttgtccaatcagttttcaattgatactgttggtagtcatggagctgttaaatgtaaaggcctgaaaatggactatcaagtgagttcattctatgcttatcaagaaacttttattttaaatgtttctattaactacttaattaaattttataaagatgttatacataacagtttttgagctgttaatttttttttcttaggttggtgtcactatagacctgagcagttttaacattactagaattgtgacatttacccctttttatatgattaaaaacaaaagcaaataccatatatcagtggctgaagaaggaaatgataaatggctctctcttgatttggagcaggtgggtagatgaatttcaaaaatatacctctttggattctattttctccttgaagttagatacctaaagtcaccatgtaatgttttaactctccccttactccaattttgttttagtttcatgaatctttattgaatatttgtgccctgctctagatagatgggaaggttcaatttttaataattaggtaactaggaatgcccagcttgttaagggaggtagacgtttaacaattactaaccactttggttaaataaagcagccaaagactagataagatgtaaatgcaccaaagagaaggaaattacttattctctctaggaagctattaggaatgctttcagagagtagggtaagccagactcttcttcaagttatttgaggagagtagtaacttagaagtgaaattttgattttgtgccatcattaaatctttgaataagagttttctgaatgactgacagaggttgatggaatattttatttttgaagaacttttattctaaaagttaggattagagaagtttttgctgtttctattcattattcctttttgcatacaaaaccgtccttgttgggattattcttgaagtatattctttagaatttcttttagagctggttttgaaggtaaataccatcagtgtctctagaaaaatctctctggcgggagggacaatgatcgggatataaacccaggcgttccagggggcaacggcaaccccctttaggtcccctcccatttatgggagctctgttttcactgtattaaatcttgcaattgcaaaaaagaaaaaaaagaaagaaaaatctctctggctgccttcagtcttctctttgtctttgatgttctgcagtcacactgctatatgtctatatgtggtttactttttatttacccttcttgaggtgctttacccctagatctgtggattaatgtatttcatgctttctgtaaaatttgctactattgtttctttaaatattgcctctcctccattcttccgtttttttccatctaagccgttaaatcagacatgttggacattcatactctatcctccatgtctcttaatagctcttttatattttccaactctctttgcttcattctgagtaagttctacatggacatctttcctttttttttttttttttttttttttttttgcttttgctgtgtctgaactactatttaagtcttcaactgagtatttgaataattatagttcttattcccagaaatttcaccttttttcaagtatattcattctttcaacaaatattgtttattttttatgtgacttgcaatataatagttaaagccacagtagttaaagcccatctttatgtagtttacgttttagtgggtataaggggaaacattaataataccgtaatcaattagtatatagtatgtttcaaagtgacaagtctaatgtgggaaagtctgatgtaggataagggacattgagagttcaagagccaggggtggtctctaattttatgtaaggtagttaggatgggactcattggagtgacatttgaacagtgccttcgaggaaatgagaaagttagcaattgtcgagagctcagctgaggaggagagagctgagctgccaggtgtcggaatagctgattaacacaaaccacaatgaaagtaacagtcaaacctttaatcacttactgtgatagtacagattgagcatccttaatctgaaaatacgaaatcaaaaatgctccaaaattcgaaatattccaaaatccagaacttttcaagtgccaccatgatgccacaagtgaaaaattctacacctgacactttatgtttttcactttcttaactgtcatttttttttttttactgttaagtacttatgtgtgaataagtgtaagaaaatgattgtttattggtaacacaaattgagagtcagaaatgatggtgatgccacacaaccacagattgtcaacatgggtggttgagatagtgacacattctctttctgatggtccaatatgtacaagttttgtttcatgcacaaaattatttaaatattgtataaaattacttttgggctatgtgtataaggtgtatgtgaaacataaatgaattttatgtttagagttagataccatccccaagatatctcatcatatatatgcaaatattccaaaatccaaaagaagtccagaatgtgaaacacttctggtaccaagcatctcgaataggggatactcaacctgtgtaagcaggaggctaaatcagagaaagcacaattaccacctgtgctggaatggcactggacaagggttaggtggatcagcacaaacatggggattgtctcaccgtctaggaaaccttgaacaaagtgtccggcagttttatggacctgggggatggagtaggacaaagcggaggagctaggaatggaaatatgctgagcactgagagtagacaaaaagtgtcttcactttttgtgaagtgactatacccttgttttaaactgatcatctgtgttccagttctcagctcaggcgctccctttcccccgataaagaggtcctgcaggagctctcaaggaaggcctctgccaaaaagctctcataaagagcttccgaatgaagtgcctgggctaggaatgcagacatggataaaagctttgggacagggttgcttgaatccttaagactgcagtgccctggctgtgcgcaaagtcaggttatattcctaagcatgtctcatatctagttccattaattccattttatggttgaataaaactgtctttaacaagctaagacacttagctctaacaaccaggttctgctacattgtcctcaagtcatgtgatgatgatcaggtatcacacatgagcagtctcactgaaatatatgaagggatcagtctggtcagggcctaagatggagttgacttaatagcttacagacaaggctggttcttcattctttttcttttagctctgtttccagattcttttgtccagtcttctctgtagtaccttgactatctcctattcttttagtttggtttccagatcactcacgttgaagttatttcgtacaattctgagcttctttcctactctgaactttgaatactacttttacttttttacccttatttgacaaccagatgctagatttaatacttgttttgcgtactttgatttctgcctaatttccagataatgttcatacctgattttgatttttagtaactgaatgtacacttgttttaagcctgatcatctgtgtcccagttctcagctcaggtttcttgctgatttttcaacccttctctgtaagatcatgaccacattaaagtctcttttctcgccagcagttcacttaccatagctcttcaatttgctatccactgcttcttgaatgcatagtgctgacaagtgacaatccatcttcaagttgaaagtttacagctgtttaaacaacccaataactagagcagtgttaaaacaggtttttttatagtttaagtctattctgatgggaatattaagatgatttatatatttatggtgaaatctgtttatttttataaacatatataatgtatattttagtgtatccccttttggcctgagtatgcttctagtaaacttcttattcaagtcgaaaggagtgaagatcctcccaaaaggatatattttaacaagcaggaaaattgtattctattgcgtctagataacgaggtaagtttttttttcttttttgcatgtgtcattaggaaagctaaaatatactgactagtattgtatttattttttgtatcaaataattacttctgttgatttttcccctttccccaaaaacgaacaaacatttctttttgtagaaggaaacagagatctaagataatttaattgttaaataaaaagttagttggggccgggtgcggtggctcacgcctgtaacaccagcactttgggaggccgaggcaggcggatcaggaggtcaggagattgagaccatcctggctaacacggtgaaaccctgtctctactaaagaaatagaaaaaattagccgggcgtggtggcgggtgcctgtagtcccagctactcgggaggctgaggcaggagaatggtgtgaacccgggaggtggagcttgcagtgagccgagatcgcgccactgcactccagcctaggcgacagagcaagactccgtctcaagaaaaaaaaaaaaaagttagttggaatgcctggaatactagaatataccacatctggaatgtcacctatctgtaatacagtgattgagattatagatttccagaaatgcagtacaaaattctgaattgttttctcagtcatcccaaaaattaaattatcaagttatgaatagtctgttcttaaatgttattagttaatattcttgggaaaatgattacattaaaatgttttctttttctttcttctagcttggaggtattatagcagaagtgaatttggccgagcattctacagttattacatttttagattatcatgatggagcagctacattcctcttaataaatcacacaaagaatgaacttgttcaatacaatcaaaggtaagattatcacaaatacagtaactcttgatggtgtaagtctagatgatgaggcacagttttttttgataatttcttaagagtataaacactgataatagcattgtagctgtgtaaaacagtgttccattaaaaaatgtacttgaagcatgtaggggtaaaactgacttgatgtctacaatttattttgaaatgcttcaaagaaagaaaaatggaagagctgaagcaagtgtggcaaaagcttgttcattgttgactctgatgaggagtctgtcagagtttgttaggagtctctgaattttgtctatttttgaattttttcatgtgtttaatatagtgtaaatatgtaaaatttcagatttttttttcaaacagtaggtaccctcttgttgagctgtcttggggaaaggactgcttccttaaaggctataattgaatcttcatggtttaggactactcttcaacattattcattttatttgctgttatatcttcttagtgccactacaggttatgcaagtttctgatcctctacttagtagttccaggctgtcttgaatttattttgtttcctttctttctttcttttcacctgttacttttcaacaagcacatatttatcattgcacttccactttccttccactgctaactgtacaacttctaatcattgattaaaatcaaacagacattgagtagggaccacagggctggactagcaagtacctaaaactcgtttggggtagcattctctcatctatttaagatgttaagaaagagggatgcctgttttttttaattatccatattataaaaataataagttgtttctaaacatgtgtgcaagtgtctttttaatataatgacttctcttcctttgagaagatacccagtactgggattgctggatcaaatgatagttctgcttttagttctttaaggaatctccatactgtttttcatagtgtttgtactagtttacattcccaccagcagtgtgaaagtgttcccttttcaccacatccatgttaacatctatttttttttaatttaaattatgatcatttttgcaggagtaaggtggtatctcattgtggttttaatttgcatttccctcataattagtgatgctgagcttctttttatatgtttcttggccacttgtatatcttcttttgagaattgtctattcatgtccttagcccacttttgatgggattattgtgtttttgtttttgttttcttgctgatttgtttgagatccttacagattctggatattagtcctttgtcggatgcatagtttgcaaatattttctcccattctgtgcgttgtctctttactctgctgattattccttttgctgtgcagtagctttttagtttaattaggtcccatctatttttattttgttgcatttgcttttgggttcttggtcatgaactctttgccaaagccagtgtctagaagagtttttccagtattatcttctagaatttttatggtttcaggttctacatttaagtctttgatcgatcttgagttgatttttgtataaggtgagagatgagaatccaattttattcttctacatgtggcttgcccacgatcccagtaccatttgaataggagatagtcaaagtaccagaaagaagactggacaaaagaatctggaaacaaaagagctaaaagaacaagagtgaagaaccagccttgtctgtaaaccattaagtcaactctatcttaggccctggccagactggtctcttcacatctagtcccttcactagaataaggtgtcctttccctacttcatgtttttgtttgttttgttgaagataattggctgtaagtatttggctttatttctggtttctctattctgttccattggtctgcatgcctatttttataccagtaccatgctgttttggtgactataggcattgtagtatactttgaagtaggataacgtgatgcccccaggtttgttctttttgcttagtattgctttggctatgagggctccttttatggttccatataaatttcaggattttttttctagttctgtgaagaatgttgatggtatttttatgggaattgcattgaatctgtagattgcttatggcagtatggtcattttcataatattgaatctaccatccatgagcatgagatgtgtttccatttgtttgttaaatttaaacttttaaataaatattcccttcttatgtaatctcccctgccattatcctagttcagtaaccctccatttcttatctatttgagtagatttttatgcgttgttttgttttatttgagtagatttttcttttttgttttgttttgagacagtgtctcaatctgttgcccaggctggagtgcagtggtgcgatccaggctcactgcagcctccaccttccaggctcaagtgattctcatgcctcagccttccaagtagctgggtttacaggcatgtgccaccatgcctaactacatttgagtagattttttatctatctctatatatctagtcttatctttagtaaatctcccattttccactagaatgagttttctaaaataagaaatataatcatatctctctagtttaaagtttttctttttttacccatttctttaaaaatatacttctaggctgcctttctaaacatttatctttccgtggcctaaatcttaccctatacaaagtgaagtttttttttttcctgaatgctctgggtctttccatgtgtttttacctgaataggtgtttctttcagctagaaaaatgccattctgtaattattaaaaaatcaagaaacaacagatgatggcaaggctgtggagaaataggaacgcttttacactgttgctggaagtgttaattagttcaaccattgtggaagacagtgtggtgattcctcaaagacctagaacccaaaataccatttgacccagcagtccccttcctgggtatgtactcaaaggaatagaaatcattctcttataaagatagatgcacacacatgttcaccgcagcactattcacaatagcaaagacatggaatcaacccaaatgcccatcaacgatagactggatgaagaaaatgtggtacatatacaccatggatactatgcagccgtaaaaaggaacgagatcattcctttgcaaggacatggatggagctagaagctattatcctcagcaacaagaacagaaaaccaaacaccgcatgtccctgcttataagtgggagctgaacaatgagaacacatggacacagggaggggaacaacgcacactggggcctgttgggggcatggtggcagggagaacatcaggataaatagctaatgcatgtggggcttaatacttaggtgtaggttggtaggtgcagcaaaccaccatggaatacatttacctatgtaacaaatctgcacgttctgcacgtgtattctggaacttaaatttaggaaaaaaaaaaagaaaaatgccattctatgtgatcccttcccttgccaccttaatctatgtaccccagtttttgatagcacctttacatatgtagattgcagcattcgtcacattgtgttactttcttgtgagtttgagacatgtacacacagatagtgaatagtctgaggactatggttagtttcccttttcttggaattttcattgcctgtcccaggtagtccagtacgtttttgcataaggaatactctgcaatgaattaaacagattaaaatttgtatgaattaagagcatttttaaatatttttaaaccaaatttatttgataatcaacacatttacatttgattttttttttcatggaaaaatgaagagtatgattttgttttctcctccacatttccttctcttggcttttaaaaaaatatggatgttatttcctgcatataaaagtaatagttgttaaattactgttttaaaaaatactacagaaaaaatgtgaaagaggaccataatccctgtaatccaaatactgtcaacattttggttcattgcttttcctttcctttcctccctcctttgttctctccctccctccctttcttccttccttatgtatctctcacatttgacagctattgtgagcatatcaatttgcttcaaagcacaatttttttttctttctaacttttattataggttcaggggttacatgtgcaggtttgttacatgggtaaattgcatgtcacggggttttggtatacagattgtttcattacccaggtaataagcatgatacccaataggtagtttttcgattctcaccctccttttactctccacccccaaataggttcccgatgtcagttgttccttctttgtgtccctgcaaagcatgatttttactgaatgcgtgatattctatcatttagatgctctacaattaaataaatacttaattgttcagaatttttatttcaacttttataattttagaatcagtttatcttctttttttgttgttgtttatttgttttttgagatggaattttgttgttttgcccaggctggagtgcagaggcgcgatctcagctcactgaaacctctgcctcccaggttcaagcgattctactgcctcagcctcctgaatagctgggattacaggtgcgcgccactatgcccggctaattttcatatttatagtagagacagggtttcaccatgttggccaggctggtctcaaactgctgacctcaggtgatccacctgcctcgacctccgaaagtgctgggattacaggcatgaaccaccgcgcccagcccagtttatcttctaataacgatcctcaacccatttgtaatcattgtaataactagtttataattccttaccatatttttttgtagtatattgtcttctaatgattttttggaaaatacatattctgtttcggttatggataattccttttttgttattgaaggtttcgatacatttaaaatcaattttaagattgaaacagtatctgctagcttacccataaaaaattgtaatgcttttttaccttttcttcaacctctttccaaattcttactttcttgtgaatataatttggtatgttttcaaacagattaatataaaatggttagcttttcaaaatatgtattatttcattcaaggcccttttggtatttgcattgattttaatgttttaacaaaaaaatgactttcttaaactggtttaattgttcactacaggttcctcaatatttctatatcctagttgttaaaatgttgttctgagttcatctctagcttggttggaaaaagtctgagttatttttttagtaaagatttgtggatagtgttatgctattgcttgttcgaaatgtcttattcttacaaatttatgacaatttgacataaaattttaagtgataacgtttttctcaaaattgtataggtattgtgccattgttttttgatattaaacatcattgaactgtgagagtaacatttttattttcttgcgagtgactatgattttcctagatatgtgttagggttttttcccccctattttcttacaaagatatgtctagaatgatactgttttcatttatgtctgatacccagtgaagtcttttaaatctgcagagttaattccttcttctactcagaagagctatattttattacttgtttggtttataacttttgtaatgtttttttctttctgagcatctttttgtgagtcaactgaatttcttagatgtgtatttcatgttttgtgattttaaagaataatttagttactttgtttttgctctagtaagaccaatacttaggaaagagttaccaattaaattatcttagaattggtataaatagggtaaaatagttggaataattttccataattaatttgtattaaaaaattgacaaaacagttttaaagacttgaagacctttatttcctaagtagaacatgtattttctaagtgggaaaataatgagaaatattcattagtgaacccttttttaattgtataaggtaagaatttcagccttgttttaatcagaacgatcacagatctcagtgaactaagaattaatgaagtattattttagtttttttttaatctcttcgtgtacttgcatttaatttaacgcgtatttttgctactgtgtcagttctctcagtgaaatagaagattccctccctcctggtaaagccgtgttttatacatgggctgatccggtgggctctagaaggctgaagtggagatgtagaaaaagccatggtgaagtaacacagaaggatgtaagtattgggttattatggtgttcccagcagccttttttaaaaaaggtatttgggccgggtgcggtggctcacgcctgtaatcccagcacttttgggaggctgaggtgggccatgagttggagatcagcctggccaataaggtgaaaccctgtctctcctaaaaatacaaaattcactttgggaggccaaggcaggcggatcaccaggtcaggagtttgtgaccagcctggccaatatggtgaaactccgtctctactaaaaatacaaaaattagcctcgcatggtggcgggtgcctgtagtcctagctactaaggaggctgaggcagaagaatcgcttgaacccgggaggcagcgattgcagtgagccaagatcacgccactgcactccagcctggcgacagagcaagactccgtctcaaaaaaaacaaacaaaaaacaacagtatttgattttcagccttcctagttttaaggactttttgtggccacacttctgaaaaactgccaaacgtcttcaaaatagtattcaagtatttacttaaccaaaaatgtttaaaaccaaaagtagtcttattttgtttacatcatttgcttctactgtgttataaagaataaagttgtgtttagagaagtgctttcagcattcacctgaaaaacaaatatgttctctgcattgacaatcatactaggtagatttagcttctgtaaggaacatttaaggatccactgagtgaactaaaacaaacttatttctgagtggcaagctatgatgataaagttatgcacatatattttctggtaacattttaaatactttcagaaaatttttaaaagtttttaatccttcaagattcatcttaatttgactcctgatgtttttttttcttaccactggtgattttttcttcctgcttatcagtaggtggtattttctcattgtctttcagtgctgctgttgaggagtctgctgtgggtattgtttacattgtatttaagaggattgcctataagtggcctttcagttttaaaaattcattactattagatttattcaggaaaaaaaattgtactttgatataaaaagtcttattcatttgatctgttgattagtactttgcatatttatatcatagtgatagtttgaagcttataaagataaatcagacattcactgtaaaatattagaaagacttcagtgaaataagttagtcttcttgattctcaatgtggttttagtgatatacatatatatacttagaaagtattacaagtaaggtaagtatccccagataattattttatggtaacaactcacagtttttaatttctgtatattgcaacgtgaaggtatactatatagtaaaattttctgaaaatcagaatattaactagaaattaatggctgaatattaattatgagaatttgctatgtttatcttgtcattgaccctcaaaaccctgatatcagcacatttatgtgagattcctgcagaaatagcctcatgatgaatatacatgctttgtagaacatacaattgagatacaagatattttttatcctgtttgattcagctatgaaaggaaatgtgaatttcaaactgaaacaacttttaatacatatcacattgctgtagtcttagaataaagcagaaaaaaatactttgtgttacagattagcctacgtgggaaggttcaattttattaaaatgtttaaattaaaaaagtaaacaattggcctgtctttatgagtaataattttataacagataacatcaaatgatttcaataatgtaaatttgcaagtattctacaaatattaattcatttagttgccactaaccccatgaagtaggtgccattaatagtctcattttataaatgtgaaatctaaatttcatgttctttgggaccaaattctaattttttggtttttttttttttttggtggttttattctaggatatgatgatgcctatagatttgggggaaaagacaatatatttagtttcattctttgaaggtttacaacgcattattttattcactgaagatccaagggtatttaaagtaacatatgaaagtgagaaagcagagttagcagagcaagaaattgcagtggcattacaagatgttggaatttctcttgtcaacaattacacgaagcaagaagtagcctatataggcattacaaggttagatgcattaaattttggatacatttaaatgatcagtttctaattgttaagaaattgttattgtaaaatctcaaatgatttagtttcagttttgtgctttgactattcattgatactgtggtagtgctagttttaaatgtgcttgagggaattttttgccttttgaaataaagatatggcagaaatcaaatttataaactccttattatgttaatccttccacttatctaaaaagttatatttattcaacttgccaaaagtatgttttgcatatcatacaaaatgcttagttcattttccattaccatctagcacagttcagggtacatatgctgtagctgttggaggattaacatagacaatcactttctaatttgaccttggcactttaagatctaataagatctaataaggtgatcactgtatttatcatttctcgtataagacatcaccattaaatcttttatctctcccttatgtccttattattcctattcataaacagttgttttaatttacatatattagtgcttaatgtgagaatatttcttctgtataaccaggataatgtaattttaatccttttcttgaattaaattcttgaatatatataaaggtatatgatacagatgtaaatttagttttctatgtacattaatctatacgtgtccctgacctcttattgaattgaatcaatgccattttaaaaggaatattaaaatctatattcttaagaatttttattctcaaaaaatgtttttactatttaaatagatcaaatacaccatagatttttaagacctttagacctattatatgttatcttctaagctaagtgatgttaatgcaaagatgaataatacatggtctctacctttctgtttcttaaatgaatataagttctataaggaataaacaaatagaatgctttaataaaattaaacaacttaaatatttaagtaacatatgaaagtaacatatgaaagtgagaaagcagagttagcagagcaagaaattgcagtggcgcactctatatcctagataactattttatacttgtctccccttaaacccccattgtgtcagcttactaccttgcattccacttcactgaaaaaattgaacccatcaaaagcaaacttccagagacccatctcaccccccaatatcacagcttgctatctaccagcgtttgcatactacttgctgtactgacatactctcaacagtttacagtagatatatgtgctcctgtttaaacagatttttctctacttttgcactgtacttcatttcctcttacctacttgaggacattgttccagcagtcctcttcttcatctctcctaagtcaacagcttttgggtctctactgaattgtttcagtgttacttctctcaacataaaaaattctcttgagcctactttccttgctacctgttgctcatttctttctttgcatttataaccaaacacctcaaatgtactgtctgtttcaaaggaacttaacatatcctgtgttctccaactatttttcatccattttctctttaaccactccaaacagggttttgctttcaacacaccatgaaactggttttgtcagcattaccagtgacctccataatgccatatccagtgtagaattatcggtctttacttaataacatttaacacagatccctccttgatgtagtttctttcacgtgacttccagaatacctcaccatcttggtttttcttcctatccagtctcattcattggttccttgtcttctctcaactgcttacattggctaaatgccttgaggctcttagacctggtccttttctcttgtggatttcagttttatgatttcaaatactgcccagaatttctctcttaggtatgtcttctgtcacacctgtcatctgaccttaagacttcatatatccaactgtgcatgcaaaatctctattcagatatctaagagacttcttaaacttcatatgtgtacactaaaccttttatttcctccttctaccaaaactccagctttccaatcagagttaataaaaaatagctccttctagttatgcagcccaaaaatattgaaattgtcttcgattcctctctttatcttacaccccagacctaattcatcaagaagatctgtgctggttctaccttcaaagtgcacatagatctgaccacttttctagtatctcactgttaatagcctcatcagggccatcaccatttttcaactggcttactgtagtacactaacaagttttcctgcttctaatcttgactccactcttttttctttccatccacttcaacacagagtgtattcttaacgaaatgtaagtcagattatgttgttagttgtcttataaccgatcagtggtatctcatctcactcagaataaaactcagagtctacagtggtctacaatgctttacattatttggccccccactataagtcttactttattttctattcctaatgtgttcctgacatgccagcctccttgctcttcttcatatactgcaagtgtgcctcctgctttagctggcctctctacctgaaatgttttcctcctcttgtctgctggataattctctcagctcatttaaggttgccaaaatctcactttctcaatgaatcccccattgaccactctaatattgaagaccccaccactttacatattgcagttctccggatcccccttgccttgtctacattttcttctttcaaaagcattttcacctcctacatattaaattttactaatttattttgtttactatttattttcactcccccactaaaatgaagctccagaatgacagagatgttcactgataacggctgtaacacctagaatagtgcctcagtagtagcttaataggtagtagttgaatgaattcatgtttttaaatttgtaatatgctcacttgtaattgaggctgttctgaaattttagtgaaggtattgtaattcatgtaataaaccagttaaaataaatgttaataacttagtattaaatactatgatttttgctttcttaaataagttctgatgtggtttgggaaacaaagcccaagaagaaggcaagatggaagccaatgagtgtaaagcacactgagaagttagagagagaatttaaggaatatactgaatcttctccttcagaagataaggttattcagttggacactaatgttccggtaatatttttaagtactgatgtgaagttttaattttttgcctgtcgtagtttggtgaatcactagtgaaatttaaggaaagtttggcttccttataaaacaaaataatcctgtcatacataccttgtataaaatgttttaaagaggtgtttatctatattaagaaatcaggctgggcgcagtggttcacacctgtaatcccagcactttgggaggctgaggcaggcggattacttgaggtcaggagttcgagaccagcctggccaacatggcaaaccctgtctctgctaaaaatacaaaaattagccaggcatggtggcaggcgcctgtaatccccgctattcaggaggctgaggcatgagaatgccttgaacccaggaggtggaggttgcagtgaaccaagatggccccactgcgctccagcctggctgacagcaagactctgtctcaaaaaaaaaaaaaaaaaaaaaaaaaagaaaagaaaactttcttttaagatactagatgctaatgatctgttctttgggttagcaggaaacttaaaaatgttttattttttcactgtactttctttaaatattttatttttcctttattcatttttattgtggtaaattttagtacatttatgtaaaaagtaatgcagtgaagctttgtaagaattatatgaatatgtgaattttatggacatgggatattaagatctaaatctaaactaatacaaatatgtagcttactgttttaaaaagtttttggcattaatttctaattctagtcatttatagataaattaattttttcatttggggggacatatttttcaggttcgcctaacccctactggtcataacatgaaaattctgcagccgcatgtaatagctctacgaagaaattatcttccagcattaaaagtggaatataacacatctgcacatcaatcatcatttagaattcagatttacagaatacaggtaagtctttctgaaaatataggcaaaattgtattctaaaggaatgcaataagaaaccagatctattcccatggtctgctttatctagtattcagtttcaatgttgtgctagcctttttttttttttttttttttgagacagagtctccctctgtcgcccaggctagagtgcagtggcggaatctcagctcactgcaaaccctgcctcccaggttcaagcgattctgctgcctcagcctcctgagtagctgggattacaggtgcccaccaccatggccacctaatttttgtatttttagtagagacggggtttcaccatgtgggccaggctggtctcaaactcctgaccccagatgatccacccgcctcggcctcccaaagtgctgggattacaggcgtgagccaccgtgcttggtcaccgctagactttttgattctttttgttcctcaaatcctgttattctggtcaggttgtataattgacatattaatatactgatgtgtttttattttcttagatccaaaatcagatacatggtgctgtatttccctttgtgttttatcctgttaaacctccaaagtcggtcaccatggattcaggtttgtttttatttttagatttccataaaagcagttgtattagctatttgatttactttactataaaaatatgaagtgaaaccattcttgggtttaatttttataggataattggaaaattaaactgcttgaaaaaggaccagcaagtactatacacaactaactttgataagattttgagtgaatcttgaagaaaagattgattagaaacatatattgaaatttttagaaatactaatttaaaaagcagataatctgtaaacctgcgatttaaaaacctttaaagcctttgaatgaacaataaggaagttcaaatctagagtgttttctaacagcagaaactgtcctatgttctccaaataagaataacggacaagtcctttctacccttttctttccctttgcctttcttgtttcctgcatatccctcttccccctactttctcttccctcctcactaccctacttaactttcttctccccttgctttcccacctccaccccacaccacttcttctaaactatcctggggggagtactctttataactcgctcagaagctttttggccagtataatgcgtaagcccttccacctagaggtctggagcaagtccccagaatctgttttcacaaagtttccctgatgattctaatgcatacttctaaactgctaattgtagaattagttatcttcagagtaactatagatagttttaaaaacaatgctagagtctgaaattaagattgtagtagattttgccaatatcagtaattttaactgatatttattatttagtaaatgatttaattttccattgtggtgtatattggaagaaaatgcctagcttttgcttaaagcatcatgggagtaattatatttataacctttacagcaccaaagccctttacagatgtcagtattgtcatgagatctgcaggacattcccagatatcacgtattaagtaagtgtcttaatacatttcttgtatatttatttaatgtttgatttaaatatatgaattgtttgtactctttaaatgttggacaagtcaaagatttaagcataaaatattaattataaacgtcaaataaaaaaatataatgttgtggctcacgcctgtaatgccagcactttgggagacctagacaggctgatcacttgaggtcgggagttcgagaccaacctggccaacacggtgaaaccccaactctactaaaaatacaaaaattagccaggcgtggtggcacgtgcccagagtcccaactactcaggaggctgaggcacgagaatcgcttgaacccaggaggcagagcttgcagttagctgagatcacaccactgcactccagcctgggtgacagagcaagactgtctcaaaaaaaaaaaaaaaaaggcggctctggatgaaatacatctaggtatttataatcattgtttctggattttggatattttattattctcttgtacttgtatttgttttttgtttggggttgtctataatcatatattgttttgaaaaaggaaaacaataatattttcgtcttcactcactacccattccaagaaacagaagatggactgaaacatctatgtaataatctcctgtctaatttcccttaccttgtcaccaagataacctatctttatttccttgctgtttaaaatatagttttattgttcatgtgtacctaaacattatgccttttagttttaatttttttctaatttttagaaaattgtttcaggccggaaatagatgttgggacttgcttttgttcattcaacatttttattaaaatttattcattttgttgtatgtagccatagtttattcattatcactaatatataatattctgttttatgactctgtatgacagtttacttatctggttcctctttatggccattttcatattttgactttgttgctgttattaacagtgttccatgattttttaaaatttagtcaactaaatagtcctaagtttcaaagttctaatattgatctcatacttttttctcatctaatttttgtaatacagttgttaattgatgatttttaaaaaatgttttctactttgtaatacaggtatttcaaagtattgattcaagaaatggatctcaggttagatcttgggtttatctatgctttaacagaccttatgacagaagctgaggtgactgaaaatacagaggtaagacttaaaataataacatttgatggaaaggattagggaaaagatattattataaatttttaaaggtattaaaatgactttgttgcattttaaaaatacaattaaataaattttattactctcttgtggtacatacctttttagaaatcttattttctgatgatagaaaattagcaaacaggaggaaaggcttggggtgaatagcagggagaaaaggataatttgtcatgttcacatcacttttttcctcttttattttcctggattactttggctttgctttcactttaataatttagaaatttagggtatgtccaggatatttaatgggagaaaggataggaaaattaaaaggtggtatcatctgggtgactggaagaccataaaatcatagttataaagtgggtcagatatagtctgtttttcacttgccctcatagattcatggatggagaaagagcaaattagtaacagtctattgaggtatagatcacataccatacatttcacccatttaaaagatagggttcaatgacttttaatgtattcacaaagttgtacaatcatcatcactctctaattccggaacattttcatcatccccaaaaggaactgcctgtgcagccactgatacactttgtgtctttaggtttgcctattctgaatatttcatacaaatagaatcatacactgtgtagtcttttgtgaagggcttctttgacttagaataatgctttcaaggtgcatctatgttgtagcatgtatcagtacttcattcctttttatggttaagtgatattccattatatggatgggccacattttgtttatccatatatctgttaatggacgtttgggttgtttacacattttggcttttatggataatgtaatgaatactggtgtacaagtttttattggacaaaaactttattaaaagtcttaaactatttaaacttaatcaccatgtgattaagcaattccaatcctaggtatatagccaaaagaaataaaattttattagaagtggaattgctcaatcacatagtaaccttatatttaatcatttgggactgttaggcagttgtgcaaagtgcctccaccattttacattcttaccagagcatatgagggctctgatttttccatattatccccaacacttgttactatctgtctttgattctagcaatcataatgggtgaatgtgaaatagtttgtcattgtggttttgacatgtaattacctgatgactaatgatgttgagcatctttgatatgttgattatcctttaatatgttaagtagttaatttgcatatcttatgtgaagaaatgtccattcagatcctttgcttattatttaatgagttatttgtcttttttcttataaaagttatttgcatattctcgatacaggtctcttatcagatacataattttcaaatattttctctcattctgtgtgttgctttttcactttcttgatgttgtctattgaaaatcaaaagttaaagttaatgaagttcaaattattttttattttgttgctcatgcttttggtgtcatttctaagaatccttagccaaatccaaggtcatgaatatcttacgttttacgaattttaaagatctagctcttatgattaggtctttgatcaatttttagttcatttttgtatatgatgtataaggatccaaattattctttggcatgttgctatccagttgtcctattaccatttctttaaaagactatttgttctttgaatggtcttgacaccctagttgaaaatcagttaacaacacacatgtgattttattccgtcgatctgtgcatctgcccttgtgcattgcacactgtcttagttattgttttgtattaagttttgaaattgggacatatgtatcttcctactttgtccttctttttcaagatgggtttggctgttctgagtcctttgaaatttcatatgaattttagaatcaacttgtcaggttcttcaaagaagtcagctggacatctgatagagactgcattgaatctgtaaatcaatttgggaagtattgccatcctaacagtattaggtctttcagtccttgcacatgacatgtttatccatttatgtagatttttaattttttttaacaatgttttgttgtttttcagagtgtaagttttacacatttttcattaaatttattcctatgtattatattcttcttatagtattatgaataaaattgattttttaattccatttttggattgttcattgctactgtataaaaatgcagttgatttttttatactgatcttgtattttgcacccctactgaattgttagctctatttgttgttccgtatattcttttgggatttctatacataagatcgtgtcatctgagaggagaggtagttttacttcattctttctgatctgaatgcctttgtttcttcttcttccctagttgttgtgtctagaaattggtgacacattaaacagaagtgccaagagcagacattcttcttttgcctctgatcttggagggtaaattttcagtctttgagtatgatattgaccctgggtttttcctagacatcctttttcaggttgaggaagttcttttcttagttggttgagtgtttttaatcatgattatatattttgtcattctttttctgcatctatggaaatgattgtacactttttgggttttgttctactgatatgttttattacattaatttttttttttttatttttttttttttttgagacctaggctcgctctgtctcccaggctggagtgcaatgctgcaaaagcaatctcagctcactacaacctccgcctcgtgggtttgtgcaattctcgtttttcagcctccctcccgagtagctgggattacaggcgtgtgccaaaatgcccagctaatttttgtaattttagtagagacagggtttcaccatgtttctgtgtttttttgttctgacctcaggaaaactcctatttgtcactttctctgattttctcctgcaaactattaggtctacaggttagccagtatcttctgtaaatcaatgactttccttttagttgtctttcaccacatctgctgtttctgagagcccttaggctcgaactgcactatatgttataagtgaaattagttcctttgggaagagattaatagttacctgttttaaaacctactttccccatcagcaaaaatccctaaaccaggcctctgaagctggcggtgggaacagttgtgacacccttctatttgagtaacaccccagtttaggagctgagcactatgtgtggtggggtaagaggggcagtggcctgagatgatctcagcttgcctttgctggcatggaaccaccacattacaggcctgggcaagagtgatcagaactctagtattctcagtggtactgtacccaaggcagagcttttttaccctgcacagaggctggacagagaaaggaagccctgccaagtacggtggctcacgcctgtaatcccagcactttgggaggccaaggtgggtagatcacttgaggtcaggagttcgagaccaccctggcaacatagtgaaaccccatctctactaaaaatacaaaaattagccaggcgtgttggcaggtgcctgtaatcccagctactcaggaggctgaggcaggagaattgcttgaacccaggaggcacaagttgcagtgagccgagatcgcgccactgcactccagcctaggtgaccagagcgagactccgtctcgaaaaaaacaaacaaacaaaaaaaaacccataaaggaagcccccgcctcacagttgcactcaaccataacttaacctcagcagcaggtagctgggaacaggatgagaaatgctgacgtcctgttcttcccaggaaggaagtcctccaattgaggactgggccaagaaggagctctgtgttcttgggtatactagtctagagtagaattctggctcattagtctgggagaggggacagagggaatggcctttgttaaaacaccacggattcgcttttcttaccaaattctttaggttttcttaaatagatgtttcttcatttgcttatgaccttaaaaccattcctagaggccttaaatttgttgttgttgttgtttaaattttatcagtttagctggggtgctggtttgaagagcttcccactgtcatttcagaaattgatttctaaatatactttttataaggctatcatttcttatgtttttatgaatatgttaaaatgtgaatcttggggctcatttttcaacacatagaagttacttccgtctgagcatttaaaggagaagtattgatgaatatcaagaatgaaaccaccaatcaattaatgcaaaattgttttcaacaccttctttattttattatattactgatctgtgtaggatgcattaaagcaattacaagtagactacaaaatacaagttgactgtatgattatgtttaaagaaacaaatatacccaagagagtgttgatggtatggattaatgtcattttgggataagatttatagtcacatggagaaaagcttagtgtcttttaatggtttggatagaaatatagaagataatgcttgttggtttgtcagtggcagacagaactgtcctatagatagagatgttactttcccttctgaggcaatcataagcaatgttgagtctggatcttatagaagagttttggcagtgtgtcttctatttgcttaaatatctcatgcaggtaggtccctttagttttaatattttgtgttccttttataggttgagctttttcataaagatatagaagctttcaaagaagaatataaaacagcctcattagtagatcaatcacaagtcagcctctatgaatattttcatatatctcctatcaaggtaggagaaagtcatttttattgtccttgataatctaggtaatagcaaattgatgtagcatttatattgtgttcttcagtaatatataaaatctgtaaatatacaattaaactaagtaacaaaggaattacccttttacatttttatttatttttaaataactttttatcatgtggagccacctatagcatgtatttatgtttataatttgacctaacattattttaccttgattttctgttaagctgttaggtgacaattttcaaaattttgcatatgatgatttgtgtattagttttaaagtaatttataaagtagccttaagaactgaagactgaatggtatcaaatctaagttagtttttagtgcaaaattcctataagctaattatacaataatagaagaaaattactaaacaaccatatatgtagagtatatatgcaatacaatacaaaagtgttttttaactggctattaacttctgaaataattgaaacatatacttttggagatacaaatacctttcagcttatgacagagttacatctcagtaaagccatcatgagttgaaaatcttgtaagtcagaaatgcattgaatacacctaacctactgaacattaaagcttagcctagcctgtcttaaacatgctcaaaacagctgggcaaaatcatctaacacaatgcctattttctaataaagttattataaagaattttgaatcaaaattcaaagtacagtttccactgaaggtgtattgcttttgcagcattgtaaagttgaaaaatcataagtgaaacataagtcatataagttggggaccatatgtatttgagtcattttcaacagcttcaacttttagatttttaatgttattaacaaatatataaaaattaatattttcttaggtttgccaaaagaatgggataggattaaatatcatgctatcttaaattgttgaattgaagatttaaatagagctatgttagattttaaatttcttcatatttctacttagtgattttaacataatccagataactttgaaatcttatttatggtgtagtgaatttaaaattaaactgattttttaagagttaaaattgtcaatatgaagaaaatacttttaaatatttatctctttatctttttagttacatttaagtgtttcactgagttccggcagagaagaagctaaagattcaaaacaaaatggaggactgattccagttcattctttaaatcttttgctgaagagtattggtgccacactgacagatgtacaagatgtagtttttaagtatgtttagtattcaaatctgtaaattgatggaaatatttctattttatatgtccctaaaaatttcgtaaatgaaaaagtgtgtgaagtacgttgcagatcataggcaaaatgaggtttttgcattcaagtgaagtgcaatctgaataacaccaacgtatgatttgctaacccctaattgctaaattacagaattattaaacaatttccttaagaaaaagagtcataggccatgcaagtttcacattttaaaagatctttctggcttagggaaggataggatgtgtatgcccaaagatatggtgcctgaaatgtatggatttgaagctaataggaataagactcttcaaagcatttgcaactagaacagaatgaatgcgataataggggaaatgaaaggatcaactttaagtgttgtaatcaggaatttatattttaatatgagtcataatgaagcttatagagtatctgaccaaagagattcagaatgtctgagttgagactttagaagagaataaccctttcaagtagcatctagaattgattattaagaacagtcgtaagaatcaataagtccaacacgaggtaacactgaacctgaagttaggtaagtgtcaaataaaagtacacaggtatgatgttagcagaaatagtattctacttagcaacaagaagcatagagcttttcagttactgtatcaggtatatgctatggatgggttataagtaagctaatcttagtatatattctgtgaatggagttataagtaagcaggcaaaacctgctgcagctgaacctggccattcgtgagcaacctctttatcagtgtgtcagacattttctatgtgggccatgataggacagaattgggaaataaagttctagtggtacatgaatgggattcacaggatctcagaactctcgaatttacatgaaaatttatgtgtactggtgacttgtctgaagataagatccatgtcttttatcagattcttagaaggttctttgattaggatatgcagagatgtatgtaaaaagtaaatttcctgattggcatgggaaaatgtactagaaggaaaggtttggagaaaagattctaaagaaaataaagccactcattaatattaaaaatactttcttcatacacatgtacagacaatatatttttacgcttttttcaggcttgcattttttgaactcaactatcagttccatacaacatccgatctacagtctgaagtcataagacactattcaaaacaggtttgtctaagattatattacagagggacagagtgatacagactggtaaaaccttttgtgtctatacatatataatgtggaactattgaggaactaaatagccattttcaaattattaaagcatgggtattttcctcagaattataaaaagaaattaagctcaatcactatttgaattttttgtccttatattttttagccactgagagaaattttttgtggatcagcaggactggaaataaataaatctttaaataaaatattaactaatttatcacacttaattaaaaaatgggttcatggaaactattagtaactaactgatgaacacgggatatttttagtgtaactagttgttaagtcagccagatgtatttttttaacagatgtttttccacttctagagagactcttgggttttaggatataacttagagtatctgatatagctgtggtatgacagatcactgagcatgactcaggagatttggatttctcccacttttgccatatacccactatgtgaccctgagtatcatctgacttatatgtttctccaatctataaaacggtggtggtaatgacagtggtcacagataattgtaaaagtgaaagtattttaaatattctagagctttacatgaatataatgtcatattatttttaatactataataccaaattactttttaaaagctaagaatagcgatcaataagcctggcatggtggctaacgcctgtaatcccaacactttgggaggctgaggctggtggatcacttgaggccaggagttcgagaccaccctggccaacatggcgaaaccccatctctactaaaatcacaaaaattagccaggcatggtggtgcatgcctgtagtcccagcttgggaggaggaggcacaataattgcttgaacccgtgaggcagaggttgcagtgagccgagatggcgccaccgcattccagcctgggcaacagagcaggactgtctcaaaaagaaaaagaaaaaaaagagtagtgattaataaaatgagatggtttaggagttgaaattggcattaaaggtgttggcctgagaaaactgggcgtgtgttttaaataatgtataagaaaaaatagatctaattatctgaattgattaatgttcatattttatttttaggccattaagcagatgtatgtactcattcttggacttgatgttttgggaaatccatttggcttaattagagaattttctgaaggtgtagaagcatttttttatgaaccttaccaggtaaaatagttatttttgtggttgtgcaatatgtcactaatacttttgaatagataatacttttctattgttaagttgagttaataagtgcaaacagattttggaacacacacaaaaggacatcattttgcagcaaacaatggtaagaggttttgggggacatttttacccttttcctcaaaatttaaacttaagattttgttaagctacgctgaattgtaagtgttctcttggaatataaaaggtggataaagtagaaagaagatcaccacatcttgctttgcacagtagtgtggaactataaaaataatcatgcaaactgacacctggccaagcaatcttaaaaatcagtgggaaaaattatgattgttctatgtcctttaaaactttttcccaaaagactcctacttccacgtataaatgtatagggaaataaaaaataaagttaacattaattttgcacattgtaattaaaaacattaaaagcattaagaattttaaagtgtttatttgaaatttttattaaagacttatcaagagtagtttgaactgtgcttgcattttgctcataaacttacaatatggaccaagcacctttctgtactttggtgagttgccgtactcctttctaagggtcagcgtctaacattatatccttcacactttcagcgtccagaaatatccctaggaattcttttaatgtgaaactttttgctgatattacttcctctgggacaacattatccatttttgttactacctctttcgtcgtatatatccgtaagctcatctttaaaagtgaatataactcactcactcatttatttactatttggccctttagggagccatccagggtcctgaagagtttgtggaaggaatggcactaggacttaaggcactagttggtggagctgttggtaagaaacagaatatctaccaagtatttttgtgctagaaagtaatggcatcattacttttactaaagataatttctgtcaggtggattggctggtgctgcctccaaaatcaccggtgctatggctaagggggtagcagctatgaccatggatgaagactaccaacagaagagaagagaagccatgaataagcaaccagctggttttagagaaggcatcactcgtggaggaaaaggcttagtttctgtaagaaatttcacagggttgtgaagattttgggaaatatcttttaaacaaacctacatttgcgaataaggaaatagacatgattctcactccttaaattattatttggatattttaagagcagtgggtggtagcatataaaacatgtcagtagcctctaaaacattctgtttaaataaaatacttaggagatctgttaattcttatgctatataaaaagcagaactctgtattttttgtgtaatccaaacttggttcttctaggcatcataaaaaagtattgtaaattttcagttgtgttttccttctagggatttgttagtggcataacaggaattgttacaaaaccaatcaaaggcaagtatagtagttcctttgcaagtctttctaagttgattctgttttcattcttggatgcaattgtcaaaaactcttttttctttccaggagctcaaaaaggaggagcagctggtttctttaaaggtgttgggaaaggtttagtaggagcggtagcaaggccaactggaggcatcatagacatggctagcagtacatttcagggaataaaaaggtaaatcctctttggtgtaagatatgagttaaaatgctgaagccatgagaaatggaatttatctgctctttggcttcaggcatttagttattgtctttgttttgtgctgctataacataccacataataccacagactgggtaatttataatgaacagaaatttattggctcacggttctgaaagttaagaagtccaagattgagaggcaacatctggctagggcctttttgcggtgtcatcccatggcagaaggacaaaaagagggcaagagaagaaaaaagggaaccaaagtcacccttttataaggaacccactcccacagcaacagtattaatgcattcatgggggcagatcctcatggcctaattacctctaattaggccccacctcctggctggggataaagtttccaacacatgctcttggagggacacattcaaaccatagcagttaccagcactacaatatggcaggttgcatatggtcttcctaattcattttgattttttttttttattattatactttaagttttagggtacatgtgcacattgcgcaggttagttacatatgtatacatgtgccatgctggtgcgctgcacccactaactcgtcatctagcattaggtatatctcccaatgctatccctcccccctcccccctccccccaccccacctgtgatattccccttcctgtgtccatgtgatctcattgttcagttcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacgttttcttaatccagtctatcattgttggacatttgggttggttccaagtctttgctattgtgaataatgccgcaataaacatacgtgtgcgtgtgtctttatagcagcatgatttatagtcctttgggtatatacccagtaatgggatggctgggtcaaatggtatttccagttctagatccctgaggaatcgccacactgacttccacaatggttgaactagtttacagtcccaccaacagtgtaaaagttttcctatttctccacatcctctccagcacctgttgtttcctgactttttaatgattgccattctaactggtgtgagatggtatctcatagtggttttgatttgcatttctcggatggccagtgatgattagcatttttgacaaaattcaacaacccttcatgctaaaaactctcaataaattaggtattgatgggacgtatttcaaaataataagagctatctatgacaaacccacagccaatatcatactaaatgggcaaaaactggaagcattccctttgaaaactggcacaagacagggatgccctctctcaccactcctattcaacatagtgtcggaagttctggccagggcaattaggcaggagaaggaaataaagggtattcagttaggaaaagaggaagtcaaattgtccctgtttgcagacgacatgattgtatatctagaaaaccccactgtctcagcccaaaatctccttaagctaagaagcaacttcagcaaagtcttaggatacaaaatcaatgtacaaaaatcacaagcattcttatacaccaacaacagacaaacagagagccaaatcataagtgaactcccattcacaattgcttcaaagagaataaaatacctaggaatccaacttacaagggatgtgaaggacctcttcaaggagaactacaaaccactgctcaaggaaataaaagaggatacaaacgaatggaagaacattccatgctcatgggtaggaagaatcaatatcgtgaaaatggccatactgcccaaggtaatttacagattcagtgctatccccatcaagctaccaatgactttcttcacagaattggaaaaaactactttaaagttcatatggaaccaaaaaagagcccgcatcgccaaggcaatcctaagccaaaagaacgaagctggaggcatcacactacctgacttcaaactatactacaaggctacagtaaccaaaagagcatggtactggtaccaaaacagagatatacatcaatggaacagaacagagccctcagaaataacgccgcatatctacaactatctgatctttgacaaacctgacaaaaacaagcaatggggaaaggattccctatttaataaatggtgctgggaaaactagctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtccaaaacaccaaaaacaatggcaacaaaagccaaaattgacaaatgggatctaattaaactaaagagcttctgcacagcaaaagaaactaccatcagagtggacaggcaacctacaaaatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaactcattttgatattttttaagttgctgccattgcattgtttcaactttatgaagttcccctttatttttcattcattcctagcaggcttgcaggagcagtttggcaagttaagcaagcttttcagttatcttagtttaaatacattaatgctatatatcaattataaaattagcaaatataatctgtatcctttttatgaaatgaagaatggcattttgtatttcttggttcaaactcagtttgtcttcacccttcctttattatcttattttgttataagttgttatagtagtccctcttgatctgcagggatctgcagtggatgcctgaaaccttggacagtacttagccctatatatactgtgttttctcctgtacatacatatccgtgatgaagtttaattttaaattaggctcagtaagatattaacaataataataaaataagacaattataacaatatactgtaatgaaagtaaaataaacgttacttgaacacaagcactgtaataccgcaatagtcaggatgataactgagacagctactatgtcactaatggactggtgatgtataaagcatggatatgctggacagagggatgattcatatcccaggaaggacaaagcagggtggcaagaaattttatcatactactcagaatggcatgcaatttaaaatgtagggattgtttatttctggaattttccatttaatatttttggaccacagttgactgtggataactgacactgcagaaagcagaactgtggataagcggatactagtgtatatgcatatcctttctcttcctttatgcaggtaattttaatacacattgttttttactccaaatgaaatttagtgtaagggtgaaatttagtagtttctttattgttacctgtgtcttagaaatttgtaacacatataacagatgataaaattaatgttaattagacccatcttagaaagttaggtgggtggctgtcttcctaatctttttcctttgtgttttctcttgctttctgctctatagggatatgtattgtcatcatatgagctattcctcttaagccagtatttcatactggttaccataattgggtgtttctggtttcggcatttagaattaaggtgggggaaaaaggaatcattctcctctacctgtaactttaagtttcataaatataatgtgttgagtcgtagtcatcagagaagctcaaaagtcaatgaaacgtaaggaatttgaaacatatgaaggcttctttcaaaagctgctagaattaccttctgtttatctaaaaccttataattctgtacccaggtatattacctttagggattgagggcacaatgaaacatttttagaaaaaataataaagactaagaactattgaaggatgtacctgtgaaaaaagacactgaaagtaaaaggaggaatgggttacaagattcaaagataaaaatataaattggataaatctaattgagctacatgaaagcaacattggaaacattattaaaacataataaaatgcaatttggggagagaatgattggcattaaatattgtcctatttgtaaagaggatgtatttactaatattaggtgaaacagacattaaggcaataaaagcattatttgggataaataaggtaattaggtaatgataaaaagaactaagtaggaagatagtaacaatttcaaacttctactcagttcataaaatagccttaatttttaaaagcacaacttgacaaaactgtaagaacttttcaaatgtacaacaaaggtggaagaacttaatatttttctcaataattgatagatcaggaagacaaaataaaagtaagtaaataattatctgaatagagttaacaagctacctaatacaaacataaataattattcagcacattttagggagcattgtctatgatctagacacttctctaatcacttgagggaccagcaatgaacacaattggcaatggtcctgtgttcatacagcttacattctagtgggagagtaatagacaaaaataagtaactgataaatatatgatatgctaaatggtgaaaaatgccatgaagaaaaataaagcagattaaaggaggtaaggagatgcaaaatggtagggaggagggttgctattttacatattcagtgatcagggatgcttaactcataagattatatttgaggagagacctgaaagaagtaaagggtgagccatgtgagaagaatgtcccaggcagaaggaacagcagttaaaaagccctgatgcaagaatgtgcttggcctatttgagaaacagcaagactagtttgcctggagtagagtgaggaacggggaaagttgaagaagatgttaccagggaacatgcggggaatcacatctcgtagaactcggcaagcccctgtaaggacttaggcttttgcttaagatgagaggccattgaaaggtttcaagccagagaaatgatgtgagctggctgctgcattgaggcgtaaccacaggggattagggcagaaacaacacttaaaaggcttttgcagtaatccaagtgagtgacaatggtgattcgactattagagtactagagattatgtcctgcatgtattttaaagatagtggcaatagcattagttgataaattggatgcaggatatgaaagaaagagaatcgtgaagaataattctaaagtttttatgtgtagtactggaagggtgaggttgtcgttctttttagggaaagggtattagacatttccttttgaatatattaagcttaaaatatctcttagacatccaaatggagacatcacgttattgttgagtagaggagtttgaagtatagagaaaggtccaagctagaggtaaaaattcaagatttgtgagcctataataaggtatttgaaaccatgagattggatgagatcaccaagggaatgagactgaaaagagaaaaataaggtccaaggacttggctttcaggcacaccaactcttagaagttggggaaatgaggaagacccagaaaaggaggctaaaaagaaatggtcattaagttacctaaaaaattttagggtcagtttgtcaatttctacaaaaaaggtagctaggattttgatgcagatggcattgaatctgtagttcaatttggggagtgtagccatcttaacagtattatcttttaacctgtgaaaatgcaacgtctttccatttatttaggtcttcttgaattgctttcaataatgttttatagtttgtaatgtacgagtcttatacttctttttaaaaacttattcctaagtatttttgatgctgtttttttttttttttttttttttttttgagacggagtctcgctctgtcgcccaggccagactgcggactgcagtggcgcaatctcggctcactgcaagctccgcttcccgggttcacgccattctcctgcctcagcctcccaagtagctgggactacaggcgcccgccaccgcgcccggctaattttttgtatttttagtagagacggggtttcaccttgttagccaggatggtcccgatctcctgacctcatgatccacccgcctcggcctcccaaagtgctggtatgctgttttaaatggaattgttttcttaattttattgttggattgtttattgctggtgtgttgaatacaactgtttttctttatatttgagtttctgcaatcttactgaacttgtttattagctctaatggttttgtggattcttttgggttttctatatgtaagagtatatcatctgagaactgaggtaactttacttcttcctttctgatctggatgctttttttcttgcctagttgtcctggctagaacctctagtacaatgtgaagtagaagtgctgagagaatagacatgcctatattgcttttaatcttagggggaaagctttcagatgttcaccattaaatgtgatgttagctataggtttttgtgtctttatcatgaaaacatgttagattttatgaaacgctttttctgtataattaagttgatagttggtttttcctttgtttcactaatgtagtatattacattaattgagtcagatcttaaactaatattgcatacctgggataaatcccatttggacataatgtgtaatcgtttttatattttactggatttggtttgatagtattttgttgaggatttttgcatgtatatttataagggatattggtctgtggttttcttgtgatgtctttgcctggtatgggtatcagggtaatattgtcctcacagaatgatttaggaagtgttccctcctcttcaaatttttggaagactttgtggagcgttgatgttaattaaaaaaaaaatttggagaattgatcagtgaaaccgtctgattcttacttttatttctggtgagttttaaaatgacaaattcactctctttacttggtaaaggtctagttaggctgtttcttgagtcattgtcagtagtttttataggaatttgttcaattcatctagatgttctaatttgttgatatatatttattgatcatagtaaatatttactagtattctcatataattatttttcccttatatagtatttattcctagtattcccttataattattttttgtttccataagattggtagtagtgttccctctttaattcctgttattcataatttgggtcttcttttttttcttggtcagtttagtgatggcgtgtcatttttgttgtccttttcaaagaaccagtttttagtttcattgattctattttttctattctctatttcttttatctctgctctaatttttattattttcttccttctgctagctttgggattagtttgctttttctactttctcaacttgtgaagttatattattgatttcagaccttcttttttaatgtagacattcacatctataaatttccctctgagcactgtctttgctgcatcttataagttttggtgtgttgtatttttgcttttatttgtttcaaagtagtgaatttcttttgtgatttttttctttgacattttgttatttatgcttctatgttttaatttccacacacttgtaaatttcataaatttctcttatttacacatttctagttttcttccatgtggtcaggtatcatacttgtatattttcagtccttttttttttttttttttttttttgtgagatagagtctcactcttgtcacccaggctggagcagtggcgtgattttggctcactgcaacctctgcctcccaggttcaagagattcccctgcctcagcctcctgagtagctgggattacaggcacacaccaccatacccagctaattttttttttttttttttgagacagagtttcactcttgttgcccaggctggagtgcaatggcgctatctcagctcaccgcaacctccgcctcccaagttcaagctattctcctgcctcagcctccctagtaactgggattacaggcatgtgccaccacacccggctaattttgtatttttagtagagacagggtttctccatgttggtcaggctgatctcgaacttccgacctcaggtgatctgcccgccttggcctcccgaagtgctgggattgcaggaatgagccaccacgcccggccatttttgtatttttagtagagatggggtttcaccatgttggccaggcttgtcttgaactcctgacctcaagtgatctgaccacctcggcctcgcaaagtgctgggattacaggcatgagccaccacgcctggcctattttcagtagttttatatttacattcaatgttagccaaaaggccaagaagcaaacagtaattttatattattgagacatgttttatgacctaatagatagctaatactgaataatgttccgttgcacttgagaagaatatatattctgttgttgttggtttgaacgttctatagacatctgttgggtctagtggattatagtgttattcaagttctcttttttccttgctgatcttttatctagttggtatccatttttgaaagtaggttgctgaaatcttcaactattatggtggtattgcctttttgtcttttaaattcttagtttttgttttgtgtatttggggcttcttttattagctgcttatatgtttataattttttatctttttgatggattgacccttttttccttataaaatgcccttctttgtgtctaataagaatttttttaaaggctgtttttttctgacattagcatggccactttagctttcttttagttactgttcactttgcatatattttctcctttttagttgcaaccagtttgtgtctttgactctaaatcaggtctcctgtggatagtatattgttagatcatattttttttatctattctgtttttatttttttacttatgtatttattttttgagatggagtctcgctgtgtcgcccaggctggagtgcagtggcatgatctcggctcactgcaacctccacctcccaggttcaagtgattcttctgcctcagcctcccaagtactgggactacatgcacatgccaccacgcccggctaatttttgtatttttagtagagacagggtttcaccatattggccaggctgatctcgaactcctgacctcatgatccgcccgcctcgggctcccaaagtgctgggattacagacatgagccaccacacccggccctattctgttttcagttggagaatttattcatatgtatatgcccatgcatgtgtatacattatgttagcggtccccagccttttaggcatcaaggtctggtttcatggaagacaatttttccacagaccagacaggagggataatttcaggatggaactgttccacctcagatcatcaggctttagttatattctcataaggagtgtgctacctagatcccttgcatgtgcagttgacaatagggttcgccttcttatgagaatctgatgccgctgctgatatgacaggaggtggagctcaggcagtgaaacttgcttgccactactcacctcctgctgcacgactcagttcctaacaggctatggaccggtactggttcaagtcccatgggttggggacctcttaataaatatttgttgaatatgtgatacttgttgagtgaacaaattgagtggtcacttatgaccaaataagcaaaaatgttaaatataatactaccatacacaatttagccgtatgtggtatgtgttttttggttttttgtttgtttttagacagggtctcactctggcatcctgattggagtgcagtggcatggggctcaaactatcctcccacctcagccttctgagtgtctgggacttctgctgcataccaccatgtctgactagtttttttatttttttgtagagcagtgtatgctgcccaggattggggtatgtgtttacagtaatacacatcaagcccagtaagaatgtgaggactgtgagagtatttgaatattagaaaactatataatgtgatttataacattaatagattaaggaaaatataccatgtgatcaaaacaatgccagaaaagaaattcttatttaaaattcattgcctatttaagattttcaaaaacagtaacaaaaaagaactgttggtaaactaaaagtagcaatgaactttcttgacttgttaaggggtgctttaaaaaaaaaaagttgctgataactatacttcacagaaaactcttagaagctttccgtagggtcaggaatgagacaaggatgcttgcaatccctttttgtttatagcattatactaaagaaactagacaacgtaataggaaaagaaaaagcaacaattgctaatattgtgattattatcacaaagaaagttctagagacttaaacttctctatagttctgtatttttctagagaacttacactgtttatgttacaaaaacaatttaaaattagagaatgttgtaatatttttaatctgaaataagattgtttttagtaattgcattttatagtttatttacaagtttttgaataatttttaaaataaagttatattttttttcctctagagctacagagacttctgaagtggagagtctgcgacctcctcggttcttcaatgaagatggagttatcagaccgtacaggttgagggatgggactggaaatcaaatgttacaggtaaattaagagctatcttataaattaagattaatttagtcaagttagattttttttaagtagccatttaatatatattaaattatttgggcttttatctattttgcttaattccacttataagtttcttatatttacttagattttaaagtacatttatttactataagatttttttttcttttttacaggcatcaaaaagtttgatatgaaaagttaatgcatgactttgcaagtgaaagccaacagtagattttagtcttaaaatttacaaactacgtacagctgtttcagtattttgaatacaaagaaaaccttttgtattggtaacttttaataggaattttaatgaatctggtttttttatagggtgttcttagttctgcactggatttgctagatttgttggaagcctttgtaccttatgtatcctcgtcattggtggtacttacttaaccaattaaaccatttctgttgtggggttattaaaccactggtagcttttataccagatatataatccttatatccaattacacatgaagaaggaaaagcaaaactcaggaacactgctattgtgaattactcttggattcttgtgctttgcctttgaaaatgcttaaatggccatgaccctcttcctgctttattctagtgtagtctttataaaacttgtgggatttgataagcagttcacatgcaaaccagtatcttttaataatacaaagtagcatctggaacaatagacagtttgaagttagaatctgcttagacaactttcttacttggtaaattcgactttttaaaacctggattatgctgtaggtaactagtaatcatatataggctataccagtgtcatgttgtttctgtggtttagaggtggaatactaaattaaatcatttgtttgaaaacaaacaaggaatcattatgttatgtaggcttgcagatactcatggtagcaataaactgttggaatatgaagcttcctttatggctttaatattttaaatattgtgatatttaatgtgatcagagtaaagatttaaacttcagtattttacctattgcagggcatatagtattgcataaaatatacttctaactctttctctgaggcttctaatatacaaaaatgtaaccatagagttaatatgcaatatttagttaagtgattttatactgtatttaaaatgtttttgaagcatcaaaatcattgtatattgggatagaactggtaatctattaagaggttgtgctctaatggacagattgtgcagtctctacaatgacagtgtatcgttctttggaagatagtaaatttgcagaagtcacccatggctgatacagtcaaaacatgtatttctacccaatacctgccttcccttgttagaacgcatttaacaagttactaacattttactagactaaaaatcaaatatagtacgaagtaaggatgagtgttgaggagagtttaggaatatatcctcattataagtgagcacgttatgatacccacaaggaagccatgagataccaataatttctcatggttgataatttgattttagtgaagcttctcattgttttctgaagctttaaactttgagatgtaaaaacatgacttttgactgtgtacttttaaagatacatatttatttttaataggtcagtctcatcattaatcactaaaagagctatttaaatgactaaaaaccacagcacttgtcagccattacttgtttttcagcaagcatttacacagtattagctgaaatatttgtagggattcaccaagtaccttgggatgttgcagttagcatttttttcttacaggtataaaaagtggattgttgttttgatggtggtgggttttgtttttttttttttaatcaaagctctagtgtattattagcaaacacttaaaaaatatgtaaataccagtactgtggaaaataattagatgacacataaactggatttaaaatccatctcatctgcctagattttatgtaagtgatataatgaaggtgccttaaaatatttgatactttcaaatgtttctcatgttattttcttattttctaaaaaagatgtattcactaaattatatacactcatataataattaaatataaaatacattcttttattgtgtacctttctatctagaaggtagcacattattacagtgtttcctgctggtcaaagttgcctattagagaaatagaatggtaattttaatatattcacaaaataccttattgatatcatcaaaccaatttatacattgagtttgtaccaactagtggaattgtcttaggtctattaagttatggaatattatatccataattacagtctgagtcatagctgaaaaaatctgctttaaaattattctcactctttgaacatttcataatcttacatgttttcaagcaatttgccatactctactaacctttgtgcttcttttttcctttgccatgcttacagaaaattcaattctacagggagtggattatgactcacagtagcagtagtgatgatgatgatgatgatgatgatgatgatgagtcagatctaaaccattaaaattcatatgttctttattttacttggaatgtttcattaacatgttttgtatgacttataccataatgcccatatgtccatttatagggaggtaaaacacattttcttttaaaatgttttcctacacattttcataaagcaaaataattgtattatttaagcacagaaaaaaatgtatcttacatccaaagtagggagggcatccaacatattatagatttgcttttatatattttatagctttgtattgcatagtttgtctttaagagttcaagttagacttaaatataattttgatgttcactggttttattttaaattgccttcttatttgttagcaaaatgcctttttttaatggtctctgtaaattttctgggctttaatgtaatgccactgtgtaaaaaaaaaggaagaaaatagtaatagccatttaatgttttatatttatcattttaaagatatttttgtcaaatttcttttaataataataaacatatgtaatctaaaggagtgtgaatttgttgttctatccccaaatcatatagattgaactgctattataaaaaacagtcatggcctctcatggaagagtagatagtaaaataatttatagtctgagaatgaaaaagaccgttcttttatgtctttgctttactttttaccgttttgtttcacatattttttgtgaaacaatgaacaaagttggttttaatagtcattatattcacttattaatttgtatatgcatctactatatttctattatgaattcagaatatttggaaacttctatcgtaaacataactatatatattttttctgtgtaatattagggaaaatgttacatatatctctgaaagatccattagtaaatctattttatgttttgtgtaataaaggtttttaaaaaaatttcaacatagatgaaactgtcctatttctctaacatatcagacgtactttaaaaaattctctaaaaagtatatgatctttggtagttagaatgtttaatccctatgactgctgtgcttttggatcaacaaaggaatatttatcttgactacagcagaagctcagtataagcaacaggtgatttaatttaactgattcagcacatgatttctgagtctcctctaattcttaggtttatcaagttttatttctataaatcattctctatgttttttgaaagtgactactttaaatttgaaaatattgagattactgcaaaaaaaactgaaaaaaatcagcttttttgaaatttcttcctatgcagaattcattcaaattaaatagaaatcaaggttatgtatgtaaaatttgtttgaaaacaaacttactaatatgtaaacatcataaagttgttttaaaaaactgttatgtaaacatcaaaaaattcaattattgttttaatcacagtatttttatctttttagaataagtacatacaaatagtgaccattaaaatagtcattgctttattggaaaccaactttgtatttgttgtgcacccactcctctctcacccttggccaaaatcaaacaaaacttactgctccttctaaaatctagaaagaatactgcctatttttgtattttgtatatgcttaaggaaggaagagtctggaagtttcttcattggcttcttacattccaactttgctagtcacaaggcctttgtaaaagagactgtggaaactacttgtttgcaagacatttcccaaatttactgtgcttggcctgtgacacttaatttcatggaatgggattcataaagatgatcttaacctttcattccttaagaatttatcggaaaaaaaaaaagttgtggttatcttagcagtgatttaccattttcatgaaaagaaaattggaggtaggattacatttatttaaaatttcttcagtaaaaatattttaaataatatgctagtaactagtaaacattgcttgtgtggtcttagagtttcatcattcttcagtttttagcccttagagatgagatgtgctctttattttttttttttaattttttttttttgagatggagtctcgttctgtcgcccaggctggagtgcagtggcgcgatctcggctgactgcaaactccacctcctgggttcacgccattctcctgcctcagcctcctgagtagctgggactacaggctcctgccaccacacccggctaattttttgtgtttttagtagagatggggtttcaccgtgttagccaggatggtctcgatctgacctcgtgatccgcctgcctcggcctcccaaggtgctgggattacaggcgtgagccaccgcacccagccgagatctgctctttgacagtgtaattgcccttgtttttctgccacagtgaaattatcttttcaaacctcttgaggacaggtattaattgtgttccagttttgaaaaaaaacttgaatttttctctagtaaaagcaaaaaaaaaagacagaattgctcttttgttttacaccattgttctcttgatggagatagaggatctaggcaaaaatatattcttatttcttatcaaatatatagaaaatgaatttatatttggattttaataagatgaactcttgtttatcaatggttctataattaactagaacttttaaaatggtagtatctaacaggaaagtctagtgagaaagctgtttgaaaattatgtaatgccacacctttccatatgctttaacttcatttatgttccagatttctgcacgatcattgcttatgtatagaaaatgggaaggaaggttcacttccctgaaggagtgattacctggagattccttattttcctttgtgtctacctgacgcttgaataacatattgaaaacgggcaggaagaaaaatttgtaaaaatctgtaattgtggacactcataaccatagataaataatctaagcctgtaaatgaaattaattagtactcacatgggatataaataaaacaaatgtaaattcagaataatattgccaattttcagtattatagaaaaggaagtcaaattttgtttccttatttaaaataatcagtattttataaatttgtttttgaaactattcaaaacacatatcactgatgcagtgttgaatgttgattttaagttcatgttatttaagtgtacacctggagccactgcatacttatgacatcaatattcaatgtgaaaaatactgttgtttctgtgtctcaagattataaatgactgctatagtagctactagtttgtctgatttaagtcttgtaatgaaattttgcattcagcttttttgtggtgatgggagaaggaccagaaacaaccatcccagctgttactgcgtattttctactgcatcttcaaatttcagctttttgtctcttagatttccttgcaaaatagtaaagggtcttatggatcaaaatcaggtgatgttaagtgtacacacattatttagctcaaataataatgatgatggatatgtgaaaatgtcaatttattccagcacctttggaataaatggagatcaattaagaatgcttacactgttaatttaatcattaatattagtgagtgaatttgtgagttcataaagtacagtgagtacagccagcattatacaaaacgtagaaagtccatcaaaggaaagtaaaacaaataatttcaaataggtctgtgttaagagaactaattagaataatttatgattttcatagggatttattgtccggtttgttttaacgtggcagaatatttatcattctcaataagtatgataaatttatttagcaattattccatatcaaccgatatatagcaacagtctacctccaaatatcaattttaaaacacacgtttaacagtgttataaaactggcttttgatgaatcttcttcattgcttacacatgttttaagcaatgaacttgtaaagatttctcctgaattgtattatgctattcttctggatcttagagatcctcaaatacatgagcactgaaaatattataggcattgtttttgttttttaaaagcaaccaggatagtcagagatttagctaagtatacccagtttgtcgtaattgggcatgttatatttttctactataaattatcatttatcagtaacctgttaactacattatgtctacaaaggttttctgagtatattcaataaaacttggcatttctatgaattaaaaattttacagacctgcatttctagggaaaaagctaaaaacctgtggatccatttgctgacattgattctcagttgacaactttagtattttataaagatacgaaatttttcaacattagttattttctacattaaatagattattttctacattgaagtatgctcattagagaaaagcaggaaactatagaaaaggaaacaattatcctgtctccccaccatttatggtatatttcctttttaaattttttattcacctggttatgactcaaaagtataaattgccattttatgttttactacgtatttttataagcagcattattaacttctaaagattaaaaaagcataccactcagaaatatccgtaattgggaaacctagtctttatttatggagcacataaagagtaagcagaactctttttttttttttttttgagacagagtttcactccattgcccatgctggagtgcagtggcttgaataagctcactgtatcctcaaactatggactgaagtagtcctcctgctccaccctcccaagtagctgggactacaggcatgcaccactatgccaggctaattttttaaattttttcgtagagacagggtcttgctatgtggcccgggctggtcttgaactgagctcaagcgatcctaccgcttcagcctcccaaagtgttgggatttcagacgtgatccattgctctcggctttttgtttgtatacctgatgtagaagcttttttctttttcgttaaacatttctaccttttgactctatacttttttaaaaacatttcttccctttaagtaaatcttttaaaatgtgtttgcatgggtatgtgtgtgtatgattcctgtgtccttcattgtgtctgaatgttgacagctgagttgttgtcctgtgggtgtagtatagtgtgttcttaaacatttcaggtatttttgaatttatctatgttgtctttgaatcttttacagggattctataactgccgtcatgtaagttgttacagaagggaggctgtttttgtgtcttgtatatttcttttctttcagaaattacagatgtttataattagcttcaaacactgccttaatagcaattggaagataactgccgtcagccgacgtggtctttccctttacttcaggaggagaatgactactaatctggaagaaaggtcttactatagcagtcagatcaccagagtagtgccgaacacttcctggcttcatctgaaaatttgagtaagtggacaagaactaggagacaaaggctattggacttcactcttcattttatagctcttcctctccagaaggatacttctgaatgggatgagaacactgaagagagccaaattgtgttatccaggcaaattagaattcttagcatctcaaataaagcagatttcatggaaaagatttccatggatttttggatacaattatcataccttactagtttagcaggaatctcttggagagactgtcacattatttccaaaggcccaaatgttgaacatttaatagtgtgtaccactatattttggaccagtagagtccaaaatagagtaaggaaccccacttagaaccttccagtgttatataaaaataattttagaataagattttgaaataaattatgtcttcctctggtggtgatgattccacttcgtggaggttcaggttttttctttcatctcaagtgtaaaatttattcatttcccaccgcccgccacccctccccccaccccgtccctctctttttgttgttgttgttgttgttgttgtttgttgttgagacaaggtctcactctctcgcccaagctggaatgcagtggtgcaatcatagctcactgcagccttgaactcctaggctcaagtgatcctcccacctcagcctcccaagtagctgggattatagacatgagccactgcgtctggcctaattctcttttttaattcaggaacttaaatgagactaatttgatttctagatctttcagtttgtcatcattgcatcccttaaatttgtaaatatattaagaaaggataaatgctactgtaatagaaaattcaatacattataacattaaaagaaatcctcaaatgttaagcccaggtacgttcaatttgagtcttacatctttttaatcaaagatctgtcaatacagctaaaagtgcagtaagtattagctagaaggtcttcagccttaattaagcaaagttgctaaattctgatacaggactcaactcatgatttctctactgatgtgatagagctctacctagtaactttccctagttaccttggacacaaagattctcagcataaggtgagtgtagtaaagctcattcagaaatatttgtgtgtgtgtacgtgcatgctgtaacaataacattgttagaaaactagtatacattatgaaaagtctattttttattagccaaatgtcctgtgaaaggatacattcacttgccgaatgaaagttatcatgcaaaatcagattagaggcctcttttcactcatccaaaaacacaatttaatgccatctattaaaggaagcaccatgttttttggtgttttgtttttgtcagttaagaatcttttgttttaaattcaaatgaaattgatatcctagtcacttctaatgatgactctaatgaattgtaatggtaatttttcagtgaaaatttatcactgtaaagaaccctacggaagcactataaagaaatatagatttagacatttctgtggtacttcaagtctaagtagtttgagttagagatcttatgaagatgcagtgttggaatacaaatatgggagattgaacatttcatgtaaagttaatctttatggaataagttgccaaaagaataaaatatatggatagatatagatatataaaattgaatttttgctggctttatttggtagcatagtttatatgaatacaaagaaaagaattaatgccatgtattcatttgttctacaaacaaattcagttctgttcattatgtgttcagacactcttgtagatagtagagttacagccctgaagagagtattgaaggttcctgctcatctctcatgagtttataattgtaatgagctttattgttctggtgatggggcataaaacacatgccacgttagaggccaaccctgtaatgtcggatcttcacactctcattcctgtttgttgtttagccggtatatgcaaggctgtaaagaacattaggaatcagagacacctaaaatatgacccatcttccacagagacagtgatccctaggtattatatgaacttgaagcattgcaagagacatgataacagtttgtgagatatctaaatccatataccaatgaacggttaaaatgagatcccactgagtctactggaatatatatagttcttctgtgctaactcgttttgttaataaaaattattttgagatatagcaataccctgtgcctaagggcctggactctggagccaagtaaacctgagttcaattgtagcctttttccttttactagagttattattttttattatgcttatctgacgtcagtttccaggttgtaaaagagagataattgtagtgcttatcttggtgttgttgctagggttagaacaaatgaggtaatgtatgtacagccatacctcagagatactgcacgttcagttccagaccaccagaataaagcgaatatggcaacaaagcaagtcacacgcatatatttgttctccagtgcatataaaaattatgtttataatgtagactattatgtacaatcacgtcgttaaaaaactatatatacactatataaaactatatataactatataaaactatatataactatataaaactatatatatacacaccttaatttaaaaatacataattgctaaaaaaaaaaaaaaatcctgatcatctgaagccttcagtgagtccatctttttgcatgcctggtgttgatggttgctgactgattaggatagggattgctgaaggttgggatagctgtggtaatatcttaaaatgaagtttcccacattgattgactcttcctttcacgaaagatttatctgtagtatgtgatgctgtttgatagcattttaccctcaatagaacttctttcaaaattggaatcagtcctctcaaaccctactgctgctttatcagttatttttatggaataatctaaatcctttgttgtcatttaaacaatcatagaatcttccccgataatagattccatctggagaaaccattttctttgcttatccataagaagcaatttctcctttgttcaagttttatcataggattgtaacaattcagttacctcttcatgctccacttctaatccccttgctatttgcaccatatctgcaattacttcctccgctgaagtcttgaaccctcaaagtcatccatgatggttgcaatccactttttccagacaaactcctgttactattgatattttgacctcgtcttattaatcacagatgtttttaatggcatctagaatagtgaatcctttccataagttttcaatttactttgaccagatccatcagaagaatcactccctgtggcagcccaacaaaatgtatttcttaaataataagacttgaaagttgaaattactgtttgatccatgggggctgtagaatggatggttgtgttagcaggcatgaaaatgacattaatctcgtacatcttcatcagagctcttgagcccgagtgactaggtgcatggtcaatgagcagtaatatttttctgagcgataggtctcaacagtgggcttaaaatatttagtaaactttaagtaattcttaaggactctaggattttttctttttcttttttttgagacggagtctcgctctgtcacccaggtagcctgcaatggtgcagtctcggctcactgcaacctccgcctcctgggttcaagcaattctcctgtctcggcctcctgagtagctgggattacaggcgcctgccacaacatgggctaattttcatatttttagtagagatggggtttcaccatgttggccaggctggggacgatctcctgacctcaggtgatccacccacctcggcgtcccaaagtgctaggattacaggcatgagccaccacacccggcacttttttttcttttgagataagagtctcactctgtcacccaggctggagtgcagtgatatggccttggcttattgcagcctcgaactcccaggcttagttgattctcccacctcagcctcttgagtagctgagactacaggcatgtgccaccacatctggctaattttttttttttttctgtagagatggggtttcaccatgttgcccaagctagtcttgaactcttgtgctcaagcgatccgcccaccatggcctcccaaagtgctggaattatacacgtgagatgcctcatgtggccagggctctaggatttttggaatggagtcttggcttcaacttaaagtcaccagctgcaccaggcatggcggcagccacctgttgtcccagctatttgggagactgaggcaagaggatcccttgaacccagaacttcaagtccaggttgagcaaaacagcaagaccatgtctctaaagaaattaaataaagtcaccagctgcactagcccctaacaagagaatccgactgtcttttgaagctttaaagccaggcatttacttctctctagctatgaaagtcctggatagcatctttcaatagaagtctatctcatctacattgaaaatctgtagtttagtgtagccactgtcatcagtgatcttagctagatcttctggctaacttgctgtagcttctgcatcagcacttgccccttcaccttgtgcttttatgctatggaggtgaattctttccttaaacctcatgaaccaatctctgctagcttcaccttttcttctgcagcttcctcacctctctcagccttcatataattgaagatagttagggccttgctctggattaggctttggcttgaagaaatgttgtggctggtttatcttctatccagaccactaaaacgttctccatatcagcaatcaggctgttttgctttcttataattcttgtgttcactggagtaacactttcataatactttccttcaagaatttttcctttgcattcaagattggctgtttggtacaagaggtactacctttcagtctaactcagcttttgacatgtctttctcactaagcttggtcgtttctagcttttgatttaaagtgatagacatataactcttcatttcacttgaacacttagaggtcattgtagggctgttaattggcctaatttcaatattgttgtttctcacgtaatagggaggctcaaggagagggagaggatttgggaaacgtccaatcagtggggcagtcagaacacacatttatagattaagttcactctctatggctgtagtttatggcacctcaaaaaggactataaaatagcagtatcaaagatcagtgatcacagatcaccataacagatataataatgataaaaaaagtttgaaatattgtaagaattaacaaaatgtgacttagagacacgaaatgagcatgtgctgttggacaaatggtgcctgtagacttgcttgatgcagagttgccataaaccttcaatttgtaaaaaacacaatatctgggaaatacaataaaatggagtataataaaattagatatgcctgtaattattagcatggtgcctaataataactcattatatttttattattccagatgaataccagtttatgcaagttcttagtcatcattatataaattcctcatttttgtcctctttggcaagacaaaatctattctatttaagagtagattttaagaatttaaaagaatagattttaagaatttaaaaaagaatctttttttcctttcaaggttaacagagtagttaaaacaccatgacagttttccacacatgctaattggcaagcagttgaaacagtaaaacctcagtgatttgaactgctctgaattatacagtattttaaaagaaatgttactgctgctttcagggatatgtagtatgatggacccgtaaatgttgatccattagaggttctgctgaactttagtgagacttttgttactgtgcacctacattacccttgatgctctcactctggctcttctcctagaatatattaagtacgttaattgatggtctgctgttgtcagtacatataactatttgatgagcatagttattttccttctccaggcttttggttgtaccagttgatgacaacaattcgtatctcttaagatatagtagtttcttacacttgattttatgtcaaaggttatgctcagctttcctgccctgtctaagctgtcagtatagcctatacctatggttttgctgacagtcaagatagcatattagcatgggagaggatgaagttatgagggataaaataagtgctggttgctcttcagatttgaccatatagtcagtaagattttatttttttaaaaccaacttacctcagacaaggtaagctacctgtcacttctttattcttgtttacatttattctcattcaagaatatgaaatcattaagttttgaggtaataaatttctactatatttgattgtgaagtttgcttgaataccttctttttcctggccatggcactcgagtctgaggtttgaagtgaattagtaaaactttctttatccctaaaaattcatcataaaactctaaggaagttatacttattaagttttctctaaagataagattgttttgaacagtttgtctatttacttcttaaatagttttaaaatggcagtatttaccattttacaattaacttcctgaattttgttggttttagaaataagcttaaattttaagtagaatctattcataaatgcttcctctttcccactcatctccggaaccctcaaattaaccagtctataaaaccatttgttatctatatattttcttgcttgatagtattcatttttatctttcatttagatgaatttcatggttttttgtttttgagacggagtctcgctctgttgcccaggctggagtgcaatggtgtgatctcagctcactgcaacctctgcctcctaggttcaagtgattctccttgcctcagcctcccaagtagctgggattacaggctcctgccaccacaaccagttaattttttgtatttttagtggagacggggtctcaccgtgttggccaggctggtctcaaactcctggccttgggatccgcccgcctcggcctcccaaagtgctgggattacaggtgtgagccaccgtgtctggctgaatttcatgtttttaatcccccatttttgctatttttttttaaacgttcatacctctttgcaacacttgtcttccacatgagtcagatattgattagattttggttttttgttttgccgaacaacatgttcttgtcctttaaccaattttcttaaatatatttcctattaatgattaacacattctttggttgggacttaaagccttttattttagtgatttattcctatttttaatcttttcatattttgcattatttttcagaagtatttttgttaagggattctgtttcttcataacatttggatgatttgagagtgttagaagtgtctctgttaccatggctctgtccttcaagttccactttctttgtgtttccaaatgtatcattaatttggtttgaatttatttatgtctaataaagtatggtttatgtactcatcttttctaaatgcaaaaggacctgtttaccagtaaccatgtattttaattattacctatagattctgacaattgtatataatgaatgcagtttccattgtgtttctgtttcttttagtaattcttaaactatgataggtaatttatatatatacttttaatgaataaggcgaaaaaaatgtttttcctttaacatttaagcatataaatgaggctaacatgtctaaagtactggcattgttaattccttcatagttcagccaaatcttggtctttatgtaaaggccctacatgatgattcccaaaccctgattttgctaattcttcatttattttaaaggctatcacaaattattttaatagaaccatttatacctagcatctgtttgggatggaggaagataggatttttgacactaaattatttgaatactgttgacctggaaaaaattagcagcctacctcagcaactatcagtatccagggatatcaaagacattttttgaggtaccatgaggaaagtatgactgataccatgaggaagaaacatcatgatatgtttggtatagtgaaacgcactggaattagaagtgaagaatccagttttctgagcccagttttgcaactaaccccaagcaagtcacttagatgtactcttacctaattacacaagatggtgaaaatttagatttagaagattcattagacacttactgatcctcagtttctttgtgtgtaaaaggaagagattggtttggatgagcaacaggagtttttcggttccaaaattctggggttttttccccccaaaaatgatgttttgagtagtctaaagcttcttatataatgcattcataaagtcaggcaggaatttgtgactacaacgtgacatttgtagactttttacagcgtgacgttctctcccattaacttctgtggattcagtttgaaagttttggattctgtttataatgttcttattccgtattctcatgtttataatggagactgaccagcaagattttgctgtgcgatgagttatctttgacgctttgacgtttattcaaatacagtcactctaataacaaaggatacggttggcagccataaaaaatgatgagttcatatcctttgtagggacatggatgaaattggaaaccatcattctcagtaaactatcgcaagaacaaaaaaccaaacaccacatattctcactcataggtgggaattgaacaatgagatcacatggacacaggaaggggaatatcacactctggggactgtggtggggtcgggggaggggggagggatagcattgggagatatacctaatgctagatgacacattagtgggtgcagcgcaccagcatggcacatgtatacatatgtaactaacctgcacaatgtgcacatgtaccctaaaacttagagtataataaaaaaaaaaaaataaaaaaaaaaaaaaaaaaaaaaaacaaaggatacggttgattacgtttcaaaacagactactatgaccataaagctcattcatctatcaagtgtgttacatttaaggttttggatggaaagcattatatgaattactttctctggattcttttagctcttacttataccagatgctgttgtgactgttgaaactggtttaactgcttatatgcacagattagatttgatttaagttgggtctggaaagtagaaagtgatgagaggtaggcttaattacaatgcccaaacttagcataatatggaaataaaagttaggtacttggaataaaccatagcttttaaactattggaaggttacgatctattaatggtgtatgtaggctcttgaattctattagcagtggcattcttgagatcaacatttgtattcttcatttttaaacttcgccatatggaacaaaagaaaatgaatctttgaaagccagtttcttttcagatatcaaaaaactgaaacagaataaaagaatgtaaaattaaaaataaaagcttaacttctgcctccaccattatgcttcagaagcccagtgatcagtgctgttaatagattgatgtgtaccttccagaagtttctacatgttgaaactggtttaactgcttatatgcacagatacatgtacgtacaaatatatgtacatgtatgcatttctacttttcattctatacattctcttgtaatataattttatttactatatcttatacatctctctatgtcagtatgcacaggttttttatgacttcataatgctccattgtatggctgtacatgaatttatttaaccagtacccttttaatgaatatttagattttgtgcttttaatacaatattgctgtgaagattcttatatgtatattttggcatacttttgcctaagataaattctagcagtgtaattgctgactcagagggtatgtttaattgatttgcattttcctaattttgagttatagtgaatattttctcatgtttatcagtcagattttttttttttttttttttttgctgaactaccttttcatattcttcacacatttttctactgctttactcatttttttctgtcggtttcttcaaattgctagaattgtctatattttgaaaatgactctatatctctgtattgacaaatattttcccaaattgtcctttgatttttctgttattttactttattactgtttatttgcttatcgttttgccattcagtagtggttaagttctatgtacttaacaattttttatgttgtgttttatggactctgttatattttggcctttcccacttcaagattattaaaatgggccgggcgcggtggctcatgcctgtaatcccagcactttgggaggcagaggcgggcagatcaggaggtcaggagatcaagatcctggctaacatggtgaaaccccgtctctactaaaaatacaaaaaaaaaattagccgggcgtggtgatgggtgcctgtagtcccagctacttgggaggctgaggcaggagaatggcatgaacccaggaggcagagtttgcagtgagccgagatcgcatcactgcactccagcctgggcaacagagcgagactctgtctgaaaaaaaaaaaaaaaagttattaaaatgttactttttatagtacttttatagttattttctatacttaaatcattgatccatgtagaattgatagggtatatagagagaaggatacagctttagccagtgagttacttaaaacgccatttatttgataatacatgtgtttacccactaatttgaagtgctgtcttcatttaataaatttccgtaattggataggattttataatgtcgtatatgcatagtggtcagtttctgtaatctgtattctttcctttgatatgtctgcatatactttaccaccaccaaactatttcactactgcagctttataaattgcattaatgtcttccagagtagttcttctcattcttctttcataatttactggatattaccacatatttttcctagctacattttagtataattttgacaaatcacttcttacctcctaccccatgctccaaaaaccaccatcttgggatcacatgaagttgtgtgtgtgtgtgtgtgtgtgtgtgtgtgtgtgtgtgtgtgtgtaaaaattgggagggagtcaataacatctttattatgataaatttttatatccaagaataagatatggatttccatttccaaaatttcttttactcccctgaatagagtggtatggcttttatcacctatattctgcacagtatttattaaacttacatgtaaatatttatctttttattacccttgtaaacgggatttctttctcttccatttccaaattgattactgggttttgtgtgcttggattttccagatgtactgtcatccacaaataatttctactcatgatgcttcttcctcttaatatttcttaaaacagttcttttcatctaagttttcaaaattatttgcataatttataaattatctaatacagtagtcctgtcatttccacagttgctttctgcagtttcagttacccatggccaaccatggtttgaaaatattaaatggaaaatttcagaaataaaccttcacataccttttattacagtataattgttctattttattattggttattgttaatctcttactgtgcctaattgataaattaaactttatcataggtgtgtgtatataggaaaaaccatagaatatatgtagggctcagtgctgtctgtggtttcaggcacccactggaggtctaggaacatatccccctgcagataagggagaactactgtaattcatattatttttttctgaatctgtatgtatgtccctttttcatttgtattacaaagtgtttgtgtttatttgccctacctactacagtaaatagtaaagatattcttttcctcaatattttataatcattgaagttaggaacttcttccatgcaattaatctgtatgagtcatcctgctattttagttttttaacttctttctcagataaaaatgaaaactatcaattttctatacgaagatcatcatgaagtcacttcttagctttcttctaagctaaataattttagttttttggtacagtttcatggaacacaattttctaaaacctttatatcctcttttggatttctttatgatttttcacatttggctaaattcataacatgcctcttcttgagggaacttagtcataattacattgcttgccttgcctgtaaaaacagtaggctagcctgctatgtactttaaatagctgaagtacgtccatcctcagagcaaatattactgaaaatggaatttaaaatggtaaatcttattttgttcatatggttatatttacatttcttgaagcaaacaattgttaataaacagtgtcatggatagacagtgtttcaacagtcttgaaaataaagattgattcaaaggctaagtaagccttggggtccctgtttgtccagaaactctctgctctttattttttactaagttgtgagattgacaaagaaaagcatatttgttacatacgaaatttctagcgcaaggcagaagctaataagtaatttatgtgatgcatatgtttagatttgtgttagtatttacatgtgtttttgtacaaatattattaaatactaatgtgttttccaatataaagtcactgtaatagttaaatacctcattagattgaatttaaactttgtaagataacatcagcttctaaaagtctagcattaaaggctggcattgctgcaactgagtaatgttaaataaagtagtgcaagtagatgcttttaaaaaggaaacagcaatgattttacaaataattaaatgttttctctatgttaatggtttgccccattgagaaatggtttttagaggactataaggcattgtttgcattacagtaggaaatactatcaattttctcattgtctctcacttttttcttttaggtcatggaaaatggaagatttgcaaaatacaaatattttacccatgtcatgatcaataagacagatatgctaatgataaccagacggtaacttgctttctttctcttacgtaattttataaggggttaactgacagcgactcatgaggtgaagatttgttattcaccttttgttccatatagtcacactgattcttgggtcttcttgctccacaagcctaactcgctaaacattacataaatttcctgcatagctttgtgcatgcatacagataaacacagtcatgcacagacataaatattttagtatttgtttcaactaatttaactggatgcagaaattccataaagctatcctcttaaaagtaagctttctcctctctgaagaagtgtacaattttaggttatcccagaagtcagcagtcctctggtagtatctgtttgttagaatatatatagattgacgtaagtggatatactagtagaagcagataaaattttaggtggatactccagcgacttcttcaagtagacagtggaggggtacatgtaaaaatacacaggggcatagcctcagaggggcaagtgtgcagaagtcattgttaaactagggaaaaaatgagcaagtgcattagtaagatggcagtctctgggtggtggagagtgaaaatacggctagcagggagaagttagagctaaatagaaatgaattgtcaatctatggttttgttcacttatgaaaggtaaagttatatgagcattgtgttggttcaaggtgactactaagcagtcacttttaatgttgtaatctcaatttctgaatctaaaatgtatagccctattttaattttcttatttaaaaagtaacaccaagtggaaaacttccacaatattagaagttatacctgtaaaaagtaagtcttcattccaccccagatactggtccctctgttcccttccaagaggcagcccattttttacttgtttcctttgtatccttcttgaaatattctatgcctctacaggtagacatacacacacattttaatgtagatgaaattctcttatatataccattatgtacttagttttaatttttcacttgagatctatattttgaagattattacatgtcaacgtatggacagctgtcttaatttgtaaattcctgcctaatatttatttaggagtatgtacgaatttacatgtaacttgtttctagacttttgtaattaattacagacattgcttcagcgatcatttttgctcataaaaattttccatcatgtttttagtaactcactttcccattgactaaaggaaaggtaactaatcagcattaagcaaaatcagttgcaaagtttggttccaaatcttgcaacattttaaaagttatcttttttctcaacacagtggacctctttagatgaggccatggtgccttgacagaataagggaagtgaattagttgtagttgaataaaacgtgatggttatacttgagattccctttccaagtttcgggtttgaggataaaggatctttgaatcaggactgggaatagctgctacattggccagcctgtctgtgatttttcacatggttggagatgtcctggggcaccactaggtttgctccatcagctcctgtaatccaggactggtaaaagaggggagcagggacagaagatggaagtgagagatagatataaatcctggctagctctctccttttccatcctagccaggagtcagacctttttttttttaactcaatctaatacaaacctctggttgcacctacaattgatgtttcaatcagaaagaaaaattaagaagaaagacatttgaaggaaggattaaatagacttcttatagacagaaggtattttcatttcttggtttctttcttcaaaatgggaaaacaagaatttatttaaaaattagaatgatgctttttgaagtcttcctctaaaattggcagtaatgggacttgattttacctgtgaacatcctgaggccctcagcatgatgattctgttcaacatggttagaaaagcttttttctgatgtagttgggaaatacgttacatggagccttagaaatgaaagtatttattctaaggcgttaattatatgaaagttcctccaaatattggctgatagttggttctgtaaatgtaccctgtttcttatgaagtgccttacatatttgattttgtaagaagtgcttcagtttttctaatataaatatgttgtgttataaatttcccattgagcattatgttagctgcatcccacaaattttatggtgtattttcattcttattctgttcaaaatattttctaatttcctttgagattctttgacccctggattatttggaagtgttacttttaagcatttggaaatactattgttatctttttgtttgggtttctagtttagttctgttatgatctgaggacacactttatggttccagttcttttaaattcattaagaatatagaatatagtctatgttgatgaatattgcatttgcacttgcgattcattcgtatcctgttgttattggatataagtgcctcaattttaaagcgaattctttttttgtttttctttttgcagtggtgtattgtttgtaacaaagggaacatttggacaactcacgtgtgagtggcagtatagttttgatgaatttaccaaagagccattcattgttcatgggagaagattgcgcattgaagcaaaggtatgttgaatagatttattttttgaaaacttggaactgaaaataatgctttgaagtagtcctttttatttgtataatgctctacctcttttatagatgtcactttgtcctggtgtggttttcccttatacctgctatcttacccaggcttaaaggaaaaaaaaaaaaaaactaggccaagaaaaactgtgctttctgtgctattgcactgacaataacattcctgggcccttgctgtatattcagtaacagagccccaccttcccacatatgaaataatggatagtggctattagcctgtgctgcagtccatactgctttcctggctttttaaatatattttccctttctaacattaatacattctcttatctctttgatttcttccccttcccccttttcatgagaccttatatctacaattctgcaatcattctttttttcttttttgagacagagtcttgccctgtcgcccaagctggagtgcagtggcgctcttggatcactgcaacctccacctcccaggttcaagtgattctcctgcctcagcctcctgagtagctgggattacaggcatgtgccaccatgccgactaatttttgtatttttagtacagacggtgtttcaccaggttggccagtctggtcttgaattcctgggctcaagcaatctgcctgcctcagcctcccaaagtactgtgattatagacgtgagccactggacccagcctcatcttttttttttttaattagaagaaagaatgtaattcttctagtgtctgtatttgcatggatagttgaattacttatagaacatgtttgactagtaaaacctttactttgccctctatgacctcacccatatgtacagaggaaaacatcatccttgtcctcaatagtttcacttctgtttgcccctgatatgcttaatatctgctctgagacagtcccactccccactaccaatactaaacataataccaacggagcataaatagtggaggaaaatcatctaggacacaacctgatctctctttgattctaaactatattcttactgtatgactggtttaaaatggcagaagtacatacatgcacgcacacatgcacatacaatatatgtatgtgtttatgtacgtatgcatacacacacatgtgcatatatttttaacctggactcactcatgattctatggccagataacaactgtgtaagaaattatttggagacgaaaaacagtggcactactccccaacttacctccttcccatcctttatgtcgactctttatggcattagcaattaaaatatcaccttaagctttttaacttaggtttagtgataatggttgtgttattaatagaatgtagtctttttttctattggttttgattcttcttgcttcctcattcttgtcttttttaaggtgcatgatttgtataagagggacactttaggcatacagtaataaagctttgtggcatttctttatggatttttacaaccagattatctttttaatgaatttacatattctgtttataggaacgagtgaagtctgtatttcatgccagagagtttggaaaaataattaacttcaagaccccagaggatgccagggtaaatataataaatcttttatttaaataggagctgctcacttcaaaatcatgtaagtggactattttttaatgcagataagttttgtttgggggtttttgtttgtttgttttgcttttgtgttttggcaggttttaaaagtatatgtaaccagataatatttaccccagacttttttttctaccagattcaattcggcatacctacttgcttttcaaaccagattgctccatcttattttaaatgctaactctaattaattttttttaataaaaaagtcaacaaacaaaaattaattattttgttttagtgttaatccatcagctccaacaggaaagtgtagccccacattgttgatttttctactgcatagctaccgtgattttttaaaaagttgccatagctgacacagaccaaagggagccaagcccaacagaaaatccaagtttgaatactgattttgtccttcttgactatagaatcttgcagaaggtcaactaagcacagtttcctcaagatgagaatggtgtgaactgaaaagcatggtgtgtactttagggattatggcaatcaatcacaaggatgtgcactgtcaagaaaatgaagactatgaattgactgtctgacctcattgatcacaactgaagtgctattcagaatgttgagttgtactcattatatcatgaaacttacagtaagagggtggagccaagatggcagaataggaaaagctccagtctacagctcctagtgtgagcgacacagaagatgggtcatttctgcatttccagctgaggtactgggttcatgtcactggggagtgtcggaaagtgggtgcaggacagtgggtgcagcgcaccgagcgtgagccaaagtagggcgaggcatcacctcacccaggaagtgcaaggggtcagggaattccctttcctagtcaaagaaaagggtgacagatggcacctggaaaatcgggtcactcccaccctaatactgtgcttttccaacggtcttagcaaccggcacaccaggagattatatcccatgcctggctcggagggtcctacgcccacggagccttgctcattgctagcacagcagtcagtctgagatcaaagtgcaaggcagcagagaggctgggggaggggcgcccgccattgcccaggcttgagtagctaaacaaagcagctgggaagctcgaactgggtggagcccaccacagctcaaggaggcctgcctgcctctgtagactccacctctgggggcagggcacagccaaacaaaaggcagcagaatcctctgcagacttaaatgtccctgtctgacagccttgaagagagtagtggttctcccagcacacagctggacatctgagaatggacagactgcctcctcaagtgggtccctgacccccaaggagcctaactgggaggcaccccccaagtaggggcagactgacacctcacacggccaggtactcctctgaaacaaaacttccagaggaacaatcaggcagcaacatctgctgttcaccaatatctgctgttctgcagcctccgctgctgatacccacgcaaacaggtctggagtggacctccagcaaactccaacagacctgcagctgagggtcctgactgtttgttagaaggaaaactaataaacagaaaggacatccacaccaaagccccatctgtacatcaccatcatcaaagaccaaaggtagataaaaccacaaagatggggaaaaaacagagcagaaaatctggaaactctaaaaatcagagtacctctcctcctccaaaggaacgcagctcctcaccagcaatggaacaaagctggatggagaatgactttgacaagttgagagaagaaggcttcagatgatcaaactacaccaagctaaaggaggaagttcgaatccatggcaaggaagttaaaaaccttgaaaaaaaattagatgaatggctaactagaatcaccaatgcagagaagtccttaaaggacctgatggagctgaaaaccaaggcacgagaactaagtgacgaatgcacaagcctcagtaactgatgcgatcaactggaagaaagggtatcagtgatggaagatgaaatgaatgaaatgaagcgagaagagaagtttagagaaaaaagaatagaaatcaacaaagcctccaagaaatatgggactatgtgaaaagaccaaatctacgtctgattgtcatacctgaaagtgatggggagaatggaaccaagttggaaaacactctgcaggatattatccaggagaacttccccaatctagcaaggcaggccaacattcaaattcaggaaatacagagaatgccacaaagatactcctcaagaagagcaactccaagacacttaattgtcagattcaccaaagttggaatgaaggaaaaaatgttaagggcagccagagagaaaggtcaggttacccacaaagggaagcccatcagactaatagctgatctctcagcagaaactctacaagccagaagagagtgggggccaatattcagcattcttaaagaaaagaattttcaacccagaatttcatatccagccaaactaagctccataagtgaaggagaaataaaatcctttacagaaaggcaaatgctgagagattttgtcaccaccaggcctgccctaaaagagctcctgaaggaagcactagacatggaaaggaacaaccggtaccagccactgcaaaaacatgccaaattgtaaagaccatcaaggctaggaagaaactgcatcaactaacgagcaaaataaccagctaacatcataatgacaggatcaaattcacacataacaatattaaccttaaatgtaaatgggctaaatattccaattaaaagacacagactggcaaattggatagagtcaagacccatcagtgtgctgtattcaggaaacccacctcacatgcagagacacacataggctcaaaataaagggatggaggaagatctaccaagcaaatggaaaacaaaaaaaggcaggagttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtccttagagacctacaaagagacttagactcccacacaataataatgggagactttaacaccccactgtcaacattagatcaacgagacaaagttaacaaggatatccaggaattgaactcagctctgcaccaagcagacctaatagacatctacagaactctccaccccaaatcaacagaatatacattcttttcagcaccacactgcacttattccaaaattgaccacttagttggaagtaaagcactcctcagcaaatgtaaaagaacagaaattataacaaactctctctcagaccatagtgcaatcaaactagaactcaggattaagaaactcacttaaaaccactcaactacatggaaactgaacaacctgctcctgaatgactactgggtacataacgaaatgaaggcagaaataaagatgttctttgaaaccaacgagaacaaagacacaacatagcagaatctctgggacacattcaaagcagtgtgtagagggaaatttatagcactaaatgtccacaagagaaagcaggaaaaatctaaaattgacaccctaacatcacaattaaaagaactaggccgggcacagtggctcacgcctgtaatcccagcactttgggaggccgaggcaggcggatcacgaggtcaggagatcgacaccatcctggctaacatggtgaaaccccgtctctactaaaaatacaaaaaattagccgggcgaggtggcgggcgcctgtagtcccagctacgcgggaggctgaggcaggagaatggcatgaacctgggaggcggagcttgcaatcagccgagatggcgccactgcactccagcctaggcaacagcaaaactccatctcaaaaaaaaaaaaaaaaaaaaaaaaaggaactagagaagcaagagcaaacacattcaaaagctagcagaaggcaagaaatgactaagatcagagcagaactgaaggaaatagacacaaaaaacccttcaaaaaatgaatccaggagctggttttttgaaaatatcaacaaaattgatggaccgccagcaagtctaataaagaagaaaagagggaagaatcaaatagatgcaataaaaaatgataaaggggataccaccaccgatcccacagaaatacaaactaccatcagagaatgctataaacacctctatgcaaataaactagaaaatctagaagaaatggataaattcctcaacacatacaccctcccaagactaaagcaggaagaagttgagtctctgaagagaccaataacaggctctgaaattgaggcaataattaatagcttaccaaccaaaaaaagtccaggaccagatggattcacagccgaattctaccagaggtataaggaggagctggtaccattccttctgaaactattccaatcaatagaaaaagagggaatcctccctaactcattttatgaagccagcatcatcctgataccaaagcctggcagagacacaacaaaaaaagagaattttagaccaatatccctgatgaacattgatgcaaaaatcctcaataaattactggcaaaccgaatccagcagcacatcaaaaagcttatctaccatgatcaagtgggcttcatccctgggatgcaaggctggttcaacatatgcaaatcaataaacataatccagcatataaacagaaccaatgacaaaaaccatatgattatcgcaatacatgcagaaaaggcctttgacgaaattcaacaacccttcatcctaaaaactctcaataaattaattaggtattgatgggatgtatctcaaaataataagagctatctatgacaaacccacagccaatatcataccgaatgggcaaaaactggaagcattccctttgaaaactggcacaagacagggatgccctctctcaccactcctattcaacatagtgttggaagttctggccagggcaatcaggcaggagaaggaaataaagggtattcaattaggaaaagagaaagtcaaattgtccctgtttgcagatgacatgattgtatatctagaaaaccccatcgtctcagccccaaatctccttaagctgataggcaacttcagcaaagtctcaggatacaaaatcaatgtgcaaaaatcacaagcattcttatacaccaataacagacagagagccaaatcatgagtgaactcccattcacaattgcttcaaagagaacaaaatacataggaatccaacttacaagggatgtgaaggacctcttcaaggagaactacaaaccactgctcagtgaaataaaagaggatacaaacaaatggaagaacattccatgctcatggataggaagaatcaatatcatgaaaatgcccatactgcccaaggtaatttatagattcaatgccatccccatcaagctaccaatgactttcttcacagaattggaaaaaactaaagttcatatggaaccaaaaaagagcccacatcgccaagtcaatcctaagccaaaagaacaaagttggaggcatcacgctacctgacttcaaactatactacaaggctacagtaaccaaaacagcatggtactggtaccaaaacagagatatagaccaatggaacagaacagagccctcagaaataacgccgcatatctacgaccatctgatctttgacaaacctgacaaaaacaagaaatggggaaaggattccctatttaataaatggtgctgggaaaactagctagccatatgtagaaagctgaaactggatcccttccttacaccttatacaaaaattaattcaacatggattaaagacttaaatgttagacctaaaaccataaaaaccctagaagaaaacttaggcaataccattcaggacataggcatgggcaaggacttcatgtctaaaacaccaaaagcaatggcaacaaaagccaaaattgacaaatgggatctaattaaactaaagagagcttctgcacagcaaaagaagctaccatcagattgaacaggcaacctacaggatgggagaaaatttttgcaatctactcatctgacaaagggccaatatccagaatctacaatgaactcaaacaaatctacaagaaaaaaacagccccatcaaaaagtgggtgaaggatatgaacagacacttctcaaaagaagacatttatgcagccagaagacacatgaaaaaatgctcacatcactggccatcagagaaatgcaaatccaaaccacaatgagataccatctcacaccagttagaatggtgatcattaaaaagtcaggaaacaacaggtgctggagaggatgtggagaaataggaacacttttatactgttggtgggagtgtaaactagttcaaccattgtggaagtcagtgtggcgattcctcagggatcttgaactagaaataccatttgacttagccatcccattactgggtatatacccaaaggattataaatcatgctgctataaagacacatgcacacatatgtttattgcggcactattcacaatagcaaagacttggaaccaacccaaatgtccaacaatgatagactggattaagaaaatgtggcacatatacaccatggaatactatacagccataaaaaataatgagttcatgtcctttgtagggacatggatgaagctggaaaccatcattctcagcaaactatcacaaggacaaaaaaccaaacactgcatgttctcactcataggtgggaattgaacaatgagaacacatggacacaggaaggggaacatcacacaccagggcctgttatgggatggggggagggaggagggatagcattaggagatatacctaatgttaaatgacgagttgatgggtgcagcacaccaacatggcacatatatacatatgtaactaacctgcacgttgtgcacatgtaccctaaaacttgaagtataattaataataataataataataataataataaaaacttagagtaagaggacatttctcctatacttgatccctgggcctcctggccagactcagaagagatccctggcctcctgcactcatacaacactctgcgttgatcctggctgtggtgactgtttaccagttcacctgtcacatctgaacccaaactaggggcctctcccactgtctcatacacataccttggaccagttaacatgtcctatgcaattttctatctagacattctgatataaggcgacactgacacactaatagtggaaaacacaaaaggagcaagttacaaagaaagaggaataaagttaccagtcttcatatgcttgtcacctggaacagggagacagataagcatgacttttaggccaccttctttcatgtcactgaaggacagtaccacctgtttcaatttacctgcaataaagttttcttttaattccttcaccatgtgactgactttatcccagaaggtttgtttttaatcctcctgcttggccaggaacatccagagaaggctactggattcagttatctttgtctccctatcttagggctattcttactaggctcttttaagttaaagaggtacaaacatctctgtgaaatctttatatattagaataagccctgtatcacctccgtggcttttatctgtcatccatgcccaataataatagacattactggtagaaaggttgtgtattacatttacattttatttttgtaatttcaaattattttagaatagaaaatatattgtgagagcacctaaaatgctcaagaatgttgcttctactaccctctctggaattgtgtgtaagtatttctactccattagtagaatcctgtatctggatttatggaagttcatgatacaaaatcagcacagattggaaggaatttttttctttcaggctggctcatttcacttaattctgaagatgaacatccaaagaccttagaagaactgcattcctactattaaaccaagtactattgtccctgagccatctgggccattgaagtgaatgatctcttttgcaggatgaattttatgtattggctgtcagtattacacctaactaaactataaagctaacttctagatctccattcattacattttgtttcattacaagttcactgaagtaagcaaatgttcatttattttcccaccgcagtggatcctcacaaagctacaagaagcaagagaaccttctccgagcctctgacagagaacactgcctgaagacacacagcaataagtgattacagctcctagactaccttccaaaacctgtttgggaagcatattacagaaatgatttcaagtaccctgtattctggatgctaaaaaacaaaaacaaacaaaaaaacaaaaacaaaaaaacaaaaccagaatcaggtaaaacagctatgtgattaaaatattttaattcttcagcaattacccggttttctaaattgaatcatgcatctatttataattctaattattttgtaaaagaagacaaaattatgaatcttaagtatttgctccatctttttctctgtaatggtggagaggctgcccataattcatctccacatggagccaagtttaatgtttctagttcacattttgtacttctgtcatgcttatttcaaactccctgagtgatgggtaagaaatcaaacattgcctcagtggtatcaagagaactttggtggtggtttcttcagaatcatgaagttcttttgccagataaatattttgatattattttcctttttaatataaaggataggtttgaattgtacttaaaatgcatagcattattaaaaacaatcttttaaaatataatttataacatagattgaagcctccccttaagaaaccttaaagaaataagtatcctactcaaaaaaggaagtctgtttcagaactttagggcctttgaaatatttcctcaagcctatttcatgagatctacttggtttacccaagtcatgtttttaatagactgctaatatcaaaggagaatttttaaagccttaacaatgcctactttccattcactgttaacatggaataaacacaattcccaacatcttagatagtgtattatgcttccaacagacagtccctctcatataaagtttatgtaccctaaaatctaacccaataacctgtcccgttgccaatagattgagaatttctggtttgcttactctacagttattcaaatgagagtcacgcttttaaatttacagctcatcacagaaatcatcagctatacattagtaaaaataaggacatgaggttttctttcttggtttttgtccaagatctttgcaccttaatattaatggactgtttcaggtaaaagagaatgaatgtatgattgtgaactgtgaagagaatgatgcaggatcctatttagttactgaataatacagagtattcaatgcatgttgtatgtgccaccaagttactattaactgtttttggaattgaagactctgtatagtcaatagttgtgaaattcttctcaggctccttaaaccctcgctttgttgtaaaagctaaaataaacagcatgctatattgtaattgtatttcttgctgaccaaatctactaaatgctattgatttctctctgattactaaaacacattgtttattctcagtagtttcccccaaaatgcttttttctttgctgaacttaa

SEQ ID NO: 1482 - DNA, 240040 bp, Homo sapiens; identical to SEQ ID NO: 1481

SEQ ID NO: 1483 - DNA, 154746 bp, Homo sapiens
catgggagcgggatcggcgcggggggcccgaggcacagcggcggcggcggcggcgcgcggggggtgagtacgaactcggggacgccccctccctagcttcctgctgctccaatctcggggagggccggggttccccgccatgcggtcgcttccagcggaacgtcagcttcctgccccttcctgcgcccccgcgaggcgggacgccaagggttaataggggctgcgcccccggccgggcgagagttggcgaacgctgcccgccctgccgcgcctggcccggctgcccgatcccgttggggcgggggcagagccagcccgggggtcgggggtgggggtgggtggtggcgcctggagcggccggcggggtgcggaggggggctttttggatgcttgggggaggaggggggtctccgtttggggccgtctcggtgtgttccggtgtctcagtgtctgcaggtcccaagcctgtacgtctccgtttctatctgttcttgtgaaattgtccgcaagtttctaggtcaccaggtctcgggttctgctcctgtctccgtgtctgtgtggctctgcacgtccccgcgtttctggaaatctccgcgtgtttgtgttagtcggcctgggtctgtgtgtctgtgtttcctgcttctcggttcctgtccctttcacgtgtgtaagagagaaaaagtgagagccagcatgtcagagcagaaagggccctgggcgatcactgtgcggaacccctcagtgtacagatcgggagacagggccggagaggggcagggactctcccaggagcggctgcgcggagctggggcccagaggctgggattcccagcgtgtggagtaggagttgtaagagagagtgagcctgtgctggagccggcgcagcgtgtgggtgtgtgtgggagccagcagcatgcaagcagcccgttggggcctgtggacggcgctcctctctttccatcctgcccccaggacaccaggacactccccagaggctgttagggctgtagctgggccctgccccctttgagctggagtccgcgggatgacaccccctcctttcttccccatgtcttggaaaaagctggctgtttgcgattcccccgccccgcaccccctcaccacaacacacacacacacacacacacacacacatacgcgcgcgcggcaccagtgagcacactgctgactcattttctccagaagaccctgcgccagggtagatgccagcagttgggcagaaaagtggtgccaggcgagcaccccatggtggggctccagctgtgggcaagtgggcagtcaacactgctcggaggcccagtctctgccttctcctgcctccctgcctcccttgacatcacgttgtcctgcatcatgtgcgctctggcgccagcatacctctgctctccagcatgcctctgctctccagcatgcctctgctcctggacccttctggccggaccaaactccatgtcatgtctatggacacatccctggcctctgcctccttctgtttcctccctgtactcagaacattctccctctcctgtgcctccaccagcgctgcggaccctcagcagccagcagcctcctggtggtctctgtccctttctgagcacactcccctgttctttgttggcattttctctcctccatctctgtccagggaccctcttgatacccacatgcctggcttggctacgcagagtaacatatccactggtggtaggggacagcagtgagacactcacagaatcatgttggtgggaggcaggcggcaccacaggagggccatgaggcttgccatcaggcaggctcgagtttgaatcctaactctgctgtgccagcttgggtgagccactctgctgcttgtttttctcttccacaaaaccggcaccttattcctagctggctgggttttgtgaagatgaacaggaccatgcttgtaaagggcttagaacagggcctggcatgtaataagtgctcagtaaacggcagctggtatttgtattattcccttcatgttgaatgggtgtgtgagtcaatgggaaagttctgggctgcatcctctccagacgatgacctgtctgtgttcccatggaggacgtggaagctgtgaagaaagcccaggcatagccgtctgggcacagggggtctggccagtccatggaggcaggtgggacaggtccaccccacttgatgagctgtagttccagctagctcccttttcagcttttaccccatgcgtgaacagccaagcctagtgtccacagggccactttccctgtgtgtttctgtggcctgggtctcagctcagagccctcagtgactgttgaagctggtgtgggtttctaagatcctgtgtgtttccaggtaataaggatggaagaaaactatccaagcagtctgccggttctggcagtgtggttacccaggagtagccccatttggtgcactggcagagggccttttgcaagggcatagaaacacctgggtttcctctttggagggctgtgtggccagacgatgtttccatgtgatgtttcctcgcggctcccgtttcggctgcctcctggcctccctggcctctgtgctctggtcttcctgacattctggagccctgggtttgcagagacaaggcccacaagacaagtggtgaaaacagaagtctggaagaacaaagccctgagccagcacaggcactaaccatgattagcagtagcctaaacaggattggaacgggagcaaaagaatcggcagggcctccctctgagagccaactttccaggcctggagctgacttagatggctcgttggctccctgggttgcatctctgttcctgctggtgaaggctggggctcgggtctctggcaagtaggaagtccctgcaagtctccaatttctgctccatggagacaagtcaaatgaaaaggactatctgttaagtcatagacttgaagcactgtgtgacttcgggcaagtaacttgccctctctgggcctcagttacgcatcttttcaaagaagggagagagaggactagaatctgacccctagatgatcttaaatggccttcttccactctgacatgctctatacttgggaagtttatgggtcaagtgcacacagaatccatttccaagagggtcagctgcatttgtcagggagaatgaatggaggttgaatacttctgtaataggccttcagggctgaagtcctcaagttggaagccatggtgttaggaagcttaattgaagagaagattctgattccatgtctcctgtggacttcttcttcctgattttcagagattacaaggatttgccctctaattctctgcagagtagtcattttggtatagctgtagccagggaaactgaccgagaaggacatgtgtcgtttttgtaccttctcttccccacctcgcctttctttatcagtttgggaaacttcctaggaagtttggtatgtgacataatccaatgaaggactcaaggagtgagggcaggtgccagacaagggccaggaagagagggggctggaaggagatggaacagaaataaatgggatcgcaggaacacaggaaggcaaggggtagtctcctctgaggaggcattcatggaaaaaatgattctaaatttggggactgctgaatgacagaaagtacagtcaacttctttattgcaggatttctccgagcctttgatatacagttgtgctttccggattgtcaagactgggatgcagggtacagctcttccctaatgtatctggccaatttcctagaaagcatgtccctggtgggtgtgggaaatactactgaagaattatgagcccagacgttgcccaggatggaagtacctgccttccctgagccttggtattctccgtttgtgtaattaaacaaagctgccttttatttctctccagggctcatgctattgccatttgcttcaagtaagcaagtcatgccagaaaggttggccctgcccttctccccaggcaaccccagggcagcttgacactttgacctttagtcgttgcccatggtgagctgggggcctggccccatgaaaaggcattctcacaacagtggcagcagattggagaggatgaagaggaaggaccaaggattatcttggagcaattctggaaaaagtcagagtaggggaattaaggctttgggaagacactttttaaagtctatttttttttttttttttgaggcagagtctcgctctgtcgcccaggctggagtgcagtggcatgaacttggctcactgcaagctccgcctcctgggttcacgccattctcctgcctcagcctcccaggtagctgggactacaggcgcccgccaccacgcctggctaatttttttgtatttttggtagagatggggtttcgctgtgttagccaggatggtcttgatctcctgacctcatgatccgcctgcctcggcctcccaaagtgctgggattacaggtgtgagccaccgtgcccggccgttttttaaagtctagagtcctgtcatatcaggtgatattaattcatcttataaaaatatactggacacttcctgtgtgcctgccaggggctggaaatataagcccggcatggtggcacatgcctgtaatctcagctactcgggaggctgaggtgggaggatagcttgagccctggagttcaagtctagcctgggcaacactgtgagactctgtctcaaaaaaaaaaatgaaaaaaaaaaaaagagtgaataagacaggcatccttgccctttagagacttcgtctagacagggaaataggagagtagacaatgaccacacatgtgagacctgctgtagtgtggcatgtgcagtgagctgcgggaggtgacacccaagctgggatctaatggatgtgtaggaactgaccaggcaaaggagtagtgtctacatgatgggagtagcatgtgcaaaagcccagagctggagaaggcgttcaggggaccatcactggcgtctgagtgctatttcagctggtttacattatgctgcaagtaactgaagacccaactcaaaatagtttaaacgataaggggggttattcccatatcaagaggcctcaaggaagagcagtactagggttggtgaattcagcatcccaacagtgtcttcagacacccactatttttctgttctgctatcctcacgtgctcatggggcttgttaccttatgtgcccaaaatgactgcagcagctccgagcagtatgtccttactcaacaacatataaagacttgaagaaaaccttctctgtccctttgaaatgctttcccagggtccctaacaggcatccctcacctcttattggcctcatttgggtcatatatgcatgcctaaaccagtcactggcatggcaaatgaaattctcgggatcaacttagatttatccagattcatgtaggatcctctaagtccatgcctacgtgagcaagcaggaaggagggatgctgtgggcatgtaatcaccagtgtcttcaccatgcccacagtgacagaagctgtcgtctaaggtgcccagggagtctgggaagaacctagggttccagttatcaaccctggcagacaggtttcctagattatgtgattccacagaagcacactatcctagctttcctcttggaaatacatcctgggcctgtctgtcccagccttagccctcaccacccacctgacacagctctcttgcctgtgtcccgcctgtctctggccacgtgccggcctcccctctgcctgcctggggatcagataccccaggtggcttcgggtgtcactggtggctgctcccacaggaaggtgaaattgtatcattgcctttgcccatcttggcaaaagccacagagcagagctttaacccttcctggccctagagtgtagggacagtggggaccatctaggggagtatttttgtggctggcagcagactgagcccttgccatgcatgagcttattgaatcctcatgcccggcctgtgagatagggaatatcagcccatgttgcagaagataagacaggctcagagaggctgagcaactcattcggggtcatacagctgataagtgacaaggccaggtttgcacgtggctctgtctaactccccctcgtcccctctgttttctttctcccactttccattaggataaagccaagttgggagctgccttcacacagcactggttctggttaaggggtctcctctctcctgccctgtgtgggaattggtctcccaagcagtccagcctggtcttcccgctgacctttcacccctggctctgctgcccattggctggggtctggggaagggtctaaagatcatgaggctgtagtacagatggggagactgaggcccagagaaggggaggggctggcccctggttgctcactgagtcagcatcagattttgagctggaccctagatgttccaatgaccagggcagggctttctatgcactgcttcttccccgttgacgttggctaattgatctgtgagaagtgaggctgtgtttgtctatataagcaggtcctcactgagaggctgtgcctggaggccgggaagagtgggctgctgctctgatggggtcctagagcctgtacctggcctcctgcctcccgtgggcaggactggggtgagactgggactggtttccactcccagcttccccagccggatccgggtgtgaggggtggaagctgatgccgcctctgcttgtgtctcctggtctctagggggtttctcttctcctggatcttagtctcgtttgcctgtcacctggcctccacccaaggagctcctgaaggtaattctctcttctctttgtccagggggagacaaaggagaacggaaggggcctgagaactcaggggtaggagacagccgtgcctgtaattggaactcaatgcctcagttttcccatcagtagaatggagatgataattggcaaattctctttaggcttgaaagaatgacatttgaggccaggctcaagactgcagtcccagcgctttgggaggccgaggtgggtggatcacgaggtcaggagatcgagaccatcctggccaacatggtgaaaccccatctctactaaaaatacaaaaattagctgggtgtggtggcaggtgcctgtagtcccagctactcgggaggctgaggcaggagaatcgcttcaacccaggaggcggaggttgcagtgtgcccagatcacgccactgcactccagcctggcaagagagcgagactccgtctcaaaaaaaaaaagaatcgcatttgaagtttttgtaaaagggtaggaaggactctgtgcagaaatgtggaagggtgattcttgtgttcctttctggggcaaaatttgagtaagttactccggttttaagcctcagttgtccctgtttgtccaatgagtgctctaagaactgctaaaaaaaaaaaaaaggcattaagcattaactctcatggcccaagcctgggatcccatcttcctcttcccgtgagatcctacttttccctgctatccctgaggggctgtccagggggccggggcagcgatgggctggcttcacatctgcccagggaaactgaaacctctcccacatctgtttgtcaagcagccgcatgcctctgaaaatagctgcccttcccccgccttcacgcccagcccgtgtgctggggcaggcagcccggcacgccgggagtccctgtggcctgacctggccactcggcagggattgggcccctgggagggcagggctgtgcccggaagagacttctgctgcccagcaacattttgtgcaaatgtcatattttccaagcttgctgtttcccccacaaagtaggtgaacagctgtccagagtcctgagtcagtcactggggcggggggcggggggagaggctggagctgtgtggagccaggtttatgtaatgaagggatcttgtgggggccagctggcaggctccttctatcttggcgttgggctgaattcattcccctgtcccccatctcttcacccttgatggggtgctggatgtgtctccaccctgctttccgacaagcctgggaggccccaggcagaatagcatcatggctaagcacaaagaccccagagtcaggtggcctgggttcaaaccttggctgtgccttttttaagctgcaagttattccctctgactcttctgagccccctctataaagtgaggataataaagagtacctgctccatagattgctgagagaatcaagtgagatcatgcctgtaaagtatttggtatctagtaagtgctcaacaagtattagtttttcttattgctgttaattagttacctgaaaagtttgggcaagaacagccctttcctatgccctgcagggctcacagtggtctgactcatagcagctctgtgctggtcacatttgccaggtgtcagggcttgagactttgccctttagctgcagatggtctttgggggacacctggagactgctggttgtcagcttagaaacccacccagtggataggggaaacctcacccatgctgcctggcccagccagttgtgactctctttgggtgagtgcaggttagccctaaattccatgtgtggagaaagatgtgagcaggcctgaggggccctccgggggttgttgagcagggactaaaggaaggaccaagtggcttcctgcccttacctcttgtccaaccaaatggctcctcccattctaagtcccagtctatagtgaataatagtgaatagtatttcatgataataagagggtttcagtgactaaaacatataccactaagagaatccttaatcagtagtttattttagcttagaacctgaggacagacagatgggagaaaggatgggaaagaggagtttgaaatgaaatgaaagccccttgggtcctaaggaagaataaaggtcttaaactcaagccaacctgaaccagcaacacagagctatagaattcttagaacattgtaacacctgtgctatctcaagatctgtttctcttgtcttacaggcagggaattgaggcccaagggtcagtaagacacttaagcagagttactcaatgtggggcttgggtgaagatgatgaggaagatgaccatttcatcctcctaacaaccctatggtgtaggcgcactttatagccctgttttacagtggagggaactgaggctcactgctggtcttctcaggctctaaattttggccttctgactccagagtctgctatagaaccattataacatgctgccagcactcaggttctcaatttcccccagggaactgtccttctatccattcatccacccattcatctgcctatccatttacccatccatttatctatccatcatccatccatccatccatccattcatccatccatccaatatccatccatccatccattcatctgccctttcatccacccatccatccattcatccatttatctatccattcacccatccatccatctatctaccaattcatctacctatccatccatccattcatccacccacccatccatccatccatccagccagccattatccatgcatccatctattcatctattcatccatccatccatccatccacccatccatacatttatctgcctattcatctactatccatttatccatccatttatccatccatccatccatccatccatccatccatctaccctttcatccacccatccatccattcatccatttatctattcattcgtccattatacatccatccatctaccaattcatctacctatccatccatccattcatccacctacccatccatccagccagccaggcattatttatccatccatccatccatccatccatccatccatccatcaatccatccaccaattcatctacctatctatccatcaattcatccatccacccatacagccagccagccatcatccatccatctatccatccatccatccatccatcccttcatctattcatccatccattcatccatccatttatccatccatccaccaattcatctacctgtccatccattcattcatccacccaccatccatccagccagtcattatccatccattcatctatctatccatccatcccttcatctattcatccatttatccatccatccgtccatccatctacctgttcacctgcccatttatccatccatttatctattcatccatccatccatttttctatccatccatccattcatttatccatccatccatctgtccatccatccatccacccatccatccatccatctattcatctattcatccatccatctatacatccatctactcatctatcctttcatgcatccatgtatccatccatcaatccatccatccatccatccatccatccacccacccacctatccatttatccattcatccatccatccattcatctatccatccatccatccatccatccatccatccatccatctcccagttgtcagctgagggccaaatgccaagtgttgcattcagcccccagcacaacctttgcagggggtgatagggagagagcattcagtactcagggcctatcttgctgagcttaggggaagggccctgaggacctgacccagactcagattccagaggcagcttttccttccctgctgagtcagagctcaggagcctgctttgccaacactggcagctcagctgactgaaggggtctaatgacctgggaggggaaaggtcaggaagcctttccataaacactctggaagccctccttttcttttgctctggcaagccctgctgacataattattgggcggatgtgacctggccagaccacagtcagatatccatacgctttgccaggggacagaggttgcagggatgctttgattgcttcctctcctctccccagagtcctgtggggagaaggaggagtcagcggaaatgccatcacccttctgatagcagatggcagccccgtagcctgctagagacacctcgggagtgggaaggggaatgggtgggtccctgaggagatggtgaaacctgtcagacccctaggacatctttaccaagctctggtgacaggtctattcttgtcatcctggtccctcacttatggggctgcttcctggaggagatggctttccaggtggagaaaaaggagtataacgtgtcattgttgggcagcctctaacactctcagcaacagcatttggttattatcattatttttagtattagttattatttgaaagggcttcttttgtaccaggcacttaaaaataaatgtattcatcatgtaattgttacatccttctgaggttgggactgttactatcccatttaatagatgggaaaactgaggcactaaagtcacaagattagtaagtgttagaggtaggatttgaactcaggaagtttggctccagagtctgttttttaaccccaacatgcaagattatgcagccagataaggggtcacaatccctgccagatagttccaacgctgccctctcagccaccaccatggggcggtgtcatttttagatgaatgaacaaaggaccaggtagctgtgggtggacggtccacattgcctgtgccccttagggggtagggggtggggtgggctggagcaggccctgactgcgtcctctccccttttccctccctctcagatgtggacatcctccagcggctgggcctcagctggacgaaggccgggagccctgcacccccgggagtcattcctttccagtcgggcttcatctttacgcagcgggcccggctccaggctcccacgggcaccgtcattcctgccgccttgggcacagagctggcactggtgctgagcctctgctcccaccgggtgaaccatgccttcctcttcgctgtccgcagccagaaacgcaagctgcagctgggcctgcagttcctccccggcaagacggtcgtccacctcgggtcccggcgctcagtggccttcgacctcgacatgcacgacgggcgctggcaccacctggccctcgagctccgaggccgcacagtcactctggtgactgcctgcgggcagcgccgggtgcctgtcctgctgcctttccacagggaccctgcactcgaccctgggggctccttcctctttgggaagatgaacccgcatgcagtccagtttgaaggtgctctctgccagttcagtatctaccctgtgacgcaggtcgctcacaattactgtacccacctgaggaagcagtgtggacaggctgacacgtaccagtccccactgggacctctcttctcccaagactctggcagaccttttaccttccagtccgacctcgccctgctaggcctggagaacttgaccactgccacaccagccctggggtcactgccagcaggcaggggacccagggggactgtggcacccgccacgcccaccaagccccaaaggactagccccacaaaccctcaccagcatatggcggtgggaggcccagcccaaaccccgctgctacctgccaagctgtcagccagtaacgcacttgatcccatgctcccagcctctgttggcggctctaccagaacgcctcgccctgcggccgctcaaccatcacagaagatcacagccaccaaaatccccaaaagcctccctaccaagccttcggccccttctacttcaattgtgcccatcaaaagcccccatcctacccagaaaacagctccatcttcatttacaaagtcagccctacccactcagaagcaagtgccacctacttcccgtccagttcctgccagagtctcccgtcccgcagagaagcccatccagaggaacccgggaatgcccaggcccccaccgcccagcacccggcccctacctcctaccaccagctcctctaaaaaacccattcccacactagctcggactgaggccaagataaccagccatgccagtaagccggcctctgcccgcaccagcacccacaaacctcccccatttactgctttatcctcatctcctgcccctactcctggttctaccaggagtactcggccaccagccacgatggtacctccaacttcgggcaccagcactcccagaacagcacctgccgtccccactcctggctcagctcccactggaagcaagaagcccattggatcggaagcctcaaagaaagccggacccaagagcagcccccggaagcctgtccccctcagacctgggaaggcagccagggatgtccccttgagcgatctgacaaccaggcctagccccagacagccccagcccagtcagcagaccaccccggccctggtattggccccggcgcaattcctgtcctccagcccccggcccacgagcagtggctattcgatcttccacctggcaggatctacgcctttccctctgctgatggggcctccgggacccaagggagactgtggcttgccggtaagactgagtggggtctgcatgctgcttggagctccagtgggggactggggcattggtcaagtggttgcccctagtaaagacaggaaaaggagcagcttagagcagggagctggttatgggtacatccttggctccagccaggcccccggctcctctggctctgctaaatgcatcattgcccaccctgctccagattcatgatccgctgggacagactcaagtctggtggctacccccaggtgaagagcatccctgggctttggttggcccaggtccaagcccgttctttgctaacccagctgcaaagctcgaacagcttaaggaaggcccgtagctgactggctccagatcatgcagtgagtaagcagcttccaaagccccgttctcccagctcatggagcaggggtccttctggcccatcagcttgtctgagagttgcagacaaaggtcacacatggggagctctggatatgttttgtttggcacgtgcagtgttcttttttaaaaatccaataacttactaacattttaaaaatgtgagagatttcttataaaaagactcagcaaccaacttctcttggaaagtgggagatgcgatggtgcttgagccaccccgttaggacaagtccactcctgtctgtgctggtccccacttctcctgactgagtcttccgaccagtcctttcacccgtttatgttacctgcctgcctggcacctgcaggggtttgatttgtaacccccggtaggagtttggggtgcagaaggtcagcgtgggccagaaggaagaggaagggagaagaaagaacacgatttgcaggatggtctcagggtcgatgcctccggcttgcctgggaccgtctctaggggcaacgaccttcccacagctggaggccaattcctccgggtggggaatgatgggatggcgtttccagaaggctcagggctctgctctgttctcccgccttggagatgaccaccgtgtggtggcctctctctctccttcctgaagccggctctcccactgggctctgtgtttgaggttagggctccctacaatgtggagacagtggcagatgctgggaattcccaggccttccaaacacacttaatgagttttaataatcattaggaataatatttatccagcctgtctccaagaggacggagagtctgcctttattataaccatattgtcgaacttatggaaactgtatgcattgctttgcaattatgtcaacgttctgctcaagttccgtgttctgaaattggcagcgtagagagttgggagccaccactttcttgtggaaagaacgaggaacccttttcacctctccagccaacccaggccaactctggcaccaggtgccttggggccctgacagctcagcttcccacgctgtgtgcgtgctgggctcaatggcggtgaggtcaaaaggggaattgccccctcctgacatggtgaggtccatggtctcaattctggccacacagcacaacccagccctgaggaggaggccggccctccctcccaagaatttgtgtggtgtggagagaggagcggagctggcccagggcagattctatagtatcttgggtctgctgtatgtctgagtcaaatactttttcctggggcttggggctctgggtcagcaggaagcgaggcctccttccaaatctctttgaaaaagaggaggcactgaaatgaaactggtcagtcagtggttgcttggggatgacttagttcaactttcctcattgggcaggtgaggaaattgcgctcagagagggccaggacctgcccaaggccacgcagcacggaggaggtggagttgaagtttacattccagactgtagcctccaagactagcacgttccatcccactgccctgagtgtccactctgaggctctgggactcagatctgggggactgggggcttcagacaggagtcactactgtccctggcctcaaaggaagggctcaacatctaaagaatctttttctttttttttttagagacagggtctcactctatcacccaggctgctgtgcagtggtgtgatcacagctcactgcatccttaatctcccaggctcaattcatcctcctgcctcagcctcccaggtagctgggactacaggcacgtgccactatgtccggctaattttttcactttttttgtagagtctgggtctcactatgttgcccaggctggtcttaaactcctggcctcaagtgatcctcctgcctcagcctcccagagcgctagaatgacaggcttaagccactgtgcctggcctaaagaagcttccgattcgataacccatcaagtttatgagctgcttccacaggcgcggtgtctcctttaggacctcatgaaaactggttgaggagggcaggctgtgtgtgttcatccctgccccacagatgatccaagaggggttggaaagagataaaggaccccgccaaaggctcccagcgtgttcctgaaggagctgggatgcaacttgtggtccctgacttctggccagggctgaggctctttctgctccttcagccctgactactgaggacaaggggaagacaccaacctgcccgggtgacatccctgtctcaggccccatgctatcccctgtccccaccctaggaggaacccggaagctggtagaatctttgtccactgtgtagcagatggcaacctggtcacttcttcaccagataccagaataatgtaatggaagaggcatctttgaacggtgatgaaatgaactctcattctttctggcctctgctgtcttcccttgacccccatatatatccaggatctaagcccagcagaacagaagctccagctgcccaggagaagagcttaattgtcccccatccaggcacatgcagacttgggttcaaatcctgactccaccccttttagctctgtgactgatccatgctgagcctgtttttgtagaacataagatgataatagctcccacctctggtggggagggtggcctgaaaatgtgcgtaaattttatttgcatataaagctgtagtagaggctgggcgtggtggctcacacctataatcccagcactttgggaggccgaggcaggcggatcacttgaggccaggagttcgccaacatggtgaaaccctgtctttaccaaaaatacaagaattagccaggcatggtggtgtgcgcctgtaatcccagttacttgggaggccgaggtaggagaatcccttgaacctgggaagtggaggttgtgatgagccgagatcatgccactgcactccagcctgggcaacagagtaagactctgtctcaaaaaacagctgtagtagaaatgaagtaatttgggctatcttatctagttttgctgagtgactttgaggaaattctttcctctccccagggctcagtcttccactgaaatagggtgttgggacagctctccccttagaaatgactgtgggacctttcagtgtttgagaaaggtgcagtggctgtgtctgcatgtgcaaacctgctcctcggggttcagggcacgagagcaactggcagaggcagagacagagttctgggcccaggcctgccaggagttgtagctgctgagtgaggaagctctgtgggagccccaggaggggggaacatggaaaaattgagcttggccctgggtgagttggggcggggaggccgtggttcacagccctgcacagaagctgcacagaagccccacgcctgagaggaggcgagtcaaggccttatttattcacgatcaggccactggcatttgcccgtgcttgcactttttgcaaatgtcccctcgggaagacgccgctaagggcctggcccacaccacgtgctctgtgactatctatctatgaaatgaacaaaagaatttgatccttacgaaatgcaggtcgtcctgactcccaggcggggttccttgaggttacccagaactctcctgccagggagatgaggaggccatgtggactgcaaaagaacataggctttggatttgggacaacctggatttgaaccattcccttattcagccatccattcattctttgcacaattgttaactgaacgtcctgtagatgcctggtgctgtatgacctttggcaaatcacttaacctctctaagcctcagtttctgcctctataaaatggggatacggtgccacctacctttccagggtcgttacatggattcagtgagatgcgggggtcggggggaggggagtaaagcacatatgaaacctgggtcctggtagattgtcatggctgtgattgtggactgatggtgggtgttgaggtggggactttggtgcactgagagaactgggagggtctggacatagtctcacatttgcttggagaactgtgctatgaaaatactaacctggggttagtcggtggagcagggacagcagggagcctgaatggataagagtgtcatgacacatgtcagctagacagcgggggtttgggggaggactgcccccatttttttttttttgagacagagtcttgctctgttgcccaggctagagtatagtggtgcgatctcagctcactgcaacctccgcctcctgggttcaagcaattctcctgcctcagcctcctaagtacctgggattacaggcatgtgccaccatgcctggctaattttttgtatttttagtagagacaaggcttcactatgttagccaggatggtctcgatctcctgacctccaggcagggcccagactcactggggagagttaaaggaacagactatttacggaggggtggacagcatcaagggaaccagcagaggcaggtgaaacacaaggggcctggaaactgcaggaaattgttaccacacccagaccagaaggtcccagggaaagatgttcccagaacccaataagagttaaaaccttgagcaggggtctcctcacagaagcaggggccatgggcgaatacagctgcagccaaattatagcacagcagagagggcacagggagagaaatataccctgtcctcccttctgtgcactctcttcctggggtctcccattggccaaacccagctggaagccagaggtcaaggaaggccggggtataatctgtagaagtcagcttcccagggcacggcacagatctggggagtaaatggagaagaaccagcatgcatatgccatctcagaatatgggtattacattcccatttcacagctggacaaactaaggcccggaggcccagggagattaagtaacttgctcaaggtcatacagagctgtactgatgccaagaagctctgttccagcaggtccttcccaggacagaggctagggaagtctgggtgccctgtgtgaattcttaggaataatcatgagctcagatggtcagagatgggagagccctttgaggccccctatctacccccaacaggttacagacacagagtcgaggcctagagatcaaaaggacattgctcagggtcacatggtaggtagcagcacacctaggatcggactttggtctcctaaaccccaggcttgtaaaacctctcattgcttggcaggcagaggctcttccagctggacacaacggtggacttgttccgtaggatggggttcccctagatctggctgtcagaggccaggacccttgggggaagccccgaggggtctgcttggttgtttccatggctctgtttgcgtacgcctggagcccaggcctcctccacctcccccaggcaggcctgagcccccgctctgctccccctcagctccaggccctctcagaggccccgttgtttgcaacgcaaagtggaaaatcccaccccggcctcgtgaatcatcccagagtcacccgctcaggcttcaggccctggaaagaaatggcagcgtttttccactgcggagagaacaggcagggtctcggatcaggggagaggggccagggggcacccgtgctcgccacgagcaaagtgggcactgagtaggggagggtccagcccgtggctagcactgggcagccggcggtccccacccaggttgaaggtggagtgaagggattggccaggcccgaagctggggccgccccgtcaaggagtccgcctgtgggctgacatcaccaggctggaccctgggtcctgagtggcactcagagtctgctctgcagatgtggtggatgaggtcagactctatcctggatgcccctatttctggggcagaagacatgccaagagggagtgtccaggcctctgcagctgcagccccaccagggtccatgaaggagctgcacccacggagcctgttcctccccggagtcctggacaagcccttcaccctgctgggtctttgccttctctgtgagatgggaagaatctcgcttttcctcttcacttgataatgtagcagaggaaattacccccaccttggctttccgcaactcaggaaatgccagtgccaggaagtttccaggatcttcatttcacagatgtccagagaagagaagggacttactcaaggccatatacctagttagagtcacactcaaccaagattgtgtggcagctgcccagggtaggagaacaggtccagtggtcctgggtttgaatccaggctctgcctcttgttagctgtgtggcactgggcaagtcacttttcctctctgaacctctctctggtttcttacctgttgaaacggcatggtatacctacagtatgcttcgtctcagccccctgctttttctttaattctgggtccacctgggacagttgggtcaaggagggccttctaagaagggacatcttttgctgtcccctagaaacagatgtgaaggaggatggcttaaaattttgagttgaggacgttccagaagcttgcttcacagaaataacagctaacattttttttgagcattaattgggtgccagacaccaggattagcacttgttatagattatctgtcggctaggtgctattattaacctcattttacagtaatagaaaaaaggcttggagcctggaaatagctttgctcaaagccacccagatagtaggtgggtgggggggggtgccctatgtgaacccaggcccgtggtgttacaccatactctactgcccagagacagctggagaggagaagtgggtaagactggcacccagagtccagaacccacaaaaccagacaacccctctacccacccctggaactctgccgccaatttggccagaggtctctggatgctcagaggtagctgggacttgcccgaggtcacaaaacagaccctcctccttctgctcagggctcttgcccagtgaccttggtacccatatctgcctgtctggatctctcctctgatttttattcatggacgagcaagcacgtggtgttcacaggccagaactgtgagccgagactgcccagcatgagatctggattaattaccagccaaaccagactgggttttcaacaccgattttaactctgggcaggaaatctggaatctcattgatggttatttgaaacaaatgaattccccaggcctcacacatcctcgaaagcctggcttccttcaaaggctgcaggcacagttcttcacatcaggcgcttagttaatcctcatttactccttcgaggtaaatgcagtggtagctattggacccatcttaacggggagcatctgagactcagataagtgggaggaactgcaggaagtgtgcagctattaagtggtaaagccaggatttgaacaaagatcagctcatccttcagtaagtctgctcggctgcctcccttcctgtgtaaagagaaaagagatgaggacacacagatgctccttaaatgctgagcttcagggttaggtttttcacttgtgggaaatggggagcccttaaatgttgttgagcaggggagggcttttggaaggtgaatgaggctgtgtggaggaggactgcagaggggagggaggagagagtagaggcagggagaccactgagggggctgctgccggttcttggggagtggtgatgaaggctggaccatgctgtggccatgggaacagatagaaaatttgagtgccagttacataccaggcaccgtgttaacatttatcatctctcatgtcatccttggaatcccatggggagtgttttattgcctccgtttgtatgggcacaagctggctaaagacttgtgcattttgtcagcggcaggcagggatctgaacccaggcatgtctgattcaaaaacccatgccatgctctgtgtgctgtgctgcctgtttgtggggcagagatacttggtgtgaccttggccaagtcccttctctgttctgattctgcagagaatttggctgagctctgaggtttctggctgttttattttatcaaacgtttggctgagccctggggataggcagatgactcatatccccttagttcctttgaggagactgtcatctgatgggagacacaggcttctaagcagataattccccaagtaagatagcggtctttaaaatagaggaaaagaagggactttgtccaacttggggaaggttttctggagaaggtgacaccctaagttagctgggtgataaatgatgagggcgtcagtgactgaatagtagctatgaaagcccaaaagccccaaagagcatgaatttctcagggcagggacctcaggggactcctcctcttagccgcggactatccatgcccacagctgcaggcgggattgttgaatgactgcttgagcccattctctgctgccagtgggcactgtctaatgctgtcttcttgttttctcctcagggtccccctgggctacctgggctacctggaatccctggtgcacgtgggcctcgggtgagttatctcacactgtcctttggaactcttggtggctctttggcctgcgtctcactgcccctgaggtctcgggtttgctgtgtgtcctcaggttcttccctccccctctctggcacccatatttggctttatccatttggagtggacttagggctctcaagggtgctatatggacagatatggcatggaacagcaatgacctcttgtaggtctcagttgtccattggggatatcaccctttgcagcctggggtggggaaggggctccagaagatcacatcccttcggctggtgagcttcagtgtttggccaggaaaactgccttggggaatatatgacccttgcatccctcttcctgtttctgcagggctctcctggagtaggggtgcggacataggtacctggaggggccatgcggggaggagttgagttcctcctgctggagagaggctgggggacagcttggcaggctgcggtggctgactgagctagcccaagcccgagagggaaaatagctcctatgtgatgtgcctggcaccttcttttatgctgccttatttgacctctcatgcccaccccaagttcccatgggacagtgagatcattctcattttagagatgaggaaactgagtaggaaatggcaaaaccaggactggaacccaggctcttacccatatactggaacccttggagatccccttagagggaaacctacctgcttcccttagagggctgagaccaacagcacccggcatctgtgcccaggctgaatcagcctttcccacgctgggtgcctggtgaggccctggcagaggtagctgcctggggcatatttttagctctgagcccagcgagtggttctggttatgcaattacccaagccctagttccctccagacctggccctgtgctccctgggcccagggctctggaatctgccatctgaagcggcatttcctcctggcttcagagccttcatgaagcacgtgccctctggggaccacatagatatcacagacgctgctagcccatgggaccttgcagcctgggaccaggatgaggccgttgacctaggcagcctactcccttccccaacctcctgagcccccaagcctctgcggttttgctctggctgtcctcctttgtaaacttgtcctccattcatgtctaagagcaaatgccacctttatttctgatgaccactcccttcttggaactcccgcagtggttcccctgtcccctctggatggcatgggccactttctcaaagctctcattgaccactaaactctgtttgctgagccacatgtgcaggatctcattccaccttcccagccattctgagaaacaggtttcaatctattcccattttacagatgaggaaactgaggctcagaaaggtttagttacttcagataaagtcaaagagagtaaatggcagagccaggattgaacccaggcagtctgcctccagagcctaccatcttttttttttttttttttttttttttgccagagtctcgctgtgtctcccaggctggagtgcaatggagcaatctgggctcactgcagcctccacctcccaggttcaagggattctcctgcctcagcctcccaagtagctgggattacaagcacacgcccccgggcccagctattttttcgtatttttagtagacatggggtttcaccatgttagccaggctggtctcaaactgctgacctcaagtgatccacctgcctcggcctcccaaagtgctgggattatgagtgtgagccactgcgcctagcccagagcctaccatcttaagcatctattgtgcttatttttctgagtattcacctgagcccctccagagataggcctcggttacctctctctcctacgtgatgcctggcagagcaccctgcgtgctggaggtgctgggcaaatgattggtgaagagttctaatgtaggagtcaagaatatttctaccaagaagttgtggaatcttaggcaagtcccttctgtccttctaggctcagtttccccatctataaaggctggggtcatggtaaggcatttctaagtttccacctagctctgggtgaatgactctcctgacacgcttctaggctctttgcctgcacgccaccccaactctccctgcccgccgtcccaccatcatcctgtttctagactggaaattccatagattataaaattccaaagataatagaatgctggattaaacaatcccagctcctctctgcacagatgggggctctggggcttaaggaggggcattcttacctgaggtcgcccaaagctctctgtcttgccccttcctacctccacatattcccccagcccatggagggatgttggggaatcccagagcctcccccacctggctttctaggctgcagcatttatagaattggtctgcttggctttcagtcaactatgtgcctcgtttctctgcaatactggagagggttggggacgggggggcagggaaacaggaagcccccaccttcagaagctgcagatgggggagctgagtgctctggcccaccatctgtggggcagctggggcacgactggggagaggcagccgcccttgaccttgtgcagcctacgcctggctctggtggaactgggtgtcaggaacccctccttgaacactccctcccaacctctgtccaattcccactgagcttgtggttagacctggttagaccccacaagcctgggctggggtgaacatcggagggtgttccagattccttagagactgctgggtcccagtcacttacagaacagagggagagaccgaggctggggattatgaggtggggctcagaattgggactcagtctcgatgcttccaggttctgtcgcgtgccaggagacagtgtttggtggactgcaggggagggcaggagggctgattattttggaaggagggtcacaagaggcactgagaaactccccaggctcagtgtgctctggacactgttccttgccggtgcattcggagaaggggagggtcccagttcaggcatcaaggaagagaggaagagggaggtgccttggttggaatgtgacaggctgcagctgggaagctggcctcagagagggaagaagaaagcagttcacacacagttagcccgatgaatcaagagggacggggaagagggcagtgtgcctagaggctggtggggttgggaggaccactggacccttgagggtgcctctcctcacctcctatgccccagattattcctgctagacaaaaaccctcaagtattccccggctcttagggctctatttatattactgtgctggaagactctaggccagggcccttgctggagaaagtggacataacaggacccagctgttatcggggaacttggatatggcctgggaaaatccagcgccatgaataaactctggacttgaagccaccaggccctggaccctgatctcacttggccacaaatctgctgtatgaccttgatcaagcctcctggactctctgggtccagtgttcccaggtgctctgtggtctctggaagaccttgaaagcttggagcttgcaggtgtctaagggtctgatcacgtgttgtagccacaggagaggtgcacctttgttcacaagaggtcaaatacatccttcttgagctctcaactccaaagactcatacaaaagtccagttggggccagctgccgtggctcacgcctgtaatcccagcacttcagaaggccaaggcaggaggattgcttcaggccaggaattcgagaccagcctgggcagcatagcaagactccatctctataaaataataataataaaataataaaaataataaaataaaaataataataaaataataaaaattagtggcccatgcttggagtcccagctactcaggaggctaaggtgggaggatctcttgagccgaggagtttgaggctgcagtgagccatgatcataccactacagtctagcccaggcgacagagcaagaccctgcctctaaaaaaaaaagtccacttgagactggaggagccctagagggttccccggaggagatggcactttgagccaggcctgaaggatggatcaggtttcaagcagaggagatggatgagaaaagatgctgccagatgagggaacagcatgggcaaacgcaacgaggagagaaagtaccagatacgtgggagggaaatgcatagctaagtgtggtttgagcctgaagaagctgggaagggctgacggggctaggctgagagatgtggagaggtggtaaaatttaggggtgaaggacttgtgctccgaggtcaaggtccagctctgcctcttagcagctgggtgatctgagacagttacgaacctctgtgaacattggcatcctcgtcttcaaaatagtaataacaacaccacctaccttccaggttaacaggatcaaatgagatggcacatgggatgtgcttcccactgggccaggcatggagggtgtactcccaaaagtaggctgagtggccacgacagtgttgctagggcttggcttggggagaagataaaccagtgggtggagggaaggtgccaggcattgctgtcagaggcgagatggcccctgttttttgtcacctttttttgtttttgttccttgtctctttcagggtcctcctgggccttatggaaatccaggtctccccggccctcctggagccaaagtgagtatttgctggagatgtggccatggagtgggtgctggggttggagccatgtttgcagtgcttcccaggggtgcctggtgggagggcttcaggggaactgagggggattcccgcctaagccaggggcaccctctgggcccctttccagggctgggccctgtgcctggtccggagacacagtgcttccgtctgggagagacttgggagagtcgggcagttggaacccagagccttcaggggagtgggcagagaggtgatttcttgctaaatagggaaggctggccttgaatgtcagactaagaacataaggcttaccgggttgtaagatgcatcctggggagggatgtggaaagatgacgttttagaaagctcactggatgccctgaggaggatgaatgcggggtggggaaccagagccaaggccgggagaccaggggtgatatgggggagaaaggaggctagtccgggccaacttaggggtgtgggaggaggtagggtggaaaggatggtggtgggtgcaaggtgagagacagttacaaacaccagacagtttttacctccctgatgttagccttggggactgaactgggtcccaggaggaggagtaagatgatgttgcacgcaggaacatgtagcccggtcaagtgatcattcatggacagatattctggaactcaggattgctctgagctggagacagagccagggggaggctggcgcagagatgccacctcccccagggagtcttcttggaatactcgaattcacttttaatgagaccttagtggctgatgctttgatgatatgggaacaccacttgctgagctcttcagtctgttcccggagctctggcagagggcaaggttgttggggcactgcattggaagtgagaaactcagagcaccaagaggattgccggagccagcaacatttaggtcatgggaaaagaaagtttgtggaatggctggagagataggaggggaaggaagatgctaaagtccctgaagctaagagaacagtgcctgtgccgaaggagctgtggagggggcagatgggctcctgactcaggggcctcccagctcagcctgtgtcatctgtggggtaaccaggtgaagagcacccccgtgctttggttgggccaggtcccgggtcattctttgataacccagctgcagaggttgaatggcttaagggaagcccttaactgattggctccaggccatgcacagtgagctgctgagcagcctctaaagcccatctctcctgagtcatggagtagggctccttttggcccatcagcttgtctgggagctttggacagaggtctcacatggtagccctgggcatatggatctgtggtgtcagagtcttggggcagagcagagtgcaggagcactggcctcagcccctctagatctgtgactctacgtccagggttgggctgggctgggttcctttccggaaggcaggcagtggaggcctcaggtgtccagtgcttagcagctgcctggaggtgctctgggctttcacagggtgaacactgatgataataacagccatatactgaacccttcctgtgtgccaggcactgttcatgcgtttgatgtggcttgtctcatttgatcaccacaaagacctaaagagatgggtggagataccgtacccatttacagatggggaaactgaggcacgggtcgagtaagacattgtctaggaaatggcagtggagactgcccccatgggtcaggcagagaggcaggaactcatttggagagttctgctttgcagaggccatggcacatcaagatgccgagcatcagcagctgttttgaatggccaggcttgccccttcctggcctgctctgggaccagtggagcctgtctcctcccacccccagactcactccctgctcctgtggtagcagatgctccatcagccccttctgctggccctgctcagagcactgtggaacctcagtaccaggcccatggtagcccaccccaatcttgctaacagatgtgccatggtaggaggagggcctgccagctgtttctcctcgcattttgaacacatctcttagtatgaccactgaggctcctccctagcaagtgagttctcctgccaccacatggagctgggaaccatggactcagggcctcatggacaggactcccatttgcatctgtgtataatagataaggatgtgggttctataaaatacactggaatcagaggctgcttctctcattgggacttgcataaaatgccagggggaaatgtcatgccctttgcctggacacttggccctgaggccaagggtgaacagaggtggccccagagcaggctggtgggaggcccagttaactgggccagggccctaggctgatctgtggcatgggcaggacaaggttaaagcagaggccttccctggatggaagtaatgacttggctgagattggctgagaaagctgtgtgtctgcatgaatgggtgggaccctgggaagagggtcctagagtccttactgttcagcagatcccctttgggatgggaggtgacctggtgggactgtagggctggcctcccccagggcctatgctgtcccgtcctcttccagcatggtgtctggggccacacatccattcatcctccttcagtcaacaaacgtgtattgagcacccactacgggctgttgacagataaatcagtcacactgtcagggcttgccctgggggcacggaactggatcagccccatgcagtcatcccatcagtgcatctccaccttcaggtgcttatggccttgtgggaagacgatccctctgctagactcaagggtgggagagatgggtggtttgaggaagaccaagaaagagagaaagcagaggtgagggacctcatccctccggagggtgcagaagagtgaaagttcaggaggccaagggaccttgcctagatcacggctgggcagtggggggactgtatttcagatccttgggtttgcctgccagaaggagctttgtcagggtgtcacagctggcacaggccagagccaggccacaccccatcttcctcctccagagtccaaggctttgcctatctgccagctacccacatatcccatgttccaatccagcagggaagggagcttgtcagctccagcacagagttggatccaggactttgagaatgaggcagagaagctaggaccctgagaggatgtgtttccgcttagagcggtgctgacccgtggcaggtgctgcagaaggggcagttgtctgcatgtgtgaggcactggggctaccagggacacaggcaggcatggtccctgcccttggggagtgtagaggtgagcgagaaagcaaaacaagccaaccatattgacaaatgcagacttacaccatgattaggtctctagggctccatgtgagaggcccggagtgctcggagaccccacgatatggggattgatctagtccgggaggtgagggacaccttctcagagggcaggaaggttgaaccaaggtctaaagtatagtggacgactaggcaaaggggctggaggaggctggtgagggcaacaggcctggtagtttgcggtatgattttcggactttatccaaagagcagctggaagacctggaaaggatttcagcagaattgacatgactggatgaggtctgcaaacgccatttaggccatttgagaagcagagcttggctggtggccagatggagggctggagctgcccctggggcagggtgctgatgctggaccatggtggagtcaggtgggatgcaggtccttggtgcaaatgaggagctctagggcagaggtgggggtctccttctggatagggaagctagtgctccccgccagtgctccctgcactgggccatgaggctcctggttccactcttgagcagccagccaccttgtctctggtctggtccacttggtctgcagtgaactagccaggatgatatggccctcagacactgggaaggagatgtggtcagcagagggcaggctccatggcccaggtggctgctggcagagctagtgtgagctttacctttcctcttcctctaatgttccttcctttgggccaggccctgtgctgggcacttgagatcagagatggagtatgcagggggcttccagcccagaatattttaatcctttgtgatttagtgctcatttgtctcagccccaccctgggcctcagccacccaaggaaaatatggagaagtccagaagatgtcaagaagaaagtgagctatctgtagtggtcctgcccagtaataagctctgagagcactttgagcaacctttgggccaggccccggccaagagctttatgtactttgcagggcaggtattattacccccattttacagatgagggaataggtccaagatgctaaataacttgcccagtgtcacatttctagtaagtggcagagcacgcattcaaaccctcaactgtctgacctcaaggtgtcaatctagccctcagctccacagctctctggtcttccctgtgtgtgtcacatatgtgagtgtggatccactttgtagtggctgggtatctggccttcctcacttaacaattattgtgaacattctcctgtgttagcaacttggcatccatcacatatgatttaatagcttcatggcattttatcaacactaatatcccatgctttatataacttactccattagtaaaaaaaaatcagttccactttaaattaatatacaaatattatcttgattaacattactgtatgtaaatgttagaatatctccaattatttcattaggataagttcatcaaaaatagaattgctgatgtggtctcaggagtcagtgtgcccaagtttgaatcctggctctactgatgcagggcagacaagccccaaattggggattagcctgggagggtttttggcttcactcaggaaagaattcaacagccagctggtggtagaagaaaacagctttattgatgtggcagtacagctccgtgactgctccggcacagcagggctaccccataggcagtgtgctgacagtaacggttcagaggcaattctgcagtcatatttatgcccacctttaattatatgcaaattaagaggcagagtatgcagacatttctagaaaagtggtggtaacttccaggtcatcaggtcattgccatggaaaggggcagtcactttcaggttgtcacctgagaggtgattctacctcatgcctgttttagctagtcctcaatttggtcccaagtccaagccctgcctccagagtcaagtctcatctcccacctcactaccatttgctgcttgtatgactttgggcaagttacttaaaacttggagggcctcagcttccacttctgtaaaacaaggatgatcatagttcatacctcataggattgttctgaggattaaactgtgtgtgtgtgtatgtgcacacatatatgtgtatttatatatgtatatgtagacatatatcaagacatataccaagatatatttgtatatacatacacaggcatacatacacatatatacaaatgatttataatatgccttgcacatgagagacatataagtgcttagctgttattttattagcaattgccttctagaaaggttaaactgatttatgctgctgctagcattaaaggaagatatttttaaaagaagataatttattatcattttcacttcattgatcatctatgagatgtatgtttttcttaaatctcttttccatttgtacttcaccacttatgagtgggtttattttggaaggttgggatgttgccatttgttattggtttgtaaacattattttgaggttattaaggcttcatccaccttacaaatattttctagtttgttgtttgcttcttaagagtattcatgatgattttcacaaatagaaatgttatcctttaaaaaaaataatgtgtcagataatctcaggagggctctattcatctataaaatctgtggttctttattttgcttttatacataggaatgtttttcccattttaaggtcagataggtattcatttatattccttgtaatttcataaaatcatttgtactcttaaaaaattaaaaccatctggaattcatgttaatgggggtgatggaaatgaagttgggctccagcattatttctcctccaacagttaaccacttgttaaaccatctttcctccactgtttactctatgatagacatgggtctaatacaagccattgtattatgtttcattgtttatttatttttatgctagtaaaataccaattatatgacatttactatctttattctgtgtatcctccttcttttcttcatttaaaacatttctggctatttattctatcagatgaaccttatgcctatcttaataatttccttgaaaaaacgcttgggatttttactggaattgtaattaaatacatatattaatttgtgaagaattgccgtctttaaaatattacatttttctatctaaaaacatggcatgtcttcctatttggttgaatttttacaatgtctcttagtaaactttaatggtttttattacataagccctgcacatttcttattaggtttatacttagaaattttatatatttttttgctgtcctgaatggaatattctccccattatattttctagatagctctcatctagtgaaaataactattgatttttgtatttttttactttttgtatttaatttataaccatccccttactgaatcaccttattaattctattagtatttctgttgggtctcctggattttatagataggcattcacattatttgcagaaaagaacatattgttgtctcattttcctcaaaggttagtagttcttatttatttttcctgccttattgcattgtccagaacttctagacccatgaaaatagtcgtactgatagtgagaggcctagtgaaaattcagagacagttctggggcaggagccagatttgacccattcctatccctaccattgtctcttgagactctgttcactcatttgctcatttgtgaaacattttatgttgacttctctgggccaggccctgtgccagatactgagaccaaggatgacatatataggaggcttccagctcagaatttctcaatatttattcatttatttgtttgtttgagacagggtcttggtctgtcatccaggctggagtgcagtggtgctatcatagctcactgcagccttgacctcctggactccagcagtcctcccacccagcctcccaagtagctgggactacaggtgtgcaccaccacacccagctaaattttttgcttttgtggagacgggctcactttgttgcccaggctggtccagaactcctgggctcaagtgatcctccttccttggcctcttaaagtgttgggattacaggcatgagccaccatgcctggccagaatttccaaatcttttgtgatttattcctcccttgtctcaccccatctctgggcctcagccacccaagccttctgttctatttcccaaccctacctgcaggaaaggtattcaccatagttcccattcctgctatgttcttggcacttaaggctcccatctgtcttctagtaccacctggctctgttaactaatccaggcagagtctgccatttcacatacagagagggaaagtggcttgctcaaggtcacacaggctctgtcgtggtcacacaagctcattggctggagagctggtctggcaacaagattcttgtttctatgaaggtgtaaatggttagttagactttgtatataacttatatttcttattggaagatttgcaggagcctggctgggaagacatatagtgtgctctatcccagaagtcataccttcacctgtctaggggtaccttgagcatcccttaagccgccacttcatctggttcctccttgtctttttccagcctcaacttagctgtaactcccttcaaggatttacctccgtctaggtgaagttctctccaacttcttcctgtcctccacttaccaccggattgtagtttttcatctgcagtatatcaaaatgtaaagagttcaggctctggaaccagactgcaagaacctaaatcccactttcttttttttaatttttaatttttattttaagtttcgggccacatgtgcaggatgtgtaggtttgttacatagggaaacgtgtgccatggtggtttgttgcacctatcaacccgtcacctaggtattaagcacagcatgcattaactaattttcctaatgctctccctacccctactcccctgccaccgacaggccccagtgtatgttgttcatcccagtgcgtccatgtgttctcattgttcagctcccacttatgagtgagagcaggcagtatttggttttctgttcctgcattagtttgcttaggataatggcttcttcatccatgtccctgcaaaggacgtgatctcattcctttttatggctgcatagtattccgtgatgtatatgtaccacattttctttatccagtctatcactgatgcgcatttaggttgattccatgtctttgctattgtaaatagtgctgcaatgaatatacaagtgcatgtatctttgtaatagaatgactaaatccaactttctaattgtatgaccttggacaagtgacttattcctaccgtgccttagcttcctcttctgtaaaagggggatagtgatcgttgccaacttatggatttggaggattaaatgagttaatatgtgtccagggcttaaggagcacacagtaaatattaatgcttatcatcatcactggtctctctggtttttccatcatggacatgagtgtgtctgttccccaccatggcattccctgtcttctgttcaacttgagatttggcttgtagcatctgtacttgtaggtatcatactcgggcaggcattgcatcttgagcactgtgctggctgctgagaatgcagagagacatccatgaataactaaaatgccctgggtaaggaccttgggcaagggagcaagtcatcattttgggtctcagtttcctttttttgtaagataacagaatgggatacctgaaggcccagccctgaaagcttgttaagcccagctcctctatcagctgcagatcgaggtgggcacaggctggctgagaaagagctgctgtccttttttggccattggaatcctcggtagccctaggtctggccttgtaccatggacataaaaggcattgagctgggcttctgaacagcccagggtgggagggtgtccgggaggagcagctgcagtgcaaggtgaatcccagaggtgaggttctgcagaagatatgacctggaggggcccagatggacagagttggagttctggggaccttcagcctggggttgctggggggatggggagtgtgggagaagcacccaggcctcccatttgcaaatggggctttgaagtcagacctagcctggggacagactcagcctttgtctcttccctgccagggaaggccagcccaggctgggacttggccttctctgaacccacctttgtccttccttggaacaaatgggtgctatgaggactaaaggagttggtgcacagagtggggctagctcagtgtctgcacatagtaggtgagcagcaaaagctcattcctttcccttctggaggcactttctagttcagaatgcagtgatgtctggtggagggtgaccgagtcaggatttggaaaatctgagttctaatgaagaaaagaactgagtgggaattaattaaagttgcccaaaccacccttcccatgtgttatgaccattatcccactggctccttgcctggaaacctgggaagctggcgtgtgtttgtgtgtgtgtgcacgtgtatgtgtgtgcgcatgtgtggtccccactttaaaggtgagggagctgagctcaggaaggtgcagtgacttgcctgaggtcccactgtgagtctggcaggtccaggacttctgactctgggcccagctgaggcagggaggggagagggctcaaggtgggataggaatggggacaaagattaagagctcttagaaggtgacacagggtggactgactttccacagggctgtttcctgagtcatctgatcaggtttggccaaaggagaggagccgcagccaggagcaccccgtgacagacatggctggtgaacctgtgggcccttttcccgagccccatgctctcaggagccaggatctgtgtgacagggactgtcccctatgctaggcacaaagagtgcttgcctctgatgggggactcactgcttgtcagtttctcctcaagttactgcctgttctaactcagcaggagccagggcatcctggaacgcaggtctgggagtcaccagtcaggattataatctcagctctgccaatgcttcatcttgaggccctagacagtccctttccttctcctagcctcagttttcccaaatatattatgagaggaataatgcttcctttgcctcactagattgtagaaatctagtgcggtgagggatagtgccaactgtgaagggctgtacacacctgtaagtggctgttcgtgcattgaacctcatgtagagacccatgaaatggatatcaacattctggaaaatcaaaaagtattgacacgcctcttggacatgtctctcagaaacccctgagagccccaggggaacaagccaggagacagtcctggccacgtgcacgggcagagactggtcacctggaggatggacgcagagctctacaagtaggatgtgaaggacacattccagctgtgaactgaagaatgtttgtggtttggctaacgatgattggagaaggggtttctaggtgtgggtgactgcctgagcaacagcctggtcgcaggacagtgtgggacatggctggggcgtgggctgtggtttgaggatagagcagagggaccctctctgtgggtttggctgctgaaaggagagcagagtctagatagggtgcctgggactggctggattacagaagacttgggatagcagaaggaggaacttggactttgtcaccatgcagtcaggggaagctgtggaaggtgttagagcaggggagtagtagaattggagaagaccctctggaggtgtgtgagtgggaggatggatgggaaggcatttaagcaagggagcagggctttgagcagagtttgtggggaggcagacatcctttctagatgacttggtggccaaagtggaattgtttttgtttcagggacagaaaggggacccagggctctcaccaggaaaggcccacgatggggcaaaggtaggtttccagggaccccagttctcagggaagaggggagtggatgatagtgaaattgccacactttaaagctagctgtcctgccagaggccatgcatggcaaaggcagggaggtgggaacatctggaagggttagggtatggtttggttttttccttgaagtcctttagcctttcccaacaccaaacccacccaaggttattcccagccaccttctttccagaatgcaaccaacaaaactgacaaaagatttctcctatggacacacgcttggtgaatgtccttttgcctaatgtcctgcatggctttctgcggggtctgctaggtgactgtgggcatccagaagtttcttggtagcacatggccaggaagcttccaatagacactcaaagcctttgctgaggttaactccagcagacgggtctgtggatttctaggaggctagagattcagggctccctaactctgaagggctatgaaaccaggcttgcctgcagaaggaaaaacactttggctaaaggccttcatccgtctctgaagcatccaccccataaactgagcaagggacttggagggagtgcaggacagatgggaagaggggagcccagaactccaaatgagattgtccagtgtgtcagtcttccaggcacacacaccctggaagcaatgcccaggtctgcctgacttccttctggacacagccccagagccatcctgatggatggaacactgcttctcagcccagcctcctgtgcttaaaggcacctagaattggctgctttctttgatttccccaagacacgagttgcttatttcttcacatcctcactgctaggtgtttgcacttagcacatatttactgggtgacccagggtcccaggagagtgttcccatatactaccacttgacccccatcataccccatgagccaggacagacgggcccagcttacaaatgagaaaacggaggcctaggcaggggtggcttgctggaggtcatgcagctgataagtggcaaaatgagatcggcacccaggagcccaggcttccctcctgctcctgtgtggcctgttctcaggtcttggggtggtggcagaaatgccccctgcttggccagtggcatgcccagcaatggaaggtgtcttaggactgcagggagagatggctgattgatatgggactgataaggcacatgtcctctggagcatagttttcaaacgtggttttagtatcggaacccattcttcaagtggtgtcttctgctgaagcccagtatgtaaaatagatcagatggagccgctgagttgagtggggaaggggctgggtacaccactcactcttcttgctgggcagcccccgagtctcctctgaggcctctacttctctatgaatctcatttggaaacaaccagccattggaagttaccattccaatttgtagagtgtagcagagtgtctctgctcccgttttcctgcctcacccaccttgtctgtgtcttccagggtgacatgggcttgcctgggctctccgggaatccaggacctccgggacgaaaggtactgtttggttttgatgctttgccttgcgcagtgggcctcctagcaagccaggtcttcaggcagaagagctgtgggcccacctgcctctccccagccccagcccagctcccctgggcacagggtacatgggtgagaggtgagagagctttccaagggttgtgcctgttgagggcagggaatacctcggctcgtagtaggtgcctcccaccacggttaatgaggtagcataggaagtatccttggtttgctgtccttccttttgggggcccagccgctcccagggaggccaccttcaagaaagcctgtggtgatggagtaacctgtgctggccctggctccaccacccactgtctgagaggccgtgggcctgcgagtcctgtctctgcccctcagcctcctcctacatgagatggagacaatgatccccgtctctgaccctgcacagtctggggctgtgtgaccaggagcaaggcctggagcggagaagttgagggagtggaccctggggtcagttggacctgggtcctactcctgcttctgccatttcctggctgggtgaccttgggcaagtcagtgagctctcagagtctaatatgcggccctcgctgatgctctgcaggggaaggggaaggggaatgatctggagaggcagtgggttctctctatcttgctggctgttgttatgtcacgcccatcccatccccatttcagccatgctgggggagttacctgtccaaacgcctgtgtgaggaaaagactggcatttcctgggtagtgggtctgtaacttacagtccccctggatttctgtgactcctccagcctgtgtctcccttccttcaagactctactctagttgtgcctactccaggaagtcctcctggagcacccagcttcaggccatgaggctcctctctgctcaagaacacttaagctgtcttggcttagttattttgagccaccaggcatgcctcaccaaccagggtgtgcaaatctggtttattgctcttcctactgagcctagcatgaagcctgtgcatagcaggtgttcaggaaatggggggaaggcaatgcagactaaggatcgattgctttttccaagaaaatccccaaccgctgatggattgtctggtgaatccatcggcctaccactgtgtcttaagcttctgccctggctcccagctgtggccacagctgaactctctctaggccatctggctctcatctggacagctggggtgtctcccagctccatcctgttcttgccttgagagccccatgacacagggggccttgcaggacctcgttcccccattcccttctccatggccagagcaggccataccttcaacctgagaggcccaccccagaagcagtggctgtttgtgagctgggaaacatggtcctttctggctcacagaacacagagggacttgcgctccccacttacttcctctctgggctctagcgctttctgatggatgaggtgtgagtggaaaaggctccttccggtcccagctcataaagcagcctcgggtggtcttgttctgcatgggggtggcagcctagcagaggtggcaggagatggggaaaccagactggaaccagctcctccctggggtgccagggctccttgcattaagcagatgtccggggaggccaaggacccccaaccaagaggagccaactcacctgagcagggagaggcagcttctccaagttaaggaaaagccactgcgcagctggaaaactatttggcaaagccaattgctctgagctcccctctggccctggcctagacatgcacagaagagtttcgtctgtggcaggctggcgtcacccacttacagagggtgctgggcgaagtgtcggggagctcaggtcccaaggcagagacccctgaccagtggtggggatcagagaagagaaccactgccatgggcaatgtgcctggggccaccattgtagatggtctttcctatcacacacatctttggtgacaatagcagccacttggctctgatcttgcagtgtggcttttctgcattatttcttgtgggaaaccttgaggggagaagggaagtgagtggataagaggtgaggttagcttcctcttcgtgcttaccagcacattgaatttttgtcattctgaggcaacacagataatcctatttattcatttatttaacaagaattattgaatgcctataatgtgccagccactgagctgaatggacaaaaatccctgccccacagggcctgcatccttgtgggggtgtggggagacagaagatacaaagaaaaacagtaaaaataaaaggtacactataagacagaaagggctatggagaaaaattagcaagagaaagggagttttggttggagggtgcagtctacagcagtggctcccagctggggagctcaagccccatcgtggtgattctggctcagctggtctgagtgggactcaggcatcagtagctctaaaaggcctccaggtgtttcccacatgcagtcaagaatgagaggcaccaatttaatggaaataccttccatgggtttctaagctgcagggctaggattcgaacccaggtcttctgaccctcaggccctttctgtcaccacaaggctgattgaaacagtttctcaaacaagacagtgtccatctggtaaaaaaagaggctgcctgcccgagaaggtttgtttctctgccaccgcctgagatacttgtggaaggaatttgctgggccagttcccaaggtggggaagacacgcaaaccaggtcagatagacctggatggaatccccgctctgtccctctcctgctgtgtgagcttgggcaagttgcctcaccttgctgggcctcagctgcctcatgaggtggttgggaggattaaatgagatgtaatatccctgccctcagcacagggctggcacacggctggcactttgtatgtatttgtgtgatgaataaataatgatcatgatgatcacgaagagaagcatctgaagaaggtcttgccaatctggtagcactagtcattttgctagtttccagctaaccaccctccactagccaagaaggctgccagaactccatgtgcacctcccatgctttctctcatctaaccctcctgctttctttcctgtagaccagtagttctcaacttggggtgattttgccccccagggaacagttggcagtgtctggagatatttttggccattacctacaactgggagggaggtgctactggcttctaatgagtagaagccagaaatactgctaaacattctgcagtgcacgagatagcccttccctcccatacacatacaagatgtgttcagcccacaaagtcagtgttgagaaaccttgctgtatagaaaccctggccccatccaatcccatataccctgggccttcctgcctccctggcccccgctgtgtagaaaccctggccccatccaatcccgtgtaccctgggccttcctgcctccctgtgtttgcttctgctgtgccctccccaggcatgccctctcctccacactcatcctcatgtgcctactccttggttctgttcttagagaagaatagcatcttcttcaagaacgctccccagcacctccaggcagaagtgacgcctcacttcctgaccatttggcctcccttctcggcctctttgggctagtgggcaacccactagtgtcaacacattgcttagactggacagtggacagaacccaacctgttcatctttgtttcccacgtggggcttagcgcagtgctgaccacattcaactccctcgctcctcacctctggcaagcctcacgaattgatctttctggccaagtcctgacacagcccctgaatctttcttaccatactgccccagatagacatgatgcatggaacaaaactgctactcaaatcaaaacctgacttgcttctctccagcctgacatccccccagctccctcctgttgcccccaccctgccccctagcaggaatgctgcctgagttggccattatccgtggaagctgtaataaaatgggagagcacaggggtcatctggaagtgtgtctggggaaatgtgatggaggctgcctgagacaatttcccacctttctgctgaactcccggttctgcctgagtgtggcacccccaattccatagagttcctctcaagaaacttctccaggctcccctgcttctgcagcccatacccactggcatccctcctatcccatcctgtgtctcctgtccaagtcctgctcctcccccaagcctcagtttacaatgtcacctcctctggctgggtgcatctatattcttctagcactcttcttcattccacctaatatgcatttaatgcccacatccccttgtagaaggtagagagttttttctgttcactggtgtatctctagtgcctaacacaaggtcttggtcattgctgggactcaacagacatttgtttgatgaatgaataactggatgaatgaatgagccatgcagaaaatataccttcctgcctggagccgtctcaggcatccacggagcagagttgggtgtcagacacctggctgtgccatgatggactgtgctttttgactagccacagactttggaatcctacaatttctgagcccacaggacacttggagaggccagctggggaaactgaggcccggagaggcaccttgtccagcatcacataataagaccctctactctaggcatgtgtttctcactctttgattctttctgtcctgctgatggcccagtctggggtgtgggctgcccgggaggtagcgaagttcagcagagattcatggagagctaagcaagcttggtgagtttcatgtcaactacaaggggagctgaggccttgcacaggcggaggtggagcctcggtggacagccgatgtctgagtacatatgggtccctaggacccccaggcaaggacgggacccctcccctccctgcccaaagcccagaaagcagcccagccagacggggagacggtttgtagcaacagtgaggtgatgtctggtttctccttgcgcattgtaagcaatgattcatctggctcccaaaccaaaatatagaccgagttctattataaacacaggttctgtggagacccgcctgctgggcagccagaggccccttgcagacaccacgttccctggagctccccgaaacattccctctcccttagtgccagtcaggcaccgatcgcaaactggaaagtcactgcccacgggcccacttcttgcggtcagcacccgccccataattggcggggcgctgcacaagataatggtttagattcttgcaggtctggggccctgtcatttgaagctatttgctggccccagctggtaaacattgttaagatgcttccagggagcataagcacctcccaccgcctacctcccgccttggctatgctcgctcttctgctcctggccatccaggagaaactggggtgttcacggcaatgttcaaggcccttcagggtcccttgatcaagagatacctagaaattgtatatcccaatgggtctggagtcctagggaaaagtactggcttggccataacttgctaggtaactttggacaagtcccttcccctctctgagcttcagtttctcagtccgtccagtgagaaaggagattgtcaaactaatggtttggggctctttcaactcagttactccagggtttcatgactgacctctgcctgaataatgctgcaatgatgtgaagctttcatcccagggaggcgcatctataaggggatctctccttgagtggctttgtggctcttctaggcaggtcttaggcctcaatgagcatgtttcatcccatgctttttgatggctaaggatgcgggattggagtcacaggccaggcgctgcccctagaaagctgtgtggcctcagcaaagtctctttacccctctgaacatcagtttcctcaactggcaaatgtgtatggtaatttctgcctcctaggagtgatagcaaggagtccatgaactgatatgtgaaggcttcagtgctgagccaggcatagggcctgccactgtgcatgcccgtgatgatcattcacttccatttagctgcatcctgagtaaaagggtttacttgaaatcttctcctgggatttcactggagaaatgcctctgcttcctttgtggggaggtttgggggctgaagaattggttttcagcagagttcttgtggctgcagatgaagccacaggagctggtgatggccaagggccccctggaccccacattatggttctcttggggttcttgccctgttactccattggatctttgcaggcaggtagaatacggcagagtgagcttcagagaggataattactcatacagagtcacataaccaagagtgcaaggctccattcagctcttcactgggaaaaagtttcacttgttcttcctaatctgcaagctccaggtggaaaaatgatgatcacggctgttagttacatcatgtcgcgctacctccctgctcgaagagcttctgtggttttgcatcatatcaccgccagcatgctctgacctcctgcttctccaaccaccgccatccttcaccctctcacccactctattccagtcatacaggccttcctgtgttccctccaagccacttgagggcattcttgcctcagggcctttgcacttgctgttccctctgcctgcactgcctttctccatggagccagccctgtgttcatcccattcatctccttagagcagcctttgcttgatcccaccctctcttcaccatccctccccaatgccgtgttctctgtctgtaactttacttccttttcttcacagcactgatcactactagacattttctctctgtttctgaaaagattttattttaattgtggttaaaaagcatataacataaaattaccatcttaaccaattttaagtgtacagttcgatagcgttaggtacattcacattgttgtgcaatcaatatccagaaatgtttcatcttgcaaaactgaaactgtacccattaagcaactccccattcctctctccttgcagcccagatgttatttttgtttgctttgtttttatacctccttaattagaatgtaaactcctttagggcaaaggatgttgtctgtctcattcttcctgtgcctagaatggtgctggagcatgaaaactcggtaaatgtttatcgaatgaatgaatgaaaaatgaagattatgataacagcagctaaccttttcagcgcccttgaatccaatgccaaatactgcgctttacacactttctatcctgccatccctgctccaactttgtagccccatgttataattgaggaaaatgagattctcagaggtgaagtcattggctttgggtcacccagccagccagttagtacagtagtactggaatccagatgggtctgaaacaagaggttgtatgccccggtttgcccactggggaaaagagtacacgccccagctagaagaatcacacccaaccttgttgcatcaatctccataggcccctgaatctgagatacaatcatgtcactgagggctcttgagacatgaataggtgcagaaagaatgcttgtaaactctccagacctcttagatcaaactgactctgctgtttataataaagagtccccacttcctgggggctgatggggggtgttgagtgtgtatgcctgtgtgtgtctgtgtaagtgcatggagctgtacatgtctggagatgtttgcaagatttccagcgtgttcccagatgtcagaaggatctggtagtgagtgcctgtggcttgttagcaatgggactcagagtaggcgtcttcagttctatgagactcagtgttctctgtaaaatggagatgatagtcgcccccgagcccagctcatctgactgttggaaggagtagatgaagtcatctattatgcacgtagtcctgggtaaacggcagcacatagagagggtctacaggtttgagcgtgcatgtgcgcgtgtgtgtattctggtcttgtgtgtgtattttagactctggaggagtcttcaaattctagggttctaaaacatcatagctgaagaggactcaagagttctaactcccttatctgaagttcagagaagggtaggaacccacccaaagttgcataataagttagggacagcatctaaagcaagcccagagctccctgcgtaagagggtctaacatggatgagtgtggctaccctgtgcacaatggaagccccccatctgatggaagcttgaagtctgaggtttcctttggagaccttactcttatgaaatggctcaggtgattatacctggtgccacctgaaagcacacagtcagcttggttctctcgactcagaggcctggcctggacatgccttttggccatcaggacagagggtcaaggttggtactggggcgttgccagagtccttctcatcagtatctggatggcctatccctccctggaataggagctggggccggtgggagaagggaaacaactatttgggttaataaatgtggtcaaggcgtgtgatgggggctttatgagaaggggcaggtcttgaaaggggagggaatcccagcatcccgtgtgacgtggtggctcagcacagtccagacctcaagtcctactcagtttactcctccattgacaaatcctagccctgagagacggtctcgccttctctcttgattcagaaggaatggttgcgatacaccatctcttggtcacagttgctctgtcccagttcagctcacctactctgccagagcagtgaatgaccctcctgatgtcctctggcctaagaaccactgggagcagagagaaaaccttaggaatatgtgaaccctcacatggtatctgcatccatctggggaacctttactgagtgcacactccatcccggatgcagtacatacggtgctgaacagggcaggccgggaggctgggcccttgcgatctccaggaccagatgtgtcctccctgcctgatgcagcttcttccccctccaacagggacacaagggctatcctggaccggcagggcaccccggagaacaggtgagggcctcagcctcagccctgccctggtcgctctccctcctcccagcccctacctgtctctggccccctccctagatcctgctctgtgagccagccccagagccaggctgttttgcctctcaccctgctggagcccccagcccactccagtccaccccacctctctcgcccagccacatttgcccaaaagagccagagtccatgccagcctgatgttggcatgagccgcacaacgccagttggagccatgaatagctggcctgttccgggcgatgttaggggatattatactcaccgccacggggtttgcaggaattttggccagcctggcccaagtgaaacagcagccctgccagcatgggagaaccagccaggcctcctcagtaatttcttattcctgggctgcaagcagagggggttttgtccctcagagctggtctgaccggtttcacagaggggtgggcttgggggccctccccttcctcctgttccatctcacattcctgcccctctctttattcattgtcagccccagtctcccagggtcccccagacccagagctgggcagggtctttcttttccttatgtttctctctgttcctttgcaggggcagccaggacctgagggcagcccaggggccaaaggttaccctggcaggcaggtgcagtatatggcttctggaagctctgtggccatggtgatgtgaagatggccacaggtgccccgaggcagagggaggtggtgggctgggggccaaggagctgcacctgctgggtggaccctaaggagggggctttccaggggactggaccaaggaagcctgtctttgcaggcacaggataaggctgcatagtaagaggaggtctggttctgcggggctggggctccagaggctcctcctactcagtctccctcctacccaccagccacctccctgggatcctagggctgtgggggtcaggccaaagatcgctgatctaaccccacccccattctacaaagagagcagcagaggccccaaagaggcaggacttgccccaggattggcagcaggtagagcgtctccatatgtccttgcccctctgtgttttgtgtttcaggggttacctggaccggtaggagatcccggccccaaaggcagcagggtaagtggttcctggccagtgccacatgggtggggttctaggtgagcatcacctgtccctccagtgggcttgatgggaggtcagagctataaggagagccaaggccctcccacttgagtgctcccggacaacagaggggcagcaggagggatgggtgatgggagacccttgagccaggtaaactgcttggtccccatggccaagaagtctgggaagtaaagactctgctgggggtttggccacagtccagctgcaaacagctaggcatttgtttgctgtgtctcctggctcatcccaagttacaagggagccagtatgggccacttgaattgcctgtcgtcgaatcttcagaggcctccctcctgctcccaaatgagggctggggggaaccactctttgtggagggcacctggtgtgggaatgctgcccaagcctgcagcctggtggagtttccagatctccccttccttcaaggcccccatggagcagaccccgagtagcgatcagcctcagttgcctacctctacaatggtcatgatgtccatttgtacctctagtctggttatgtcaagctgacttgacagctcaggagggggccaccaggtggggactcccatgtgggttgtgggaagacagagagggttctgggtggaccgaatggggtaaatggagttggaaagatttagagctgatgtggtggaatcgtttcttttacacacaaagaaactgggttcatggcggggcctggatggccccagcttacactgcacgcctaaggcggatctgggatggggacccaagtcttccgaggcctggacttgctgcctctcaaggaatgctcaggaagggggtcacacagtcctcggtcaggacagatcacgtatcctttgctcctgagccaaagctatttatattttggcaggagggagaggacagaacagttgcagtctcagccctaatccctgcagctgactggtggctgttaggagagtgtggggaggcgggagtgggggcggggaggtgcattccccaggaggttactgtgacaggcagggcctaaggaggctcttgtcccagggtgctgtgcctctcttcctttattctgctgctcccatgggccattcccccagagggaccccctaaacccaaggagaaaggtcttctcagtccagccccagtcctgatctcctgacctgccagaaggacaggcatgttaatgacatctggggttgctcgacttgcctgccaggctggtggcatctcaaagtcacatagcaggagaggactggtctggccccagcactcctgtctcttacaggccacacagccctgggtgggaagcctggatgagcagtgagtcactcaagctgcccttccaaccctgccaccaccagcctcatatttctgaagtaggcagagggcaggctttggaatcaggatgacaggctttgagacctgccctgccattagctagctgtgggagcttgggcaagtcactgggcctctctgagccaattattttctcacctgtaaatctgggagataagcactatttggaatggcagtaaatggcactctttcagattatggatattaatcatgctggatgccaacgaggaggctcagtggcttcttggccttccagggaaggagagatggttgtgagcctccattggttgcttgtttgaggagaggcagtatgcagagtggttaggagcccaggcccaggagtcagaagacttgaatttgaataccagttctaccacatttcagctgtttggtcctaggcaagttgcttcacccctctgggcctaaatggtcttacctctacagggggctgagtaataatacttcctcagggctgggcgcggtggctcgtgcctgtaatcccagcattttgggaggccaaggcgggtggatcacctgaggccaggagttcgagaccagcctggtcaacatagcgaaaccccgtctctactaaagtaactacaaaaattagctgggcgtggtggtgcacacctgtgatcacctgtgatcagctattcaggagactgaggcaggagaatcgcttgaacccggtaagcagaggttgcagtaagccacgatcgcaccactgcactccagcctggatgacagagcaagactccgtctcaaaaaatatatataaataaaaaaataataaaatataatacttcctcggggtgtgataaggatggaataaatgctttaatatatgcaaagcactggcagcaggcctggcctatcattcgtgctcaataaacattagcttttgttagagttattattaaatcattccaccaagagtggcacgcagatagtggtagaagccccgggcgaggttactgccctttagaagttcccaggctaatgaggacgtgaagcatgaacacaaataatgaagatacaagggagaaagtggagaaggatgctaccgaggtgcaaaaatggcactggggatgggggggagagattgcttccggcttggggtatcagggatgcttgcccaaggagagcgcttatgagagctgggctttgaaggatttggctcagaagtcatgagggatgggaaggacatgcctggtggaggggacagagtgaggaaaggctgggagggaggaaatgagatgcatcctagggaagagccccagaatggtgacgagccccagctgtggagtcagctggccctgggtgacccttgaactgattaggaattcccgaagagaattcacagctccactactgactagtcgtgttgctttatctacagagcctcagtttctttgtctgtccagtgtgggtggtgacaatctggggggtccttgtgagagtctaatgtggtagcatgcatgtgcctggcacaatgttggcactccgggttcgcagccgctgttagttaatgccagcactcaggcggccagaggtggatgtaagccctacatccaggaccttgaaggcctaggaggagccatggcaggagccacgggcacctaccagcatccctgggggtgggcagggcttggtgccgtgctagcatctaacccagccgcgagcttccttctgcaggtcctggagccctggcgtggggcgggcctcctgccggcgagcgcctgcgcccttccctggcgtgagggtatgtgcctttggactacatcgtggaagccagcaccatgcagtccatgggcatatacacttgcctcaaggcctatgtcatcgaggagccaccggagctgccactgccaccagggaggaagaggaggagccgggatgtgggatggcagtggtgggtgggctgcggcaggttgggccagccacacctcactgcttgaccgctctgaccccctttcttctctttcctagggctacattgggctcccagggctcttcggcctgccagggtctgatggagaacgagtaagtttgcttctttggttattcaccatccacagccacccctgcccaaacagagcagaacctgccaggcaccagcctggggaagtcaaggaattcctcctggaggaggtgcacttgagtcgagtaggagtctgataaggggacaagtcaaggcagatgcattccaggcatagggaacagcatgtgcgaagtcagggatttacggtaacttggcgagtttaacactcaacactgccaaagtgctgcgtgagagggtgagagtggtgggagttgaggctggagaggaccctggggcaatgtcttaggtgcccaggactaaggttagaaaaggaactctgttctgagggtatgcggagcctcttgaggacttgcaaccaatgaacaccgggcccactttataatatagatcaggggtctgcaaacggtggcccatgggccaaatccagccagttgtctgtttttgcaaacagttttattgaactcagccttgctcatttggttacatattgtcaatgccgctttctcactacaatggcagagttgagtaggtgtgacagagaccgtatggcccacagagccaaagatattcactatctgcccctttccagaaaccatctgctgattcctcttttagacagatcagttggtttacttgagtaaaatgtgttggttgggggtggggacagcaagagcaggtggcaggagttccagcagccagggggagcggctgtctggggaaggtggtgggactggtttggtggtgggcagtgggtgctaagatttcctaagacaccctgtccttccagaccaagtatctaagtcagaggagtccaaaagatggtgtgggagcttctcacagacccctggcccagcctggaggtccattagaagcccctggggtggtggcctcgggatcttcctccccgccccctcccaacctgagcccgtatctatgggaactcacttgtaacctccataagctgggtatagagaaccttaggacagctggagcctgagcatttatgaagcacctgctgattacaggaactggcatttctctgtctcttaggtcaccacagaccccgaccctgccatccgtctgatgtgcatgtcactggggccgccacgcaagtggcacacattccaggccctctgtgacttcctgccgtgggtggctctgggctggtttggggcaagcctggctgtccctgctggcatcctgccctgacctctcccctgtctctcccctgcagggcctgcctggcgttcctggcaagaggggcaagatgggtatgccggtaaagattttccgtgtctattacgcagactctagcggggaaccccacctcccacggccacgctgccctggccacctgctgcctggcatcttctgcttctccccctgctttgagtgtgggggccgcatgtggggttgtctggccacaggacctgctgctggcacacggcgtgactggggcctggctggggctggggcttccatgggctctggacccctctggggtagctcctgtctccctgtgggcatcagtggctctccagtgcagttctgtgtctgggggcttctgtctaaggtatttgtgtctgtgggtctgctgtgaccgggggaccttggctagaccaggtgactctgctcccatctcagggaacactcagtctccacatcgtcttggtgtcatccggctctgtccagtttgctcatgcacacgcaaagccagaggacaatggggtttatgggcagtgcccacagcaggcatgaccgaaagaggggctcagcggtgacccccaattcaccagctttctctatggctccccatcatgggaggaaattgtttttccctttgtttggacatgtgcagaacatggagaaagagccaaggcacggagagattaagtcacttgcacgatgagtaaacaatgcagccaggattggaactcagttggtttgttcccggtgtctttgatctcagtggctgcttgaggcagcctctcagggtccctagttggcagtcatattataaaaataggttccctagactcttcgcctggaaggaagatcattcattccaattattgagaagcgggaaactgaggctctgagaggcagaatgagataccagggtccctctgccactgccctgcaggttgactccttgacttggaaccatggtcagaccaagtctgggcctcccatcgctggtggttggtgaggaagggagtatgaagaggaggcctggagcattcgagagtgctcagaggggcctctccgtgcttctgccactgatgggcatgttagctgttggagcgtttaacctgggccctctgggggccaaagaggaaaaacaaagaaaagaaaaaagcctcaaagagctgacagaggaggtccctccacccccaacctagacccctctgtggcccgaacaggcagtcttctctaaggtccaacacctgacacctagacctgggcaaggagcagcacctgatgctcccagcttcagggcaaggacctggagtctgagagggctgggctggcacatggggttgtccctcaagccagcatgacctcaggcaaggagatttgttcatccagtgattatctgttcatcccatgaatatctgttgaatgcctgctatgggccaagcattttgctttgttctggcagagcagtggataagacaaagttcccactctcttggggcagacagacagatacccaatcactgaatggggaaatggaagaatgaacaattaaatgaaggttaggtagtgctgaatctaagagagagtaggatagggagacagggagtacttgagggttgggatcttgaataagttagtccagaaagtctccctcgctttatgaagaatctcaatgaggtaagcgtggaagctgtgtgcctttccaggcaaaggccctggggaaggagcaggcttggttcaaattttctgaaccacagttttctcttccgagaaatggggacaatagtatggctcataagaccattgtgcttgtcacatagtaagtgctcaataaatagagccgcccggaataaggtttcctggatggctgaggggatctctgtattgtgtgacactaagccaatgacttcacctttgctgggtctggtttcccatggtttaagttgcagagtgggaggatttgacttgcttaggcgatctcagctgggccctgccccaacactcaggccagcctccagggccacctttgggggatttgttcagacacatcctgggagccttaccaagggccaggcgttgctcctttacagatgagatcgcttctcggagaggtaaatgattaggtcaaggtcacatggctgctcagtgtcacagttggattagaacacaaccagagctttcaactccagtgccagagtgtagctgtttagagcttggggtacggagtctcctgagcatggaagaggtaagacccatgaaagcctggacatgttatggcctcttctccaaccggacacagcaaggaatgtcagcagggccatgcctcagtttcccccttctactccatcctctgcatcctcctcatctcccctcctggcggccccttcatccaccttctccctgccatgtacctgtgttcttcttggagcacaaagttaccctgttcatggcctggctgagaaggcagtcccaggtttgaggtcccattatcctgcctgtgtgagataaggccactcattcattcctcattcaaccaaagattatttgttgaatatattactctatgccaggcactaaggataacactgtagccaaaacagacaaaaatctctgttgtcatgaagctcaaattttaagggtagagacaatcaataaacacgatgaataaccagaagaaggcatggttgccaccctaagtcccctgcaagtgaaaggaagcaacgagtattgaggccctcggtgtgcatagtatttgaaccacatgcgattctcccagtgaacctttaaggcaagatcgattatccccattttccagatgagaaaactgaggcttagactgtcaaagccatttgtccatagacactctgagccttgccagactgagaacttctgtctgcttccttgcttcttgcctttaactttctaagactaggctctgatcttcatgacaggcgtgttgttccctggcactggggtgtcagatgtgggtggagggaaacatcttttcagccctagacctgtgcaatacccttgagagccatgaaaataccctcaactctgttccagccaccatggccagcaaatcggcgagatctgcatcagatatgatttaatgtgtacgtaatgggacttcacatcggctgagtccctacagcttggtctctgtctccgctgggcctctgagtctgccatgcctctcagcctaaagaccctggacagtctttagggccatccctctgttgctgttgctcccaaccccttgatctgtctggtagggttgggggctcctgtcgtgaatggtttttcctccttatccaagctttaggccagacagtttctaggcacttattaagaaaaggaagtgacaggggaatgagctgaattccttcatgccagattgcagctggcgtcatttctggcagggctggtgatgattttgctgtagtcagtctttccccagcaggcaaaaccttgggcccgtgcatgcggcctcctcagtatccagtttggaagggtgatgtgtcagagtcttttactaacgggagctgaggaagagacagtggaggtcaaagcacatcagagctataggaaccttcgtgatggcctggcccaaactctttttcagacagataagcagacatagcccagggagggcaagacacttgcctaagatctcacagcaagttgttggcaaagtcaagacttgaatccagaacacttgctttccagggcaaggtactctccacatggctccctcttctctctgctcccatcttcaacctccagaggaaagcttggtccacagctctcatccctcctcatacctcctgctaagagaacgtgttgtggttttctggcgaggggtccaggtggaaaatgttaccaacttggctggagctgaatggctttctcctggcctgtcctggcttgttgggcatggctcagtatcactcacagtgagagactgagccatgtttcccagccaagggtctctacgagcaggctaggaagatgctgcagtgagtccttctacctgtcttctccaaatgtactttcaagcctgctgggatggccctgcaaggcaggccaccatgcacagctttactcacagcccctggccaggactgccaaggctggcctcatgcagtgagtccggagggaagaccctaaagcttagagctggaagggcccagccctggcaccgactccctggggtgtggttcagggatgactgggacctgcccaaggccgcgcagtcctctgggaggaggcagggcttctaacacagtgcatttgggcttcaagttcatggctctttccagttctcagattacaggcagcaagcagccaagtaacagagaattcctatttccaagtagggaaattgaggccaaagcagattaaggttctcagctgaggtgatgctgtgagctgggggtgtggtctccagtgacccagatgtgaaccagagctgacccaggctgttggtgcccctggaatcctggagagaactctgccttcctattttctccttgtcccctgaggcgacttttcttgagtagatttcctagtggatttcaggagggcagggtaaaaacatgtttagaccacgagagaaaggggctgggaaagttcaggggtctttccatgtcagcacgcttggagcctgcacacctagaaaagaatatggctgcttcgagtgcagcaggaaggatgcaggttagacttaagcaggaacttccaggccttggagaatgtccacctggtaagaagttctccaagatccttttgcgggcttctcctagaggttattaaatattcccactcttgatataaaccctaactagtgtagtgatggcacattagagttgaccaggggctgcattagaaacatctcaccgtttcttcagcccagccctgccaggtgagtgggacagtgctgactgttttgcaggccagggacctgagccttaggagcatgagggggactttggattctagatgtttcttgcttctctgcccctgtatcctacccgctggagcacacggttggggtggacacttcctggaggcagaagagtggaggagatggccttctgagttctccttggcatcctgctttggatgtggtggcgaggaccgtccctgtcctcagctctattcctctgagttgttgtggccaagagagaatgcagagtctcactccttagccttgttctatctcctcttgggccttgttctgctccaagtatgaagtgttcagttctccagaggggcccgacctgggaaagtagagaaaccacgtggctggggccctggcagggagccaagctcattccttgggcctggggccagcctgctgcagccaggagctcgggcatgtggaggaaggtccctgctgctggccaggctgggcatgcatgccatgtggtcgccttacacatgcaggcatggccagagagagggaagcagatggggttgaagtgggggctatacattccagctcagcagccgccaccctaagacccagggagctctggggtgactgctggaaatggctctgccacttagtagcggagggatgaggcaaggtagtgggtgagggggtcttgggtgtgttctgggctgcagtctccccattggtgtaatgaggtggtgaacatcaagaacgtctcgggtcctttcatccttagaccatctgtgattgttccaatcagagatttgttccagcacctttaaagctcttttttccaaccactgtgctcttaattacaaaccctagattcctagaggtcatctgcttgacccctccattggaagggagattgaagatggagacaggggttgactcccggaggccctcagcgtgtccaagcagaaccagtcctcagcatcaatcatgccattcctttttgcacattagctcagggctctaatgagccctcggagagcctgtaggctggttctagttcatctgttcattcagtgtccagttgtagctaagagaacagcttctggagtcacactgcctaggttcgaatctcatctctgctatgccagggctgtgtgactttggaaacatttcctagcctttcagaatcacagtttcctcatctcaaaaatgcagccaataataggacctgttgggtggtcacgctgttggggtttactgttgctatgattgtttcatcccaccatcatcgccctctggctagactcaggctgcattttgtctgcagaggttactcccctccagaaactgactcaaaattctgatgaccgtctctcccttgcttatacctcagagacattccctcacatggctgaggcctcccatgtggcagtgaggcaccctcactgaggcacccttcatgtggcatctcagctcatcctcacagcactcccttttggatggcaaagagaactgaggccccaagaggcctgtgggtggtgcagtcaggactgtcttggggcaggctggccagcctggaatggcctctgaatgcagacccatgggtctgagacctgcctggcagctgctgtatgtgaatatattgggcatcacagggtcctaaaggatccttagagatcacacacctccaacctgagcaggacagagggtcaagtgtgggggcctgcccaaggtcagacagccagcctagaggagagccagggctcatctgcaggccatctccatatgctggacttggagaacagggcaggactacaagttctgtcccttgtaggccatgtggagtcagccaggtgcccagccagacaacattgcccttgtctcaaggagttgctttcctctcctaccaggtccttctaccccaaagttcagaggccagaggtgggaactcaatgccttcagaaggtgccctggctggacgccatggctcacacctgtaatcccaacactttgggaggccaaggcaggcagatcgcttgagcccaggagttcgagaccagcttgggcaacatggagaaaccccatctttaccaaaaatacaaaaattagccaggtgtagtggtgtgcatctgtaatcccagctacttgggaggctgaggcggcaggatcactaggaggcagaggttgcagtgagcagttatcacaccactgcacttcagcctggatgacagagtgagaccctgtatcatgaaaaaaaaagaaggatcccctggacacagcccacctggctgattcttgtcccaggaggtgagacgatctaccttcagcatgaccaagaagagctggtttaggtgagactggaatttaccaggggagaccctaaagatgtgggggaggaagcttgggtaaggtcagatatgcccccacaaagacatgatctggaaacacacacacaccctcccctgccacactcctctgccaccctctgcaaccagttggacacgcgtttgagcagcttctacataccaggctttgcccgtgcatagctcatatgaacatgccaaactccagaggtggacctgggctctgcttgctttatgaccttggccatgtgatgttgcctaaccgagtctcaattttcccatctgtgaaatgggactgataacttttccctcaaagatagatatcaaatgcaaaatgaagtcttgcatgcaaagtgactaccttggtctgaatttcattatcgtcttctcgtttcctccttttggtgtctgaatgaagccacaccttctatggggtgaatgtcaatccaagaggacttcctggcaggggagagatttaaagggagtagggctgcggggcagggccaggctaaacacctggttacatacacacatttcaaggtgtctttgcctaaccagtagagactttggtttgggttttgtttgtaggtttggtcttttgggtttagtgtactcactggactcctccagtagtattagaaaccgaaaacaggatcatcctccatgaggaatgtttaccatttgaatcatagccccagcattcacttggtcaggaaaacatgtgctttgtttttttttttttttaattacatttccctggaaaaacaatgatttgaattcaaggaggggaggagaacaggtttcccccaactccaagcttgaggactttcttttccttttgaagtaggaatggagttctgtccccggcccccgaaggcgtccttacagctgatatttttccagctgcctatctccccagagcgtggagcggcctccagagtggggtcagggatggggcgagagggccagacctgcctgggccgggcagctcagcatctctctgagctgctgaacacctatggaggctgtgctcatgttcactggtggtgtgactttgtgtgaccttgccacttcactctttcacagcctcgtttcctttatctgtcaaatggggatcatgagttcactgggtggcttttgaagaacgtgccacaatcagagaaggtctgagctgggaaatgcaacagaggccttctcctccttgaccagtggggaaacagaggctcttaaaactggcatagatccagcttcctgcccctagtctctgtctttcccattccatcaggaccagatctcagaataggggattggcattttcatgctggggagctgggtatcattttcttttcagagacttagtagaaaataaaaggatccctgagaaattctttatgttcaggtgcttgtcgatggtaggggtgacctcaggaccgcactgtctgcccatgaccaaggagtgagactgcttggacattgtccttgtgtcccccctgggggtctggatcaaagcccaccctgaaggtgacaacactaacctacagatgtttgttctctctcatgccctccaggggtttcctggagtctttggggaaagaggccctcctggactggatggaaatcctgtgagtatttcaagtctttgggaacaggagcgagattctgagtgaacacacagcagattttaggagcccacgctttagggtcagacagacctgggtcaaatcccagccctgtgaagtaccagctgggcacccttggacaaattacatgacgtctctaaacgctaggctcctgtctactgcggctgcaccgtcgcccccctgtaagagtccccagcccactgagcccctgggtccaaagctccaggctgcaccccatttccaggactttggaaggttcatgggtcactccccactggagaggccccagctgctgccatcttacacagcatcagcaatgtttatgggccggcagaggcatggggaagcaaacggtctgcaggccgtgtttggagaaaaggaagagctgagttccaaaggaatctccaccacaggcatgtttatagagtttgtaaataattagaggcccaggctctgttccccgaggagccaggtcagcctgccctggggagccgagtctgtctttcccttcccagctccaggccctggtgggagaaggtgttcatggttccccatctccccctggggcttcctgcctgagcagctgtgccagctgtgccctctgcagtggtggctgctgcgttcataaccagcacccgattaggcgctaattcagttccacaaatgctccctgagcctgacccagccaggctcccttggggattatagccttgacctcagaaccctgcggacctgggtttgaattttgttgtaccacttgtcaggtgtgtgagcttggaaaaatccattcacctccctgaatctcagtttccttgtctgcaaattggggggatcagaattccagcctgaggccgggcgcagtggctcacgtctgtaatcccagcactttgggaggccgaggcggctagatcacttgaggccaggagttcaagaccaccctggccaacatggcaaaaccccgtctctactaaaaatacaaaaaattagctgggcgtggtggcaggcatctgtaatcccaggtacttgggaggctgatgggggagaattgcttgaacccaggaggtggaggttgcagtgagccaagatcacgccactacactccagcctgggcaagagagtgagactctgtctcaaaaaaaaaaaaaaaaaagaagccgttgtgagaatgacaggagggcagccaaggtgttgcctcatcacacaggttcagtgggtgaggctgtgtaaaatactgggtaatccggggtatagtcctgcctttgaggagttcatgggccattgccctcctctgtcacacaacaggcagtgggatgggtgggatcagagaggtcccaggtgcctctttggagaagggaacagggaagtaacatttgcattgggatgaggagataggtggggagacattgcaggtggaggaaggggcaccagcaaaggcatggggtgaggggaaaccagagcctctccctcaatacagcatttgttagattaactattagcgatatgcagtatcattctgcgagtttccttggcgagcggcagggatgtctttatgctgctggcatagaggaacagaaaagacctgatgtccatttcttcctctcatttgaagtgaaggctgttgcttacttctcattgctaattacaatgtctagagccctggagttttattctcacttttccattttgaacttgactcaaacccttccacctgtcatttctcatgtgggccatggaagatccatgtttaagacgagaaaactgaggtatagggggataaatcacacacacagcctcgtctcctgactcccaggctagaactctttccagtctctgggggcccctggaagaaggaaatgtgagggtgtggggtgctggggaggattctccaagggccacagcacctcccggctgagaaagggaaggaggctggcttagaggctctcagcttggagccctcatggctttgtcatttccttgcacctggccttgggtgaatcacttaacctctggagcttcagttttcctgtctgtaaaatgagcgtgaaatgtcaagcaccatgcacgtctgtatgaccttgatcgcgattccgctccttcctttatgcttccaatgggaagatactggatttggaagtccgacctccccatttgacagatgtggaaagctgatggcagagaggggatggctgtggtccaaactccaggccaggctcaggaaagtcgctggagcctgtggtcaggaataaggagtgttcagctctgaaagaccccaccaggtgcctgtgtggaggatgacatggagggaggggccctggagggagatgggacaagtaaccaccttggtctctctctatctgcagggagaactgggcctgccaggcccccctggagtccccggcctcattgtaagtacattgatgcctggggcagcaggtgggtgttgaggagactcagggtggagccagcgtgtggggagccaggagcaggccctgcaggggaggttgaaaagacccttctctcatcaaacccccagaggggctggggggccaggagagaccaacctgggtgaggaaggtgggtaggggaaggtgggtaggggagggcgggcggctgagggaggagagccctgctgtgtggcctcaggtggatcaccttctctgagcctgtttccttattagttaaatgagatgagcacttggaacacaagattgccaaagccctttcacacctgctgcgtgcatggccgttgctctgcaaggaggtgtgggcaagtggtgatggcatacttatttcacaagcgaggtgttccaggtccagagggagaaggtagctggcagggtggtcttttgcactcttttcctccaagcagactttggagccagaccacctaggttcaagtcacagacccaccacatcctggctgtgtgacctgggccaagccacttaccttctctgggcctagtttcctcatctgtgaaatagaggtgatagcagaatcatcctggagtggccatgaggattaaaggaggcatcatatgtgtagtccttggcacaggatctggcacccagtaagtgctagtggaaaatattgttataataattcttgttattacctcctgaaatgcccaggactgagagaggcctatacacgaggaggtgggaggcgatctgacctgactccatccaggtggtgtaggcctcgaggagtggttctagccaaagccagggcccctgctgcgctttcagtggaatgagtgttaaccttgggcccagccgcaggggccagtgagaggtcagagcctgggaaatgacactccaagtgtccccataatctgatgccccctccgccctgtccattgggtcattcctcatggggtttgagtttgggggcccgtggagggacacaagtaaactatctgctagcttgacaaatgagcttccagctttaccactccagcaactgtactgagaaattctgctcagagggaggctggaggaggtccctgagggaggcagggaaccccatcgctcagggaaggccagtcctgggaagaaggcccagatgtccccgtggccatctgtgcctgctcaggtgagtgggagcagaacctgggtggggtgggcaggaggtgagagctctctgtgtctgaatcctgactttgctacctcctgactgaacttcaccttggcctcacttccctgagcctcagggatcccctctgtgaaatgggatcattgtatccactcttattagaaccacagaaacacacagtccattccagtccagtggctaagagaacagtttctggaaccagaccacctaggttcaaatcctagctctaccactcatgtaatcacaatcctgagcaaaatttttaaccaccctatgcctcggtttcttcatctgtaaaatgggaacaatagtggtacctaacttggaggattgttgtgagtgaggatgtagataaattaatatgtgaagtgcctagtatgtagtaagcactcaagaagtactagttatgataataatagctattgttggtgttattatattacacacacgtgatattttacacctggtagcagctatccgggttactgaattgacaaaaatttcacagtcacattggaacttggtgggagagagtgctgcaattgataagtgatgtctgccttggctggggttgaggaagtgtcaacacatgagtcataaatttgtcatccctgatgtccattcagtaggactttgctgagcaccttctttggcacaaggcattgacctaaatgctttggaaaaagaaatatctgccatgggaattcgagaactctctagaagtcttctaatctgaccctctctaagcccaacaggaatcccttctggagcatcttggtcatatggtgattaaactccaaattgaacacctccagtgcaaaaagtccctccctctgtgggagcctagtccattctacagagctctctttgtttggagttttcctgtggatggagcccgagtcgtcctcactgtccctgagtgaggctgtttgaggtgtaaaatggtctttgtctgtgcttcccagggctccttcttcaggctaaacaattcccatcccaaagcctttctgaagggatgtttacatatcctgtctgtcatccttggcacatgttcctatttgtcatcatcccagcgttcactaggttgggtcctgagaggagcaagaatattgcttagtggaataaacacagattgtggggttttggactatagcatcatagccctcctggttcttttttttttttttttttttttgagacagggtctcactgtgtcttccaggctggagttcagtggtgcagtcttggctcactgcagcctctgcctcttgggctcaagtgatcctcccacctcagcctcccaagtagctgggacaacaggtgtgtaccatgatgcccagctaattttagtattttctttttgtagagacaggatttcgccacattgcccaggctggtctccaactcctgggctcaagcgatctgcccacctcgacctcccaaagtgctggtacctcctggttctttaaaaggtcattcttacctgtgctctccgctgcactccactgttaaggttgccagataaaatatgacacctagttaaatttgaatgtcagatgcaatatttagaacacatttatactaaaatgtcactcattgtttatctgatattcaaatttaactgggcatcctgtctttttaattgtccagtctggcaacgctatttgcagtgtctcttaggagaaaccctttcggcaaatgggaaaactgaggcccttggtcaaggtcacatacctggcaggtgaggatgggggccatgaatctcaagtcctagtccagggcactcctctttttgcttctgagcagcctgcactgggggcagagccctgggactttctgcatttcatggtacccccttttcccagagctgatttgttctgccttgtggttccttcatgctgtgtctttttttggccactttcagcctccttcctcagtttttagattcttttcactgccaagatgaagtgtcctctctcctgtaactgggggatcacagggctgggcctgagcccatcaaatcacctctgctccctgagcaaatgcctccttccaccctggatttttgggaacagcagcttctgtgcctggggaaaaaaactgtctccccaaagagctggaaaggaaaggaattttctaaccagaagttaaagaggaagagggattgtgagtcacctacggttttccagaggatgtgggtttttagctgagcaaatgggaattccatgtattgataatcattttagtggaaattcaaatttattcaatgcctctgtctagtcagttgaagcaatttgcatgcagactgaagccaaaccttccttccgtcccccgggtccctgcagccgggaggaagggcgtgagaggacaaactaacatttattgagcgtctgtctgctatgtgtgcaacacatgcactgggctggggaggccttgcgaagccgaggtcaccagttagagagtggaagtgtcgggcttgtcacctgggtccatatgcctcaattccagtgagccaccggtggctccctgcagcctcagaggtgagagggcctccacacagccctctttgagtaactgaaaccctttggcaggccctcaagaaaactgtgcctgattccagaatctgctcaacaaagacgatttctgtcctttttattcagagtgacacagaggaaattttggctcctccacaatttaatgagacccaaagaacatgtgatctggccacaaacccagcatgtgaggggcaatggatttgtccaccttattctgccactaaatgatcacctgcctttgtttccttgtctgtaaagcaaagttagataccccaccacctggcatgcaccaaaccctcttgtgcccaacgctgtgccaagtttttagttgtcacaacagccctctgagggtaggaagtggggccaccaatttacacttaaggaaactgagcctcagagagggtgaagcacctgcccaaggtcacacagccaatcagctggacctggcctgtcacagctcacactctccactgttgtactatatccccagctcctcaagacttctgtgctgaacagagatagcgtgtatgtgacagcatggactgggcagtgccagggctgttctggtgtgacagatggtgcttagtaagaccacacagcagccagaactgaccacagctccaggtccctgtcccgaacccgcctggcattgttggccttcaaaggcagtcctcagagggattataagtgagcgtgtttagctttctttttcaccatcattaagccacttttaccaagcacctcctcagagctgtgccctgtgctaggcactgggatcacagaggtgaggtcctcagagcaggcacctgcctttggtctgggggcagcacaggtggtggccccataggcacacgcagaaaggatggtcagtgtcagaagggccctgagcgagaggcatggggctctgaggcctgacagcaggggcatgacctggtcttggggtcagggaagtgatgttagtgctggaggccgaaggacaaatgggcattaacaatgccagtggcgggcatggcactccgggtataggaaacagcttgagccagggtcggggagatatgtcagtggctaagtatgtcacagctaaggaggaagagcagggcaggaaggtgagatgtgtgagcaaccatcatgaaggatgggcaccagccgttccccacattagcctccggaggtccactggctggcagtcaggggagcacaactcaatttttctgagtctccaacctgacctgatgccctgtctcatgtgagacatagcaataggaaaggcaaccttgagtgtttttttttttttttttggtcaacagccaactcaggccttgtgagcatggactgtggggtcagacagacagacagatggatggacagacctgggttctggtcctgcctctgccccctgtttattgctcgatctcaggcaggttacatcacctgtccctaagcctcagttttcccatctgtaaaagggagtgggactgacaatggtgcttacctcctggggttactgtgagcagctggtgagggtccaagccaccagcatcgtccctggcatggcaaaggtgcccagagtgacatttagctattgctaaggagggttcaaagtggatagcgtgcatctggcacacagtgggcgttctttaaatggtgacagacaggaccgattgtgttcttggtgggagtcagtgagacgaagggcacagcgtgtggtgcggtgtctgggagcttagagaaaagtggaaacaggttccaaattaagggacttactcattattctttttcatggggacatgacattctgagtggctccggccaagctggcctcgagggcgtctggtacacagtagacggctgctctgcaagctgccctcgggggatgctggcctggagttttctttgttcctcccggaaatgcttttgtagcccaatgtgggggtcccaccaacacagggggacctgtcctatgcgagctggcaccttctccgggtgtggcctgcaggcaggggtctctcttccagattccttctcccctggggttgcccatgcccatgggatgcccatggcaggtccctgcccccaccacacacagacccctttggagagccctgctgaggcagcgagtgggacctggggagtggggtgctgcgccgtgactccccgaggccccacaaaggtgaccatcctgcctgcactgaattcagtcccacacaacaagccacttcaggcctggagggaggaagaaagagcctgtgtttctgagctgctggcggcccctctgcctgccgccctgcctggcccccggcagagaaagactcctccagcagagcccgcctctgtttatttgtgcatcagggggaactctgggcgggccaccctggctgccttcgtccaggaaaggagagaagcagcagccagaggggcctgtggacatgcagctctctgcagagagctggcctcccttccaatccggcttctctccctcctctccagagaccacctcagaatggcctagaagctctggagacaggctgcctagtgtgaatcccagcggtgccccgactccgtgatatcgctggagccctaacctctcagagcctcagtttcctcatctatgaaatggggacagtagtagactgatcttcatgggctgtggtgaggaattactgggttaaagcacgtcaagtgcttagcacagtgctggcaactggcatttgcttattattatcacccgttaaactgagccctcactttctcagtgagactgtttgatgggacctgaaagcagaatttctttctctctctttttttttcaaagatagggtctctttctgtcgcccaggctggagttcaatgacgctatcacagctcactgtaaccttgaactcctgggctcaagggatccacctgcttcagcctcccgagtagctggtaccacaggcatgcatcaccatgtccagctaatttttaaatattttctgtagagattgagtctccctatgttgcccaggctggtcttgaactcctggcctcaagcaatcctcctacttaggcttcccaaagtgctgggattataggcatgagccatggcgccacgctgggcctgaaagcagaatttcttagcaaaggctcagctgggaggttttgtttaatccaatcagatgggaatcctaaagtccagaaaggggaagcatttgcccaagatcacacaggtcaggatgggccaaggccagactccagttgttctggggttgggagagtgagaatcggcatcatctcaggcaggctgagctgccatctgcaaactccatgccgtctgtctgtctgtctctctctctcctcgggggcattccatcacatagtccccttggcccttcctccaggagccagggaggaatgtgatttttcattctctgcctggcctccctccgagacgtctccaggcagctccgacaagaactccagttcccattcttgagcctggctactggggcagcctttgttcctccaatgcttcagagctgtgcccccacctcagagcacttgccaggggcctctgtagagcctgatcgggtagcaggaaacagaggcccagagaggttgggcacattgaaaccacacagcagccagacactcagatcagtcatggaggatggacaagggagagaggagggtattttcagggtctccctttctctgagtgcagacttaatgttatggttgtggctgagggagtgatggagtgggcagaagtgagatttgagggagaaagcgtaggctggttaagagaaaagtcagccgcttcttcactctgtaccagggttcctggaccttggcactactgacatttgggctggatggttattcgtggcgggggctgttctgtgcactgcagcatgctcagccacatccctggcctctgcctaccagacgccaatagcacctcttaagttgtgacaactaaaaatgcctccagacattgctaagtatttacatgtgaaatcagtttctcctggaaacaaggctggcaggtacacagtattgtacgtcctcacttgtcacatgaagaaaccgaggcatggagacatcaagttcctccagttcacacaatgagtgagtcccagaggagagtgggatccagtggtctgctgtccactgggtggacagggaatgaaaaatcacattcctgcctggctcctgctggaagggccacggggcctgtgcagtggaatgcccctggggagagagacagagggacggtgtggagtttgcagacggcagctcagcctggctgagtgcttcccagagccttccttgcagaggaaggaaggctttggaaaggacaggaggggcgtcatggggacagcactcagccaggctgagctgtcatctgcaaactgcacacccgcaaagagaacttggctttctaggtcgggaactccatttttctcaccttggaccggctgatctgatctgaagctgggtctccaacctgtggtccaggatctgccagctgattatagtgtcccacagggtccaccatcaaccctgggatttctgggatcaacagcctcactccttacttgctgccctcctcagagagagccaagcctctgggaagcaggaggtgcctcccctcatgtagccagaggagtcagaacttccatttatgctgaatttaactcttacagcagctccggggggacagatagagagaaagcatgagggtccaaaatagtcaaatgaaaagccctttatccctgatacggggtaaagaatcagatataggagagaaatattgaatatggaaaggaatggggatagggaaggggcagcagtctagaaatgagcttgggcagggatctttatgaagtttattccagcactttagtgaaggtctctggatgaagaacattccagattccaagatcaatcctacagagttgcgtctttggaagcccaggcccagggaccttggggattgtccccaccacccaggccagcctcctgtgggccactgctcacagcaccctcttctctttctctccccacagggtgacttaggagtgttgggtccgattggctacccgggacccaagggcatgaaggtaagcaagggatgttcccccgattcaggccttgtccaagctgggcacccccgacccatttcagcccagaaggaagggtgaccttagatgatgctgggggaagggaggatggcaggatgctcagaggggtgctaggaggaagctgggcaggtcaggagctgtcagctctggcctcagagccaggcatcatctgtatgtcatttaggccagacatcctcctctagctgagcatgagtctgacagggttccaggcctcagggcaccggaagtccagtgggggacatcaccagggccatagaaactaccatggcaaaccagtgaactcagcccatccctgagtgggaagggcgtgcagcaggaaggcaggccaagactgctagagcacatcccaggggcgaccaaatttaaccaacgtgcgtgtgacacggctcattaagcccttccctccccaccagttccttcttcctctggatttgcctgcagtgctgtggtgcactgcctctctcacagctccttcagtccacacccttgccctgtgagattggagtcatttgcccccttttacagatgtgaacactgaggttgggggatctagcacggggtcttgcagcaagtcgtgtttaagccagggctcctgacttctgtggcctagagtcccatcacagctggccttgggctttgtcttgcagggactgatgggcagcgtgggggagcccggactgaaaggtgataaggtgatctgaatactcccttattgcactgtggtttctctgcatgccacccccctctccgcccggaggctgctgctgatttctcgccaggtccactcccctgcactcttcctgcctctcctctggcctcccctaaatctgtgctccctagcttcttcctggtcactctgggtggggctcaggcagatggttctgggagcccgaaaacctcagcagatagtgcaggagcagctgttgcagcaaggagggcaggtatgtcaagacagggctctgaatccagagagcagagctgaggccagcatctgggatttgaaggcaaagccacagagcaaggagggtggcagtgagggcacaggaggaaacaaatctacatagatcaccctggcatgaaattggaaaccccagagagcgtgccgactggaaatgcgactctgagcccctgacccgcttctcctcctgctgccatgggggtggctgcccttgccatgtatcctctgtacagccctgctgctgagctctccctatctcaccctgtgccaaaccagagttggaagtgggaagacaggccctgggggcccagagcaaagcagcatctgaatacgagagacacagggcccagcacttgtgccctgctctgtggccatcttcctgcctagcctcttcagaccttggcaaaccaggacccccgaagggggtgcaggaggggttcagagcaacattccaagtatccatgagacatccgaaggactgactgctgctcagccagcccctcatgtggtcaggtgacaccgcacctgtctctaggtgcctctgcttcctcctacacctgagtcataaggtcaggtgccatgctgggcgccatctgagtgtaccacatggatccacccattaatcctcctacccactatgaaataagaagcttgcttgggccgggcacagtggctcatgcctataatcccagcactttgggaggccaaggcgggcggatcataaggtcaggagttcgagaccagtctggccaatatggtgaaaccccgtctctactaaaaatacaaaaattagctgggcgtggtcgtgggtgcctgtaatcccagctacttgggaggctgaggcaggagaatcgcttgaacctgggaggcagaagttgcagtgagccaagatcgtgccactgcactccagcctgggcaacagagcaagactccctctcaaaaaagaagcttgcctgaggccacgcagctggtaagtagaaagttacctggctccagagacctcaactgtgaagcagaactaagtcagaaggtcagagctggtgagactctgggaggtcacatttcacagttcctacgtctcacagatggagaaaccaagacccagggagagaaagagatttgcaggcccctggactcttagaacattagaattgctgggtgaaaatggacatctccagattgttttactcaagcctatccctgggtagccagctgggtgccatgccaaccccagtcctttctctacctgtttctacctcttccatctcctcctgtcatgcccaagcctccagccacaacccacctctgccccccttgccctgctgtctgctacacctttctgccagagccctccctctttgaaggggctttctgatggaggcagggggttccccacacctacctgtttatcccaaggtttgagacatcagcgctctggaaatgttgaagtcatggacgagagagaaaggaagctggggaaaatgagagtgtaggcagtgagctctttataggcccctttgcagagctggtctcagctcagcgttgcttcaggaacatggaaataaatgtgttacatggaactcggctggcttgctgatgggagttgcctgggacatttagagatgtgaaaactctggaaaaagaaaaaggaggaggaaattattttcatgcccatagtttttaggaaaatcaaatgtctttaggggaaaaaagagagagagggggagaaagaaaccccttttcctttggtggggaggagccttaaggctgtgttccgatcagccacgcacacatccgtgtcccctggccctaccctgggatgacagagccatcccttcacgttccaaggttgctcctgcctcaaatcccagattttccatgacccagcctggactcagtcccacttacaaccgcttggctccctctctcagcctggagaagcattctggaagcaaagctcctgctccgagcccagctcccttcaaattcattgtcctgatttcctaggtgccttttaaactttccttgtttttctattttcactcctttttttcaccccttcactcctctcttggacattaaaaaaaaaaaaaaaaaaaaaagtcctgtggttccccaaataccaggatgttgtacaggattttccaaattggaaaaaccaaagtaagttgaaaaaaaattttttttttaattctgacttttgttctactaaggaagttcttttgttaggtcatggccttagccatgtgtgggttttctaaggttttccatttttcctgggtttttctccccattcttcctcctgctcccagggatgtaaatgttttcggaatcctggggctgacagagtgtcagtaatgtccaacgtggagggctggatagagtgaggccagggctgtgtgaggtggtttcggccctaaggggaagcagctcccaatctggactgcctgttcagaatatggctaaaaacagggagggagcagaagaggcctccagcagccagaatcagtgtcacgaagcctgtgcagtacatcgtgttagaagacaaacacccagacttaagtcaagaccaatttacttgctgtttacacatagtctcaacaagccaggaaatctgatttcccatgctatagctgattaaaatagttaattagaagtagaccggccaggcacagtggctcacgcctgtaatcccagcacgaggcgggcagatcatctgagttcaggagttcaagaccagcttgggcaacatggcgaaaccccatctttactaaaaatacaaaaaaaaaaaaaaaaattagctgggcgtggtggcacgcgcctgtagtcccagctactggggaggctgaggtgagagaatcacctgagtccgggaggtcaaagctgcacagagccaagattgcaccactgctctccaacctgagcaactagagtgagactccatctcaaaaaaaaaaaaaaaaaaaatagaccaaagctgcttgctggcacagaaactcccacatgaggaggaagtgacagctcagtctgatggtgaaaaattgagcagacacaaacgctccgaaaccacgttggtgtgggggcccttgcacacgctgccttcacccctgtgtgacaacacccgttaatgatgaagaggttgaaggatcaaacacttgatttgctctgcatcagttctccaggcaaggccagttgacactgggcagtgggcagcttagcttctgttagtggcattttcagccatccgagcagccccaggcaagtctgcacattggccagctcaccccccgccaccgcctgctttcctcgccaggggcccgtcctttcctctcacaaggctgctgctggccggatccgacttgggaaacagcctcggcacagctgtacctcgccagggggtctgtgggggaggcttccagaacccacgtggcctccattgtaaccttctttgctggtgtgtacttagggtgaacaaggggttccaggtgtgtcaggagatcccggattccaaggagacaaggtaattgcatgagattttcccctccccctgcccctgcccctgccctgctgttcccctggtcttggcttccttcctagggtccatcatgagcaaggacccacctgtaagacggctgccctcgaaataatccagtcttctccatccttgatcctcttgtcatctcttccttggactttacagtgtgaccttttaacttatttctgggccccagcctcttgctttctctctttcttctttactgctacccagttgttcttctgagggcaaagctctgctctccgctcacacaccgtccatggctccctattgctctcagaatgacaccctggctccctaaccagacatcaggaccccagtgagtgcatctctctgatattctcctgctccccgccttacagctctgcactccagccccactgaaccgcctgccgtgggcctctgtacacacacacacacacagactgctacccgcccgggaccccctccacccagcctctccacaccaccctgctcagagccctttttccccacctgctcagaaagtggccatttccctctctagatgctctgagaggcatgtcctcccctcactggtggtgccacctttctcctctgattttgggggacttgtactgtgtcccctgccagacagtgagttccctaagaacaaggctccagactgccctgatggagctcggctcagggtcctgtccttgatcatgaatatttaggataaggttgagggagtaactggccttacaaaatgacatattgactatgggatcaaactgaggtggccttgacttccagagcccagctgtgggcctgctgagactggctcccctttgcctgtgtccggcatcatgtggccacatctggaactctcccggccagtcaacgaggcccagatgttggccagctctccctcttcctcttccctccctcctcgctggcctgtcctgacccagccttggtatctccgggttgtgaaccacagcaggcctggctcttccctactggaccctgtctccagagttccccaggagtcagaggcaccacagagcctgcgtgcagccccagggtccctgattcttcctggtgaggacaggggctgctgtttcatgttagcatttcctggggcccagcctataggggtgtcaggcaggtgtgatccaagccagagcccacagcagggaaaggaaggaaggagctcatcttcctccaaggcgggcgttctctgggcctgggaccagcaggaggactgggcggctgttcacctggccatttctcttcctcactaaccccagcctgctctggatctcttccaggggagccaggggttgccagggttccccggtgcacgggggaagccagggcctctggtaagtacctgctcctccagcacccccaaacctcacactctccaactgatcgtgtaatgtggctggggacaccttcacctccaagacttcatttcctcctgcagcagagctcctgggggcaagcagggcagggcaggaatgggatgtgctcatttcacagatgaggatactgtgagaggctcagtaactcagccagcttcagaggcaggcctcatttgccgacaaagctctgatgaggatctggggttcctgatgccttgtaaacaatagtgatgttatcagtaacagcagtggctgtcatttattgagtgtcactgtgcatccgaccctttctgaactgtttctttgaaggctgccaactaccccaggagtgagggaattaatattgctcccattttacagatgggcaaactaagattccgaaagttgaagtgacttgcccagggtcccatggttagcaagtgcaggaggcagagtttgaatggtagctccttctagttgtccaggcagattttatgcacatgcttctgaactttccaaccatccacaaccagcgggggaacgcagggggttcatggaaggtggggtcctcacccctgcctccctgcaacctcttctcttccacagggcaaagtcggagacaaaggatccattgggtttcccgggccccctggacccgaggtatgtgatgccccatttctccgtgtctggctgctgctgggactcggtcttgtccttgggaaactgaggcccagggatggggaaagacttgctttaggtcacacaggatatgagagatgaggctgagaggagaaactcctagatcagcaatcatttattttccccttctgctcttctgctcttactcaggggctctcaaaagtcaacagggccaaaaggtggcctcagagtcctctgccaactttgtggccaccgcagctttgtgattcatgaaagccctctgtgcgccactgtctggtccctcacaggagcttcccacattctccactcagagttccctctccaagccctggaactttcctagccacccacagccactctggaacggttcagggctcagagcttccgggtatggggagcaagaggtaaatgcaaaattcgggcttttgaatgaagaatgagaaataaggatagatttagcaattaatataataactctagttgagtcaggagagagcctcagggtttctgatgtgtgtgatcattggcataggtaggctacacctgaatgatcaactcggaattcacatgtaatgttgcgaagcaagctggctgggttctttttgacgcccccgtctttaacaggggtctcgtgtctagagagctgggctgagcaggagccagggctgccgtccctctcaggatcattggcacccaggccaacctcagttggagccccccacccacaactccctagcctccaggtcttgctcacccatgaggtctctgcatccaagacaaaagtgtggctctgtggataggccggaccctgccaaagatcacttctgctatcactcggatggatgaggaaatgtttcctaaaagctacaagttctgactttccactctgttgactttggccatgacacagtcctatctttagacaaatggacttggcctctcctccatggccccaattccctcctctggtcgctggaaaaaggcttttctgagagtccagctttcccagcattctggcccgtgagggtggaaggcatgctccctcacatttattaggcacctcctggtgccaggaggctgtgcagtgtcctcgagatgagaacttgctgaatcgccacgacagccgcatgagggggatattaccaccaccagtttacagttgaagaaactgagtcacagagcaggaaagtggcttcctcagggttgctctgctatgtaggaacaaataaggtctgctttggccctttcctgggtccctggacaatttagccatcagcctctcccgtctttgtgctctgttttgattggctgactctgtagccgagagatagctctgctcagctgaagggggaagctgataagcgcggaagctgataagcgcgtcagcaccctgcctgcttctttccctgagaccatgggagggagctccagctctccagcacccgggtgaattatctctcactcatcagtgggttatatgcaagtgagcatcaggatttgctcagcatcccgactgctaagttctcacttagagatgggcccaccccaggcagacttcttttcccagagtacaggacccaaaatcattttggatgcagatttttactgagcacttgcaactttgctggttccatttaaacttaagactagccctgtaagggaggtgttacgagcaccattttacagatgaggaagctgaggcccagagaggctaaggaacttgcccagggtcacacaggaggagggcagggctctgggaactgcgtaacaggtctccaaattgtgcaaagaccactgtggggagagggagtccctgtgctctgtggggccctaaggaggagcacgaggatattgcagggaagggaggtgattccgctccatgtgggaagaaccttctattgtacagtcatcccaggggaatggccctcactgggaagcagggagcccccatgggtggagtggggcagagtccaacacatgtggccaagatgtaggaaggacttaagcttacgatgactggagctgaggttaattaaatcagtgcttttcaatgctttcaaagtcacagcaaacccagaaaatcatcctctttgcaggattactgcagtcaaaagacaagacttctcagggcaaggcgtggctggctctggggagcaatgtccccagacacccataattctgacccagtagcagcaccggatttgagaaataacgaccttgagtgtgaccttccatgttacaaccttaatgctttcctgcaccgtccggtgtattgtctcagcaactctctgaggtgtcagggctggaaccatgcaccctgttttagaactgaggactgtgggatcaaggtggttaactgacctgcctggggtcccatcccagcaggatgagatggaaacccggtcagtctccctgcaagacgcatccccgtagcactcccttcacagcccccgtgggtgaccctgctctctgcttcccctcagggattcccaggagacatcggcccccctggcgacaatggcccagaaggcatgaaggtgagtacctgcccagggcagctccagttggaggagcagacagctctgcagaaaccacaggggctggctgcctggcttggaagcaggggttgccttgccagcctgcgatggagatggaggtaccgcctctgagactccctttttgttcccttctccccagggtaagcctggagcccgaggcctgccgggaccccgtgggcagctggggcccgaggtgagactgtctggccccctccactgcccatcctggcctgattgcagcccccagcctgccctgtcctgggtactgaaggccttagcttgggctggagccccctcagccaggacaccacccagggcttccccagacttacccaccagctcatcctatacagccctgccccgtgccccttccagggaccttctctgccctgctgtcacctggcagggtggcttccccgcaccctccctcctctgcaccctcgtcaccctggggttttctttcccagagctactgacaatgccgtgctcgtggtagcagtttatcagggcattaatgagggagtaggaagtgtcagccccattttacagatgaggccactgaggcccagagaggaaaagagactcagtcaggtcttatggttagtagcaggcagggctgcaatgggaacccaggtctgcttgagcccaaagcccatgacatacgtcctatgctgtcaactctgtgcttcctgggagtggccttgctgtcaactctgtgcttcctgggagtggcctaggggcacctccagaatattacaatgacttgcacaattagttagtggcagagcatcgatttgcttatttatgtgcgctggatgaagtgggttgggaggggtctctatggggctgttggagcaccaggtgggcacttaatgggtgggcccctgattttgccctgtgcacgaggccattcttagccttcccatgccccacctaccttagctcaggcgccaggcccccgtgacacacagccctgggctgagggtgcgggaagcccagattcaccgcgaccgcaggcgggcatccagctgacatggatcccttctcgggctggctctgggtctggcggggtcccagcactggctctgggagccaccacgtggagctgctttcctggaagctggggaaaaggagctggggggtgtctctggagggagccccttggtcaggcctggcatgccagaaggagccaattaggaggctgcctgagcctgtgggggtggggagcacctggagagtctcatgggccggaagcgggaaggaaggggagaggagggaacggcaccagccacatgcttctgtctacactcacattaccactcaagaaagccctatgtatgcctgccacttgttcacatcttcattcattcattcattcactcaccaaacaccccttagacacggcaccatcccgagtgatgtttgggggtggctgcaagaaagaataaggcatcactgctgacctccaggaactcagctgaagccacttattatatttgaggatgatcttctccaatctgggaaactgagacacagtgaggctgaggtctgccagtgagcaaatggcagaactcagagcctacatctttgagctgcagtttgaggctctgttcctcacagcacacaacggggtttaactctcatgcccagggcttccatgaagcctggagtctccattcactggaagtcactgtgtagcctggcctctaggccatggccagtggagcctctgccctgggtggggccaggcaggtgggccaggcgtgctgtttccctttgtccaggagggctctcctctgtccatccctttccctccatacaggacaagatctctgcaagtccaactggattaactttctccttttttcctctctcgtgtctcccaattctagggagatgagggacccatggggccgccaggggcccctggcttggaggtgagtgtcactggcctggggtaggtggcattcatgggagctgagccagctgtgcacaggcagggcaacatctggccagtgctccagagggaagtcatcagtgagggccttggaccagccagagagagaactaggacagaccccaaaggagagagacaagagccaagaaactgactgtcactgcccacctcctatgttccaggtgcttcatgtcagtatttattctccttgattctcccatgacacatgattgctttccttggtttcattagagaagaggcaaacgagagtgaaggctttagctcgacatctcacagccaggcagtggggacgccctgcctgggccctcagcccgagccctctgcactcttccaagctgccttcccaaagtcacttgtcctacaccccttcttggtcccagccattgcataaaccagcagctcatgaaatttctggtatccagagctttttacactcttgaaaatgatggaggacccaaaggcttttgtttgagtgggttacacctactgagattagtaattaaaaccaagagactttaaatgtatttattcattcattgaagattaatcataaactcatttcctgttgataaaaattatatttttaggagaattcacgctattttccatagcaaaataattgagtggaaagagtggcattgtgttaccatttttgcagatctctctttaatgtctggcttaatagaagtcagctggcttctcaactccgcttctgcattcaatccactgacaatattgcgcgccatgcagcctcgggaagatgccacttaacattcaccagagtgagagtgacaaaggcgaatgacatcttagtgttatcatgaaaatcattttgacctcctgaaccttctgaaagggcctccgggacccctgtagtcctcaggccacactttgaggaccacttgcataaactgttccttccctgcaccccccgatcatctgccaagttccttcctttccctcactccctgaaggcaggtgtcatcttcctcatttacaacaagaagaccaacccagggatgggggaggcttccctgagttcacgcagctggaaaccctgcctgtattccaggacagctggccacctggtggactcagggttatatgcccctgtccaccagggtatgtggctctctacagctgtggataccctgtgccaggcccttggagcccctggaccccagccatgttgcccctgtccagcttctcccacttacctgtctctctgttgcagggtcagcctggcaggaaggggtttcctgggaggcccggcctggatggcgtgaaggtgaggggacctggagatccctggggacaagaggaaagaggggatcctacatatctgggccccaagtcaagccccaaatcccatggccagttgtgaaaagggagaaaaaaattggttcctgtttagaacaaagtattggtaagggagaaaaaaatggacacaacctaagtgtccaactgtgggggattgttcaagtagtgggatatagtccagccaccctagatggtgtttcgggctattttacaagatgggaagatgcctgaatgtggggtgggggtggtggaggaaacaggttataaaagggaatgctcaagtgtgagcctgtggcaggggctgggttgcaccgtttctgtttttttctttcatttttttttttttttttttgagatggagtctccctctgttgccaggctggagtgcagtggtgcaatctcagctcactgcaacctctgcctcccaggttcaactggtcctcctgcctcagcctcccgagtagctgggactacaggtgtgcagcaccacgcccagctaatttttttgtatttttagtagagatggagtttcaccatgttgactgggtgcagtggctcacacctgtaatcgcagcactttgggaagctaaggcaggcggatcaagaagtcaagagatcgaaactatcctggccaacatggcaccctgtttctttacgcacagagcagaggctagaaagtggacagggattatctctgggtggtgggacaataggagattttcattttcttctgtgggcctctatattttccctattctgcataataaatagatagtacatatattaacagggtttttaaaaaatgttatcaaaaaagacctggcccaagataggagagtaatggtcctcagcccatgggcagcctcacttaatagtttcccaaggactcccttaagttggagttttcccagccattctgggcaaaagattgtcgggtcaagtttacagatgggcaaacccacaggaggttaggacagagccagggggagcgcaggtcatccatatctccctcccttctggggaaatggcccacttatctgtcctggcccctctagttttcatgaggtccagggaggagccgaagggggaggaggctccacccaggcttgcagtaagccacatccatgtatgcgccaaactactggctagcccgagcccatgtcctgccgtctgaggtttcggcctctctccctcagataccagttgggtttctgtggtgggagtggtgacatcgtctgtgtggatttgtcccacagatctgctgtgggcctgaggagcaggagccatctcagcatgggacaaaacagacagacaaggccgagataggccacccaatgtgaaagtgggacagagccttgaagacaaatgagtctgatttcccttttttatagctggggaggctgagcccagagcagagatgggactcaccccagccacccgtgagctggtggcagagctctagtgtgttgaggtctaggaccctggtgccctgacgtcccatttccctgctcttcctgagatagggcagcctgatgcagtgggaatgtgcattcttgttttttttttttttttttttttttttttgacagtctcgctcttgtcacccagactggagtacagtggtgcaatctcggctcactgcaacctccacctcctgggttcaagcaattctcttgcctcagcctccccagtagctgggattacaggcatgcagcaccacacccagctaattttttgtatttttagtagagatggggtttctccatgttggccaggctggtctcgaactcctgacctcaggtgattcgcctgcctcgggttcccaaagtgctgggattacaggcgtgagccaccgcacctggcccagaatgtgcatttcaaccgggcagaccaaggtttcggttctagccctacctctggctcactgtgtgacctcaggcaggtcacttcacctctctgggcctcattttccacctccacaaaatgcaatgggcttctgaaggacctagatgagacatacacatccaggtgctgagtaagccaaggccccctcagagggaatgggtgactagagtcatgtctgcctgaggttctgtccaagtacccctttgactctgcccatttgttgggggtctccaaggccacacactggagataagatccctggttcatccccactaatggcagctaaggccagcaggcctgggacttccccaggaggtctagactttcatctcccatcccaatccatcctcctctttgtctctttgcagggggaaccaggggatcctggtcggccggggcctgtgggagagcaggttagttagcaacggtctctgaatgagtggctccatttattgggcccttactctgtgccaagccctttgcccagcaccctccatgcaccacctcgtgtaattctcagaacaactccagaggtaggttcagtcctctacccctttcacgaatgtggacggtgaccctcagaacggggaagtctgtaaatgagaaagctgtggatcatagtcacgacagcttttccccacagcctgactctacacacaggtttttggtgcatttgcccaaagaggttatgtgactgctcccccaggacattaaaactggaggagcccttggcagtcgttgctcgtgttcccatcagcttatagatcaggaagccaaaggccagagaagtgttaccacttgccaaggtcccttggtctaggcatccctaaattatatagaagatgaaatccaaaccagtggctctggctggttgagaagctgggtcaaggtctgaagaagagaagaggttgcaactagtcattaaaatgaaggtttgaggatcacgaccttcaattaaagtccagagaaacagctctgagggatgggcagagggacagcttcaatccttcctgcccagccctggggcctcctgaaagcttaacctcttggctccaaggtggagaggtgttcatctcctccactcctttaaatatggagctcattcctggaaggggcttcctcaatccggaaggactgatgctggggatggccatagaggaatttggccgcaccacgaaaccccgtcagtggcgtgagagtcacacacgatgggcttcctcaccaggcctgcaacatctgttgggggaagaaaggaattaaaacagggggaggcctggatttttgaaatctttccagtgtcattcgagcgcattctgtgggaagcccgggagtttggagaggctgccgcggcctggatatatttcctgattggaaaaaaaaaaaaaaggcaatttgatcagcaaattcagtttcatagttatgctaatggtagggccctcgggaaatagatatgcagggtcttggaagtcagagcacaaagatccttggaaatcactgtatctaagagccctaaccatattttgtgccttggatttctttgccaggctggaaaggcccagggatccccttctcagaatagagtttataaatgcataaaattaaaaacaaaggaaactgattatatagaaatgcaattatgaaaatatgttaaaatataatatattcatatatatgcttctttggcaatgcattaaataatgagttctagtagcaggtgtaacagcggcctcaattttgaagtaatgccaagccttagtgatgtattttgagatctctgcagcaatgattgtaatgtgccatgtcactttctgggacagtcccaggtcctggtagtactactgtggtttgttgcctacactcatattcgaggcaaatgctaaatttcaattagaggttcatgaaaatgaaagagttttaatttttttccattcaagttgatataccctctgagttccattcatagagactgacagagaccccgggtttagaaccctcagattctagtccatgttggcaatctgggatttatggaggagaagcacgtttgaccaagatcaccaagtgggatagtggtagaactaggcccaggaggggtgggaaccttgcctggagcagcccagtctcatttggtcagcagaacacccggcttgctgcccaggcagcttggacagtagcgggaaggaggcagagctggaaccctgtggctgctataaggcacatggaggtaccatgccagccgttcccttggcccccaccccatgtggtcacagtgaaaggggaggcattttctgttcactgcaggatcagaggatccctgggaaagttctgaagctcacaccacaggacctccttgtaatcatagtactgggtcggtgcaaaagtaatcacagtttttagcattataatggcaaaaactgcgattacttttgcaacaacccaataacagtgacatttattagtcacctgttaggttccagactctgtgccaaatgctatctacacaatcgtctatggcagtaggtattactgtcctcattttgcaaatgaggaaactgaggctctgggaagttaagtaacttgtccgagatctcacaggcagtaacatcactgtcagaggcaagattgaccctgaggtctgctgggttcccaatgcctgcctcgagggctgaaaactctccgacctcctgagccctggcctgtctctaacagagcacagactggctgccaggccctggccgaggtgctgggaacagggcatgggtcttgccttcaagacaccccgtccaggggcagccacgcatataaacacgtcacactgagctgtctagtccagctcagggtccatagccctctcattctcagttgcatccccagtgcctagcatatgagaggaggaagaaaacttccggtagcagacaatggccctttatctgtaggcaatgtgaggaccaggctagcctcctccccaaaactgggaactcggatcctgcctgtgcggtgcccgctgtgggtaacaatgctgcctcctcccatgcccgccttgccagccctagaggagccagccatgcccgcagctttccaagctgcttctccgttgacctgcctggacttctgggcctggcctctctggaccagcctcaagaacaggcctgccaggatgttctgggacagtaccccgggggggtcccaggggtgcgggtcgggggatggggcacttgctgtatggctcttattcattaggatcttgtttggtttcttgttagaggtttatgacccgcttgccttccaggacccaacatctcataaatttaaagtagctatgaaatttctgtttctctgggccagtcaggcaggggccttttaacagagcagtttttattcccttcattcggcatcctctaaatgtctgactgctcccttgtgggaagcccaggcctctgtcttacccctgtgcccttgtaaaataaattaagaggggatgggaaagagcgaacatgtatgaagtacctctacgcatcgtgcaccatctcccgtattcggaacagtgccaggaagtagggaggtacctttattgtctcccattctgcagatgaggctcagagagactgatttgcccagaacccacacacctgaagactgaatgacagttacatagataaagtgccaggtacagggcttggcacacaggaagtgctcaatacgttgaagccgttgttataatattgctatcacttagaaaatgctctaattaatttttaaaaataagttgttgcaaaaatcaagtatttggttattttctgtgaaatgttagctgtgaccttatacctagtgcctcatccctcttaccttatacttcagaaagttctctgaacccagggaaccaggggcaggtgcaggatccaccatgcgtagtgccagcgtggtgctgggatgtacgggagatccgggccctgttcacagccacatgctttggaggccttgggctggaggggaaggtgcgtggtctttggagccacacaaccagagcggacatcccaggctgcagcagcaagacacgtgtggccctcgctgaagtgaccactttaaaactgtctttagataagaaagtgtggatcccagaggtaaccctctcatggtagttaactgacagctgggccggccttattgactgagtacacaaactctggcctattcctggcccaaggtctcattttactctggccagggtttgggggacagggagcggattttatggacaaaatccactcatccctccatctttcctaattcacccagaacctcttggctgcaaatctgggttcttccaaagccacttctgcactcctgaaccacacaaggccctcccggctcagtttgtattttccttagcagggaagaaggtggggcctgaataagaaattgatgggccttcctaggtgacccctctaggctgtccaccctcgctgcgcgtgtgcgtgtttgcttgctcagggagacggcaaggactggggccacctagaagaaccccctggaacccagaggcaagttgtcacccagcggagttcagcagagcagcaggagctgcagcgtgtgtctgtgtgtgcaccctttcagaaaaaggcaaggaggcctttcagaagacagtaaagaggcctccgcctccccgattccaatcagttctcttggcggaggctgttacggtatttctgtcccagccagcgggtttgtttcactctttgaaacagccccagagccccgaaagatgggcacagatggcctcttcccagctcagcttaagccaccccccgcccaaccccagctctccaaacgtggcagcctcccagcctgcttctggcgcgggaagaatgtgtggcgctcccagggatgttggcagcggccccgctgcttggcttcaaaatcagaaccatctggtggagtgagggaagtcagaacggtgcccagagagaggcagcgctctccccggcacaaccccatgctggctgggtgaccaggcacgggtgggagacacctgggagatgagcttcaggggaaggagcgggagggctgggtccccggattcacgttgtttctcttgctttcgggaatgtgtctcatagggatttatgggattcattggtctggtcggggagccaggaatcgtgggagaaaaggtaagtggtgttgaggggaaaagataaacaattagagcttgtgttttgaaattgtaaaaaggtgaagaggccctttgacctggggatttcagaataccctcccctagcctctctcctgacctggcattctgagtctgccaagagacattgttccctttcctggcatcccttggggttctatccctgccctactgtcatcagcctcaagcacagttagacttttgtgtgacaaccagcagatgcatgtgacctgggctcctcacagctgcctactggccctgcacaggggtcggcgagagcagggaggaaaagactcatctttacaaagaggaaagatgaggttgccttgctaagcctctgttttagatgagataacagaggctcaaataggggaggtgacttactccaggtcacccagataataagtggcagtgctgagatttgaaccaggttcattgccaaaggttagctacactttgctcactaagacactctgcctcatgttggctcccagctcccaccaagggccttggaggcacttgtcttcctttgtatgggtttatccgatccccagagcaggccctctgggagaaccaatattattcccattgaatagatggaggaactgaggtccagagggaggaagtatcccccgcaagtctggccccgcctaactctccaggatcctcttgtgccacactctatcactctatgtggcccagaccctcgggcctctgccttcctcctcctcctcctccctcgcttccccctcctcctccttccccttctgctcctcctccttttaaattcagctttttatcttgaaattttaaatttaactttttattttgaaataatgacagattcacaagaagttgcaaaaaatagtacccttcaccctgtttcttccagtggtagcatcttacataatgatagcacaacatcaaagccaactctgggcttctgctgttgctcaaatgacccatgtcccttctcacctacaaaccattgactgcgccattcccttagccaaatgctttcttcccattgccatctgcctccaccctttctgcccagatgctcttcattatccttcagctcttgggtcaagagggacttcccgagggaagctttccctgaccggctctgcccccaagtgggtcaagtcctccaataataacaccttagcaccatgacccccaccctcactgcactgtgtctcctacaaccctctgagtgccttgctccatgggagcagggctgctcaccattgtatattcagagtctcgcagatagtgtcagacacatagtaggtgctcaatagatatttgctggctgggtggatacaagaaacagagcctcacgaaaacagagccaagattcgaacccagagcacctaccttctggctggagctgtctgctacactgccaactctgcccagtgtgtctggattggtcgagagggaatgagttatgtctctgattctctagcatctcatctaggtttggacagggagtttggagagtgaaagacatgccttctcttgctgtttctgcctcagcaagcctagcccaggggatgccaggcctaataaggaccaacatgatgtgggccaggatcaaaggggacagtgtaattagtgcttccttaatcaggaccatccttggagggaaattcactgcgtggcccactacaggggatgctgaggccttccagggcttgccagaggtcttggcttcctctgagtgaaatcccagatccccacctgggtgatgtggccatgaactaggcagggaccctctagagaccttgagcaaacccctacctctctttgagcctctggatggccctctgcacctgcctcccacagagccaccccacagccatagccgtgacctgcctgcattgctgtctccatcacagggtgatcgtggcatgatgggacccccaggcgtgcctggacccaaggggtcgatggtaaggagtaagtctgcatcctcttgccctctcctgttgcagccttgagtgacagctctgctctcctccatgaaccgcttaccccagacgttcagaatgaccagctccctctttgtccagggggcctagctgctgtcctcctggctttgcactggggctgagccgaccgaggtgggactgaaggaggaagcttccatagctgattcctcctttgtcttctctgtcttggcagggtcatcctggaatgccaggtggtatggggacccctggagagcctggaccccaggtaagcaaagccctcgtgatccctaagctcaaaccactgtcagataagggttaggtggctgggtgtggtggctcacacctgtaatctcagcacttcgggaggccgatcacttgaggccagagttcaagaccagcctgacaaacataccaaaaccttgtctctacggaaaatacaaaaattcgctgggcgtggtgacacgcacttgtaatcccagatactcagtaggctgaggcatgagaatcgcttgaacccagaaggcagaggttgcagtgagccaagatcgtgccactgcactctgcctgggtgatagagctagaccctgtctcaaaaaaaagaaaggaaaagaaagaaagagacagagaaaaagaaagaaagaaagaaagaaagagagaggaagggaggggagaaagaaagaagggagtggaggaagaaagaaagacgaaagaaagaaagaaaaaagaaagaggaaaaaagacagaaagaagaggagaaaaaagaggagggagggagggcgggaggggaggaagaaaggaaagaaaggaaaagaaaagaaaggaaggaatgaaggaaggaaggaagaacagaagaacagaagagaagagaagaggagaaaaagaataagggttaggagttcaagcctcagaatcagacagacctgggtagaatcccagctacaccactttctgactataatcctggggcagatctgactgtattcctggggcagatcatttaacttctccaagcctgaattttgctcatttgaaaaacagaaaaaagaatcatggtcaggatagtgtgatcgtgtgggttaaatggaagcgtggggctaatgttcattacagaatggtgtttgttccctggaagcattttggttattagcagcattattgcttttgtccattcactcattcactctgtagttactgagcgataagtgcttgtgggcagtttcaggagctgggtgaaggggcccaatctccactcactgcaacctccacctcctgggttcaagagattctcgtgcctcagcctccctagtagctgggatcacaagcgtgtgccaccacacccagctaatttttgtatttttagtagagatggggttttggcagttccaggagctggggatgtggcagcaagaaaggtagaaagtggtcccttcctttggagcatgtagtctggtatgggggggcagggtagatagaacccagtaagtgatgtctgttctggaagagcaggcacaaagatgggaaatgctggacaaacagggctgagggtcctcaggggcctgggcttctcatgatgactgaggaagcagggttggtgggaggctctcaaggcagagtggtgggagaggctgggagagctgggggaagggtgcggccaggagcactcaagttcaagagccccttctccttcccaggggtgatgatgtgcagggggtgggggtgggcttgctctcatttggagcaggtagaacttgcttcagatccctgtttctgccaatggaggatggaaactaggaaagggcactcgcttcagccaaagccaggggtcagggctgggagcccagtccgaggtgggcttggggaagttggggagggtgtgggggtagagggaccagcccaggcacagatccggaggtagggctgaggggcgatgagctcaggttgcctgggtgtctccaaagtccagactgaggagttccctggggtctgatgaggaagggccctgaagcctttcatggtttgaacccaggggaagctcgcataaacctgttctctactgtgattagggaagcaaggccaactcagctcctacactttttcatgcacctgctgtgtgctagcataagctcctccctggaggtacaaaaatggtaagaaagagttccagctcttaagactctcactgtctggtggggctgtcaagtataaacattctctccatcattaacagacttttatcgagcacctactctgtgccaggccatgccaggggccgaggaggtagaggggtggactagtccaagggtgagaggcctggatataggtgaccgtcacccagaggagaaggcatcagcaccaggggtctctgtccatcctcatgattctttggacaagttggaacgttcttgaggagcacagttggaagcagaagccagcactctgggctcccagtgacatatttttgcccttttcatgagaaggaggaaaagtcacatctggcccagggctggaggagctggcagtgtggaagtaggactgttggggtagaagcagggggtcagaggaccagcattctggtcagggggctagcacggctggccgaggcacccagcttggaatgcaagggcccggcctccctcccagtggtcagagatagagtgattggagccctcagcatggggggtgcccagagtagggccgaagcctgagtacaaggatgctgggggtacatcatcgagttctatccctggcacccctgcacctcagccgtcctgggcctgtctccccatctgtctagtgggaggaggaaagccaggaaaggagtcactgggacacaatggaaggccagcgggagatggggaaagagtggggatattcaggccaatacagagaagaaggtgcaagcctcctctgaatcccttgcctccctggctccactcacctccccaccccaccccatctcctcagtgcttccccctcttcagtgggttggctcaggcttggtgaaatcagacggtcacttactgctgtttctgatcccaaggttgccatggtcccccactgctacggtacagggctggtcccttggatctcttggggttcctcctggccagcgacactggggaagccggctagctcggaggcccagaaaaccaccttcagaatcagatacatgggggtgaaattctggctccccgacttgccggctgcgggattgttggcaacattcatagcttctccgaccctcagtttccccatctgtaagtcagcatgatgccacctggagtatgagattgtcatcggaaatggtgcagtgcatgatgtggtgtctcacagccctcctgcataactgtgtgcttcatgaatggtgataactatttgttagagatgatcattgccactattatgagtaaggctactacgattaaaagtgacatttctggtgatattgttcacacctgattggcattttcccactttatcaatcactttcacctccatgttgtccgatagcacattgagatctatcaagattattatccccaggccaggtgcaatggctcatgcctgtaatcccagcactttgggaggccgaggctggcggatcacgaggtcaggagatcaagaccagcctggctaacacggtgaaaccccgtctctactaaaaaacagaaaaaaattagccgggcatggcggcgggcacctgtagtcccagctactcgggaggctgaggcaggagaatggtgtgaacctgggaggcggagcttgcagtgagccaagatagcgccactgcactccagcctgggcgacagagcaagactccatctcaacaaaaaaagattattatccccattattgggggtgggagtgaggccctgggacctgcctagggtcgccctgggacctgcctagggtcacccagtgaccagagttgggtctagcattcaattctgacctcctcctgccttgcgagagcaggcagctaccttttcctgaggactttgtcacttcaccttctagaaactctagggggtaaggactcttctatccccatgttatagatgacaaaactgaggcccagtgagttgaagtaacgtgcctaagatggcacaattagtaagtggccaaactggcatgtgagcccgggttctccagtgctacagcctgctcttttcagcactctatgccttgatgtagagacttggctcccgaaatttcccagcggtgcattgcatgccttctgagctctgagatcactctataaaatggcccattctcacccagtctttctgttctccaccatccgggagtcagaactgccttttatggggccaagcccgggtccacaccctgcttgctctactgacgaagggtcagcctgggacccagcccctcacatcagcccctccacagcagctgttggagggtctgctgggtgatagcggctgggttcacacccctcaaagccatggggaaagggaaatgggaaagtcaagagttcgctctgaggcaccagatggggctgggcctctccctggtattcagaggagggatgagactggctctgccttgcaaaaggagcacgcccagtctgagaattgctgcggagctgggaggctcctggagctggcagagggtcctggctggccggtggatgaagttgctgcttgaggtctctcaagctgggcctggaatcggggtgggggcgggggagacattaggcagaggggtggcctgcttcccatcttctcctgtgttccctccgttcccaccctctgccctcttcagttcatgtgctccttgttcattcagcagattcctgagtgtctgtcgtgcacctgtgccaggccaggtgccgagaattccaagaactaaactggccctctcaccctgtctctcttgcccctcttgtcgtctgttcatcaaaaccaagatggctgcccatttgcccggggctgggccttgctcccttctcatgccaccccacccacttctctgcctctgcctcccctctccttctctctttcttgatcctctcccactctgccctctccgcctcccaagctcaccccaggcctgtgttctcagttcttcctcctcctcttttccctgggagaaaatattcaggaaaatattgggtgtcagggtggaggtgagggacagaacttgggtcaccagattctcctttctggtgggggagaaaaagggagatgaggatttgaggagaccttttgtcatacatgtcattgtagtctggatgcagtggctcacacctgtaatcccagcaatttgggaggctgaggcaggaggatcacttgagcctaggagtttgagatcaggctggtcaagatagtgagaccctgtctccacaaaaataagaaaattagctgggcatgatggtgcatgcctgcaatcctagctactcaggaggctgaggcggggggatcacttgagcccggagctcaaggctgcactgcactccagcccaggccacagagcgagatcctctctcaataaatacataaatgaatgaatgaatggcatcgtatcttctcattgttgattttgaggaaaaggagaagaaaatgtcatgcagggggccttatccccactccccagactcccaggaaaggtcgaggcccatccccctatagcccagggcattggctgtgttcgaggctgtggctcgcctgctgctttccccagtgagccaggtgcccagtccttccatgtggaggctgctggggccccggcagcttctgaacatgcccgtctgagggctgcaggccttcaagctttgccccacactcccagccccccgtgttgctctcacttcctaaaaaggggcctctccaaactctttctcctcttcccagggtcctccaggatctcgaggcccaccaggcatgaggggagcaaagggacgtcgggtaagtcgagcccagctcctgggggctgatgctggtgggagggggcacacttggaacagggccatctgccagagactgcctgggctttgcccctagcccagctctgggatctgtgactttcatagcacaaggcaaggttctaggctcaccctggacctgtctctaggggtgggaccccacccctctttccaactcatttctcagccttgctatccaccaggcacagtcgggctctccggtactagttctttgttcattcatttattcaaccagcacttatttagcacctactgtctggcggacactgttggaggctctacaggtatagtggtgaacaggacagacataacccctgcctgcccttgtgagccagtcaacaagtgaatcaaaccacttggcagatgcaggtgataaaatacagggtcatcagcacatggactgaggaagtattagcagcctggaagcccagaggaggaccctacctgggcagggtactaaggaaggactttaggagagggcagtgcttgagttgatgccagcttcctggcaggggactggcaggggaagacctgaaggtgatacaggaggtggatgcttaggtatcctcagggtcaaaagagggacgagggagagggatggggctgggacttagcaggcaccaagcgaggcagggcctcaaaagccacagctatactccaagggcattgggaggctgcagggggttttaaacaaggcttccctgagcagtcactggaagtaatcgccagcacttaatctatgccagatactgcctgtcacacacattaactcatttaatcctcaacactaccctgtcatgaaggtgctattctcattcccattttattattattttattattggattacttaacctttctcccagaaagcctttgattcctgggataaactaggtgctatgtgattcagcccaagccctgaacacctctgagcctccactccactcccagagaggcacagaaaggttgagtcacttacctcaagttgcacagctaaaaagtggcagagctgggatttgaacccagggaatctggctcatttgcatactgaattcagccttattttcaatcacacagggagggttgacaggatggtctgccagcaataggtatacaggcgtggggccgtgcagccttattgtaaagagaaagtgagatggtgcaggtggtgccggcagcccaggcctgatatccaagctccatacggggggatctgtgattattattctcctcttggctggatttcaagtggttttacaatttcccccaaaccagatggcctgagcagccggcctggaagagggaagattaaaaggcattcctgtggcccagcagggtccctccggtgcccatgtcctctgggtggggggggggtctcttcaaatgggccttgggccaagggcagccaggctccatccggatcctctgtacctcccctcctgccccaggaagctggatttcctggagggtgagctgcatgggcccaggccccctgccctgcctcaggcgcggggctcaggcccccttcaactcactgggctcccttcaaccatctccaccaccccttcccagcagtggcttgaagaacgtattcctgcttagggaaacacaggcttccaacctcgtcagtgtctcccgggctgggaggggagcatcaggaacatgagcccctctccccactgggtttgtcaggaatgcacaacctatgagatcggccccctgggtctcctgccaaacaggctgcccttcgccacctcctagaggaggtgactgaaggtggggaacctacagaggcacccaccgtgcctgtgaaagagcttgattctgggcaagtcctgatcagctcccggtttgccctgtgcccttagcaaggccttgtggcgctctgtgcctcagtttccccatatgtgccacggggaatgggcctggaggtctgaaaggccttgcctgctttcctgcctatgtgtaggacgggccctgctccccaccccaccgcccacccaaggaagaatgagcactgagagttgatggccaggggcaagggaggctctcatcctctgttcttggtgaggacgctgactagaacctgggcccaccagccccagtgaaaagaatgaggactctggggtcagatgggcctacggcaagtctcagcacccccggttcccagctgtggaaccccaggccggtttcttaacctctcagagcctttctcccacctgctcaggttagagactttaattcctccttccgagggggtcgtaaggaccccaagattccaatgcctcgggccaactcttcccctgcctgtgggtgttagagcttagcagaccttacccaaatccaggctcttcctcttggatcttagaccttgggccactgatttcccatccctgagccttcacttccccctccgtaaaacgggttggcaacagaacaaagctggtgggctggctgtggggactcagtcactgcctgagcaccttgaacttgctgcagggtggcagcacgtgatggtgtgtgctcattcccgcttgttcatcggcccctttttcacaagagctgtggttggccagattttctgtcccaggcaggagctcctccccaccaagcctgatccccaggcctggctggagggcagtctccagcgtgcctgcagacatcttcctcgaggagcggatacaagagagcagacaggtagctctgatagaaacccaagcttccctccagcaggcggggcgggggtgggcctgcccaggttcatttagggaaggaggcagcaggactggggaacctgcgggatgaactgttgagtggcccagagcaagggttagagtgtgcggctgttctcgcccctctccctgccctgtggggctggggagacagggtggctggtggccccactactgcctcctcctctctcttaagccaagccagcttctcccgggttctctggtgctctgctgggatagtgagttctctcagataagagggattttagatattgtcttctccaacaccaggccccagtgtgcagccttcctggcaggatcctctgggtcctgacctgtatacccccggtgacggggagctcactccatttctgaaaaacagtgacaggtagtggtgaaaaaaatggatgtccagctgacttggtctcaaattctggctcctccatttcctagctgtgtgaccataggcaagttcaccaccatcctgagcctgtttctgtccctgtgaaaggaggataacagctttcactgctcctgcggtggctgctactgctctattattatttgatgacttaagctttctcccagaaagcctttgattcctgggataaacaaggtgctatgggcttcaggccaagccctcaacacctctgagcctccactcccctcccagagctatccctttctagggaggtgtatgtctcagcgagagacagagcccagagccagagatcatccctcaggagggttcagttgtctgccatcagctcagcccctgtcccagctcccatgacctgacacggccccaccccatgtggctccagctccgccaggcctgtgcccatgaatcacgggtgttaagcctaatgacgtggtgtgacagtgtccacgtgagcctgagactgaggcccagagaggagatggggcttttcggggtcacacagcaaaccagcaacaggctacggctagcacctgagccccgtaatgcccactagagatggcttgtttaggggttcatcaaactgcagcttgaatctgaaaattctcaactggttttacacagcatagtgtgaactgcctgaggaagggactgagcccagattccccaagccactcctgtgtccctgcctctggggaggctgccccctcccctggcagagcctggcagggatggaactagccattcttaagcactttctgcgtgccaggcactgagctgcctgtgggcatcgcctcctgtcttgagggagagatttcttgtgcccatttcagaaaaaagaaatggagtctcagtgaggagcagtcacttgtccccagacacatttcctgagcagcccggtgcctagggctggaccccacaatgggcaccaggccctgggcttggggatgctgaggacagcgtctcccagctgagccttggccttgcccggtggctccctgttccaggattatttgatcagtggggtgctctttaaggctgcggtgtgggattgaagcatagggagctccaggcagctgagaagtggaattttcactttgttggcccaattattcattgaaaatttccttgtttgattttttttttttttttttgagatggagtctcgctctgtcgcccagggtggagtgcagtggtgcgatctccgctcactgcaagctccgcctcctgggttcaagcaattctcctacttcagccgcctgagtagctgggactacaggcacacaccaccatgcctagctaatttttgtatttatagtagagatggggtttcaccatgttggtcaggctggtcttgaactcctgacctcatgatccgcccacctcatcctcccaaagtgctgggattacaggcgtgagccactgtgcccagccttccgccactgtgcccagccttccttgtttgatttttaaatgatttttcttcatttagttttcttattccccatcctctcccacctagacacttccccagttccttttatctgggggagtattgcgggctgatcccctgggctcccgggccaggatgggctggcctcctccacaggacactcctgtcctcccaacacagactgcttgagaccccctagagaacacagcctgctctgttttccacgggttttttccaggagagcccagcccatctgcgtctctgtgggagcggccctggaggggacacacgtggggcagtgggtggagcccacatgggggatgagagcggctaatgtgttagggaccttagctaagtcacttcccttggctgggccttagtattcccatctgtgcaggggggatgggggtggactccacctgcccctggggtctcccagcaatcagggaccaagactcctgtgtcaggggtcaggcctgagcccagggctccagggagcagtagcctgactcccactccctcgtgcaaaatcctgccctgttcctgcccccacctcatgggctcttcctctgtgagctgggctgtattcgttgtacgtctggctagagatggggctgctccacacatctgggaaggacatgcaggttcttcccaggtcctgctctgtcagtttcccctgagggctgtttctgccccgtgtgtgctctgggaatggcacatggcagcagagtctgaagagttggccgtgtggacgtggccacgtgtaactcaattgcggccctcagtctccacgtctgtgaaatggattggctgggtgacccccaaggtctctctgaacagggccattagtgccccagcccccttctggaagcatcagcctctagctgagtctactcatgctgcggcctctgcagagctgtctcgaaggcgctgcacgagggtgaccacctcagtggggagtgtgtgggaagtgggaggaggagggggccggagcttgtgcaggggaaggccccaggcttggagcagccccgccctcctggttctccgcccgagggagacccctgctgtccggtgtgctagtccctttttcctattccagggcccccgaggaccggacggaccagctggggagcaagggtccaggggcctgaaggtaccgacccctaggacctgcccttcctcactcctccgacactgggtcaggaatcgtgaacaaggctcacagctcctcagaacaatgccccttagggacaacaaagggagccccatggaggctgcagggctctttctgagagcttagcccttccactcctcctgacccctcactgcaagcccaataaagagaaagcaagaaaggaggagggagatcatacacgtcctcagaccctttccccggaccccaaaccccaccaggcccctgacagctgagactgcttctggcagccccatccctaggaaggggtccttggttctccacctggagcagctggtgacggtggcgagccactccccttgtcaggccttagttttcccatctgcaccatggaaagggggcagactctgtggcctcaaacgggttccttttatctcccatgtggaggggtccctttttggggaacggtcctcccaagcaccctctcccaccttcacgtgctctgcttcccacagggccctccaggaccccagggcagaccgggccggcctggacagcaggtatgtcaggccaaggccaagcaggccagctgcaggccccctccctgctccgtgctttgtgatctgagcctgtaatgacccccacatgtgcttccagggtgtggctggtgagcgaggccacttgggctcgagaggctttcctgtaagtagcaccagttcttgaaattctctacatggggcttttgatgggggtggggggcgggtgcggtgctgataataaccacttttaccaagttcctgtccttctgtggaaaccccgcaggttctggttgcccacctgccctgcactgaagctcctccagcacatcctctcttctctgggtctcagccttcccatctgtcacccggtgtgggaggaggggacccaaatacactaggatggcttgcttgaaatcaagacagggcagagaaggccatggagggcctaaggtcacctttaccttgtctctgcagggcatcccgggtccctcaggccccccaggcaccaagggcctcccaggagaaccggtaagagccctttccttccctcttctgcttctttgccgctggcacctgggggtgtgggccaggtggtcagataaggagaagggttggaaagggaccatgcctggcctctaacccgctgtgggccaggccttggggttggtggcgagcactaagccaggagctctgggtttgaggctcagctcacttggcctccagcctgttttcttgccaggaaaatgggggtgattgtctctgccttgccattctgttgtgaagatgaaatgcgaaaatgtatagggagtgcttggcacagggaaaggcaggagggagggaggtgaagataagagtaaacgaacaagctgaccgggaactgcagagtccagcatggctgaagtggaaagcgggacctcagaaagggcaggaggaggcagcaggctccagtcgcccaaggccacggggacactgtgctttttatcccaagggcaacagggaaccatggaagggcttgaagcagaaagggcgatcagcttgccttccagaagatgtccctgggaggacaggtgtggggggacagtccaggaaccccatgaggaggctggagagtggtgctacaagagatggcagagagaggacagaatctccagggggctagaaggatgactcctgcacagggcaggggaggacaggaggctcccatcctcaaggccgctgctgcattcccacatcttgaggcccaaggagtcacccttttgaacagtgggttggctgggggtgggggtttccagacatggatccgaggtggaagagcgttccaggcaggggcaacagatgagcaagactcaagagctaggaggtttctgatcagggagggccccctgggctttaggtgggtggataggagagtgtgcagctgtgttggagggagtatgacagataccagtgatgaagaggggctgcagacaccaggaccctcggtgtggctggggcggactaggggtgtgcttcagagtccccagttctgggggtcagctccctcattcacccctccagatcccaaagagggcccaggctgacctctcccaactgtctgtgtgtctgtctgtcttccagggccctcagggaccccaggggccaattgggcctccaggagagatgggacccaaggtgagtgtgagagacccttattcgtcccatgatgctgctggggatgtatcagcccttcccttccctcctccccaggagcctctttctgccattccctgtcctggcccagggagatggtcatgtaccgtgtagttcagagaagggtggacgccctggcagagagggtagatccatcctggtggcataggttgaggagctggctcctagtccaggggcattgggtgggacacagaggtaccaggacccttgtgggggttggcattgcctctttgggcatcactggaagcatggatgcttcccaaccttgaccttgctgggactttgccccagcagaggtttgactgtccatccagcccccaagggtcatgcagcaaggaacttggaaggagcctcgcacacccctgccttatccagagggaaaaaccaagccccagggtttatgcaagggctgcagccatgcccacggtgataactcagggctgcttcccacccgcctcacgctggctaagctgtagagagaagggttagaatcacttggccctaaacacagcatccaatggcttcctcccccgtctttttgtgaatcatgaaattttcttccctctgcttgccaaagggctcctagtgtggtaaaccacacttgtggggcgggagaaggctctagaagcctctgggtagtcccaaagctcagccagcctgggcccacccccagccccctagttccagctccaagctccaagaagctacaagctgctcccacctctgcatctcttgcactgtgtgaccctgggtgttctcttgccctcttggagcctcagttacccccttgcttacaaccagggggcagctcttgctctaggagggaccaatggcgttttctttcaggggccgcctggtgcagtgggagaaccgggccttcctggggaagccgggatgaaggtgaggtgggatgaaagaagagaaaaatgacttgttgaaaccagctcccagatggtggccacatcctctccatggaagagaaatgggcctttcttgtggctgggataatgggttctctgtgctcctggctggggagtggggcctggttagggccagagtggaatgtggagcccccaccagtgccctctgcgaggtaatgttttttcgggcacctgcccctgcctctatgctggggtggctgtacctcctggcctcatgcgataccatctgcagctcggtgccagtgcccttcattacctgctgagaaacaggtgcccattgatacatggactctggggagagccccctccccattctgctgttggaagaggacgctgttcccccttggaggccccagagctgatgagtgatgctggctagcccgtggacattgttgaggcagggcccaggggagcccgcagaggggctgtgagacttgagtccagtcacccccttccatgcctaagtctccctgtcattcaaagagggagttggaccaggccgggggctgccagacttggcctagtcccaaaatcccttgctcaaacaccaatgaagaaaaccaccccacgtagaaaactgatagaagtgggattgtttccactggagcagggctgggggctcagagctctgccctcctcctgtgcccctagacaccagcagggagcatagcttgaaaattcaccaatgaagaaaccaccccacgtagaaaactgatagaagtgggattgtttccactggagcagggctgggggctcagagctctgccctcctcctgtgcccctagacaccagcagggagcatagcttgaaaattctccaatgagaaagacccttttagggcctttatgcagggggcaggtgacatttattccggctcatttagggcttcctcctcgtttgggtttctcttcaagtctctcaaggaagaataaagtcacataattgccattgctgcatccaaggctcctggaaccagactgcccaggttcggatcatgaatctgtcactgaatagtctcacgagagcttgggctccttaccgaactcccccaatgcctctgatgcttcacctctaaaataatgcctttccttgcagggctgtcttgaaagtcagatatgttaatataaaaactgatgtcctcagcctgggcaacgtagtgagaccccatctctacaaaaaatttaaaaatctgccgggcatggtggcgcatgcctgtggtcccagctacttgagaggctaaggtgggaggatcacttgagcctgggagatcaaggctgcagtgagctgtgattaccccactgcactccagtctgggcgacagaatgagaccctgtttcaaaaaacaaacaaaaaaagtccttagaacagtacagaacagtacagttagttattaataggatgatggtgttggtgctaattgtcctcctgtcctggcgtgggagaagaagtccgtggacaaggcttacttggaacaggagctctggttggtgttttacgatttctctgtggtccctgggaagaaggaccttccccagctcctcctcccacaccccaaagtcagagctggtggaaacaggaaggggtgtcgagagctggggctggccctacccacccgcaaggacttttgttcggcttctcctagggtgaccttggacccctgggcactcctggggagcagggcctcattgggcaacgggtaagttgaagcaatttattcttcctgaaagcccccagggtgtgtgggtgccgcaggggaagagaccggcttttctcaatctccctaagcctcagtttcctcagttacagaaatagactatgaatgtctacagcctcgcccagtctctcttggtaggccagcatttccacagtgtagagaaaggcattttgtggtctgtagtcccagctactcggggggctgaggcaggagaatcgcttggacccaggagttggaggttgtggtgagccaagatcatgccactgcactccagcccgggtgacagaggaagactccatctcaaaaaaaaaaaaaaaaaaaaaagaagaagaaggatgttgaggttcagtcgagtctcggcagtaaagagaatgatgagcacgcatcctatgcccactgtgtgtcgagcacttttctcgaggcacaaggagcacagcagtgagtaacggaggcctgtctctggagcttgcattccagcgggttgataagtgatacctgccatgggtacaagaggagcatggaccacccaactggcacatcgttgccatcctgcacctgacggcccctgaggccctttccagctcagactctgaacagcgatgaattctaaaagcagagagagacccaaacttaatttgatggccatttcaagaactgttgtccaggggcgtctctagagctggaagggcaagcctggttgaggttcagccagggactctgttcttgctgtcattcccgagcttgctgggaagaaaagtcgaaagactggcctccctttcctcatctgagaagtaggattccaccaaggagttccatgcaggcttactccagctccagtaatagtatctcacatggttgccaggtatggggcgcttacaccatgccttacagcaacccttgaagaaggtggtgtcagccccatttttcagataaaaaaacagatgccaatgagacctaagtagtttgcttgcggtcaaacagccagtgaatgagaaaccaagaagtagcattgacgtctggctgatgtcaaagcctgtctttaactactaggccactctgcagcccagccaaccagcctagagatgatgttcaggacaaatccatgacaagcaccttctaaattcgtgacctcatgtagcccccaccccacgtcaccctgcagagggagctgtcggtagcttgggggtctgctccccttttctggagagctgagggtgggcacctcaaccttcctgttcatttgctaactcagcccctggctaccatgcacccactgtgtgccagggcccccagggtcccactgcctggagatccatgggtcagggtcctgccccagggagggggaagagaggaaaagcacaccggggcctcctccccagtaacatctcctcctctttctccatcaccttttccagggagagccaggccttgagggtgacagtggccccatgggacctgatgggctgaaggtaagtgcccttttagggcagggcctggggaccccggcagggcattgctttcccatccaagacctaagtctcctcccagaaacactgtgttcccatagagatctgagatgacagctccagctcccattgacagcagcttggggaagggtcagcagtgtccagcagccacctcccaccctgccctctgcactacctgctcaggtgggaccagggccatcaccaccttccagtctttcctgctacccttcttaaaatatcagcttctcttggctaagggtgattcctgagcaccggcactacgccaggcccagagccagagtctttggtctctgttatcttccaaatattctagaaggtcaggaaaataataattaccaccaatgacttataagccacaatttagggaggactagtcacacacataccaggtacaacgctaagccctttaccagctggatccataggacaacggaagttctgtctttagatgaggaaactgagactcagagtggtgaagcaacttgcccaaggacacaccgctagcaactggcacatccaggacccaaatctgggcccgtttggctccaaagcctctgctcactctgctgtaccatgcacccattctaaaggcgaagaggctgaggctcagaggaaggcatagatacattcaggacctatggctatgagtgaggatccaaaattcaaacccacggctcacaggtgccaaagcctgctggcccaacttgaccctgctgctccctgagagactcctgtcagccacaaatgtcaggactctgaagagacaccttagctcacctgaattgcaggtgggcaggcgggcacctccctctgactctccagacccatctccaggccagtccctggcctccgtcttgggccccgctctgaccccacaggtgggctttccccgaggctggccggtcaccctgtgcaagtcagctccccagcccaggttcctaagggccatgccctctcgcccacctactctccaggtgacctcagagaagcagaccccttctctgaacctcagtttccccatccacaggcttccgcccaccctcgttaccccctccccacagtctcccagggtgccttggcgaccggcccctgctgactcctcacattttcttgcaagagcgagagcaccccctgtctgtcatctgcctgactcctctcccccaaccctgctgcatccaagcgtacagccgagtcccaagacccggagcatttgacagctgctccacaccctttgccagtgcctgctacactgggtggtgatgctgatgaaggtcatggctaaaatgctttgggcacttgccatgtgcccagtgccacccacccaaagggctttatgtgaattaacccatttaataattaatgttcccagcaactctcccaagcttgatacattaccatcctcactagacggatgaggaaactgaggcacgaagcagcagccttctcactccactctgggcggccacctttcttcttggaaagtccactgaggtgggcgggagggggtcttccagcctgggtgcctcatgcagtcttctgcctccaccttgcatggctttttggccctgacttcatcctcttcccctcccttcaaagccaattctacctgagtccttgtgctcaaatgcacagcatcttccctggtctttacatgaatcccaggagagacccattttcttaaggtgtttgtccaggaatcacccctcatggtgaaaactgcgtctcgaatatgcacagcacttcatagtttatagagtgcttttacacccgttatctcttcgctgatgtccagctgacagtgatgatggtggtggtgaccaataatagttagcttttatccagcattcacatgccagacacactgctaagctatttacatggtttatctctttcaatccttgcagtaatcctttgatcctgattttacaaacgaggaaacttgcccagggtcacacaactattcagtagcggtagcaagatttgaacttaggcagcataacccgagggttgagggaggcatcgtcccctgagcagagaatcttggaattagaaggagccagaaccccaggttcacacagcactgactcactcggtggtattagggagtctccacctgtctgcacttcagttgtcccatctgtaactgaagagggttaaggaaggtgacttgcaaggctcctctgagcactggcagatgtctgaggatttggggcatctctaggaacccccagagactgttctgcatgagattcacaaggacgcccaccccaggggtccagttagcccctggagtgtggtcttaggcagagcccaggtgagggccctttgttgaaaacccgactagccacctggaacaggctgtctgcctctgagaggagaacaggtggccaggacgacaagccagaaatggaatcccagagccagaggagtctgcaggagagttattcaggccagccccctgtcttcatgccaggctgtgcttagaagctgaggctcccagcaggaagggatccgggcacaactttgtgcccagatctgctctacattggcccacgcctcagctcggagtcttctgcctttatctgtgccatctctggaccgctccattggaaaatcttcccaactgaactagaaactgccccagcaactccctcacacccacctcctgccccagagctcaggcctcagcaggcccagcttgaagcaatgagcaatcatgagttgctttcttgagcctctcttctaggcagggccaagccccaggctccagcttcatgccctctgcttcctgtgctctctctcctctggatgcacaccagtttatcagtgtccctcgtaaaccttggcactgggggacagaactggtaaagacacactatgcttttccaagcctgctcttctcgcccatcccttcctgatggacgccgcccctcagcagccatgcccgtgctgcactccacacctgctctgctcacggtgatgagggtgacagcccacgccccatcctggaatcctgcatgccccatcctggaaccccacctgcccccaatctctctcagagtacgcaaagattaccgtgatgagataaggcaagcttagagtgacactgattgcttcaaaaccataaaaagcccatgccagcctggtgcagtggctcacacctgtaatcccagcactttggaaggccaaagtgagtggatcatctgaggtcaggagttcgagaccagcctagccaacatggtgaaaccctgtctctactaaaaatacaaaaattagccaggcatggtggcgcgtgcctgcagtcccagctagttgggaggcgggggcacttgaacctgggaggtggaggttgcagtgagttgagatcatgccactgcactccagcctgggcaacagaatgagatccgtctaaaaaaaaaaaaaaaaagcccatgccaagggttgcctttccaaggaaataacctcaggtgccccaaaggtccgaagccccaagaagaccttggttacagccctatcactgtaaagaggatacgctcaggatcctgcttcaaagtccagctccaccgctagccagttgtgggcctctgggccagaccacttgatttagctctgcctcagtttcctcttctgtaaaatgggactaaaagcggaccagccttagaaagcttttgtggggattaagtcagttaatagatgttaaaggactcagactatggtcctgacatggttagtgctatataaatgttagctccatccactccccagagaaagtattctgcagccaataagaatgatcgccatgcagagcccagagcgataggagggcacgttcaccatagagcaaagcagtaactataacaaacaaagatggagaccagcagtccagtgggattgtgcctttagagcttagtttactgctgtccgattcattgccttgggagagttgcttcactgccctgagcctggtacataccatccaaactgttacctaccatttattattattattattattcactgtgtttttgtcatcgaggattgaaaatacaactcagaaaaatggaaagagtggttctgagaaggagaattgggtgaattttctttcttgatgaaaatttctttcagctagttgcagcagctcatacctgtaatcccagcactttgggaagctgaggtgggagaattgcttgagcccagcagttggagaccagcctggtcaatggtctccaactgctgggctcaagctctcttgtagcaagaccccatttctacaaaaaaagaaattttttttcaattagctgggcatggtggcatgtgcctgtagtcccagctacttgggaggctgaggcaggaggattgcttgagcccaggaggtcgaggctgcggtgacctataattgcgcctctgcactccagcctgggagagagtgagactctgtctaaaaaataaaaaaaaaaaatctgcttcataagactcttgttctcccaatgtgtctaagttggagagaaattgcccttgtctcctgtgaactccatggggtgggtgcagtcaggaccccggcttatctctgagtcactctgcccttcgcagcccaggcccaggcagggacacatgggagcctctacgtctgggatgcatccttgtgcaagcttagagctacactgggcttggcagccgagtcacagcaccctgcctttttggctgcagagggaactatcgagaatctagggaccagttggctgtggatgcctgaatggagccctgagatttggggcctctgatgcacttggcaactaacttattctctctctctctcccctcttcatgccctgccacccagggggacaggggagacccagggcctgatggagaacatggcgagaaaggccaggaagggctgatgggtgaggacgggccccccggcccccctggcgtcactggtgtccgggtgagtgtgcaggccccttgcagcgcctggagctctggggtaccctgaactctcatgcctgtgcaggcggctgggcgggagggcttttggtcgtgccactgaaggatcttctgctgtggtcctttctccacctggcagtttgccagagaaccaatctgctcaatgctccatggctctggagaacaacctcggttactcatcctcctggctgccctgccctgtgcaaacctggtccctgccgacctcatctcatccatcccccatatccagacacactaaacttttttcagtttcttggacaagctgtggcccttacccctgggcctttgcatgtgctctgtctaggacactctcccttcttcactcccctgtcacctgcttaagttctatttggccttcaggtatcaccatagacatcacctgctccaaaaagccattcctgcccccaggctgggccatgagccctcagggacatgcataaccttcagtgtatgtcttggctccatgaagaccaagaccttttctggccttcatttacgtctttaacagtgccttggccaggtgcggtggctcacgcctgtaatcccagcactttgggcagccaaggcgggtggatcacttgaggtcaggagttggagaccagcctggccaacatggtgaaaccccgtctctactaaaaatgtaaaattagtcaggcatggtggcgcatgcctatagtctcagttactcaggaggctgaggcaggagaatcacttgaacctgggaggcgggggttgcaatgagctgagattgcgccactgcactccagcctgggcaacagaacaagactttgtcacaaaaaaacaaacaaacaacaacaacaacaaaaccagtacctgacacataagaggtgaccaaagtctgtttgttgattgagaagacggaggaactctgctcttccaccctaacagaaatgtacttagtcagtccacagaccctcacgagcatcttccctgggccaggtcccctgagattgaagaggtaaatcagaaagcatccctgactttgagggacatagaagccagtagggaagggagcagaattctcctgtttcaacatgtacagacaagttgcccaatgctttctcgaaggttccctctttgataccgatagcaacccctgaggattgggaaaatcggagaggtaaaggaaacttcccaggctcacacagtgagaaatgacaaagctggaatttgaacttaggcctgcatgactctacgcatactgcccctgtgctctggcagagttggaatccagggcttggctgtggggctgtgaggatgagctggaggcaggtggaagcttgatttttgagtgtcgcaaatactggactgatgactcggaacttgacttggtagtggggggcagtggtagtcttgtacagttgagcagggtttgtgtgacccaggagtgctgggtcggttcagttgaactccttgggacccgtggattaggtggcctcgtagacaaaatgcccaaatgcacaggcctgctggcatctaccttgagccaaccaggtggtgagaactcatgcctctgctgccatcccagtctccctggggtgtcattttcactcttcatccctcaagcggagagactgacgttgttacctaggcaaagcagcccagtttgattcaggcctgctcttgacactgtttttcccccctgaagtgtttacatgactaacctaggacagatccaagttagcctgcaacaaactatggttgtgggaaaatatttgtttcctaaaaatagcactgaagtgccaatccccctaaacagctgcaacagaatgaactcaccaaactagagaagaatacgagggcgctgagtcagccaggaggcttcccccaggcttgactcagtggcgggcttgactcagcggcggggaagtaggccaaggggaatttagcaggagggtcccgggccaggattctgcattaggaacttggtctgcgacctttcacccgccccctgccctctctggttttgcccttggagggtttggaaggaatgtgtgctaagattactttgagctccagcgttctagggacccttttttagtgagtgttgagtatcatggctgtggaatgggcaggaacacatggcagaaatagccttggaaccagagtcctgaggttgaacttgagtttctggctctagtaacccattctctgtgtgactttgggcaaatcactgcccctctctgagccttggttttcttatctataaagaataaataaaacttagggtaggaaagcactttataaaatgcaccagaaatatagaagattgtctttataaatttagaggagaaagtgactagaggctggtggtggctggtggtgatggtgagtggatggtgtgggtgggggcagcagcaatggtagtggtggtaatgacgataataatgatggtgatggtggtagtactgatgatggtgttggtggtggtgatgatgatgaagatgatgggggtgttgatggtggtagtggtggtagtggtgactgtgatgaggtggtgatggtggtgctggtgctggtggcgatggtgatagtggagtggaggtgagggtgatgatggtgctggtggcgatggtggtggtgatagtgatagtggtaatgataatgatgatgatggggcactgatgatggtggtggtgatggtggtggtgataatggtggtggtggtactaatgatagtggtagtggtggtgatgatgggtggtagtgatggtagtagtgatggcaggggagtgatgatggtggtcatggcagtggtgggggtgggagtggtgatgatgatgatatggtggtatggcgtaggtagtggtgatgatgatggtgatgatgatgatagtagtggtgtggtggtggtagctgtgttaatgtcaatattttgccatcactcccatttctcatatgccgggattggaaggagagtcacttgggccagacgaagtgtgtgccaagtgataaggcagtgaggggccttacttgagtctctttggcatcaggataaatacctcccactctgtggcctggaaacagttgagtatttaaaaacagaattttatgagccatcggggcctttccagaaatgcatctatatggatggggcccagcagaaatattcattccggacccacagcctcacccactgtatgtatgctctcggctggagagggcacgtcccagcaagtggcaccctgtcccaggggagacgcagcctcccgtctccctgcccctgtaccggatgcttcagcactgactcatctcgccttctgcaagggatcagtcagccattgccgccacctcagtgcactggaaaatgccaccaatcactgtgacatggcttccccattgcctgaccaagaccagcctggaaggagaggtgccccagaagtggaggagctgcttgtcacttctgacctggctgggaggcccacagagggcttcctctcactgagcctcagttcctttagctccaaaacgggataaataatcccttcctccaaacactggcgagaattgaacaaacatttatgtggaatgagaacacagcacatggcccgtggtgagggttgtagggattgttggtgttttattaccggaggagctggagactttgagattgcctagtgcagtccgatagaaatgaaatacaagccatatacaagccactccttttaaattttctagtagccacctttaaaaacagcaaaaagaaacaggtaacttcaattttaagggccagtgcagtgactcatgctggtagtcccagcactttaggcagccaaggtgggaggattgtttgagcctaaaagtgcaagaccagcctgggcaacatagtgagaacttgtttctataacaattaaattaaattaaattaaaaagttagctgggcgtggtggtgcatgcctgtagtcttggctactcgggaggctgaggtgggaggatcacttgagtcccagaggttgaggcttcagtgagctgagattgagccactgtgttccagcctgggcaacagagagagaccttgtctcaaatttaaaaaggaattaattttaataatatagtttatttagcccaatatatccaaatattatcatttcaaaatataatcaatataaaaatcattaataagatatttagcactctttttgtagtaagtctttgaaatccagtgtatagtatattttcatagcatactcaattcagatgtgaattttcattggaaatacctgatccgtgtttagattttcattgtatataaaatttcattggaaatacttgatctgtatttagatttcataaaatttacagttgacaatgtaggttcatatacccaagttactccaaacaagttttgtagcaacctaattgggtgtgtcaacttttaatttttttttttttttcttttgagacacagtctcactctgtcgcccaggctggagtgcggtggtgctcactgcaatctccacctcccaggttcaagaaattctcatgcctcggcactcccaggtagctggattacaggcgtgcactaccatacctggctaatttttgtatttttagtagagacagcattttgccatgttggccaggctggtcttgagctcctggcctcaagtgatccacccacctcagcctcccaaagtgctgggattacaggcatgagccaccgtgtccagccttaaatttaattttaaattaattaaagttaaataatattaagaattcagttcctcagtcatagtagccagatttcaagtgttcggtagctgtatgtggctggaggccacggggctagtcccatactagaggtggggaaactaaggttcagagaaagagcaggatttgtccaggggtacatgtagactcaggcactgggttgcaggcagtctgtgctgaggtccttcccgggccactgttcctgcctttctgaggaccgcagggtggtctgactggtgcatctctttgggatagcgtcatcttttctggcatcatagttgatgccgcattagtctttagagcagacatttctcccttgtgctgaatcaaagccagccgccccataattttcatgcgctggccaccctagagaacatggctggccctgcctccagaacagctgcagaaatctgcagacaggaaccaagtcctctgggttggtccagatgtttccttgttcctctaggacctcctcttcctgtccctcttctatcacaattagtcagtgcctcttcttaaagtacaatacctattcccaaatgggacatcacctccttcattctacatctggtgcctctgttaatgcaaccagagggattacatcaaagcagctccttagtgcttaccaagagcatagacattctttctagatcctttgaggcttgcagtcaagaagtcctttccaggccagaaacgctgcctgccccactccctccatcctgacctagtatggcccaggattgattctctctcttctctttctctctgtgtctgtctcttactgtcacattcacacttgcacacactcactcacccttgctgtgcagtttctctgacaactgtggacacaaagctggatttgccctcccagggcagggcagggcagatcaggccggaggatctctttgggaagccctgtggggcaggggcagagtggcctgtcagagggaatggcctggggactccaaggaaagtgggagaaggcagctgacctttccagcacaattccctactgtgaggaggctcctccagcccagtccctgagagaggaggggcccgttcaagggacatgcccacaggaattgctcgcaagtgacgcacaacatctcagagatagggaagaacctataaatcctctcctgccacctcatgtcatcagtggggaccatgagccaggggtggtaagagccctgggcatggagccagaacagctgggattgattcagggcctgcaaggcgcagctgggaccctgggcaaaagtcactgtatctttgggaacttggctgcctcaactggaagcgggtctcattggggcctaatgttcaaggtcgttgggagggtggaacagcacttggcgctggagagagctcagtgcagagagttgctccctgtaggacacccctggatgcctaacagtaaccatgacaacagcaaagccagcaattgcagaagccgcacccgccatccacccctgcacccaggcctcactgtcagcacgttcttacatcgccaggtcgaatccctaagttctgtgacactgtccccacttcacagcagaggatgctgagcctgggaaattaggtcaggctcaaggtcatgtgggtactgggtggcagaatcagtttcgaacctggccatctgcctccagagccgacagtctgaccgccttgcggatccgcctcagtttcctctcttctctcatctttctcttgctctgtccctcctctctcttcagggtcctgaaggaaaatcagggaagcaaggcgagaagggccgcactggagccaaggtaggtgtccccttctgacttgataggcctgcgtccctcccccgcatcccttccccacatccctcccctccctggaccctccgtcctgttgggcctggtgacagcttgtctttcctcctgttgcagggtgccaagggctatcaaggacagctgggtgagatgggcgtccctggagaccctggaccccctggcactccaggccctaaagggtcccggggcagcctgggaccaacggtgaggactctctggctggggtgggggagtcagatgtggaatagagggaaccaagggcaggaaaggagacaccaggcttctctgtgctgttatcacccaccccagctattagctgaacacctggtgctcattgccccagccacctctctgaatcatgaatcgctttggtaacctgcagaaagctgcagccccgcctccggaacagtatacaccacacagaatacttcctgcaatttgaaggggtgtgtgggtcccctgaagccctctatggacccaaattaataagccttgttattagcatcgggggagaaaggaccagattcttagaactgtttttatcaaacaaggagatttcccactggaaatagattcaggaggaatggagtgatgctgctgcaggtccctggatgactctgagggtgtcccagcattgctgggctgctctgaaggaaggggcccagagggctttgatacctccaggagatgaagaccccagggggaagccagggaaggaggctgaagagggtgacacagcagctccgatctggttgtgtgtaaggttaagcaaccaggctggtttgtggtatttgccagtttctgcggtgtaaatgctccctccatgtctggtttcaagccactgacatgacgtcactgaatgcagagtggggaggagttacacggcagccctcccttaggcagtatttccaccaacacgcacagatgcaatagaccaaaataacctcatgagtgtaggtaggaggaaaatgtagtaaaatggctaggaggagatgagttttgagtatcctctatctttgtttttaataacattaatttaactgtaagtccataaaattgaattgttaataacggctctgtttcactggcttgtaaaagtcctgaaaatttagcaatcagctgtctcgaacccctggagccaggagaaggagggctggggcaggggtggggaactccagggaggagggataatgttactggctttccgccttgttcacacactttggttatgggcggcatggatgtgccaggctgctgggcggagcggggctggagcctgcagggagactgctgtgtccccgctgtgagagccacactccataccaacgagggtctcctcctcttgtagggtgctccgggacgcatgggggcccaaggagaaccgggactggctggttatgatgtaagcagatatcacctcaccccaccccccgactctgtcctgcaggcctggaaacacaggcccatgccagcctctgccccaccacctcccagctgaaggctgacccctggaatactgaagatgtggggtctcacctgccccagggagcgctgggcccagagccgtggttggggtggaggatcatggatgggacaggtgtggttggggctgccagagcgaaatgtgccaccccaagccttcttgggtatttcctgcccagggtgggcgctctgcatgccttgtctgctgtctggggaagggaccatttctgcatccaggttggcaccttcttagacatggctgagccaaacccatgttacacatctggagaaaccagggctcagagagatatggtgcctactcagaaggggaaaccagggctcaggaggataaagagcatgcacgaggcctgaccacttcagtttggaggtgggatcctagccctggtccttgtggctctagatccagtgtctggaagaaatgcagcagggaagggaggaggaggagaggaaaagaggcgagacaagacctggaggggtgttgcgaggagcccacagtgggtgtccatacctgcaggcctagccaaagcctgggaaggtctgttgaggcaagcattttgcccctgtccctggttctggctgggagaacaaagctggttctcccgagtcacccttccaggtctgctccagggtggggcccccaaccatcccagctggaacacccctttggggtgtgtctgggaccagcacggcacatctggaaggccagggcccagacaggcacagacttactcagagccacacagccagctggggcagagctgggacccagttttgcagcccagtatccccatcttggagtccatgtcctttgtccttcctgagtcctcattctcacttccctccttcttgtttgcctgcagggacacaaaggcattgtgggaccccttggacctcctggaccaaaaggcgaaaaggtgggtgtttgctctggggaaagcagctgcaccctcgtgtctgaggctgaggtcagcttcagggccagcaggagaaagcccctggggtacccatggctggagaagcctgtgggggctcaccccctgcagcagccgaggctggtgtcactgccactgtgcccagcccgcaggagctgtcagatccacattcagcactatgtgctgggtatcatctttgtacccagcgctggaacgaaaacatgcaatccctgccctcacggggcttatagtcaagaagcagaaatggacatcaatcttgtaatgactaaaactgcgactccatcatctgtgtggacatgggaattgaagtcttgcccatgaataagatcacccagtgaagagtggggagaggatgctgagcaggagaggcttgggacagagagcaaggaaccccagtggttagtggtcaaggaaggagccaccaaggcagaggggaaggcatgttcattccccacgccttggctcaagattcagtagaggagaggaattgctggaaggatcctcgctgatccctggaccctgcccccccatgccagtggggatgtggagggccaggagtgccagaaggtccaaggtgttggtgtggtgtcacgtccaaggcaatcccaaactggccccagaacccacgtgtctaagtcctaccttcgtcgcctgagtccctcctgtctttcctcctcctcccctcccctgctggctcagctggaacgcttcgcttgccccctgcctccccagcacgcctttcttttgctgagtcagctccccactaactaaatcctgctgttggtgactcacgctggcccggcgtgctgcccagccgaccccttcctcctgctggaggaggacagctcagccatggtagacggccacccgccccagccgattccacaggaagccacagaaggtgccactcagtaccccgggtccctcctgggccctcgcagcctgccagggctggcacagaaggggttaacacagactctgaaacaaggaggccctggtgtgccccaaggcctctgcgccggagcatctgcagctctagaagcagtctctgtggctgctgagaatgggaccctaacaccaaatctgccctaaggctgcaggggccttgtgggggtccccaggattccctgagccttgagtgcctcatcaagtggtggggtccttgggaatgagaggtcaaggtgggggcagaacatgttcatcagccagatgccttttctcacttagaaggcattattagattcgttcattcctccagctctccaacaggtacttatggaggatttagtgtgttccaggccctgagctagaggatggaaatgatgcccttagaggtctcaaaaatagggcgagtcccatgaatgaacagccaccccgcaagctggacggtgctagggaggagagagcagcttcctggggtgacccattgagcacacgcccacgtgcagagttctttccctgccattcctcctgtaatcttcaccacagccccagtgcagaggtaccattgttctacaagacaggcggggaaactgagtccccataaggctcagagactagcccaggatctgtagtaagagggtggcagggccaggatttagaccccatctgtccgatgccagaccctgcttccctaaccaaaagcagacccaagataaggaagccatatgcaatttaacttgaaccgcccatccctgctcaccgtgggggtgagctcactacaaagctggtggccagagagaggggatgagactctgggacttggacagggcagggaagtatcctaccagatttctggtgctaaaaaatgatatacctaatgctaaatgacgagttaatgggtgcagcacagcaacatggcacatgtatacatatgtaacaaacctgcacgttgtgcacatgtaccctaaaacttaaagtataataataatagaattaaaaaaaaatgcatccccagactacagtcacattgcgggggatcagtatagctggctttgggccgagattgccccctgattcctgagtggccttggctaagaccttccttcctctcagtttcccatctttaagtgtggacagtagtcccagcggcatagttactgtgcagatcggatgaaacaaacctcacagagtgcctggcacatggaacacgctaggtagacacaggcaggccccttccccaaagccgtcaagtccagctgcctctatccacagtgggacttgagcactggatccaagaaccatagagagtgggcagggtcaagaaggaatccccgctccttgggccacccctctagacctcaggccaagtccctgccagccttcagcctccacccaccagaaccacagaggcccaggctggtggctgatcaccaccagcctttagaactgcctcccaccagggatgtgtcccagccccagggacgctttgcctctgtccagcctcttccggccccctttcaatccctatgaacaaaggggctcaggggtgcctggcttgagccctgtgcccaggggagtgacaccagtttctggggctggagtcttctgagccctgagattctgccatttgccgttccgcttacaccttccttgtagttgaaaggtggcgtctacacctgtcctgtgggtggaccagggcctggggtggccatggcataaggacctcacctctaaactctgttccgccccccccaccccagtctctggccatgtctatatgacacagtctcactgctgctattgttaccggctacggcaattttaacgccatctgctgagcccctgccacgtgtgcagcagcctgctgagtgcttcctgtgcctttcctcaccgagtcccctgaacagcaccgggaggcgctccagtcccgctctgcacataggaacctgtcttatggacacagcccccatgctgactggctgccaagtgccacctggggctaccatggagggtaggaggttcatcctaaagctggttcctcccagcaaggatcggagacagggactctcgggttgagggtgaaaactctgagcaggtcccatcatctctccgagcctcatctgtgaattgggataataatcgcatctgcttcacagcactgcactgcggatgtcatgagtctgcctgtgactggcccagagcagtgcccatgcgtgccagctgctggagttggtgttactccctgccgggcgtcgcgcatcattccacggagtcctcaccactccttgatgggcatcacatgctgtccccttcaccccaccccactccgctctgttctcctattccccagcagaggagagagctccgagacaggaagggaagtgttgcaggccacacggctggtcctttgcaagccgggatgtgaatccagctgtctgagctccctgacttcctgcaggatcctacagctcaagggcgtctggagggcacaaagcactgttctgtgttccacagtcctggttccacaccagcctgagtctggctcagacacacctacccttccctctctagtttgtgtccccatctgtaaccctaagcaggctagaattcatctctgacgaagcgctttccgtctggaattccccacattccccaggagcaggcggtttgccctaaagctggttctgtgtccacagggggagcagggcgaggacggcaaggctgaggggccccctgggccacctggagatcgggtaagccccctccctcccctggaccatgtggcgtcctaggtggaatctgagcctcccgctgcatggagaggggtgggccgatcaggggccaggtccctgagagctccgcagaggtcgcggccaacagggcccagggctggcatccttggcacctggtggcccaaattttgctgttgtctttgtcattcagggccctgtgggtgatcgaggagaccgcggggaaccgggagaccctgggtaccctgtaagtatcagagctcctacctgctggcaggatcgggcatgtcagggagaggggggatgacacatgtctagaaagaacaagaacttcccaggcttctgtgctgcctcccagccctctgcaggatgggcccccctcacctgtctctctttggcttccagggacaggagggtgtgcaaggcctccgtggaaagccaggccagcagggccaacccgtgagtggtgcttcgtgtcccatccctgcctcccaccctgagtggggcggagcagtgggaattaaagaactaggccctttaaagcttaaagggaccctccctgcaggagggtctggggcagccatttctgtttctcctgccctgaccctggggatgcccccagaacctgcacccccaaacccctccccacccctccccctccaggcggagactggccaccctccccgggagagaatcctggggctgccttgcgtcatctcaccttggtttgcaggggcatccgggaccccgggggtggccgggacccaaaggatcgaaaggcgcagaggtaagagggccgggggttcagcagggagactgagtcccaggaagggggaagcctgacccacagtcacacagcaaaccaaacgcaggctgcagaggctgcgaggcagggtagggaggggcggcccaccaggagcccggcaggctgcttctggccatgaccccatctcccttcaaatagcctgagtgaggagggacaatcagccccatttcactggggctccaggaggggagccaactgcctgaggccaaccagagtgacttgaacccagggctcaccacactgtagagagaaaactgggagaagtcaattgagggggtctggaggaagaggaggcagagacagggtgcttgagcaggagccacttcctgcctctgccccagggcccctgccttcccccagcccccagactgggccagtgctctcttaatgctctttccctcccccgggtgcgcccccctcacctgcctgcctcggtgatacctagtctctaaaagatccagtggaactgtggcctctggctcctcccagaaaattgtcaatgccagtgaggggacaccaaggcccagagcaggctcagtgacagccccaggaggttccaaggccagctctggccccaggcttccaggccagagtgcttgggtacatctgtggcatcagatgttcacccaggggcccacaatcctctcagtccctccttccagagcccctagggtcccacacctctaccaggcagcctccatcatgtggcccttgatttttcagggaccaaagggaaagcaaggcaaggcaggggccccaggccggaggggggtccaggtgagtgactacagctgctgtttccagccaacctccctgcccgccccccacacccgccctcctcccactccctgcaccaaatgccctcaccagctttttatgtaccccccagggcctgcaggggctgccagggccccggggcgtggtggggagacagggcctcgagggcatcgctggaccagatgggcttcctggcagggacgggcaagcaggacagcaggtgagcgggaattggcattaacagatggtggctccatttgggaccaggtgtaggggaacttccccaggccatgggccagaggagcccgtttggaaacttggatgggcagaaccaacacatccagaagttctctggggtgggcaaccatctcctcccctggcacctgggagtgtggaccttctgactgtctctcctggatgccagcacccagaaagaccttcctttcctcccctgcctggtggatagggttcctctcccgccccttcctcactcagaatcccgcccttccccactcacaatcctcagctcctcctgtcctcctggtccagccacatcacacacaggccgtctgacctccatcctggagtgtgaccccttcctccagcttcacccagggtttgcccaggcgttgagccatctgcttccttggctgtatcgtgaaacacaagagaccctcctctgcctgctttcttaacagggggagcagggagacgatggggaccctggccccatgggccctgctgggaagagaggaaatccaggtgtggccggcttacctggagcacagggacccccaggattcaaggtcagatacctcttaatacacttacccaccctctgccctttctgccttgatgcagactctagtggttccgaccctttgggcacccatgtcccagggcctgtgtgaaaatggagtccacattgttgacctttctccgtcagcagtgcttgggggtcctgccccaagcttgaaccagaatgatagttcatctggggagctgtaaatatcgcccctaccaggcccttgaaaccttcaactggtttttgagttgtccacgggcgccctctcgtggacatttgtggaacaacacgttgcttgcagccgggatccccaaggcatccttagaaagcttcccagtgccgcgtgggaggagggggcccccatgaatccgtcagagccaagggctggacactgaaggggagatgtagatgaatgactcagatgtggttcttgccctctctgagctcgaggtttaattgggggaaagattggaaccctctgagacacaggaggcggagggagcgatggccttgacccagggaagatgtgaatgagaatagaaggggaaaaggtggccacacagtggctcacacctgtaatcccagcattttggaggctgaggctggcgaatcacttgaggtcaggagttcgagaccagcccggccaacatggggaaaccccgtctctactaaaaatacaaaaattagctgggcatggtggcaggcacctgtagtcccagccactcgggaggccgaggcaggagaatcgcttgaattggggaggcagaggttgcagtgagttgagatcgcaccactgcactccagcctgggcggcagagcgagactctgtctaaaaaaataaaaataaataaataaatggggaggaggcattctacgagtgtgagctgaggtttgaaggagggaactgcatgctgttggggaaaagcaataaggaggagaggaattgtgggagaggagaggggaaggcagggcccggaatgcgagaggagagacagagaccttcctctttgggaggtgaaagtcttgtcacccctaccccaccaggcctccatttgttgccccagcattctgcaatctcgggtaccctgtggaatcactgttctggctctcccaggccccctccgcctcctcctgccttagaaccccttcccactttgactggtaattttttgtgtgtttctttaagggtgagagtgggttacccggacagctgggtccccctggcaagcgaggaacagagggcagaacggggctccctggaaaccagggggagcctgggtccaaaggccagccggtgagtgagcgccaaagaatacacatgcccacgcactcacacatgcacacactcacatacacctacatgtacaaacacatgcacactcatacacacacacaaacacactgacccagaagccacctccttgctctgtgacaaggtataaaatctgggtaccagataccattctgccacccctcaaccaggtggtgggggaggctgaggaaagagacctgagtggttccttcagaatgaggagagggtgatcacaaccagaaggtgggcgctcctgactcccagtccagtgctcattctgtgcctcactgccttcatccccctgtcccagaggctgcattcaactcacccttgcctggaaaaagaaggaagaatgaacagagaataaacagggcaaatagaaaacacacaacaaacagtttcaataccccaattaaagctgagattgtcagagtggatgaaaaagcaagacccaactacatctgctgctacaagaaatccacttcaaatataaagatataagtaggttaaagatagatatagaaaaagacatactgtgctaacattcatcccaaacagctggagtagctattttaatatcagatgaaatgaatttcagagcaaagactactaacagtcataaagaaggtattttcataatgacaaagaagccaacttttcaaaatagcataagaatcataaatgtttatgcacctaaaaatagatcttcaaaataatcaggcaaagactgataaagctacaaggagaaatagacaaattcacaattatactcaaggatttcaatatatttctctcctaatgggtagaacagaagcaaacagaagatcagtaaggatgtcttgaactgcattatcaaccaacatgacctaattgacatttatagaacaccacatccaatatcagcaagatacacattcgttataagttcattcagaacatttaccaagacagacactattttgagccttaaaatcaatcaataaattaaattataaatcaataacagagagatctgaaagatctccaaacatctggaaactaagtaacaaatgtctaaatgacccatgggtcaaagaagagaccaaaagagatgttagtattttgaattgaatgaaagtaaaaaacagcatataaaaattggtgaaatgctgttgatatatagggagatctttatagtaataacttctgtgttagaaaagaagacaggtctcaaataaatggtctcggattccgtcttaagaaactgggggttggggctggagaaggcaaatttaaaacaaagtgagcagagggaaggaaataatgaaaatcaaaaataaaccaaaaaaaaaaaaaggaaaatcaaaagttagctttttgagatctgtaaaactgataaacctcttgccagactaatcaggaaacaacaaaaacaacaaaaaggatacagaagttactagtatcagggataggggagcaatgtcactacagatatgacagaaattaaaaggctaataagggaatattataaatgattttatgacaataaatttaaagacttagatgaaatggacaaattccttgaaagacaaaactaccaaaggtcatcaagaagagactgataacctaaatagccttatatctattaaagaaattgaatctgtagttagagcttcccacaaaggaaactctgggcccagatggcttcactggtaaatgctactaaacatttacaaaagaaataataacggctgggcgcggtggcttacgcctgtaatcccaacactttgggaggccgaggtgggtggatcacgaggtcaagagtttgagaccagcctggccaaaatggtgaaaccccatctctactaacaatacaaaaaaaaaaaaaaaattagccaggcgtggtggcgcacacctgtaatcccagctactcaggaggctgaggcaggagaatcgcttgaacctgggaggcggaggttgcagtgagccaagatcgtgccattgcactccagcctgggcgacagggagagactctgtctcaaaaaaaaaaaaaaaaaaaaaagaaggaataccaattctacataacttttccagaacattgaagaggagaagaataattcccaactctttccttgaggctgattctaccctgatgtcaaagccacaccaagatattacaagaaaaggaaacaatacaccaatatgcttcataaatatagctaccacagttctcaataaaattttagttagaggaacctaagaatatataataaggataatacatcaagaccaagtggagtttatcttaggaacacaaggatggtataacatttgaaaataaatcagtataattcactatattaacagactcaaaaaagaaaacccatttgatcatctcagtagttgcaggaaaagcatttgagaaaaatctaactccacttctgataaactctcaacaaactaggtatagaagttcctcaacttgataaaggacatccatgaaaaacctagtcaacatcatacttagtagtgattgactgaatgcttttttccaaggagcagagcagaaacaagtcaaggatatctgttctcaccacttctattcaacattgtactggcaattctagccagtgcaataaggcaagaaaaacaaataggaggtattcatatcaaaaaggaagaattaaaacttttcatttgtagaggaaataatgtctatgtagaagatccattggcatccacaagaaagctactagaataagtgagtttaacaaggtcacaagacaccatatcaatatgcacaaatgaattgtgattgtatatactaggcaatatgcataaatgaattgcatttctatacactaatcaatgagcacaaatgaattgcatttctatacactaatcaatgtgcacaaatgaattgcatttctatacactagcaacaaacaattagaaatggaaatctaaaaagcaatactacttataatagcataaaaacatgaaatacttagagatacatctgacattaagtgtgcaacatatgtacactgagaactatagaacactggtaagagaaattgaggaagacttaaataaatggagatatatactgtgtgcatatttcaaaagactcaatattaagatgtcaaatttcttcaaattggtgtattgattcaacacaattccaatgtaaagcttatcgggttttcatgtagaaaatgacaagttggtcctaatatacatatgaaatataaaggacttagaataactaaaacaacattgaaagagaagagcaaagttggcagactaatggcacttgatttcaagacttattacaaatctgcagtcatcacgaaactgtggtattgccgtaaataactaacagatcaaaggaacagaatgaaaggtccagacatataccatacatatacggacaactggtttttttttgtttttttgttttttttgagatggagtttcactcttgttgcccaggctggagtgcaatggtgcaatctcagctcaccgcaacctccgcctccaggattcaagtgattctcctgcttcagcctccccagtagctgggatgcaccacgatgcccggctaattttgtatttttagtagagatggggtttctctatgttggtcaggctggtcttgaattcccaacctcaggtgatccaccacctcggcctcccaaagtgctgggattacaggcatcagccaccacacccggcctggacaactgatttttaacaaaagtgcaaagacgattcagcaaatacaaaatagtctttcctaacaaatggtgccagacaagtgatgcctcataacatgtacaaaaattagctcaacctggatcatacacctaaatgtaaaactgaaaattaaaacacttctagaacatagaaggacatcttcaagaacttggataagacaaagatttcttagatatggtaccaaaagcatgacccagaaaagaaaatgtgataaatcagacttcatcaacatttaaaacttttgctcttcaaaggacactattaagagaatgaaaagacaagccacatactggaagaaaatatttctaaatcatgtatctgattaaggatttgtatccggaacctaaaaagaactcgcaaaactcaataataaaaataagcagcccaatttttttaaatgggcagaagatttgaatagacacttcaaagaaagtatactgatagcaaataagcacatgagaaaaagattaatatcattagtcattagacaaatgctcattcaaaccacaataagatgctatggcatacctattaaaatagtgaagagttttaaaagactaaccataccaagtgttggcaaagacatggggaaactgaaactttcaaatgctgataatgggaatttaaagtggtacaatcactatggaatcagttgggcagcttctttgaaagttaagcatatccctattgtataatcaaatcattccactcatagatatttaccctacataaataaggacattcagccacatgaagactatacttgaaggtgcttagcagctttatttataatagccccaaattgaaaaaaacctcaaatgtgtatcagccggtgaatagataaagtgtggtatattttgcaatgaaatacaattcatcagtaaatggattgaactattaatatatgcaacaacataagatgattctcaaaataattaggctgagtgaaagaactcagataaaaaatagtatagactgtgtgatttcatttatataaaattatagaaaatgcaaactaatctgcattgaaagaagatagatcaatggctcctggagatgggagggtaggcaggaaagaaagattacaaaagggtgtgaggaaagtttctggggctatgggatgttattgtcttggttgttgtgacaattacaagggtgaatacagacagatatgtcaaaacaaatcagattatacaatttaaatagtatagttattatcttcagttttactttagtaagactgtttttaaaattaccccttctttgcacctgatgggtgtataggagacagccatcagagtgcaaaaatgaacagttaggacatcacgcaactggttctgtgaagccagtattatcctgataccccaaccagaaaaagatgtcacaagaaagaaatcaacagacaaatatgccttatgaatacagatacaaaaatctttaataaaatattagaaaaccaaattcagcaatatgcctaaaggagtctacaccatgacaaagtgagatttatcctagaaatgcaaagctggttcaactgttggaaatcaatcaatgtaatacaccatattaataaaataaaggacaaacattatagagtcatctcaatagatgcagaaaaagcatttgacgaaatccaacaccctttcgtgatgaaaacacaacaaactaggaacagaagggaacatcctcaacctgatagagaatatctgtgaaaatcccacaggtatcatcatatttaatggtagaggactgaacacttcccccaagatcaggagcaagccaaggatgtccactgttaccacttctattcaatattatactgaacaaaattagtagaactaataaaccaaagttgcaggatataagatcaatatacaaaaaatgtcatttctatatataacatacaaacatcaattatatgtctatacactagcaatgaacaattcaaaaatgaaattaataagacatttccatttataatagcatcaaagagaataaaataggaagaaatctaacaaaagaagtgcaagaagctgggcatggtggcatgtgcctatagtcctagctactcaggaggctgaaatgggagaatctcttgagcccaggagttcaagtccagcctgggcaacatctcaagaccccatcttaaaaaaaaaaaaaaaagtacaagatatgttcagtgaaaatttcaaaatgttgatgaaataaaagaaaacctaaataaatggaaagacatctcatattcataggtcagaagactttgtgtggttaagatggctatacttaccacaaacagagctacagattaaatataatccctatcaaaatccaagctgactttttaacgaaatctgacaaattgatcctaaaattcatatggaaatgcaagtggcccagaatagccaaaattttgatctttaaagaagatcaaagttggacaactcacacttcccaatttcaaaacttattacaaaagtatagtaatcaagacagaaataaaaccttacatttatgtctgttgtttttagcaagagtgctagggcaattgaatgggaaaagaattttttttcaataaacagtgctgagacaatcacacaatcacatatcacgtaccagagaagtaatttggacctctgcttcacaccacatgcaaaaattagctaaaaatgaagtatagaccaatgtaaaggctaaaactgtacaactgttagaaaacataaaaacacatttttataaccttgtgttaggtaatagtttcttagatatgacaccaacaaaagcgaagtacatagattggacttcatcaaaatcaaacacttttgtgcttccaaaggcaccatcaagaaagtgaaaaaactcacagtaggggagaaagtatttacgaatcatatctctgataaggaacatgtatctctaatatataaagaacccttacaactcaagaataaaaagacaatccaaatttaaaacggacaaagtattcaagtagacattttttccaaaggagatacacaaatatccaataagcattgataagacaaatgaaaaccaccaagagaaccaccaatagctcaataaagctattatcttttaaaaatgaacaggtagaatttagattaaatgggaccctcccgaagcctgacccctcagcctacctccatcagcactgggtcttgacctgcctggtctcattgcatccttccagccccttgggagggagatgacgtattatcctattttacagatgaggaaactgaggctcagtaaagggaggtgacttgctcctggtcttataatataaggctaggagattctaatacatggctttctgcttatgagcttgaaggccaagccccaagaatgtgtaataatggcaggctcttctgcctccaggggcccccagccctcccttcttggctcagaccccagcatgcccccttgccaattgctctcctaaccctttacaagattgggagcagaggtcaggaaaggaggccaaaggttcctggaatcgttcacactgggtttgaatctagcacagtccacaacatggtgtctgcgtgacttttagcaagttcctgccctctctgagcctgtttcctcatctgtaaacaggggatatggtgtgtccctgggttgatgtgggagcatggaagtgtggcggtccaggcaaaacatccggcacctaacaggccctcagtgaactgggttatttttagtttttaggggaatccttccttaacagagcttttcagagctgtgggaggaggctgcaggcccttttattctgtcccttgaagacctgggacaggagctcctgagtgtggcagagcctcctctgtggaatccctgagccgggctcctctttctcatctgacggagagcacaggctcccctcagagcccaggcggactggcatctagtttgtgagctgttcacactcacttggtcgcttcacagaggagtcactgatatccctggaaaggctgggagggaaaaggcaggccctgaggtcccaggtggctggcgggacacgctgaccatgagctcactcgctccatcacttcctgttcttcctgcagggcgactctggcgagatgggcttcccaggaatggcaggtctcttcggacccaaggtatggactcccacggctcactgttcctgtggggtcccatccattcaccccattcattcatttattcattcaacaaatatttatggagcactgaaaacattggctggaaaacagccagaatcaggcatgaacaccctcatcccccagtactccagaagatctaggttccaagcccagctacacaattacctgctctgtgccttgcaaagtcacttagtctctctaagccttggtttcctcatctgtaaaatgggagcaatgacagtagaagactgttgcaaaaataaagaccaggggcatatgccacacagcactgagccaacacactgctggtacctgctgaataattgtaggtgtttcttactccttctggggcctctcaggtaaggcctctcttgacaagaagggcaaaggttgacagaccccaggggtgagggagctgtgggggccctttacccagtggctgccaagtacagacagccctttctctgcctcccacagggcccgcctggagacattggcttcaaaggcatccagggccctcgggggccacctggcttgatggtgagttccctccctgctgtcggagcagagatgattgtcctaggcccaaggttggccagccatcagctggcctgtcttcatcctcctcttgctccttgactcatgagccctttctgcccacaggcctggttcccaccttcactcctgccgttcccaccagctcagcccccatccttccccgctttcactcttgcccccatcgccccactcttgaagtccacccctaggcacaaatgaggggctcaggagatgcatggcctgggcccgcttcagatggtctcccttctactcccttgcgacgctcgggctgccctccaccccgctccccgtgtctgttccccaggccctggaacaaggacacatgagcctttctgtctcctttagggaaaggaaggcatcgtcgggcccctcggaatcctgggaccttcgggactcccggtatgtgtggggattggacaggaagactccggggtccccttgccttcctggctccagattgtctctgtgactcagtgccagtctgagcctcagtttcctcatctggaaatggggcttcacctctgggccctgtctcactgggccgtggtttgttgcagggtccgaagggtgacaaaggcagccgtggggactgggtaagtggatgggctggggctgagggatgcagcactgcaggggcgggggaggggtgggctcccagagttgggccatggctcagccaggttccctaactctctcccctgcttctgtctccctccagggattgcaaggtccgagggtgagtgggctgggcatgagggctgtggggcggggcgtggggcgggcaccctgcattctcctcccggtggtacattctctccctccggacctccgtcatcccgtctgtgccagaggaaccattgtccctgggtcccaggtctgcttgaggagggactgggttggggagagatgaagaccctgtggaccagggctcactcttcttctcttgttcccccagggtcctcccggccccagagggcggcccggccccccggtaggtaactgagtgctgggtgcatcttggactcctggggggttcctttgaaggagattcaaggcttcaccggcagactaagccttgaccctgaaccccacaggggttcttgtagcccacagactcctaggagagtatagggcatcccccgaacattcacttttgcctacgtggggtaacacctaggggccaggcctccagaaaagcatagaccagcccactggggcccaccaagcctccgggaaagcagaggccagcttggcaggtcctgcatgctttgatggtctccctggtctcctgacaccctctcagattccagcacactgtccctgtcatttgactgacccgcagtcttcttttgcagggtcctccagggggtcctatccaattggtaagttggaaaccttctcttttgcctacttggggtaaggcctgaggggtttgggggaagaggctgctggccctctctggccctggtggctagagccctaagctgggtctagggacgcccatgtccttttgtcacttcatactggagacttggacccggaagcaacagaacgagccctgggccaggaggcaggaaacctaagtttttgagttgcctctgactgaatccgggaagatgctccagccaccgggttcatggccctatctgtgtactccatacacgtgggctgattgcaagggtctgtacatctcagattctgaatccaaagagagttggggccgggcgcagtggctcatgcctgtaatcccagcactttgggagttcgaggcgagcagatcacctgaggtcaggagttcgagaccaacctgaccaacatggtgaaaccctgtctctactaaaaatacttaagtagttgggtgtggtgggtggcacctgtaatcccagctacaggagaggttgaacccgggaggaggaggctgcagtgagccaagatcgagccactgcactccagcctgggaaacagaccaagactctgtctcaaaaagaaacaaaaaaaacaaaaaaaaaaaaaaacaaagagagtcgggccaggggggcagattggggcccctgcattcttccctattggccactgtggccctatctgagagcatgactcctcccaagccctatgacgagtccatccacattgtactattgcacggtggctacacgactattaccatcaggccccaacagcatcccagggcacagcctcgaggaaagactgaatgggccaggagcccttgagccatgcgtcattcagaacctctgctctcctcatgcctgctctcactgccactccctctgcaccatcctcaaagacagagtgacagccctggcctctcctctgcagccttcccttgtccttctcatcagtaagaaaggcagggaaaggaaagtgaaaagatccaggaaaaacagaaaattagaggattttgcatttttttgaataatcactactaatgctaattgagtgcttgctcaatgccagacaccattacaggtgctttgcttttctttttttttcttttcttttttttttttttgagacacagtcttgctctgtctcccaggctggagtgcagtggcacgatctcatctcactgcaacctcctcctcccaggttcaagcaattctcctgcctcagcctcctgaatagctgggattataggcgcgaaccaccacgcacagctaatttttgtatttttagtagagatgggttttcaccatgttggccaggctggttttgaactcctgacctcaagccatacacccgcctcggcctcccaaagtgctgggattacaggggtgagccaccgtggccgggctacaggtgcttttcatgtattcactcatgtgttcctttcagcagttcttgtgaggaagttttattatcaggtccattttcaagatgaaagaactgagaaagagttaagcagctttccccagattatgcagttagtaagtggcaggtctggaatttgaccctgaggagtagccccagagtcccccgttctggaccccaggcctcagcttttgctgttttcatggcaagaccacggctatgtctctgccaagcccagtggtagggttgggagtgcaaagttatattagactattaaagtgcgagccaaaggagaaacacggggactgggggcatagagaaagggggcctccctcatcttagcctggagtcagaagcttcgggagaggcttcccatcacaactgacatctataggatgagtctagggcaggttttctgagacacagtgcaactgacatttgcataattctttgctgtgagtgactgtcctggaggatgtttagcagaattcctggcctctaaccaccagatacaagtagtaccccctcccccggcttgaacaactaaactgtctccagatattgccaaatatcccctggggggcattgtcgcctctccttgagaaccactggtataggagatagccagatggtgcattgaagggagggagaggtcctccaggcaatgagaacagcatgtgcaaaggccccatggccagatggatcatggcgtttaggaacttagaagtactatagtgcggctggtgccagagcacatatgagggagaggaaggagacatggctcaagaccacagtgttcaaactgggtcttataaccatgttgaggagtctgaacttaatcctgagggccatggggagctattagtacctggggaaagggaatggcagggtcagctttgactgtctgcaaagagaggaaggaccgagagttctgcagagggcatatgacttggccaagatcctgccagggaatgtggccctggggctcccacttgatgggtgtggagaaccctggggggccacgatacataccctgtcttttccttgcccagcaacaagatgatcttggggcagctttccagacgtggatggacaccagtggagcactcaggccagaggtatctccaggggctctccccatgtgggatcccttcctgggagaaacgcaaatagataatggcccacatgtggtcagtgccttccatgtggcctgcatggagcatttcagagtcctggtcttggtggcatctcgcatccacaaatgggggtttgtactgaaactcagaatgggcagtgagtccaaggtcccatggccagtgcaggcagagcaaggccagaaacaggccctgaacccttgagctttctccggaggcctctcagagtctccaagctcttgctggctggagtcagggggagaagcttgcctgggcccagagcccgcagcagcttcccagtgctcatccccacgtttcttcaggagtaagaagctcatggttagctcgtggggctctgctaagaacctgccctgtggttaactcagctgtaagactccaggctgagaagggagtcccatgtcctctagtccagcctcggtcaggagccccctttgcagccttgcctccttcacatgacagggaacttactgcccccagctcaaacctcctatgaacatttcggtttgttccctgtgctggatgctgagacagatggatggccagtcacagccttgactttcagagggctcacagtctagggtggaggacagcatggatgagccccttaccatctgtccggggaggtcagtggaaagagaggggaacactcaggatccagtgcggctggagaagggaagcgtttccttccatccctagaagccagtgatgccgcacaggagagcgctgacctgcaacatccttaacatgatgaaggaaagtggctccgtttatcaagcacctcctacccactctgcattggcggtagaatagaggcttatttctcgtgcacgtaaaagttaattggcttgttgatgagagaccttggctacctgccaggggctctgccctcttcctctcccacacgtggctcccaaggtcactccacaccagggggaggcaccaccggggaaagagagtgtagagaattgtgcaggagggtctctgggccaggcctctatggggctagcatcgctccacttccatcccgttggctagagcacaaataaggctgaagatgtagtctgtccaggcagaagaaatggattgggtgagcggctgctggtctctgacacacgttcacacatgcgtgcacacacacacgtgacctccgccacccccagtggaaggagggtttatttagctctgatttgtagctctggaagctgaggcttaagggagaattctggccagggtaaccctgaatggccggctgtttagcatctgtggtcccctcctgccccctagtggagatctgctccttctctgagctgaagtcctcctcccagcacttgtgcctgctggccccagtcccgtctcctggtgcctcacagagaccctggctcccaccctaggggagcccagtgggggctgtgtgacccccaagtcagctccccccagcacctccccttcctccacaggctctttgcagatagagattgggccgctgccgagtgtcccacgcaccctcgcctacctcattcacggggctctgcctgtcccatatcagagaacatggtctgaccctgagctcttttcaagcctctgagccattgtgatagcctctcctcctgcactttgtccctggcccgttttcttgtctgcaaaataaagagaaacccaacccgtgctctagccatgaccgtggaaccgagatacctcccaggttgtgagaactgggggctgtggaggcttgaaccccaggctggaccaggaccctaaggtcccaatgaccaccctctcctcgtgacagagttacagctatccagaccggctggtgctggaccagggaggagagatctttaaaaccttacactacctcagcaacctcatccagagcattaagacgcccctgggcaccaaagagaaccccgcccgggtctgcagggacctcatggactgtgagcagaagatggtggatggtgagaaggcttcctgccgggggtgggtgcgcctggcggtggggagctggggcaggtggagtatttgatttccgccgcattttggctgagtttttgtcctcagcaagacagatacactggcagtcatttattcactcagcagtcacagagcctcacaatataccaagatccgcatgctggggatgaccatttcagtgcaaagagacaagagctctggcagaaaaagctcctgaggctgtaagagtccccacccctggggcccatcctgtcacaggctcccgggtgagccaggattttccccctttctgagcatgaggactctgctctctcatctgtgagctgatgtggtgctgtgaaggacaagctgcggagccagacagacctgagttccaatgtcagttctgcctcagacttggtctgtgagctggggcaagccacggccccatcccgagctgcccttgcctcctctgcacaagcggctgggactagatggctggttgttccactcttgagctgcaaaggttttggcttcctgagaagcccagtggggaagctagatgtaagcagcagcgctggctgatggggtgggagacctgactcctaccctcccccggcaggccctaggaggagccctaggcctcgaagaatccattcaactaggtgatcccccaaacccttgtgcaagtgacccagcctctctcaatgtcagttgtcttctctgtaaaatggatacatcccagtagcaacataggcaagtacttagccatgtgacccctcctctgggggctctgccagttgtgagctctgcccagaaggtttccttccatctcggttggaggaatcccttttctgctcacccaccctgacttcatgctcacctggggctcggcaggtcacaagatgcagggtccatctacagaaccaaggaatgggctcatcccccagatacatacatcacctccatcccacgctgcctgcaggtacctactgggtggatccaaaccttggctgctcctctgacaccatcgaggtctcctgcaacttcactcatggtggacagacgtgtctcaagcccatcacggcctccaaggtacccatcagctcccacactgcccaccaggctgtctgcctctatccccagcctgccctgggccacaaccaacccaggttctgttctgagctgtgcctgtcttactgcatgcccttgggaaagttatcgcctccttccgagactcagtttccttatctataaattgggagtgagtaggactaatttgtaaccacaaaccctttcgagtcatatgatgctgatgattctttcttcaaatagaatcttctgcctaatatctaaagcagagcagttggccaagctggcctggcttgtggaactatgaatcatcagcatgaaataaaagagaaaactagcatgatgctcatctgaagcatgttgtgtgaattatgtatgcgaatacttaactcatgttcaatgcctgcgtaccacgtgcctgtttctgggttgagcattttaggtggtacagggccactcaacaacaaaccaaggcaggtggcagcatgagacctgacagctccctcgcccagggatcctcagtggattgtgggtctgtagttccactaagccttccgaatttgggggcaatttatgccacagtgagaagctgctccgactgcgggggaaaggaaccctcccatttcatcagccacatcccctaggagatgccttgtgctgactgggtcagactggcagtttgagaatctctaggagaggcagccagccagtagccaggtctttgttgggtccctatcatgtgccaggccctgagccaggacggggaggtcagactcgaaactcccctgcggccagagctcacagtccagcagggacttggtgacctccacaggctctcttccctggtgactcgaaggttttgggatcacgcagcaaacctgcctagcagaggggtgaggctggagttggcgcctgggttggtggcatgaatgcccaactgggtcaccttctccatcagaaacaatggcagggagaggccctggctctgtgtgggaaagtgctgaagccacaaatcctgccgtgttgtttgctctcaggtctgccatttccggcagcaccccatcgcacctcacagggatcttgggacttaggaagggtctcgaaaacacctctcatttcctctgcattccatgagcctcttagtcttgggcaaaaccctctccctcgctgagctcctggatcctagctcagcccaaagaccccccatacagtaagggagtggatcagatggcaccaagatctttgaagctctggctctggagtcaggcaggcccttcccacttacgcagccaagaacctgtaagaccagctcacgcagacctcagtttccccgtctatcaagtgggcacatgtctgggagcatatcaggaaatgcttgccaggaaggggcctatccctgttccctccatagagaggcagggaaccctcggtgtggggggtgtggggggcagcctgagccgctcactgccgttgcttctctataggtcgagtttgccatcagccgggtccagatgaatttcctgcacctgctaagctccgaggtgacccagcacatcaccatccactgccttaacatgaccgtgtggcaggagggcactgggcagaccccagccaagcaggccgtacgcttccgggcctggaatggacagatttttgaagctgggggtcagttccggcccgaggtgtccatggatggctgcaaggtaactctcagagcccctcctaggcccttcatgtggggacaactggaaaaacacttgtttggaaaaatgtgtttctattataagattatatctaacattttaatagtatactatattaatgtgatagatatgatttcatctttgtgtaatataacagttttctaaaatcgtttttactcactttcctctctgggaagctatgaggggaggtctgggctggtaaaaattctttgggctagtagatgttgtacttacttgcaaggctctttcaaagaagatacatttcttcttcctgctcccaccctagtcaggctaatttcttctcattatattttttggtcattttcaaatgtcctgaacagggtgggttgtcaggggaggggaagacagaaagttgagaaaaggcaaaaatcagttttataagactaaacaaaactaataatactacacagtgttcatgaggatgtggggaaaccaacaatctcgcatgaagctgttggaagaaaataaattggtagaggctttctggatagcagctctaatatatatccaaaaccttagaaatgtacttattttcaggggagctaagctatgaagacacaaaggcataagaatggtacaacggaatttgaggacttagggaaaagggtgggagaggggtgagaggtaaaagactacacattgggtaccgtgtacactaaagaacttattcatgtacccaaaccccacctgttccccaaaaacttattgaaaaaataaattaaaaaatatatatatatgtatatgagatgtacttgttttttggtctagcaatctagaacaatccttctagaatttgttctagggaaataagaatgcacacaaaggtttagttacagtgatgttcatgacagcattccttacaagaataaaaagagtggaagcaatctaaatgtgccatataggtcattgctacaatgaaatacagtatagccattaaaaattgtgaggaaagatggaagggaaaatgctcatgatgtatgataagaatcacgatggatgtacgtgtgcacttttccttctgccttcaggtccaagatggccgctggcatcagacactcttcaccttccggacccaagacccccaacagctgcccatcatcagtgtggacaacctccctcctgcctcatcagggaagcagtaccgcctggaagttggacctgcgtgcttcctctga

SEQ ID NO: 1484 - DNA, 10668 bp, Homo sapiens
acacttctcagcagaggattttattggtggtcacctgtggcacaggttagaggagccgaagtgctgtgtttgtggtgggggggggaccacaaaccccggccctgccctcttgcttacataggcttcccgcctagaagcgcagccagaacatgccgctacggatccggttgtagtctgggagctgctcaatggggcctgtggggatagggtggagcgtcagggtggggtacctggcctgcacagggacacctggccctgtgccgcacccagctcggagatgctgcccagagcagcacaagacaggctttgagtggaaagagaggagagaacattcccccaggggtgctgagcctgtcccttcatgttctggcccttgaagccccaccccacatggaggtgcccgttacctgacgggtgcagggtattgatgaaggcaccttggcaggcagtcaaggaactgctgggacaggttttctgagcaagaactccctggcagccaggggactggggagagctgcttggggccttaactggctgctctgtaagctgagcagcagtgcgggagcagaggtggaaggggaggccaagagaacggcctgaggaaataaacaaagagcagaccccctaggccacttaccatatccagccactgctgggcactggtcatagatgtacttggagcagatctcacgtaccacactggcatccacctcctgcagggtgaggcagagggcatactggctaacgggcacctggccaccacctcagccagtcagcatcatccaactagcagagatctcccacaggcagcatgcagctgtccccagcccaaaagaggaaaggcagaagggatccctgctatagacctccatgggccccgcccatctccacagccatcagcacctatgccctgccctcccactatgctacccctgcaggtgacagctgcctaggacaccagggatgcctataggagcaggctgcgctatgccaggccccaaccctacacctcccaggtgtctgccaggccaagactccagaacctctcccaggggtccatgttaccgcaatccggctttcccattcagccagggggatgcggcggccataggtcaggaggctgcgtccgatgtcctcacacacaggagtagtgcctttaagggtgagagaaggctcagaggtccacccagcccaatcctggacccacaggtacacaaacaatctccagcctcaggttgacaaggacctccctgacctcatgctgactcagatcacagccctctcttctatggtcacctattatggcagtgatgggctgtggacctgtctcacacctgcctgcatctccaagggtggggtgatggggcatggcgtggtcttcaaagttttcctttctaaccttggttagttaggagcagtggccaccttggtgctgtcgctggcaagatgtactctacccctccccgctgagctgtaggactcaccatctagatgagataccagggcatttctgaggatgtttttgccccgggccacctcactctccgtggcactggtacacaggcgcatcctaaagtgggggggtgggtggtattcattctgagccagtgtgtcatctctcagcctcccactgtgctggttaaagccgccatcccacctaggaataccaggctgccacttaccactgcccttgcaggacgaacatcatgtcatcgattttcattcggtcacagacaaagtgtgcacccagcaagcccgtctctgcatagcagatgctgaaggtctggaaactctggcatagcttgttggccacagcacctgaagccagtgggctggacaggtgctgccagggggataggtggtcagcacccaccctcttgtcttcaacgcacactgtgacccccacgcacaggagcacacagccccagcaccctctcttccctgaaggcgaggtcccatgctcgcgctggcactcaccacgccaccaccataagtgcagtcatagtggccgatgatggcattggccacttgcaaggccacattgtccgggctggcccagccaggaccctctactgcaatggccacgtgggcaaaaggtagagcatcatcacggtggcggatctgaaacagtacatgacaaggctgaggaacagccagactgccaggggaacagaaaaggtggcaggtgtgggtagagggtgtatgtgtgtgaacatgtgtgcctgtgatgcagcagccacagaaccccttcccaactgctgaggtatctctggagtcaccaggataaccatgcacatgggggtcctcccacaggcccccagctgagcactactcctgcccaaaaggcagcatacctcactgccagtgaagcggcatggagtaagagtgggcacagcgtcctctgcatatgtccatgggatgccaccgaggtgcttctgggcgaggtctaacagttgctggtgctccactcctgctgagacagacagtggcattactgaccagccagggcccaaggcacagggtggggcgattcacagacaggcagaggacccccatgtcctgtcttagtgggagaaaccaggagtatgtgacattagaacagggtgaggaaagaaggtcctcctcagacagaccctgccttgtggacaggacaggcacctcagggccaaatagctcccatggcctcagtcccaggagagcaaaagcgttcagagtttcaaaatgggctgccatgtgatccaagtgtgggttctcacttgagaagatgcattccacctacatcaaggacaagactggtactcctgggcacaaagccacctggcctgccttttccctctagctctccctcaagtatttctggctgctggccctgcagggggtggcaagtgagggggcagaaagaggagctattacagggctgtgattagctcttgggtcccctgagagctggggacatttgcaaataatgttacaaacgtataccctaggactccttggatcttgcctcctcacctccacaagaggagggctctgtggtgccaccagttgcattggcctttttttttttttttgagacggagtctcgctctgttgcccaggctggagcacagtggtgcaatctcagctaactgcaagctccacctcccgggtccacgccattctcctgcctcagcctcccgagtagctgggactataggcgcccgccaccacgcctggctaatttttttgtattttcagtagagacggggtttcactgtgttagccaggatggtctcgagctcctgatcttgtgatccgcccgcctcggcctcccaaagtgctgggattacaggcgtgagccaccgcgcccggcctgcgttggcctttcattccttccttccatgagctcaagccctgctagtctgacacacacgtcagattgctcttgcccccaggttccccagctccaaagcccctggtcatgctcttcctattggtcttttctgcacactcagccgccaaggtcataagctgggaagcatgtttgtttttttttttttttttgagatggagtttcactctgttgtgcaggccggagtgcagtggtacaatctcagctcgctgcaacctccgtcccccgggttcaagggattctcctgcctcagccttccaagtagctgggattataggcaactgccaccaagcctggctaatttttgtatttttaccagagacggggttttgtcacgttggctgggctggtctcgaactccttacctcaggtgattcacccacctcggccttccaaagtgctaggattacaggcgtgagccaccacgaccagccaagatgggaagcaccttgacctcagttccttacccatgtccagaccccaaccaggttccatctataaaaccacctggagtccatctactgctcccccttgctcctgccatctcctgcccagtccctgccacagcccctctctagccagcctacctgcactgtgaccccacacagcagcagagcaaaccttagaccatgacactgctcttcccctgcgctcagctccccacaccccacctaaataacactcaccacctttcaggcttctgttcaaactacaggtgctttaaaaagcccctcccccaaactccaactctgagtccccagtgaaatcttccccacccttctgtgccttcctttcaaggcacttcttggtttgttatcaggcatgcatcaacacacaactaatggctggctctcccaagggcaaggccacaaggaacaaggccaggagcttacatcccctaccagcccatgaactcagtatcctagaaccaggtggggctaagacagacctgtaccagagggacagcatcctgtgtaaccagtcccagtggtggcggcagggtagaatcctatcccacctcagagagcacaggaggaaggtcattcccctcaaggttagggtgggagcagagtcccctggggtgaaaggtcccctatggtgggaaccaggacctcggctttgataaccaaggctgggaccccactacccaggacttcagtgattccatcactcacctccagctgctgccagcaccattcgaggggccttgtaatgtgtgctgaggtactcggtcaagtctgcacgagacagcttcctacaagacatatggtcagtgtgtcaacacctctaccacactggagtgagttggggtacatgcatgaatgggactgaggaggcagactaggagaggcatggtttctccgaagagtgggccctagcacactccccaacccccttcccctgtctctgccacccacccctccagggcccagagggcaacccttgtctgcccttgcctcatgcctgacttcaggacaggctcatagtcttctctgagaaggcgtgagccaacactgtgggactctcaaaagggcagcatcaaagctcccggagccatccacaaaggagacaagagaccacatggaggggacacccagacacttcgcccttggactgtcaggacatgcaccaaaacataccttaaaacaaagcccaaaattcaagtgaagcccacaaagccattaaaaaagactcactggaccacatggatacagaaactgtctccagttgcataactcaggaaaataaccccgacagctagccaactaaaaatgtgacctggaaagggtctggccaggccagaatggagcaagcatccccccacaaggccagccaactctcacctgacattctcactgggcccctccacagcctgggctagaggtgtgccctggaatgctgtggcatgcaggtagttaaagaccacatctcgcatagatgcatcattctcctgcatctcccgcaggatcacatcacgttccttctcaatctgtgagtcttccagactacagttctgcacaatgtcacccaggagctccacagctagatgcaaggaggacatgtttaggtgccaggtggaccactgcagaccaacgacagcacaaaatccccaggcctggcatctcctgctgcccacccctagttgcccagctgcaaagccatacgctaagggtaatatgattctgtggtcagccaggggctcctaggtagctgtcctctgcttccctgccctctgtccccgcctcttcctccaggtgttacctttcggcagatccttggacagcgccttgatgtagtaagctgtgtgctcccgggtgctgtaggcattaagatgggcccccatgctctccacctccttctccagggcactgccaggccgattctttgttccctggaaccagatatcaaccagaacaatcaggagctacacaggaacccaagaaccctgtcctcagaggctaaacacccagcaggaccactggtccacaggtacctccctcagcatagactctggggacacagatcccagagtctgtttaccaagcactaagcaggccttgaggtgaccaaaaccatggcatcatgcgccaacagaacagagatagccagggccaggactgaagggcatggccagagcaagtgttgcctaaagctcctgtaacagcttaccaacaagctgtggggatcattaccagtacacctcccccctccttattgacagccatggtcaggtaagcccacacctgtgttcaagtgatagaacccactcctcccatgccattcccatgactgtatgtttgtgaatacatgctagtggcctctgtgggacccaatcctagtcctgtgtgtggagaacagtggtgctatctcttggtgtgcacacacacgttaattctgcacacatacctgtgacattgcagctggctaggttgcctactatggctccatggccctgcccaccccataatccttctccatgtttttcattcctttaaaaaacatgggtctttacaaccaagggatgcctagatattccaccagagaagaacatttcataagcaagcatgcatgcccatgtctgtgggtttgttaaaatgcatgtgcatatctacgtgtgttccacaggcctggcttctctggtgaaaagtggggctcctatggttccttgggtcctcttggctctgagggcctcaggcaggggctcatcagatacgtgcccactcaggagaggttaagctcatgtggctccttttaggaaagccagccagacatcagccccgcaactgaggcccataatcaggctaatttttctgaccttcatcctcaggagggacaacaggcagccctaagcccagaggagacagactttaagagcctcaccttgaaagccagatgctccaaaaagtagcctgccccattattcttctcagtctcaaaacggctgccaacatcaatccacactcccacctggtcaagaagccaccagaaaaggttacaaacaaaccactccccagccccctactcacaccccacctgagtgactcagtacaagccccaggcagggacttatgaatcctggagtcagggagagctgccccagcaggacccctgtgcttggggacacagtcatgcttggaaaacaggggcagccgaatgactcgtcacaccacatcattgctctcctgattggctatcaaggacccacagggacacttctaactgtgcacatttacctggtctcaccagcatacaaatccttaaattcactctcaattttcagttaattatttgtttttgtctaagcatacaacatatcatttgcaaataacaacttattttttcctttctaaaaattacacgctgcctttgttctggcaatgattttatcctttcatcattaaggaagggactattggtttagactgtatattttatcacactaaatattgttcctataatatcttttttgttgttgtttttaatcagctctgaacaccaaacagtgttgccttggcacccaataaggtaatattaattttcttgacagcctcctggttgctgtgaaacacgcaccacaggctgggcgcggtggcttatacctgtaatcccagcactttgggaggccaaggcaggtggattacgaggtcagcagttcgagaccagcctggccaatatagtgaaaccctgtctctactaaaaatacaaaaattagccaggtgtggtggcacgtgcctgtagtcctagctacttgggaggctgaggcagaattgcttgaacccaagaggcagaggatgtagtgagccaagatcgtgccactgcactccagcctgggtgacagagagactccatctcaaaaaaaaaaaaaaaatgtaaaagaaacacgtaccactcaccccacttggtcacacggtctagtcttttaatttactatttgttcacagctgatttaagtttttcacatctactttcctaagtacttttttttttttttgacatggagtctcactctgtcacgagacgagtgcagtggtgtgatgtcggctcactcaacctctgcttcctgggttcaagtgattctcccgcctcagcctcccgagtagctggaactacaggcgtgcaccaccacgcccagctaatttttgtttttttgtgtgtgtgtgttttttttttgagacggagtctcgctctgtcacccaggctggagtgcagtggtgcgatcttggctcactgcaagctctgcctcccaggttcatggcattctcctgcctcagcctcccgagtagctggaactacaggcgcccgccaccacgcccggctaattttttgtatttttagtagagacggggtttcaccgtgttagccaggatggtctcaatctcctgaccttgtgattcgcccgcctcggcctcccaaagtgctgggattacaggcgtgagccaccgcgtctagcctaatttttgtatttttagtagaggcggggtttcaccatgttggccaggatggtctcaatctcttgacctcgtgatccgcctgcctcggtctcccaaagtgctgggattataggcatgagccactgcgcccagccaagacttttttttattgtataaatttatggggtacaagcacaatttttagaaatttctatccacacctgaaactccatttttttctttttttttttttttaagacagagggccttgctctgtcacccaggccagagtacagtgacataatcatggctcactgcaacctcttattcctgggctcaatcgatcctcctgctttggcctctcaaagccctggaattactggtgtaagccactgtgccccgcccacaagtgtgatgtcattacaggcacagaatgcacaagtagtcaaatcagggattctgaattatccatcaccagaataacaaaccttgtacccattaagtaatttctttttttttttttgagatggactctcgctctctcacccaggctggagtgcagtggctccatctcggctcactgcaatctctgcctcccgggttcaagcgattctcttgcctcagtctccccaggagctgggattacaggcgtgtgccatgcatggctaatttttgtatttttagtagagatggggcttcactatgtttgccaggctggtcttgaactcctggcctcagctgatccgcctgccttggtctcccaaagtgctgagattacaggtgtgagcctccaggcctggacccattaagtagtttctcatcatccaccccttcatccttccaagtcttcactgtccatcattccactctctacatctgtatgtacgtattttttagctcccactgataagtgagaacatgtgatatttgctttcctaagagatgtcaatgcatataccatatatcacacaatcttagatgaacatgtatttcacatctaacatcttggaatgcaagaggcattttacaatctatagtatcctttgattaaaattggcaagattcttgagattctttctctggcactggagcacagacagctccttacaatctagcacattttagagttcatgtaatatagcattctttactataacaagtgacatataacaaggaagttgcaggccaccttttcctatgcttagtaacaatttaaatcgcaggacattgtttctggaaaactaaaaggatgtgtcaataaaaacatctggccctggggctgggggctgaaaggaggaggagataattatttcttgggaatcttctcacctattcatatatctatctgtgactcaagatttcttgtgtcaatttagagaatttgtattttttggaaaatcacacatttcattgtactgttaaaatgcatttgcttcctaaaatgtatttctggtctagcctggagattatgaccttgggcagtgaggctgacagacctggacccctgcaagtcacctaaggtgtctgaatcccattttccgcattataagaggagacatgatcacttcccttatatgggctccttaacaaaaggctggaaaagaatttggccgcctacttaacgggcattatatgctaaataatgttggcttatagtgaagattgtcccgtgaagccaaggcgtggctagggtagggaatggggccattctcggggtgagtggtcctgggtccgaacccaaaccacaaacgggaagactcgagcccaaggtcacaccccaaccagggaaaagacggcaggcccaacctggaggccctctccccaaaagcgtccccaactcaccgtgcaagtgggctgagaggactgctcggaggccacacgcaggccgttgtccagcaggctaacctgcgtctccggcacgaactggagcgcctgagcgaaggttgccgtactccgcaaggctggcgtccgcagcagggccggctgtggaagggaacagccgcgagtgaggactcggtcaggggatcgctccccacctcccaggtcctcaggaggacccccgaaccccgcccctaggcaagcggcgagatacctttccccgccctccgccgtgaccttcccacggccctgaccccgcgtcctccccacctcgacctgccactgctaacagcccacacctgtccgcttcccgaagccctgtcccgaagccccgcgctctcgccaccacctcaccgagcggcgggcgcgcaatagcacttgtgccccggcggtagcggcccgacagaccacggacgccgccatcttccagctgcagtcggccctgttgcgccgcgcaagcgtagactg

SEQ ID NO: 1485 - DNA, 2052 bp, Homo sapiens
cttgctggtcccatccttcagtcgctttgtgtttattgagcacctcctgctgcaggacctccatgtctgctatatacacaatgctcacaggcttgctggtgtcgctttgctttacagataaggaaaccgaggctcggaaaggtgaacacctttgcccaggacagtccgtgcgtgaagtgggacagagtttggttggagctccggcagcctgagccctgtctcctgtgagccctgcatgtccctgggtcgaggctggggatgcaggggtacgtggggaggacagggcctggccaggagttgttcttgcttcatgcaggtttgggggacaagcacccactcctctcagacccctcacgtacccttaccctgctcacacacactcacagctgtcagagactcagccacacacgcacatatgcgcccataagacaaggctgccatggtcacaggcttcctgtgttcgggcctttgtgcctggagacacccctcacagccccgtccatctggggcaggtgctgcctcatggggcacagagcaagcaagtgaccctcagccagcatttctctgtgtggtggcctatgggatgacagacctgtgggcctcagagggactggtcggaggcagtgttgagctctcgtgttgaggctcctgaaagtaacatgatgatgactgcatgtggcggtgtccaggtgttctgtgactatggggcacccagacatagcaagactcgccacagcagtgaccttacgtggcagcatccaagctgtccggacatatattaggtctgtggggcacacaggcatggcaagactccatgtggcagtgacccaacttagcaatgtccaatgtccaggctgtccagacacactgtgactctgtggggcactcagatctgatatgacctgcatgacagtggctccatgtggcagtgtccagacactgtatgcccagatgtggcagcgtccagacactgtatgcccagatgtggcagcatccgtccagctgtgtggctgccctccaggtcttcccatccagggtggccctatcactgtgaccccctctctcaggctcagcagtggccgacacgggccaggatgcgggcgttggtggtggcctgctccctggcagccctggcccgggcttgctccagtaagatctgcaagaggccgatggggacatccagcgataggacaatgcgcgagccagggtggcgggtggggctgcagtggctctgggcagcccacggccatgtgggagcagctgaggggctctctgaggccgcaggtcggggagtggtctggggagaattctgagggcggagctggaaggttgggataggggtcactgggacaaccaggactctgcccaacatcaggaccatcagcaacagcagagcacacctggtcatcgtgaggtcaggctgcaaggagaaaatgggctcagggcaggggctctggtcaactggggtccatggacagagacagatggcaagggcagagtgacagagcgggggatggagagagaggaagacaccgagaaaggggttagagaggccaggccaggccagagacagagaaggggagacaagaggagagccagaatgagacaaagaggcagaaagcaagacagaaaaaaagaaacaaagaaatccagagacagagggacagcaagagagggagatgaaggagatggaggcagagcaaaatggagactagaagaaaaagacagacagaaaccatcccagagacagacagcatgatggaaagaaagattcagacagaaacacagagtccacaggagggcaggcggttctcagcaggagagcttgcagctgatccaggaaacagaagggcaggaatcggatctcagaggcagaaaagcagccagagatcccagagtcccctgggtccaagccctccataaagccaaaccccacatccactcaacctccaagacccttcccatcccgacccaacccagtcctaccgccaccagctgcttctggggtaaggcagcctgctgtggctgcctggggctggggccaggcactac

SEQ ID NO: 1486 - DNA, 88 bp, Homo sapiens
cttcctccagccagccaactcacagtgcagaggtcttcttggcctccctctgccctgtggagcaggatgtgcgggcagcgaggagaaa

SEQ ID NO: 1487 - DNA, 9772 bp, Homo sapiens
gttgagcagacaaatctttattcctgaggctaaaatatgcaccagttccctccctgtaccgcgccactgccagcctgactgcatgcaggccctgtcccagacctggagcgctgaacttggagtcccaggacctccttccctgagttgtgtgtgtgtacatggaggggactcctgggtagcacctggaggcggcctaggggtgaggggcttctcaagggtgccctgcacctccagaggtgcagtcttgggcaggatgtagcatgttcagagtctggtgacctgagcaggcagaggaggggaggctctagtcagtttccaaaggacacagaccaacccccgcccctagaacagctttatccaaagacagcggagaaagcactgggcccactggggacagagccatggccaccaggaaagactccctggagctggggccagggtggggacaagcaatagattaacaaaaaagagcttggcaggccagaggtaggctcaccgaaacagggctgtcggggacaggcctcgggtgttggagggcaaaggtgacagcatcatggacagaggcaaagagatgcttcttggtgatggatgcatcgaagaagtgcccagcctcaagctggctgaccacagggcctgtgggcaagaagtaggcctcccctgactctcagaacctctaggaactcaactcccgggagccaacagaatgccctgacctcatcacccctgacctccacccctgaggctacagctgaatccacatcacttgtaaccctggactcctgtctcccaggacacctctgacctccagttccagagaaagactttttccttgtgctacttggaaaaccccttggccaaaagtatcctaccctcttcccaggtccctcctgctgttcccaccctactcactgtggcaggccgccatgtacacctccacctcaatctcccggaagtcatggaaaatctgtagcggaaaagggggccagcctcagagggaggctcagggactcagaggggggctcgggcaggcttggggagggagtttagaaggggagctttgagggtttggggagtcagaggctgggagtgctctcagggcaaattacagggtcagtgtggaagctcgaggggccttggcctgcccccgtccttacattcttcaggctcttgaggcacacagtgtccacaaaggagagggcacccaggtccaggatgaggctgtggaagtctggctgaggcaggcccagggccttcagtgtggacccatctggggccttggagtcttcttgaccattggctgttgcatcttccatcttatctcctgagctcacctgctggggagccagacatgctgccagggccacccatgagagagtgaaggcaggactggccgcacacagacacgcgagaacacgcaaggtcagatggggagcatgcatgggacacataaggacacaaacatgcgggagtcacataggtgtgcaaagacaggaatgacagatgtgtggggacatgcaggagggcacacccagatgtgcatatactgctctgctacctcctgggccgacgctgcacagggacacgagaagggagtccctgtcccattctcatcagccagggctgagtggggagggggcccaggagcaggccagaatagacacgggcatccacatgaaacgcatgcagacacctcggcaccctgccctgtctcagtctctaattaagtttggcatcctctttgacccctcaattttttttttagagacggggtctcgcttcattgcccaggctgaatgcagtggttattcacaggcaccattagagcgcactgcagccccgagctcctgggctcaaatgattttcccgccttagcctcccgaagagctgggactacaggcgcgtaccaccacgcctgcctttgaccccttgattttctcccatataccccatccctttcctctacccatgagcagactctgggggaagtcttgtgggatctacaaattcaaggtcttcatctaggcctgagaatctaagcctagattctgtggcatatcacgacgctccctgaagaatatctgacccagcctccccactcctcctgccatcggcgcaacaccctcgagcccacagctgctgggtccatggcattcctcatgagacatgtggatcctgcatctctgcagctcacagctgtcacctcctttcccacctccagtctcaccatcatcttgcagtcctcaacgttgttgctcctcatgtcttcaaggctggtgttgacattaatggaaactgaggcgcccttgggggaggcagcctacaccagggaagacagggaatgggaaacagctagcccggctgccatgacagccatgtcacataggcctggtgatgccccctggtgctgggcaggtgggtgggccaggaccagaagctgtgggacctgcagcagccaggctgaagctcctggaacagccgtgaaagggaagaggactgtgacggttctcactgtcactggttcagatgatgggagagaaaatgctgcctagagcccggacctgctaggggagtgaagcagggtccctgggagcatgagggagaaaggggaagggatgaggagtgaggacgagggaggagtcgggggccaggagaaaggctggggcagggaacagggggcaggagatgggggtcaccagacaaaaggggccctgcctgtttccgaagcttctcctctttctgcagttgcttcagcttcagctgctcctgcttcttgagcagtttcttcttctgggagatgaggaagtcgacatccacaccacactggaggcaaacatcagagaagggttggtgagctctctgggagctggggcctgacacccatcctggggactccgtctcaccctctgcttcagcgcatcactgtagaactcagcattggcaaagtacacggtggccgaggagcggaagaccttcaccccccggacttccttggcctggggatgaggcagaactggtggtggctgaatctcctctctcctggctgcatcctgttctcctgcctttccttccctagtgtgcccagtgcctgccaccgcccagccctctgctccccaggctgcagtccaggccctcccaggggcttaggccacaagcccgacggtgtcatccccatccccccacagtgcctctccctccccacctctcctgccaccacccaggcaggcttcacaggctcttaacctttctcttgggtttccaacccctgccttgtgttctgttttctgcacccagacagaggtcctcctaggctgtcatatcaatcagaccttccccgctcccaccccattcgggtcacagcccgggtctctgctgggctccaggcatgcatggtaagggctgggctgccccctcatcctctcccatgtctcagaccccttaattcctccccgcactgcctaattgcactgtgcccatgttgcaggcaacagccttgttttattccagagccccccacctatgttcctagcacttggcccaagacctctcaggagataaatggatgactgaggacttagtaaccccactgatcagatcaggaaatgcctcccttccaacctggcgccccagggagctgccattccggctctctgacccacggctgctctgcaggtggagcttgtgctgttgactccacgacagacccctccccagccccagacccatctctgtccactctccctctgtcccttcatacctctagagggggtcatagacctaaactcctcccttgaaatcccaaagaccaaagccaaagtatcctcagcccccagttccctggccaagtgtggaacgaatccacaaaggctcattcttcctccgtctccccatccacaccatctcactcagcccctgacactcacctctgagtactctgccacatctctgtaaatatccgtgtctggcacctgccccaggacagagtagtggggcctgtgaaggagagagagaatgcacgaagagggggcagaaaaaggggataacagaggggtccgaaggagcctgaagtccccagagatgtggggaaagctgcggggagccctgtggtactctctcactagctggaatgaggggaccaacatggcggactcacatctgtgtccggaccaccacgagcagcagggagaagatgaccgcaaccaccaagccaaggtccaggttcagcaagatggtggccgtgaaggtcaccagccagataagctgagaacagagggcagcggttggagggcggcgaggagccatggggctgcccagtccctgccctgggctcccagtgcactcaccagatccgcccgattggccttccagagggagcgcatgtcgctgagctgcctcagcatgcccttcaggttcacaatgatgatggctgccaggaccgcctggggtggggacagtgccaccaggggccattgagggcacccgatgctgacaaccctcctcaccgaggcaaagccagactaagcccaagcactcaggcagtaccccagacacaaacccccacccagcccctgacccttgtctccaaatctcaccttgaagatctcagccttgaaaaacagaacctaaccttgtgtccccacccctcgcctgaacctagactggctgatttgagagccctggcctggccaagacctgaaacctggctgggtgggggctcaccttgggcaggtcatggaagagttccccaagtttgacaatgatgaggaggatgaaaagggaagagatggctccagcaacctgttcggggagggagtgagcaggggagagacctccttccccaggcaaagcaatgtgcatgcccacacccatgcccacacccaaagcccacctgcgagttgcccccggtgctctcctgtaccaggctccgagacatagagcaactcacggggaagcactggaagatgcctccgataaggttactgaggcccagggccaccagctcctgacgggggacagtacgggtgtgagaagacttcctagaagtggctggtcactgttccactgtatctaggcctgtgcatccccaatctccatccccaccaagtggcccccagagactggatgctgtcccacacgtcctgctctcccaccctcagtcccccacgtggcctcagcacatctgctgtctccctgtgtcccaccggttcctcccccacccgttgctggcgcctccatacacttggatgcctcctacacatcccgcatcacccagacctggttgctgtccacccggtagccgtgcctcagggcgaagatcttccccagtgagatggcaatggcaaacccaaccacagcgatggtgaaggcgctgcccacgagctttgagaacagctgggtgttgggggccactgggggcaccagcctgtgagaggtatctgtgaggccaaagcaaggtcctgtcctggctgcccaaccctccctgacctgatggaggccagagctcaccctgcagggatgttgcccacgacatctacctcaaatctgtgctttagacccatgccataggagatgcctgtggccccgatgagctgtgggagaggacagagtcagggaggcaggtgctggcaccatggtcagggggacacataaaccactgtgaggtgaggagggagatactgggcaaaaccttcttcgagggtgggaaaaagtcacgtagggtgagagacaggcaacaccatttcggctatggggagatgctgtcaggggcaggaagaaaccaacataggggctttctgctgtgccccccacaatacccaagaaccctcccagcccccctccagctggccctcaaatacaggaggctgcccacgtggcaaggacccagcctgacctgcccttctcccctgccctccactccctggccctcgaaccgtgagcagctccccgggtatcggcatgggcagctgctgctgcagcttgtcattcaacagcttcaccaccacgagcaccaccccagccacagctgcagtgaccacggtgccaaccttgctctggggcagcttccagcagacctccagcactgtctgaggagaggccaggtcacagctagcactcaaggccatggggcacacctacccctccctccccctaccctcactcacatagatgagggacagtggcccagagtggctgctcagatggaggccaaacacatacttgagctgtgagacgaagacctgcacagctgcagctgtggtatagcctcggacaagaggttctgacaggtaggtgaccacgaagccgaagtggatcaggcccagccccacctgtggggcggccaggggcagtcaggagaggcaggggtcctggggttgctaatgaggagcgcagggcaagtgggatgggagggggatgagtagacggcaagaggaggacgacgatggtcagacactcaggggagtacagacaggacagtggcgggagcagaagtggtggtggggggcacatactcctgactgttccacacctggaagaggccaaccaggacactgagtgtggaggccacctgtacccgggcagcatctctggctgtctcattgatcatggagtcgttcaaggcctgcggggccagggattctgtcacactgcccaccatcacagacatgacagcaaaggtccctgtaaggacggcacggggcaggtctgaagaggagaggacactgccctgccctggagccctggtcttaagagagaggccaggagacttccagttctggataaatgtactcagattatggctgcatgaacagggacagtgctggcggttcaggtttggccaggccaggagtaaaccctgagctcacaggcccttaagcatggctagaaatgctggccctgtctcatctaccctgtcccacctgtgtctactggtcccgggacacagaggctctctgtggagtagggaaggggtcagggctggccttaggctgctcaggcctctgccaagttccaggccccttgggctgcctcacccactctcatcttcctggagccagggctttgaggtcacctgcctctgtggtcctacagtcaggggtctagtcctgcctggggatgactcgtgggctagcccagggatgcagcaccaatgctgccctcttccccagccgctcctgccctgctcagtgccccctcaccctgccctccatgatggatgtgggcatcctcctggaaggctaggcctgcctccacttacccacggagatgtgccgggaagtgccaaacaggaagtagatgaagacagggtagaaggagctatagaggccaaacacggggggcaatccagccaggagggcgtaggccaagcctaggggtagaatggtagcagtgcaggcctggagagcagatcttgaaacgataagggaatcccagccctgggttaggtgccatagttccaaggtagaggtcatggccccagttttgggcatcacagaccacagggtttccaggccgacgcactgaaggtggctcaccctgcggaagctgcatgatggccacactcaggccggataacaggtcacccaggagccagtcacgcacaggataccggggtaaccagaccaaaaccgggaggtgttggagcagaagggcataggcccgagcacgggagcacctagggacatgatatgaggggtaggtgtcaggaacaggggctacctgggccccgccagcgcccccaggccccaatcttggccttactgcaaccaggtccgccactggtgggtcctaggtgctgagccccagcgccccagctcctccaaatgctcctggttcagcagcggccgttccatgtggtagtctcgcctccgcaggtccattgcttgtgttgcagacagcagtgcctgtgtgtccctcggtctggggtggcaagaccagagagacacagtgaaggcatccctggcccaacctcccctacacctccacctaggaccagagagttacctacctgatttttccaggccctaagatcaaggtacagtattccagcccccagctggcatctgtgggccacatgtccaaactcagacaggggcagtacctgaactttggctggtgagaaagcctctttctaggacaaagtcccccaagtagggactgcaggatgagcactagctatacctccagccgagatgtggcagcccagtgctgagtgttctaccagtccaggtcccaggctgctccctcccccacccagtccctctccagtccccaggtcctcctccagctgccccgggagcccactgctggctgagagcacactcagggaaggggtccagcaaaccaggggtccagctcctcaagcaactcctttcccaagcctcaggcctcagatgagaccctcccctctaagggaaggaaagtgttggagccaagcttgcccctgggcctccagccccagggtccaggttgtagacggctcaggcctgttatggggaagccaaggactggctctcacctgagaaggagcttgctcttggagtggcaatctctcacctagagggagaggctcccacatggaaagggaagtacccacttgaagtgggggaaagagctcacctgggaatagaagctttcaaggggaatctcacctagagggatctctgacctaccagggaatctttatcagcctggcaagttctgatacagggggaatcttccctctgcccagaggcacctacttgaagtcagagaaagatctcacatgggaagaaaagacctagagggagagggttctcacctggggggtactctcccatagagaaagctctgacctcgggcgaggctcccacgtggaatggggaaaagctgtcacctgggaatagatctcacagaaggatcttacctgggggaaaactctagcctgttggggaagctttcaccagtcaggaaagttctgatctaggaaaagccctgacctggggagaggatcccatttgagggacaggaactcacctgggaagcgcctctaacctggctgtactgttggaggagtgtggagtgggtgcaaggaagatcctcagagactcttgggaccgctatctcaaggagatcgtagagccccctctcctttcctacgtgagtcactcaggtcttcttaaagggctccctcccccgacaacttgggacccgcgtttggagggcggagccttgatcattggcccctccctgtaggaaggcaactggggccagaaaggccggagcgctcactccgggatcagtggagctgggtggactcgggactcagctgaaagcagctagtccacgggccgctgccagggactcccgtgccccacgcacccccgccggcacatctcctggccgggctcctccgcacgcagctgcctccctgtggcccgggatggccctcgggcgtcacaccagcggctttccgcacagcccaagggactggggtcgcgccggctcccgcccccaccccttgctgcagaggggcagccgcctgcagaaaatcagcagaggtaaaccgaggcgtcgcaagcggagaatgcctgctccagcgaggcgtcgcaagcggagaatgcctgctccagcgaggcgctcgcgcggggccaccgggaatgtgcgctgaactcaccccgacgcatccgccagccccatggctcgcaagttgtccggtgcgggctgctcctgctgctcgagctagaggccgctacgctccggaaggcggcgccgggaccgggtgaggccagctgcgctc

SEQ ID NO: 1488 - DNA, 26454 bp, Homo sapiens
ctgttttctatagaagtttattcccaaaacagagcgcggcttcacggaacaatttacacagacaggaaagagggccgctgggctggaggaggggaaccccagagaggggcatctacgaaacctaggacatagtaaagacaccctcccacccccagcaggccactcagcccttcaagagctggggtccttctcggtaaggagagtttgggtcctggctggtgggatttagctccagtcagggaagtagaatttctaatctcccaggaagctgcttcccaagagtatgcatggggtggtgggtgaggaggtgtctgcacagaccaccccccagccctgcacagccactctcccccgtggttagaggacgcctactctcaaggtcttctggatctgctgttaaacgggactcaaggctgaccttcggcctgggagacctgggggttagaaaacccctcaagatggccaggtcagggtcctcacaggtgggtcctccaagtccctctcccactttccctacctttcacttggaaacaaaggaaaaaaaattatctactgtaaacaaagtgtaaaactcaaagttttgagttgtaaacaaagtaaaaacattttttgaatctggacttgtaaacagtaacaaaattttaaagtcttcagttctggacagcagacaaaatagcaaaagtaagagttttgtgaacagggtcgtaacagtcatttttccctttttaagggaataaaggaggagtggaacggagtcacttcctgcagcccaggtgcctagggccacggaggatcctgtaaacataggaggcagtggcacctacattctgggtcttgaattcccttgtttctgctccctttgctcaccttcccaccctacccttcggaatcaattcaagcagggggcagtgtcagggaatcaaatggcaccacagacaacttttgcttgctgcaggggcaggtgaatgacccctccaccgaccctctgcaggaatgtctgactagaggcccgagcccctccccgtgggagacagggaagccttgctctgtaaacacgacatcagctgctccaccagcaccccacagcatcagtcctaggtcataaggcagtaagtggcagggactccacataataaacacacacatccaccaggaggggcggtatgagcaagcccccatgaggaagtcagaggacccctgtttccaagaccaacccccagccccagaagtttggcctttggagcattcaataaaaagcaaagaacaattctgtactttgggcccctgacgatactcagatcaacttgggggtggaatagggggaggaaggcatgtgtcccacccatctgagtccaccccaggaaggagagagagatgagcatagggtttgctcaggacccaaatggggtcaaactgcatctctccctctatctccctccccctcccagcccagcctcaaaccccccaggagacagaaaagctgaaaaataacataagcatctctctggttacaaaggtacaaaacgtataaaagtctccctccagtcccccgtctctgcacctgtcacacgcatgctcacagatgcacatggagcctcagccctgccacaccaggtagagctggggcacccaccactggggagcaggaggctgccttgggatctgcccccactcctggagtctctcctgttagcctagatcctctgtcgccctcagctgttcctcgtccacgccgtcatcccctcaggagtgaccctcacttctgggaactctggaggcacatgaggaaatcagaggttgatgcccagaggactccgagtcaggcggctctggactcccccaccacatttggcctggctgcttcccttgcctccaccactgctctcgcctcttagcccccagccccttcatgcccactccagggttctcagagtcctccattccgcgcccctagactcagccaggctccttggctgcccaggtgttttctctaagtgcttcaagagcacctactgtttacagatgctatattgagcacttgacagatattatctcatagatttccacatctcaaagagtttgttactacagacttctttacagatgaggaaactgaggcccagaaaagcttgcctctgcctaaggtcacgcagctagtaaggtaagacacagagctcaaactcaaacctgtgcgactccagagcctggacccctgctcagtccctagtctacctcccaaacagccagaccccaaagctagactgcagggggacccaggccgtgggttagctccctctggtccccacccccagcagccctcagtgcccaagccccaggatccccaaacccctgctctttcctccttcctttgtcctctctctgccctgggtcctgctcagttctgtcgatcccctgccccacccctagggcccccttcctccccaagccatctcttaccccacaaacccccagagcctgacccagctgtttctcctccttgaaactcaactctcctcttggcttacaagagacctggaagctcctggttcctccccactcccaccagtccctctcggactcctgtgtatccagctatttcctgggtctgtccgccatccccttccccacagatgcttcacacatacccgagatgaaccaggttccaactcagttcctgtgagccccaccccaaagtgtccacagacaggaggaactcaatgttgactgaatacatcgatgaatgaatgatttatcctcaacaaagcaagcccttcagcctggtatatcctggcaccacttccagcctctccttgtcctatatgaccccctaggcgaaccttcccaagcaaggcctcctgctctcctccctgccccttgcatattccaggtcatctcccacttctaggcctcagctcctgccctcccattcgctagctcagcccatcggatggcacctatttctccttagcctgggaggtgctgggaaggctggctggctccagtcacacagccagcaagtccctgctagtcacacccccatttcttgccagattcctgtccccagcctgtggccctctggctgtgctgagcctggggtagcccacacctgtctgccagccctcatccccttctgtggcagaacacagggcagggcacacaggaggttgccctaagctgatgagggtgcaagcaggtggctggaccatacttactctgagtctggcgacagctccgagatgctgtgagacgtggcagaacgtggcgtggagggcccaagcacagaggctgtggcagaaggtgtggcagtggtgtgagggcccaagggtgtgcttgaagattgcacagaggagagggccgaggagttgaaagaggcaaggatggaggaaagaatgtccaactgttctgtggaggggccatggctggggccactgaccgagtcctccctagctctgagcagctgcgggagtggcccaagggcttctcgtgaggggtgccggctaggcacctggtccagctgctcccgagagttcgagctcctagacagagagtccagcggccgggatggcaagagggggtcccttgagagttgccgctggggagacaggggcagaggtgggggctgtgggtcaaggtcccgggtgcggcggggcggaggcagcgtgctcaaccactctcgaggtgcccctaagtcgagcgcatcccgtgacccgaagcggccagccatggcgccagggtagtcccgaggtggctgcctccgtggcagggtgctgccccgatctttgggctccagtcggcctggtgcagcatccatgcattcctgggaccctggccggctcaggggacgtagaacaggggcaggggcttcctctagtcgctcacggctcagttgccgccggaggagcaggtccagctgttctctagaagagtagcggctggctggctgtgaaaggctgcccgtgcccccgccagcatagatgcgaccgtaagaggcagctggcacagcacggtggcccaaggtggctgcacggcaccaggacagctcaggggcacctcgggtctgtggcaccagtgggtattgcaaccggttcttcaggatgcctgtgagaggaagaaaatggggggcagggtttgtgtgggagggggagggcaggcaggaattgctgagtctaggggtgtggcagcccttgggatccttccaacacagggatgggagcaggaaccccttggggagcagcagaggcaaccctggtggtcccagagaggcagcaggacaggggtcagagtggaagggcagtcatcttccagttgtggtcccggggcagggggagggcgggcaggtctcatggtgcaggggatggggcaaactccctgaggtcagaagaggggcagccctcaggtcctgacaatgcaggcctggctgaaatgcaggaaccccccgggttggacaggagcagtccccaggtccctgtgatgcaagggtgagggcagaaacctcttctccgggtccccataaaagcagagtagggggcagaaatcttccagatcagagcacgggctctgggatctgggtggggggcagggggaagcagctcctagggtctctgaaaaacagatgggctggggcaggagtggtcgcctgtggtccccctgtggtgctggccagggtagagggggacagagaattcccaggtcaggacaggagcagtccctgaggaccgtgaagcaggctagagaagcagaagcgccctaggtcagagtaagaagagctctcagtttgggatgaggaagctgcaatcccttggctcagggcatgagcagcccccagcgtgtctgcggtgtgggccagggctcagggactgtacctttcctctggcgctgggcccggcccagagaagtctcatccccactggtcagggccgggtctggctggttgttgttagctgcatccttgctggtgtccagccccaggcgcctttcagagccccaagtctgcagagcacagggggctgcctcgcactcccccagggctggccagtaggacaggaggtcattgccatccacatctgtggagccaggtcaggttacaggagcttctgggttgatcccagtgactcatgacccctgaccctaatgacccttgaaaccctggctgttctcattgagcagaggtgggaacaggagggtatctcctcagagatcaatgggtgggggtgactggtgagctccctccccttaactggaggtggacagagactaaaagttggggaacctgatgactgaggggtcagaaagaccaggatgaaccccaaccgcaggaaagatggggagctggagggataacaaatggggcatcccttggtcacccaaggggtcagagggcgcctggcacctttggggtgggtgaggagcctctcactctgggctgctcggcagagtggccgttggaagcgcccccgcgtccggccattgtcctcgctttctgaagatggaatggagagactcctctcctcctccaaggacaggtcactgtcagagtcggagtctgcgcctggagttgggaaagtcagaagtactttcagaggtaagggacttggagataagggaatttggagttgagggtctagaggtgggtacggcaagggggttagggttggggacaggaaccggggcttgaagtggaggtagcagcagaagggctgggacttatcagagggaaggacgaatcaggagtggactgggagaaccagggctggagaggtaggtgcctcctgaggcagggaccctgggggagatcgtcccaccccagtcagccactgctcccagtatggggtagaagaaaaggggatggggagagatcctctgcctccctcctccctgccccaggccccaactccaccagcatctcgatggaacatggccacgtccaggtcagtggggccagcatgagcctggaggctgtggtcagtgtggtcagcggctgagccatgtcgaaccaggacattgtccctggaaaagcaggagcccccccaccatgaaagagggatgtgatggggtgccttggaggctggagtgtctttgagtgcacagccagctgcgggtggaatggcatccctgggtgtgtgtggtgggaagcatttagggcagaggcagaagcagggccccagatggccaagatgggtggagccacccgccctaggacctggtcagccaagccctggtaaggtggggctggactaagctgagtgttccctcacaaggaggctcttcctctcacctgaggtagctgcggccccgctggctgtcctggtcctgggtccggccggagcgggcactgctcacagaggagacggtggaggcgcccagagtgatgcggatgaggccactctcctcaaagagagccgtgttgttgtaggccccaggtccctgggggtggtagggacagagtgtgagctaaccctgaagcagcctaaaactctggcttctcagggcccccatcccgactcaccagcccaggtgctggccttgcctcctcaggcgctgccttcctgcccagacaggctggcatccaggcagcccgagcatctgcatttaggacacagaagagcagcagcaccgccaggccctgtgggtcagcgagggtcaaagcagagtcggcagggatcaatcagggaccagtataagtcactgtgggtcagcaatggggtcagtcactgtaggctagtgtgggtcagtgaggagcccatgcgggactcagtaagggagttggggaaggtcagcaggggagaggatggagcagcaggagtggctggagtctgtaaggtcggtgtggatcagcaaggggtcgggagccttggtgttggtgaaggtcgatccaagatcagcactcagtctgggatcagtgcctaagttagagtcagctccaggcctgggggcagcagctagggccagtgtctggtctggggtagtacccagcctggcaaagttatccagtaagagtcagctccaggcctagggtcaacgtctgcctagggatggccccagcctactgaaggcccacctggttctggggcaagggaggggcaccagagtcacctggaggccgcagagtccagcatggaggtagtggaaggctaggatgctgtggttgactgccaggagcccaaagagccaggaggcactgaccagcagaagcagcaggaaggagctgcgaagggtcctgctgtggggacatgggaagacacaggaggacatgcaaggctcatgtaggactcatgcagggaacacgggaggacacacaggggccacacacgaaacgtgaaaaaaaggaactcacacgggaacatggaggtctctggaggacactgggggagatgggaggtcccacaaagaaacaggagagcagtcaaagagccatgaggacacgtggggaaaacacaggggtatgggagccacaagggagggcacggaagacaggtgggaacacacagggcagggggcaaagtgagccacccaggccatgggagactctggggggacccagaggacaaggagagacagcagggcagaagcacatgtggggctacagtatagcgagggcgccagagagggaccacaggtcagggcaggtgtgacttcattccttcatctagaacttggagcccaacctgcaccagggaagatctgggggccccagaccccacccaggagggacctgccatcctgagaagcccccttcctccagccagccaactcacagtgcagaggtcttcttggcctccctctgccctgtggagcaggatgtgcgggcagcgaggagaaacatggtcccgttcatctggacccacggccagacatgtggggccgggcagggcagagagagagagagagagagaggcaatgagagacagagagagactaagattcacggagagaggcagaaccagtgagaaattcacacatatacacacacaccaaaggagcttagcatcacagaaaaagaaattgggaaccagagagggactgagagagagaagcagagacagaggcagggacaggcaactgaatctctgaccccgcgcccccatctccatgccagttgaatgggggtggctactgaccagaggacagaaaaaatgaaggccgagcccaggaagcctgcagaatgccacctgaccgccctcagctgagtccactgcacctcctcccccaatgagggagggaagtacagagggggcaccaagtccagggcactcaccactatgaccaggacaacagggccagcaaagctccagatgaggggctcgtggactgagatccagcagaagtcagggttcccatagccctcagggtccaggcccacagcaaggccttgggaagagaaagggtaggactgagggtgtgtgttccagagctgctgaccagcccatgtatgggagaaagcatgggtgagggcagagcagcaaccccatgaatagatggcttggggtttgaggttgggggtcatgagcaggagtggggacagggtcaggggtcaggccatgtgatggttggaggttgggggtcacagccctcacccagcagcacagcagggacgccccagcccagggcatggtagaagcgcatggcgccgcggtccacgttgcgtggctcaacctgcatgcggtagaggtgcagcccctgcacgaagagccacgcgaaggtgctgaggaagaagtagtgcaggaggatggcgactgcagtgcacaccagctgagggcaggggggcgtgtcaggacctctcctgcctcacccacctctgacccctaccccaggcatctgcttcccacctctcacccctaaaccacaatatcttaccccagcatcctgctgaaaaccctggccccaacctgagcatccctgacctctgaccctgagttttggccccaggcctcctgggccagtagggtcatcaggacacaagttccctggccctgatcctgcacctgattgtgggtcctgtgaatccccagcaggaagaggagctctgccacccccagggcggctgccacattggcatggatcccacgcacattggacttgaggctgcgcaggctcagcaggatggctgcagtcagcaccagcgcagccacagacacagccacgaccacgtgggtgaacacagccagcagctccaggtcgccctccagcctctacagagacagggatggttgatgggttgttgggcagaatccccgtgtccctttgaccccccacttccttgggacactgaacacagccccacctcacggggagaggcatccatgaggaccccaaaggtccctgtccggctgcagcgacaccgtgcgtgggacccattcctgtgcaccagctcgcagtcccgtgctgtccacacaccatgctgctccgccctgcagccacagggcagttagacacaactgtgacccagtgtcaggcaggggtttgtgagagatcatgggaagggctgagggtgcctggagttggggtacagcattcctcatggtccgggttgcacaacagcactagtgggggccccaggggaaggctgggactattagttggcctcccaagggctaacgggaccaagggtttccagaatgggggtcctcacaggccaggtgggtcccactgcacacagatcgccttgctccgattcgctgtctgtagcaggcgaaactctaggctgatgggggactccaggattccccttaggaagttgcgtccgtggaacacagccacgctgaccaccggggagttcatgacggggttctgaggaagcctggggagacacccatctgggcttacgcactgctgacctccccatgctcagcctgcttgcctcaccccgtcttcatgccactcgccagggctgacccagggtctgggatgtccccagagtggaagctgtttctaagaatccctccagcttctgctgggctgctgaggggctgagcagctccaggggacctgcaactgtttgcctctgattgccctccctcctacccccatcagtcagcctgtccttgtctgtctctgtcagccctttggtctgtctgtacctggctcatggatccctcctgtgtgtggctctgtgtctgtcagcctgtggctctgtcactctgcacaactccagagaataagattcacacagaacccggcaaggatggggctccctggagctgtgctcctctctgtgtgttgtgaacctacgcatctacccaccaaaaaaggggctgccaggctgagaagttcgtaggaagctcaggggtgaggggcctgagtacctggcacctcggcgttctgcctggaactgggcagggagcagtccccctaaggtgcggtaaacgaggagaatgataatggagatcccaggctctggctctggcggggctggtggggggaccacacttgaggtggtggagttttctatgctgctgcttgtgggcagaactgccaggagagaaggaggagcttctgtcagtgacctttgacccaaagcacccaccaacccagctctgaacccgatcaagcatgggggtctcttccctgcaggagcagaattggggagtgcagggagcatgaacccagaaagtaacagtcaaggcctgggaggggtcatttgtgatgagggagaggctctgacaaagtgaaggtgtggcaaggtggacagtggaggggagatgtgggagggagggtggaggggagatgtgggagggtggaggggagatgtgggagggtggagggtggaggggagatgtgggagggtggagggtggaggggagatgtgggagggtcgagggtggagggtggaggggagatgtgggagggagggtggagggtggaggggagatgtgagaggcagggtggtgggtggaggggagatgtgggagggtggagggtggaagggagatgtgggagggagggtggaagggagatgtgggagggagggtggaggggagatgtgggagggtggagggtggaggggagatgtgggagggtggagggtggaggggagatgtgggagggagggtggaggggagatgtgggagggagggtggaggggagatgtgggagggagggtggaggggagatgtgggagggtggagggtggaggggagatgtgggagggagggtggaggggagatgtgggagggagggtggaggggagatgtgggagggtggaggggagatgtgggagggagggtggaggggaaatatgggagggagggtggaggggagatgtgggagggtctgacactggggaggtctagaaaggggaaaattggcaggagggcaacatagtatctggttggggggacagagagacaggacttggcccaggggtcccctaggggctctcaccttcagatggggatggccgtggggactgggaaggcagcagcacatgggtgtgaggatcccaggcatcctggcctcgaaagaggttgctatggtagcgagggtagcgacgggccccccggggagaactggggtgctccatgcggtcaatgctgagcactacccaggagaaagaaaggggaggcccatcatggacctcttccccctgccaagggttctactccctcttactcgcatcccgcacctgagtcccacaatctgttttctgtgctaccagctcggagcctgtccctacaaaacgctgagggcggtggctgagtctcctgccattaacattggcattgatagccacagcccctcagaccttcaggtacctgccctttcatggcccccctgctgtgccccgccctaccccacccacaacgcactgatattaggcgtcaccagccccatgggattcaggtatgtgagttccatattccttgcgagtgtggctgcatactcctccaggtgcctcaccagtcccgcgctgcctggggagcccccaggggcccgctgccccagcgccgcccacaagtcccctgtctctggggcaagcagtgcagagccggcccacagcagattctgggaagacagagatagaattgggttcagccaggtggtgaggatgtatgaggggatagggcaggcatgagaggtctggacaggtgctcagaggggctccaacaggcaagggggcggggctggagaggacaaggacagagggagagcccaggaccttcacttcccaagagaacagcaggagcctgagctggggatccaggggcaggaggctgggagctggggggccaaggcactgagaacatagggcacagccccacctcattgaagtgggcatcctgtgtggctgtcagcccgaagccctgctgatggctctcgaaggccagcaggtgggccagcaggcgggcagtgactcgaacatcttggctaaaatagtggtcagtgtggccagtcacctcccgtagccgctgagccagcttcttggcctccatggtatccagtgccgtcttgttcagctctaggccatccagctgccaagacaaggagatggttgctctgtggtcccttaggccttcctctaaagcttcacagggagaaagccttgccagattaaagggcaaccaggaaaggctcaggagttcaagggctagggtgtggtatctggggcccaccacaggccaaggaaggtcttaggttgcaggaaaaggtctgggcagtctcaccagcagactgagctctcgaaaggcaggggaggtacagttgaagaggtcgggctccagccaaccctgggcctcatcacacagccgcacagcagcacctggaggcaggcaacccctggtcaggcctggggcctggatacctttgctgaggagataaccgcagcaccctctcctatgctgggggaatccctgaggcagaagtcagagtcatgagcatctatagctgcacccctggaggtagcggcccaagcccaggtaggccccagctgcttgtcaggcaattcctgagagggctgtagaccattctcaaccagcaaccacacaaagcacaagggtggggctgcacacactcacccacgtgggccaggactggctcatagatgtgctggttcacacagacacacaccaatgctcaccaattacacacagatgtatggaccagaccagtacgcagacacacaatgctctctcgcacacacacagacatgccaacacagaagagggcttctaggaacatccagtgaaagtcaggtgggaggattctcacacaagttttaactgccccagtggttactttgctgtcatttctctcccttgtctctggggttgggatggaggttgaatgagaattgacttggatcttaaaaaagtttgtagctaccaacaagagagagcctaacttaatcacagaatcccctccccgcaacaggttcacagacacgtgcacaggcacagagatacacacgtgagcatgcgtacacaaacaatctctgtccagccactgcagagacctcaagcagcagggagtgttctgaggggacctcaggcagtggggaggggcccccaagcagcaggaaggagctatagggtcctcagactgaggagggatctttcgtgacctcaggcagtggggaaagttctatggggaccccaggaactgagaaggggtcagcagggtcctcaggcaatggggaggggtctctgaggatctcaggcatcagagaagggcccctggggtactcagatagccagaaggggcctgcagggactttaggcagcagggaggggtctgcagggacctcaggcagcaggaggggtctgcaaaagctctggtagtgggagggggcagtgcacctgagcaaacacgtaccccttacctgcaccccgcaatcctgcccagaagccaagagaaacagatggaggctcaatgagggtgtagggaggggcccacatggactcccaccccacttccacctctttgcaggaacaaagccacccaatttaggaaaagacatggctctagcagtcagagtacaggcccacccccaccctcagtgatgtcctttccccccacatactcacccagggccccccggggacagggcactgtggccaggacgccaaactttgtctggggccaccacacaccagatctcagggacttagggcaggcatcatagagcactagagagagaagaggtgctgagccaggcagtcagggtacagggcagttgacagccacacccactgcccctccaccaccccccacaaggcccactgcccgccactcctgctggcttctcaggagctgacctgtcagattctgtgacaggtcagcaaagtacttggggcaaaggtagggttccctgggtgtaagtggtctccctcaggagaagcttccagagtccccaaggagccatgtgtgccactgacacgtgatggtggcacactggaaccagccctctatgggtggagctgggtggagcctgctcaccccggcagccgctggctgtcacctctgcgaagggactgtcacagctgttgcactggcggccaagggctcctgggcgacaggggcactgcccgctgtggggtgcacatgagcgcgaggtggagcccacagggtagcagtcacatgggaggcaagagtcactgccccgcggtcggtagtggaactcctgtttgaggatgggccaggggcctgaagtcagaggtcagggcttggggaatgagtggaatcaaggataaagggtcaagagaacagtgctcatgggccagaggacacctgggtcatgcgtgaagccaagggaggggtcacgggtaaaggatgagagacagcaacttggtcacaggacacaggcaagaggttagggcccaagtcaggtggcggaggtcagcaagctggacaggaattgcagattgcgtccaaggaagggttaaaaggtcaggggccaggcgcaccttgcagtgacactgcccatttgtcttgttgcagttgggatcaaaacctttgtgaacatcacagttgcaggggccacaggttgggctcccccaccagccccgtgggcactgctggtccatcctgggggtgcagagccaggtaagatgcctccacggtatcccagtgaccctccctgtccctgccaggtctccccatcgcctcagccccagcctcttacctgtgctcacagtggtgcccgaaatagccacccacacagtcacaggtatagccatggggggctcctggcaggtgccggcatgatccctggttctgacaggggttcaggaggcaggcatccacacagcctgggccgtagtaacctgcagattgggtcagaaagctcaggatcctggtcgcagagcatggaaggaagcaggcacccgtcccgagtccctgcctccttcaggttccccagtcttcatcatgggcccctaacgcctgcccaggtcacccttcccccaaccctctcaaggctcacctggctggcaggtgcaagaaaaggtctgccagaggtcccggcagtctgcgtgaggtgggcagggcccagaggcacaggcgttggtcacaacacagccaggctccgcattcactcggtggctggggggtagcagggccggggagccagagggtgtggagccgagccacaccccctgtggacacacagccagcaaggggtgagaccatgttaaggcacctcagcctcaagtactgcagagccagccacccggtctgatgatccttgacatgcagtcttctgataccctcaaaaaacccaggcctcaaaaatatccccaatttggtacccctgtgggaccctaattgtgctgtttctgacacagattcctaaaggcccttgataatccaagctagactcccacctccaatgccacagaaaggcttgacctagctctcaactctgggtcattcaccccctcgcaccaacccccacttgaatactgcctttcaggtcccaaggagcccctgacttctgacccctgaccctaatgccccatatcacattcccatgctgacccccacctggatgcagccaaccagaccctgaggagcctcctctgcactgccggggggcaggcctcccacgtggagctgctttaccttcaggccctgcagctcactccccaccgccatggtgtcctggaggaagtggggcagtcagcactgagggagaggggcctgatgaacccctgtcatagcccagagtcagtcttggccttcttctagcccttctaggctgccccctccctcctggacccacagtagaccttaatattgcttgattttgaccgggggtgggtagagactggggcagagactagaaggggcttctaggaatcaggcaaagtgctggctacagaggttccccaagaccaggccccaaatctggcacaaagagggcttgagagtggaccaacttggctggtgggtgggctcagtgcaaggatatatggtggggaactaggggtagaacatcagactcagtgcagtggagggaactgagaggagctggactagaggtggggtcaaataaggcggatctggttggaaggctgagaacagactaccccggggtcagaggccagacctggaagaggctaaagtccagtgagaccataaggacatggtggccccgccggccacctggttcctcctgcaactccagccgcagatcgtgccaccggccatcactgacagtcacctggtccagaaggagatgggaagcacggcccgagcccctggtcactgtcacagacagtaacccccgatctagctgtgggcagagatgcatagccctggggttagagccccatgtgggctgggacttggaggtgagatcagagggctcagaggtcaggaatatcagaggtcagaacagtggggtcaaggttatacctggcacaaagggcactgtgccaggggacatcatgttgctgatatggggtcagggggcagaggataggaccaggtgttgtgggtgggttggtgcagcttgcataagagagagctatgctggagccctgcacctgcagaggatataatgatggaaagagaatcaagggctagggtccagagcagggtcaagtgtggttgggacacctggcagaaaagtatgctgtgtgaccaacctgaacccacaagaatgtcagtggcggcctaagagactgagaactgagggtataggggtgagcagggtggacacacctggcaaaggagcgtgctgtgtggcccagcctgcacttgcatcaggaccccctgcgttgcccgtgtccgaaatgccagccccaggtaccatggcacagacacagccatgtcacttccaaagttccagctcagtgtgccgttgccacggaaatggtggggatgggccatagctgagtggataagagaaacagggttacagcccctgccccaggaacagatctgaccctgcaggcccctctgccccatgctgcccacttactaagctgacagtctttgccgccgaagcccacagggcagtcgcagctgaagctgccccagcgctccgagcagaagccactgttcttgcaggggcctgagtcacaaaagtgtagcttggcttggcagcctgggagaggaaagcacatggcggacatgagaacaagggttggggggcacaagtgctggacaggactttagtgtccagaggggctgaaagagaccaagatctcagccccatttcccattttctttcgatgagtggggttggtaagagtcaggccctaaaatctgggctgtagcatggtgcttgccaccaaaggagactggcttgaagtcaggtatggagtcctccacttcctccctatgatggggacagggccatgggctaggctggtggaagcttcaggcctacctgccatggtgccattatttgcgacaaaagccgccatgtccactcggcggccatcaatgtgcaggtcccgcatacagccgatgaagtccttatgggatacggggaagttctcggggaggttggggacacctcccagaagaagagggcccgtcaggtccagggacctggggatcaggggtctgggtcattggtgggactggggccagagtagagttgctcctggggggccacaggaagcaggggggtaggacccagagggtagggtgattgagggaggaaaataaggccgagctgtggaaggagttaggatcttacttcagttggggtgcaaaggggcacccgtgatgggccgatggtctggggaaaggtaggtgaatgggggttgagagctatgatgaaagaatgaggcatctggctggctggggaggggatggagacgtgaagactctgggggactggacatgagatgaagggactcggaggggatgtgggacattagtgagactggggtggggaggtggaggctttggaggactgcctggggactgtgtgtgggaggagggagtatggggtggaatacaggattgggggctagggtgagtaggctttcagggtctttgagaggagaggggaatcttggtggtttgggggaaagatgggagagtttggcaggatgggatgaggaatgggatgtgaagggttggagtgggctttggtaggcaggggacaaggggactagggggcaggggcctcacttcttggagcttgtttgcacaccagcagccgcgcatgagtagttgccaatctcagcaccaaactgcagagccacggccacatcacaatcatccacgcttagcacagccaccttgtccttggaggggccctgtgcaccccctagggcatctgtccggggctgaagacgcaggcacaccagtcaacagtgcccccagtaacccctgaggagcagaagtcagcatcccaactcccctcatacccgatgccagggatggcccccaccttgttgtagtatctcagatgcactgtatgccattgcccgtcactcaagccccctggaactgtggggctgaccacggtgttggattcacctggaggggagatgcatgtggaatcatcaggagcagcggagtcgccccatcccacccgtcatataagcacaaccattcccagggccaccctggatgcatcagatcagtccccccactggtgaccacaatggctggctcagagtgcctttgaacagacaggagaaacagacttcttggagggagggaccttcccacagggaatggccaaggagctaggtcttcagggcttgcatggcgtggagtgtgtgctcaggtgcacagtgaagcaaacctgaggggacttgggccctgcgtcctccagcacacacgcaccctttcgccgtcacatccggggcacccacccgtggaatatgtgagccgcacttggccagccacgagttccagggccaggaagtcgtgcttctcgttcaggcgcccgttgtagaagagcagcccgctctgctgcactgtcgcgaacctgggcggggtgggagggggttgcgggggtgggagcgtcaggagcagggtaccacttcacacccaccatccctgcgaggagaaggggctggggcgagagaggaagcgacgagggacggcgggaccgaccggggggacgcgggtgcagcgaggtcaggagaccccgggcggggcgtcaggggaggggcggtgtctcatggggatgccaggacggggcagtcaggaatctgagtcagggcgggtaggtgggggcggcggggaggcgctcagacacggggcgggcacctacgagagggacagcgtaaggtggaatcgctgccgcaggccgcgaaacatgacgaacgaactgggcgggaaggagcgcgcagccacctcgcagcgcgggccctcgaaggcgccgcctgccgggcactggcagcgaaagccgccgttgggcgcgtcggtgcaggtgcccccgttgcggcagacgcccggcacgcagcggccggcctcggtgtccagctcgcagtcctctcctgggggccaagccgcggtcagaggcggtcacgcccacgcccgcccctgctccggccccttcaaagaccgcgcgcccagaggccgggtgccaagacccccgaaaggtcgccctcttcggtggacacgccccttccgtctggccccgccccctccccagtctcatcgctgcctcggcggcggccccttccggccacgctctacggcttctggcctaagcgcgtccataccaggccgtggcctcagaagtgactcccagtactcactcgcattgtggtcccgcccccagccttggcccgtgcttcccccagctctggcccggcgccctgctcaccggtgaagcgcgggcggcagacgcacgtgtagcctccctcgcgccgcgcgcaggctccgccgttgcgacatgggttggagtagcagaggtcgagctcggtctcgcaaaagtctcccgtgaatccgggcgggcagcggcagcgcaggccagcgatgggctggatgggtcggaacagcgtggaggccgaggccaggaagggcgcggacgagtcaaagcggagcacggacacgcatttcatgtagttctcacagggctctcgcaggcacacgttgtcgtcgaagggcagtacgtcgagcagggagcgagccgccagcgccgcccggcgcacgtacaactgctcctgcagctcctcggagctgaaccagggccctgcagcgcccgccccggccccacgtggagctagcgccgagaaactcacattgagcacggtgccccctacgtctgtgtcgttctggatgttgaagatgaagacgtcctcagcgggcgtagcgagcaccgcagccacgccctcgaggaagcggcccagcagcggtgacaggaagcgctcctgccacatgttctcaaggcgcacggtcaggctgttggccagcaactcctccgtgatgatgaccacgcgcagcacacactgcgccgtcacgctgtgcaggccatctgcaggcgggggcaggggcagtggtcatcctggggacagtggccacccctccctgggacacaagagggctggggccagcgatagcctaggcccccagaacctctaagtcagcaggctgaccccaccaggacacaagggagtctggggctagtgaccaccagctcccccagcatcaaggtgtcaaaaagctgctgcttcctcccccaatccccaatacacggaggggtctgggccaaggatcaagcaaccccacacagtgcccatgggttagcaagtcactcccgcaacagcactcaagtaccctaagtactcagtaacccacacttccccaagttatcatggtcagcaggccaccccaactcaggacacagagaggagctagggccactggccactcattcccagccacctttcccttctcccctcctccagcatagcagaaccagcaaaacatccccctccagaaaagaagggttccagatcagggatcacctatctcctatttttggtcagcaaattgctcttccatgacactagaaggggccctggcccagtgaagactcaatgccatcctccagaatcctgggttatcaagctccaggggggtcttgaaccctgacatacacacacacacacacacaccagcattcttgagttagcagcctgctcgccactccagacctgggtcctgtggtttcacagtgaccaccccagagatgaaggtgaggtgcttagctgccttgttcgtcttgtccccacaccctagcacatactgggtggtcaataaggatagactgttgagtgagttgagggataaatgaaggttgtgccttctcaggcagtgccaggagtccctgctccagaactgaggaatgagcaccagtgaagcctatttcccaacctctgcagcctccagtaggcagaacttcaagagcctctcccacctgcactctcctattatggaggggtttctgaaagactggagcagatggggcaggaaagaggcaagtggacctctggacattttcccaaaggtcagggtctcaggccctacgaagccactgtccacctgaagcttccatagtaagctgctgttcctgaccactcaagtattggtcatttcctgcacagatagggtaagcgtcagactggacccaaagtaacccttcgtctgaacatgggcatagtgtggactgactggcccatactggctttgcctaggacctccagaggattaccccaggacctctgaccttttatcaggaggggagatatccctaggtagcagacagttctttacaggctttatggggtctgctagatgccttggaatcactgggattctgtggagattatccaggaacctaagcagagtccttgtgaggtctgtggcagatcttgtagggtgcaggaaccctacccttaaggggttcttggaaggcttagaaatccctctttggtttgaggtgccctgtggagtccctgaggcccaacaggttggtgtcactgggtcacttgcctgccccctgcccctcacctgtgacagtcaccaacatggaggccaccagtgggcggttattgtctagctttcggctgagtcgcagctccccactggtctggttgactaccagcagctgcagctcattgccacgctcaaaggagtagaagaggtggtcggagacatcggggtcataagctgggatgcgcccaataatgcccgacgggaaggtgtctgaacggttggatacatagttgttgaagaggatctggaagttgttgagcacagggctgttgtcattctggtcaaccaggcggacgtgcacagtggcccggctgaccaaaggagcagatgtggcctgcaccacaatcacatattcttggcgagcctcatagtctaggtcaatgagtgccgtcagttctccagagaagatgtccatttggaacagctcagggatgttcccctccacgatctggtacattatatgggcattggggccttcgtcagggtccactgcagtgatctgggccaccactgagcccacaatgctattctctttcacccgcacctcaaactcctcagctgggaagacaggtgcattgtcgttcacatcctgcaccatcacctggatactgactggagtccggagtgggggcacacctctgtccactgcgtaggcagtcaactcatacactgatactgcctcccggtctagccgccttactgtacggacaattccagaggtgggctcaatggtaaaatctccatccccatcttcaccattctggaaagtgtactggacccggccattggcatgagcatcccggtcagtggctgagatctgcaggacactggtgaaaggtggggcatcctcagagaccagccctgtatagtgggaggccacaaattgtggagcattgtcattcacgtcattgaccatcacctccacataagtagtgtctgccttctgtgggatgccattgtcccgagctgtgatagccagggtgtaggtcacctggtcctcatagtctaatggggcctgtaatgtaatggctcctgagtctgcatcaatgcggaactggggcaggttgtcctccaggagataggtgatacgagcattctcacccacgtcatcatcagaggcactgatgaccactatggtgctacccattggccgatcttcattcacactcactgagtagtgggcactttgaaagaccggccgatgagtgttggcatctgtgatgttgatgtgcacatagcagtgatcatgaagggcacggtcagatgcagttagtaccagcttgaagtagcgttcctgcttgtagtccagtggcagagccagagtcaccagacccacacccccctgggtgctgatggcaaagcgattccgggtgttgccgcctgtgatctggtagctgatggcactgttggcatcacggtctactgcggtcacgctgaccacactggtgcccacagctgcatcctcattcagtcgtaggtggtactccttcattgtgaactcaggccgattgtcattaacgtccagcacagtcacggtgacactggctgaggcagagagtgggggtgagccatggtctcgagcctccacaccaaagaagtaatgctccacagactcacggtccaggggaccactcacagagacccagccagtggcgctgtttatcacaaaaggagtatcaggtgccacaccagttagggagtactccaatctggcattctccccatggtctgcatcgactgcctgaatgtggatgactgagtgacccaagggagcattttccaagacagaaacttggaagggcgtgctgacaaaaataggaatgtggtcattgatgtccaccacctggatgctggccaggcccgtgttgttggacagcggtggccggccagcatcctgcgccctgatgcgcaaggcatactctctctctgcctcgaagtccagaggtgccaccacctggatctcgccagtgaggctgtcgatggcaaagtgtccacggctattgccactgatgatgttgtagtgcaccaatccgttggcgtccttgtcccggtcagtggccgtgacgcgcagcacgactgtgtgggggcgcacatcctcgcgcacctgcgccacgtagcgcttctcgctgaactgaggagcattgtcgttctcgtctagcacagttatgtgtacgcgcacagtggccgagcgcggcccgggttcctggccctggtcgctggcttccaccaccagctcatagctttccatgtgctcgcggtccactcggccgctggtgctgatgaggccggagcgtggatcaatctcgaaggcggcggcagctgcagcgcgcgcagctggcggccccacgaagcggtagcgcaggttggcgttggggggcgcgtcgccgtcagtggcacgcagctgcaggatagggtagccctcctccacattctcgcgaagggtctcccggtactgcgcttgctcaaaaaccggcgagtggtcgttgcggtcggctactgtcacggccaccatcgtggtggccgagaggcgcggcgacccgtggtcctgcgcggtcacacgcaggtagtgacgctccatgctctcgcggtccagagctgccgccgtacggataaggccgctctgcgggtcgatgctgaacagctccagcgagcggctgttcatgagtgccgccagcgagtagactaggcgcccggcctcgccggcgtccgggtcctgagcaaccacgcgtagcaccgcggtgcctgctgcctcattctccggcaccagcgtctggtagttgtactgcggaaactgcgggtggcggtttgcggcgcgacgaaagcgtgcccggttcgccgaggttactttcctggcttcaggacgggccgggagtcccgggggacgcggcccggggcgctgcgggaggaagcggcagcggaagagaccccgggagcgcatgcgcttgggcgccggctcgggagctgtccgagactcgcggggtgctgaacctgatgcaggagctgtcctcgccgtgcgtggtgctgaatccagctcggggccagatcccgaggcccctggaagacagttccgccggggggctgtcctttctgctccggatgtcgtggctctctcgccctgacccttgctccctgttgcccataattccccacagcagcgcgcggtgcccactcttttgcgggagcctgtcccagcgttccgctgggaggacaccggcttgggaccgtggtgccgaatcaaaaagtctgaagggaggggcgagctgttccccgagcccgggacccctgaggacagagcccctggtgacagactacctctttgcaaaggtcctgtccgcccgcaagaggagacctctgggcgccagtataacacagaccctggtccctgtcctgtctctcgttcgcggctgcccaatggctggacgccgtgttcaatccccagctcctcattcggctgctcagggggccctcgactattccgggcgctttgccttctccctcggagccccacgaagataggctccctgacccccaggccaggccccccatcctcccggaccccggaagactccggacaaagagctaaggctccgccaccgatatgcgcccttggccccgtagtggcagctaagcctgggtcccagccctggtgcccaccgccccccagctcctcctggctgagggggaacaaagagaggagaaggagcaggagtatgggggtcgaccgtcccccgaggccccgccacggcggccgcctcgccatcatcccccgcctccctgcacggcctccaccgccccccgccccggtccgggccttgggctggccccgccgctcgggccccctcccgggcccctgccgccgccccgggcccccgcccctccgcctgtctctccgcacccccgccgccctctgggcaccatctactccgcggccggagcccctccggcgtgcggccctggctttttccgcccccaccacagcatccccgacgctgctgccgcctcccgccgctccaacatggctcccggccgccccgatggttcgct

SEQ ID NO: 1489 - DNA, 8125 bp, Homo sapiens
gttgagcagacaaatctttattcctgaggctaaaatatgcaccagttccctccctgtaccgcgccactgccagcctgactgcatgcaggccctgtcccagacctggagcgctgaacttggagtcccaggacctccttccctgagttgtgtgtgtgtacatggaggggactcctgggtagcacctggaggcggcctaggggtgaggggcttctcaagggtgccctgcacctccagaggtgcagtcttgggcaggatgtagcatgttcagagtctggtgacctgagcaggcagaggaggggaggctctagtcagtttccaaaggacacagaccaacccccgcccctagaacagctttatccaaagacagcggagaaagcactgggcccactggggacagagccatggccaccaggaaagactccctggagctggggccagggtggggacaagcaatagattaacaaaaaagagcttggcaggccagaggtaggctcaccgaaacagggctgtcggggacaggcctcgggtgttggagggcaaaggtgacagcatcatggacagaggcaaagagatgcttcttggtgatggatgcatcgaagaagtgcccagcctcaagctggctgaccacagggcctgtgggcaagaagtaggcctcccctgactctcagaacctctaggaactcaactcccgggagccaacagaatgccctgacctcatcacccctgacctccacccctgaggctacagctgaatccacatcacttgtaaccctggactcctgtctcccaggacacctctgacctccagttccagagaaagactttttccttgtgctacttggaaaaccccttggccaaaagtatcctaccctcttcccaggtccctcctgctgttcccaccctactcactgtggcaggccgccatgtacacctccacctcaatctcccggaagtcatggaaaatctgtagcggaaaagggggccagcctcagagggaggctcagggactcagaggggggctcgggcaggcttggggagggagtttagaaggggagctttgagggtttggggagtcagaggctgggagtgctctcagggcaaattacagggtcagtgtggaagctcgaggggccttggcctgcccccgtccttacattcttcaggctcttgaggcacacagtgtccacaaaggagagggcacccaggtccaggatgaggctgtggaagtctggctgaggcaggcccagggccttcagtgtggacccatctggggccttggagtcttcttgaccattggctgttgcatcttccatcttatctcctgagctcacctgctggggagccagacatgctgccagggccacccatgagagagtgaaggcaggactggccgcacacagacacgcgagaacacgcaaggtcagatggggagcatgcatgggacacataaggacacaaacatgcgggagtcacataggtgtgcaaagacaggaatgacagatgtgtggggacatgcaggagggcacacccagatgtgcatatactgctctgctacctcctgggccgacgctgcacagggacacgagaagggagtccctgtcccattctcatcagccagggctgagtggggagggggcccaggagcaggccagaatagacacgggcatccacatgaaacgcatgcagacacctcggcaccctgccctgtctcagtctctaattaagtttggcatcctctttgacccctcaattttttttttagagacggggtctcgcttcattgcccaggctgaatgcagtggttattcacaggcaccattagagcgcactgcagccccgagctcctgggctcaaatgattttcccgccttagcctcccgaagagctgggactacaggcgcgtaccaccacgcctgcctttgaccccttgattttctcccatataccccatccctttcctctacccatgagcagactctgggggaagtcttgtgggatctacaaattcaaggtcttcatctaggcctgagaatctaagcctagattctgtggcatatcacgacgctccctgaagaatatctgacccagcctccccactcctcctgccatcggcgcaacaccctcgagcccacagctgctgggtccatggcattcctcatgagacatgtggatcctgcatctctgcagctcacagctgtcacctcctttcccacctccagtctcaccatcatcttgcagtcctcaacgttgttgctcctcatgtcttcaaggctggtgttgacattaatggaaactgaggcgcccttgggggaggcagcctacaccagggaagacagggaatgggaaacagctagcccggctgccatgacagccatgtcacataggcctggtgatgccccctggtgctgggcaggtgggtgggccaggaccagaagctgtgggacctgcagcagccaggctgaagctcctggaacagccgtgaaagggaagaggactgtgacggttctcactgtcactggttcagatgatgggagagaaaatgctgcctagagcccggacctgctaggggagtgaagcagggtccctgggagcatgagggagaaaggggaagggatgaggagtgaggacgagggaggagtcgggggccaggagaaaggctggggcagggaacagggggcaggagatgggggtcaccagacaaaaggggccctgcctgtttccgaagcttctcctctttctgcagttgcttcagcttcagctgctcctgcttcttgagcagtttcttcttctgggagatgaggaagtcgacatccacaccacactggaggcaaacatcagagaagggttggtgagctctctgggagctggggcctgacacccatcctggggactccgtctcaccctctgcttcagcgcatcactgtagaactcagcattggcaaagtacacggtggccgaggagcggaagaccttcaccccccggacttccttggcctggggatgaggcagaactggtggtggctgaatctcctctctcctggctgcatcctgttctcctgcctttccttccctagtgtgcccagtgcctgccaccgcccagccctctgctccccaggctgcagtccaggccctcccaggggcttaggccacaagcccgacggtgtcatccccatccccccacagtgcctctccctccccacctctcctgccaccacccaggcaggcttcacaggctcttaacctttctcttgggtttccaacccctgccttgtgttctgttttctgcacccagacagaggtcctcctaggctgtcatatcaatcagaccttccccgctcccaccccattcgggtcacagcccgggtctctgctgggctccaggcatgcatggtaagggctgggctgccccctcatcctctcccatgtctcagaccccttaattcctccccgcactgcctaattgcactgtgcccatgttgcaggcaacagccttgttttattccagagccccccacctatgttcctagcacttggcccaagacctctcaggagataaatggatgactgaggacttagtaaccccactgatcagatcaggaaatgcctcccttccaacctggcgccccagggagctgccattccggctctctgacccacggctgctctgcaggtggagcttgtgctgttgactccacgacagacccctccccagccccagacccatctctgtccactctccctctgtcccttcatacctctagagggggtcatagacctaaactcctcccttgaaatcccaaagaccaaagccaaagtatcctcagcccccagttccctggccaagtgtggaacgaatccacaaaggctcattcttcctccgtctccccatccacaccatctcactcagcccctgacactcacctctgagtactctgccacatctctgtaaatatccgtgtctggcacctgccccaggacagagtagtggggcctgtgaaggagagagagaatgcacgaagagggggcagaaaaaggggataacagaggggtccgaaggagcctgaagtccccagagatgtggggaaagctgcggggagccctgtggtactctctcactagctggaatgaggggaccaacatggcggactcacatctgtgtccggaccaccacgagcagcagggagaagatgaccgcaaccaccaagccaaggtccaggttcagcaagatggtggccgtgaaggtcaccagccagataagctgagaacagagggcagcggttggagggcggcgaggagccatggggctgcccagtccctgccctgggctcccagtgcactcaccagatccgcccgattggccttccagagggagcgcatgtcgctgagctgcctcagcatgcccttcaggttcacaatgatgatggctgccaggaccgcctggggtggggacagtgccaccaggggccattgagggcacccgatgctgacaaccctcctcaccgaggcaaagccagactaagcccaagcactcaggcagtaccccagacacaaacccccacccagcccctgacccttgtctccaaatctcaccttgaagatctcagccttgaaaaacagaacctaaccttgtgtccccacccctcgcctgaacctagactggctgatttgagagccctggcctggccaagacctgaaacctggctgggtgggggctcaccttgggcaggtcatggaagagttccccaagtttgacaatgatgaggaggatgaaaagggaagagatggctccagcaacctgttcggggagggagtgagcaggggagagacctccttccccaggcaaagcaatgtgcatgcccacacccatgcccacacccaaagcccacctgcgagttgcccccggtgctctcctgtaccaggctccgagacatagagcaactcacggggaagcactggaagatgcctccgataaggttactgaggcccagggccaccagctcctgacgggggacagtacgggtgtgagaagacttcctagaagtggctggtcactgttccactgtatctaggcctgtgcatccccaatctccatccccaccaagtggcccccagagactggatgctgtcccacacgtcctgctctcccaccctcagtcccccacgtggcctcagcacatctgctgtctccctgtgtcccaccggttcctcccccacccgttgctggcgcctccatacacttggatgcctcctacacatcccgcatcacccagacctggttgctgtccacccggtagccgtgcctcagggcgaagatcttccccagtgagatggcaatggcaaacccaaccacagcgatggtgaaggcgctgcccacgagctttgagaacagctgggtgttgggggccactgggggcaccagcctgtgagaggtatctgtgaggccaaagcaaggtcctgtcctggctgcccaaccctccctgacctgatggaggccagagctcaccctgcagggatgttgcccacgacatctacctcaaatctgtgctttagacccatgccataggagatgcctgtggccccgatgagctgtgggagaggacagagtcagggaggcaggtgctggcaccatggtcagggggacacataaaccactgtgaggtgaggagggagatactgggcaaaaccttcttcgagggtgggaaaaagtcacgtagggtgagagacaggcaacaccatttcggctatggggagatgctgtcaggggcaggaagaaaccaacataggggctttctgctgtgccccccacaatacccaagaaccctcccagcccccctccagctggccctcaaatacaggaggctgcccacgtggcaaggacccagcctgacctgcccttctcccctgccctccactccctggccctcgaaccgtgagcagctccccgggtatcggcatgggcagctgctgctgcagcttgtcattcaacagcttcaccaccacgagcaccaccccagccacagctgcagtgaccacggtgccaaccttgctctggggcagcttccagcagacctccagcactgtctgaggagaggccaggtcacagctagcactcaaggccatggggcacacctacccctccctccccctaccctcactcacatagatgagggacagtggcccagagtggctgctcagatggaggccaaacacatacttgagctgtgagacgaagacctgcacagctgcagctgtggtatagcctcggacaagaggttctgacaggtaggtgaccacgaagccgaagtggatcaggcccagccccacctgtggggcggccaggggcagtcaggagaggcaggggtcctggggttgctaatgaggagcgcagggcaagtgggatgggagggggatgagtagacggcaagaggaggacgacgatggtcagacactcaggggagtacagacaggacagtggcgggagcagaagtggtggtggggggcacatactcctgactgttccacacctggaagaggccaaccaggacactgagtgtggaggccacctgtacccgggcagcatctctggctgtctcattgatcatggagtcgttcaaggcctgcggggccagggattctgtcacactgcccaccatcacagacatgacagcaaaggtccctgtaaggacggcacggggcaggtctgaagaggagaggacactgccctgccctggagccctggtcttaagagagaggccaggagacttccagttctggataaatgtactcagattatggctgcatgaacagggacagtgctggcggttcaggtttggccaggccaggagtaaaccctgagctcacaggcccttaagcatggctagaaatgctggccctgtctcatctaccctgtcccacctgtgtctactggtcccgggacacagaggctctctgtggagtagggaaggggtcagggctggccttaggctgctcaggcctctgccaagttccaggccccttgggctgcctcacccactctcatcttcctggagccagggctttgaggtcacctgcctctgtggtcctacagtcaggggtctagtcctgcctggggatgactcgtgggctagcccagggatgcagcaccaatgctgccctcttccccagccgctcctgccctgctcagtgccccctcaccctgccctccatgatggatgtgggcatcctcctggaaggctaggcctgcctccacttacccacggagatgtgccgggaagtgccaaacaggaagtagatgaagacagggtagaaggagctatagaggccaaacacggggggcaatccagccaggagggcgtaggccaagcctaggggtagaatggtagcagtgcaggcctggagagcagatcttgaaacgataagggaatcccagccctgggttaggtgccatagttccaaggtagaggtcatggccccagttttgggcatcacagaccacagggtttccaggccgacgcactgaaggtggctcaccctgcggaagctgcatgatggccacactcaggccggataacaggtcacccaggagccagtcacgcacaggataccggggtaaccagaccaaaaccgggaggtgttggagcagaagggcataggcccgagcacgggagcacctagggacatgatatgaggggtaggtgtcaggaacaggggctacctgggccccgccagcgcccccaggccccaatcttggccttactgcaaccaggtccgccactggtgggtcctaggtgctgagccccagcgccccagctcctccaaatgctcctggttcagcagcggccgttccatgtggtagtctcgcctccgcaggtccattgcttgtgttgcagacagcagtgcctgtgtgtccctcggtctggggtggcaagaccagagagacacagtgaaggcatccctggcccaacctcccctacacctccacctaggaccagagagttacctacctgatttttccaggccctaagatcaaggtacagtattccagcccccagctggcatctgtgggccacatgtccaaactcagacaggggcagtacctgaactttggctggtgagaaagcctcttt

SEQ ID NO: 1490 - DNA, 916 bp, Homo sapiens
gtcacccactctgggtggaagtcccctttatttggatttgccgctgggtggctagatgacgtaggtggccttcgatgtggaccaggagggcatccagcatgtgcaggaccccacggagcagggtgtggtctgagattggggcccgccgtttccagggtccgcagggctcagtggtcacctgcggatgctgagaccaggaccaagaggcaggagtgagaatggtgggcagagagggagatgtgacaaggggcagtgatggagctggggagcagggagtagggtgtggggcagtgcccagatgggatgggagggagactcagggtgatagaggatcaccgagggtctgttgtgggctacagtggtcatggggcccacaggggctggatgagagcaggggtactaaaggggagagttgggggcagggtgctggctgtgggtggtggacatgggttccacgaaggtgtgtggacacagggacaatgggctgtgagctgggggtgggggtgtgggaggtccacaggccagtgtggacccatggggcagggttgggtggaagacgggctcactgagcgtacgtatattgaggcaggggctgtgggggagaaagaagagctgtgctcacctcacccttggtggcctgtgagcgccgccgcccctgcagtatcttgcggcagatcatcagcatcgtggtggtgatcatgaccgcagccacggggtagatgcggcttgctccagggcccagccagtagccaggacagctcaggccacccctacagccctccacactctttggctgacacccccagggctgcaagtccagccccacctggtaccagaggggtctcgaccaggcgtgggtggaggcagacgtcaccagcaggagcagcaaaggcagcgaggccagcacatgcagcat

SEQ ID NO: 1491 - DNA, 9772 bp, Homo sapiens; identical to SEQ ID NO: 1487

SEQ ID NO: 1492 - DNA, 9772 bp, Homo sapiens; identical to SEQ ID NO: 1487

SEQ ID NO: 1493 - DNA, 52437 bp, Homo sapiens
tatggcatgctgtcacaaagtaatgctgctgctggacaccgcgggcggcgccgcccgccacagccgggtccggcgggccgccctgcgcctcctcacctatctgagttgccgattcggcctggccagggtccactgggccttcaagttctttgactcgcagggggcgcggagccggccgtcccgcgtgtctgacttccgcgagctggggtcccgctcgtgggaggactttgaggaggagctggaggccaggctcgaggatcgcgcccacctgcccggcccggcgcccagggccacccacacgcacggcgccctgatggagacgctgctagactaccagtgggaccggcccgagatcacgtcgcccacgaagccgatcctgcggagcagcgggaggagactgctggacgtggagagcgaggccaaggaggccgaggccgcgctcgggggcttggtgaacgccgtcttcctcctggccccctgtccgcactcgcagagggagctgctgcagttcgtgtctgggtgcgaggcccaggcccagcgcctgccgcccacccctaagcaggtgatggagaagttgttgcccaagagagtccgggaagtcatggtcgcccgaaaaatcaccttctactgggtggataccaccgaatggtctaaggtaaggaaggttactgtcgtctcagatggcgtgcacggtgctttccttgctaaccagaacttggcagcgtccttagaacagccacagaccccgaatgagactaatatgactatgcgtcccttcggaaggaaacaaataaataggaacagttttcacaacaaaatgggtagttcctcactacctactgtttaagacccctcacaatttgggccctacctgccttcccagacttgattttcctacacactacatctactctagcatattgaagtccagtccagaaaatcaacaggtctggactgcttgttttgtgttatgtgtgttgttcaatctgcctggaatgccagttctcactcttccaggccagtcttaacttcacttaccctttaaggcttcttctcccagtgacaactgctcagtccagcgtctgaattgccatacacattttgtgtggcacttaaccatttctccatatgttttgattatgcacatctctcaccctccatctagtctaaaaatacctcagaggcaagcagcaggttttaacacaatacccaggggtgtgtgtgtatgtgtgtgtgtatatatatatatatatatatatatatatatatatatatacacacacacacatatatatacacatttatttatatacatatatatatttatttattattattttttgagacagtgtatgtcgcccaggctggaatgcagtggctcactgcaacctccacccctccgggttcaagcgattctcatgcctcagcctcccaagtagctgagactacaggcccacgccaccatgcctggctaatttttttgtattttcagtggagaccaggttccatgctgcccaggctggtctcaaactctggcctcaggcaatccgcctgccttggcctcccgaagtgccaggattataggtgtgagccaccacgcccagccacccagatgtgtattaaacgttgtaggtgttcagtcagtattggctgactaaatgagtacattcttgcgtacattcttgcaaacttaaagtcttaaatggctaatttggatttttgctgaggcggtgaggccccctgctcctgttaagtgctaggataagtatatacttttgccttcatccttctcattgcacttcatttagtcaacaaatgttcattgagaagccagtaacatctgagtgcctaccacactgtttgagctgctggggacatggtaaccaaagcagggaacagattaaacagataagcaagtgacaatttcaaatcatgctctggagaaaataaaatggggtgagaggatgggagtagaaggtggttattgtatacagagtggtagtgagggaaggcctttttttttttttttttttttttttttgagacagagtctcgctttgtcacccaggctggagtgcagtggcgtgatctcggctcactgcaaccttcacctcctgggttcaagcaattctcctgcctcagcctcccaagtagctgggattataagcgggcgccaccaggcctggctaatttttttgtatttttagtagagacggagtttcaccatgctacccaccctggtctcaaactcctgagctcaggcagtccgccaacctcagcctcccaaagtgctaggattacaggcatgagccaccgtgcctggcagggaaggcctttttgagcagagaattgaatggtgaaggaggaggaactcaaaggtaggtaaagaacattccaggtgaggagacaagcaggtgtaaggatttcagctggaaatgaacttagtttgtttcagaaacaaaaaggcaaggagtgctgagacctagtaggcaaggggagcagtgtgagagaaagtcagaaagcaggagaggccgatctgtagggccaaggtcaaaaatgtggattttgttctaattaattaatgggaaggctttggaatgtggtttaaccaagtgaaagatgtgattccacttaatggaaatacatgtcactaacccaggagtgagttaaattgcaagattacagatggaaaatgagcaagcatttaaataataatatggtatgttaaaattttcaaagtgctttcacatgcgaagcccaaaaaaggcgtggcaaatgcaaaataaggcagcagtggtttgtcaagaaaaggaagggacaaaaagtgtttaaggggatggtaaacatttgatggggaaaatgaaatcctagatatattaaaatttaaggcagccagtcaagccttagacacagtatacaacacattgctcagctggaaacaattgatatcacatcaaagactttcttctggaattttattatgttaaatactggctagaaataagttagatggggcttgatggatcttggagattctttgtctctctttttttctctttaatctctctctctctttttttttttgaatagcattgaaataagtgggttgactggatctttttaaagatcccttccaggtctgatgtaccgtcgactgaggggatgggtcatctctgaggcttcccttcttacatcggctgtatcccctaagaaaatgcccatcagatactcaagtttttctggaattttcttctgctgaagatctatcattttctattcaaaaacctgcccagccatgctgggcaaaaggaaggtttgggctgtgtccttggggagtgctctgtccaggagcagggagaagggaggaagagaaaatccaggtcctgccttggggagcgtgcagtctgggaagtagaactgggagaaacagaacctgcacttacattggaggcagagggatccaagcgcataaaacaggatatcatatttgcaaagatataggacagaatggaggataagagacctctgacacattttcaactttatgccttagatttattcaatacatatttgttccatacctgccaggtatgctaaggaatcaaatagatgtggtccctgccctcttggagcttatagtctagtggacatttacagatccccaaatttgaaactaccactaggacatgtctgtcacttatcctataatacgcatacgagtgaaaaatgtgaccatactctatagtatactgtttgtatttttgtttttgttttgtttgagacagagtcttgctctgtcgcccaggctggagtgcagtggcgcaatctcggctcactgcaacctccgcctcctgggttcaagtgattctcctgcctcagcctcccgagtagctgggattacaggcgcttgccaccacgcctggctaatttttgtatttttagtagagacagggtttcaccatgtttgctaggctcgtctcgaactcctggcctcaagtgatccacccacctcggcctcccaaagtgctgggattacaggctgttatttttttttaatcacatgttttgctatggtttgaatatttgtcccctccaaaactcatggagtaatgggtgtcatgggagtgggattggtggctttataaaaagaggaagaaagtgttgagctcacttgctgagcctcatcgccctgctttgccctgtgctgccttgggactctgcagagtccccaccagcaagaaggcctttgcaaagtacaaccccctggccttggacttctcagcctccataactgtaagaaatacattccttttctttataaattacccagtttcagctattctgttgtaagcaacattaagcagactacgccatgcacacattacctttaatagaaacttaaggtccttttcaacacttattaaagttacatcttcccacccacctcccgagacagagtttcactcttttcacctacgctggagtgcagtggtacaatctgggctcaatgcaacctccacctcccaggttcaagtgattctcctgcatcagcctccctggtagctgggattacaggcacccaccaccacacccagctaatttttgtatttttagtagagatgggttttcaccatgttggccaggctggtcttgaactcctgacctcaggtgatccacctgccttgtggatcaaagtgaggggtgttgggattacaggcgtcagccaccacaaccggccataaagttacatcttaacctttcattttattaacagggtttttttgtttgttttcctggctggtcttctggctgaaacaatttcaacaaaatttttgtgtccatttggcagaaaatcctaatcaggatctatggcgtctgaactaggttaccattctctccatagcagtgaacacagatatagatacatgggtggtaacatcacatactaattaattggttaatctaatacagcattttccagattgatattcatgactgaaaagtttagatagattagaagataatgtgctccaatacattgtttatcttcattacatgggatcttttttttgtttgtttttaatgctgatcataaaccactcaatccatcagagaatctatcaaagtccgtcagatggtcatgatccgaattttaaaagcagtctaggccaggcctagtggcttatacctgtaaccccagctttggaaggctgagacaggaggatctcttgcacccaggagtttgagaccaacctgggcaacatggtgagaccccatctctacaaaaaatacaaaagttagccaggtgtggtggcacatgcctgtactcccagctacttactcaggaggctggggcgagaggattgcttgagtccagaaagttaaggctgcagtgagccatgttcataccactgcactccagcctgggcaacagagcaagatcctgtctcaaaaaataaaaataaatgaaagcagtctattcagaacagtcctgggttcttggacttgtctatcattgccttgctgggaccatggacgattccctgcttgtctttgaacttgactacaatgggaagtttgggaatgacctagttgactttcgagacccttctagttctgattcctaacattcacatagcaattataatttataattgttacccggcatgatgagcatattctaaggggtgtgctccttcatattcccatagtagctgaatattgttgttatactgtgatgccacgttaaacattttatgttggtactgttttattcacaccccccgccccacttcgagatcctagacatggcacatagaagttactcaataaaagtttgttgacagaaggttgactgaagagtcagctgtgtgtgaaggagtgaagcagggcttttacaaagaaagcaggatttgagccagatacagaagcgtaataaccattcagttggtgaagaaagaaggggaggcccaggaaatagaaatcagcaaaaacagggaagccttaaaatatggcatgttcaggaaatagcaaatggttcaatatgcctagaaggagtgggggtggatgaggggtagaagataatgtgttccaaaaggtggtttagggttggcttgtgaagggctttgtgattatgctgaagagttactttattctggaggcagtgggaagcctttcagaatttcagagaagtagcgtgaccagagaagtgatttggaagaatacttagagcaccatggaggaacgattagaggcagagcacagactttacaggctatggtaacagttagggcaaaagatgccacgaggcctcggtttgtctcgtctctgcacaggcctgtgggtgggcaagtcagagtgatggtcaccgtctgggggaggtgctcctgcctcactcccatgacacctggccattattgtgttgtgctgtataggacataattatttttattaataggccaggcacagtggctgttgcctgtagtcctagaactttgggaggctgaggcaggcagatcacttgaggtcaggagtttgagaccagcctggccaacatggtgaaacctcgtctctactaaaaatacaacaattaggcgggcatggtggcgcatttctgtaatcccagctacttgtgaggctgaggcaagagaatcgcttgaacctgagaggtggaggttcctgtgagccgagatcatgccactgccctccagcctgggtgacagatcaagactctgactcaaaaaaaaaaaaaaaaaggttatttttattaatgtataatggttctatgttccttctaacattttatgatctatacccagtgatttgtgtcacttctttctgttccttgacaaaaaatataaatgaggtactatttttactaaatgaatgctttctcaaagggatataaggtagtaatttgttctggggctgcacagtagcttgatgctgaccattatttctatttagctcagcaaatacattggttgtgtaattcgatcctttaatattggtatcaactttactttctcctgatttcctttacttttatttgtgaatgcctaatttatagtaacctaaggttgtttgtcgttttattttagttgtgggaatccccagaccaccttggatactggactgtttgtgaactgctccaccacggaggtggcactgtcttgccatctgaatctttcagctgggattttgctcaagctggggaaatgctgctcaggagtggaataaagctgtcaagtgaacctcatctttctccgtggatttcaatgctgccaactgatgccactttaaaccgtttgctctacaattctcctgagtatgaggcctcgtttccacgaatggaaggaatgttatttctccctgttgaaggtaagcaaataatattttaaggtttttttttttttaaatctcagttacattaatttcttcaaagaagcttttaacttctttggcatttctcacagcccaggcactcaacgaatgcttgtcatgaaagaattaaaagacatcaaggcaaaatcagagatactgtaggaaagagttgaactcttaattcagtacaactgccagcctttgtacaaaaaaacaagtgaatgattgattttaaagtttaccagctgttcccaaagaagggtaatattattcaggtgcccaagcacatgggtatacgatttcattgcctcatagagtagattgataaattgaagaccatagagaaacaatggtcgactaaaagaagaaataaattagtctacagaaacccagaatgatgcttgttaccaggaaaagcaaacatgttggaatcttcattacattagtttcaccatatgatttgctatatggtaaatctcatttctgaatatattgtatattcacagaaataatactttatagagatatgtacataaaactgttgtacattatgtgcagtttaaggaattttcaagagtagttttgtttatataatttcattacacagtctttagaatttaacctcctcataagatatgatgcactgtactttatggatttaagaagtggtgtcttctttcttataagtagtaaacattgcttgaatacttacttcttttttttttgagacaaggtcttgctttgtcacccaggctggagtgcagtggtacgatcatagctcagatcgcagctcactgagcctcgacttcctgggctcaagggatcctcccacctcagtctcccaagtagctgggactaaaggcatgagccaccacacctggctcatttttgtattttttgtagagatggggttttgccttgatgcccaggctggtcttcaactcatggacctcaagtgatcctctggccttggcctcccaaagtgctgagattgcaggcatgagccaccgtgcctggccttcaatacttatacttatttctaagtcataatttctgagaagttctgccatcacatattgcctttgtaactccatttgtttatagctttttctatagagctaaatgaacttgctatgatgacttggcagtagaataagtgttgaagtgttcaactaagtgacagtatctcaattgacaacttgattattttcttattgttattaaatctctttttagtatctattccttatattggaattttaatctttttttaaaattttaatttggcatcctggtctaattaatctttatttctagcaggcaaagagattcaagaaacatggacagtcaccctagagcccttggccatgcatcagagacattttcagaaaccagtcagaatttttctaaaaggctcagtggcccagtggtctctcccaacgagcagcactttgggcactgacagctggatgctaggaagtccagaggagagcacagcaactcaaaggctgttatttcagcagttggtaagcaggctgactgctgaagagttacacctggtaggtatcctccacacgggaagttattcttgtctaacaacacactggtaaagtgaaataagtgtgtttataaatgccctacacaatatagtcttagtaaaactgattatgcttttgcaaataatattgttgacattatagtatcatgacagcaatgcttattagagaagaaatcacttataaaattgcatgtaccaagaatccaattaagttaaattatattcacatagggaagaaggcagttggccagatgaagtgcttatgttagggtagtaatgtgatgagtgatttctcattgttttttaaatattctgttacatatttactacttttatataagtatttaagaaaaagctgctacacagtaaaattagatgtaatagtataatagttgtgtaactatatacaatgtaatataattgtctgtgtaactcagcagttggacagtagttacacaaatgtagaaatgtcttctgaaaaggaacatatacatacccagatttgatttaacggtgagaattatttttaaactaccagcaaattccttaccttactttgtcttttgccttcatactctcaggaggggtctctattctggttcccattgtaaaatattctagagaaaaatacggtagtcattggacagatgctgttctgagagttgtgtgctctgaggaaaagggcactgggtttgggagtcagtgatctggattaggtctcagctctgctgcctactgtatgttctggataaatcactcaagtggtatttctgcctcatggttaagtacatgggtttcaaagtcacatatgcttggcatcttctcttactaagtaggtggctttaacaggttacttctgcctcagcctcaatccctcctttataaaatggggataataattatttttacctcagggcgattgtgaggattcagtaagcacatagtaaatacctagtaaatattcctggtaatgtcaggttttacttatttgtaagtagaaatatgaggactctgtgattaataaattcccttctacctctattaatgatcaaatctatctttttcatagttttcacgttaataataattgggaaaatggttattctgtcttttagtacactacattcttctttaggcatattgacaataatattctcaactaattagggcttctcacgtaggttgctgatgtggaccctggtgaaggccggccccccatcactggagttatttccccactctctgccagtgctatgatcctcactgtgtgccgcaccaaggaggctgaatttcaacgacatgttctccaaacagctgtggctgacagcccccgggacacagcttcccttttctcagatgttgtggatagtatattgaatcagactcatgattcgcttgcagatactgcttctgctggtaagctcctaaactagtaactaacagagtctagggtggtttgcagtcttttcaagcatcgggactttttcactgtgcagttagtagaaccccaatatgttataacacagatgaaagaaagctataatacttcaggcagtttaaatcattattatttatagaattccttaagtacttctgaggaggctgcaggttccatgaaaccagtctgaaatcgaagtcatggtttttaatatatttaagaaatactgcatataaaactgtagtgattctgtctaccctgcattgcattgttactactagcattgcaactaaatgcattgttactactaaatctacctagcataaataaggtttgtatcatgttagtattacaaaccttatgtaagctaggtagatttaaatatacgtatacatatatatatatataaaatcaacttgatatttctttaattcattcattcattcaacagatttgagtacctgctgtatggcaggcactgtttgaagtactgggactatattagagaacaaaatggacaaagatgtcttcccatggagctgaccatctagtccagggagacaaaacaataagtcaggaaaattacggtttagtctaaagagacaaaaattgtagtagtaaagcagaaacaaaggaatggggtgtgttagggtagggagggttgcaattttaagtagggtggtcagggaaggccttgctgaaaaaatgatatttgagcaaaggcatgaaggaagtgatggcagggagttgctggtagaggcgacagcgagtgccaaggctcagaagggtgttagaggaatggcagggaagcctgtggctgcagtgaaaggagcaaggagagagtaggagggggtgaggtcagagagccagcagcagaccaaactgggcagggctttacaggcactgaaaagactttggcttttactgtgagtgagagaggaagcctttgggtgattttctgcagtgacaccatctgacttatgttttaacagcattactctggcttccatattgagatttgactatagaaaggcaaggatagaaccagtcagacatattacaataatccaggcaagagatggtgggaaatgtagggagttggaagtagttggagctcttggatatattttgaaggtaaagccaacaaaatttgctgttagattaaatgtgtagagtgagctgtagggaaattgaaagtgactccagagacttttgccctaagctactggtagaaagcagtttctttctgagatagggaaggctgtgggagaaccaggggctggggtggtgaggactggagggtttgttttgggcatggtaagtctgagttgttcattagacatccacacatggtattgagtaggcatcaactatgcatgtttgagtttgggagatttgtctggactagagatgatgggagtcatcagtgatgttttaaagccatgagatgggttaagatcaccatgggggtgggcgtagatgggaaagagaaggggactaaggactaacccctgcaccctaatgttaagcagtctggggaatgaggagagagaaaccagcaaaggagacaaaagggggacagtcgctgagttaaagaaaacccagattgtggtaccctggaagccaagtgaagacaggaaatgcttggctgggttatttactactgacaggccaaggaagatgaaggctgggagctgacattcaactgagcaatgtggatgctcgggataccatcacaacgtgatggttgtgatactagttttggtggaattgtgagggtagaagtgtgagtgggaatacgttcaggagggactgtgaaaagaggaaaacagcaagtgtggacaattttttggagtagttttgatctaaaagatattagagtaatgaaaacagtggctagagagggaagaagagtcaaggtttttggttttgatttttagaaataataatagcctgcttgcatgttgatgagataatatggtaaaaattaatgcaggggatggagagaattgctagttagagggctttgaggaagtgcaagtggaggggttggtcttgggaacaagcacagttcatctgtgacaactgggggaaggcaaaaatgtaagggctgggatgccaaggtgagtgatgttggtgtgagtgtacggggttctcttccgattgcttcagtttttttagtgagttaggaagtgacatcatcagctgaaaatgaagacttaaggagatgctggaggctgaggagagaggggaggaggaagtggctcttgagagggtgaagatagcaggaaggtggaggaagtttgccgggatagtcgtgaaggtaaagtgagatccctctgtgggcttgcctgcctccagccacattcaccagctggcacagctgcagagtaggcagggagctggattaaccagggttgggattttcccaaatgagggtggtaaagctagagaggggtcagggattcaaaagtgtgaacaggaagagattacaggatttgtccatggaacgaggcagggtaaggagggaagtgaggacaacggaaggacaggcgatcagatcaatgggttataggggtctcaggatttctggagccaatctgctcaaaggagagagctaaaaaataggtggaggtggtcagaatggggtgcttgagatcatagagggtggtgaccagggggagagagtgactgaaggagggcaacacgctggggcaccagaggtgaggaattcaaggggacaaaggccagagtgttggtagcatcaaatgtgtgtatggaagttatccagagttaagactgagtagtactggagagactgacggtggtgagtcgggagctaacagtctttgaggagtaagggggaatgatccaggcttgttagatgactatgagcgtgtagcctttgatgtgagactcaaagctggatttttgtcgttattttcagcaggtagagggaaaatgatctggaagaggcaaggaggataccagcccacctcagggccaagtggaaaaagagcatggcgggggaacagcaagctctctccagcgctgcaggggaagcagtgtgttcagggcaggaggagatggaattgaggacataggggattttgctgatgagggtcagtgagttccagagggcagggtgggaggattttacgtgtggaagggctaggctgtggtgccaggatgggagacggaaggagcagtgaggagattccagtgggcagactggagtgacctgggggtctagggcttcgcctgacgggaaaaagcagctatgaaggggagcatgagattgattcctgatggtttcaacgcagctaatggtgctgaacctgtgagtttggggggtaagaagggtgggtgtttggcccacccccactcctgcccatgtcggcgtggagactagaaggagggcatctaactccgagggcctagggctccctccaaagccctgcccaggcggccagtggagggtggccttgtttttagcatggggctcctgcttgacatttgctggaagaggtgcaggtaactctgaggggcactctctttccatgcagagggaggcttgagacttggaggcctgaggcaggtatttttggcctttctcccctaatccagcatacaacgacttgagaagaaatcatgtcatgtttattctcatagacctttactgcacttgtctgaattttgtaatataacagcaaatgcaattataggcatttatgctgtcctgtgatgtgaagtttcttttgcttgtttaaaaaattctacaaaatcttacactaaaaataatagctttgggaaaactacagttggggcagacttctcaaaatctttggtagtgataaaaactaagacaatcctgggtgtggggacacatgcctgtaatcccagctcctcaggatgctgaggcaggaagatcgcttgagcccaggagtccaagaccaacatagcaagaccctgtctcaattaaaaacaacaaaaaaaagtgcaatcctaataaaaattctagtttgattaaaagacacattaaatccataataagtaaagtccataataaatataccttgtcctttaaaagaaaggtgaagatggcatgatggaagggttgaggctgtggtattatggagacaggggccaatgacaaagatagggaactatatcataagcactttcaagaaagtgcacgtggccaaacagccaaggagaagaaaaggagaagaatacgggttgaaaggacgtagtgtacagcactgcgctcctctggcttgttgtatttagttatgtttgtgcactttgaattcagctgctacttggtggtataaaatattagcacattaggaatgatcacataaccaaagcaacgtaatattttgtactactgtcactaccttacttaccaattgtgtgtaggctatttgtagaaaattttgtattgtagaacagactgtatcttgactatttatatagtcttggaagcagctcagaaaactgtattttggaatctggtaaaggaagaactgcagtattttaccagtactctctgctgtagcatggcccacagtttcttccaggttataaatcagtgtgccggcttattgtccagtctccccaccatgctccatctgggtgaggtcctattcatgcattggtacctagcccaaatactgcattctccatgagaccttccttgcccatctagacggagttagcatgtgctaacatttatacgtatctccatgacttcacaagagtggatctactcttcctatactgggagctcctttcgaagtatgcattgtatttatctctgaattctttcactgatagaaagcctagaacttggttgtctcaataagtttgaatacattttaagtatttgggtttttttccccaagacttcattaatgtctaacatttcatttgtctggggtcttagatggatctctcagaattacagagttcactgaaatttctgttactgttcccccaaccacctcctccatcaggcttattttaagagagccttctaccctcacactccccaatacagagccacatcttcttatttccaattttcctactcagtgcagcagaactgtgatattctgcagttttgttactgtatatttattcttgtacaaagccaatttttgtgtgtgtgtgtgtgagacggagtctcgctcttgtcacccaggctggagtgcagtggcgtgatctcggctcactgcaacctcagcctcccgggttcaagcttctcctgcctgaacctcccgaatagctaggaatacaggcacctgccaccacgcccagctaatttttgtacttttagtagagacggggttttgccatgttggccaggctggtctcaaactcctgacctcaggtgatccacccacctcggcctcccaaaatgctgggattacaggcgtgagccaccgtacccaaccatacaaagccatttttaagaacaggaccaggcacggtggctcacacctgtaattccagcactttgggaggccaaggcaggcggatcacctgaagtcaggagttcgagaccagcctgaccaacatggagaaaccccgtctttactaaaaataaaaaatgagctgggtgtggtggcacgtgtctgtaatcccagctactcaggaggctgaggaaggaaaattgcttgaacccgggaggcggaggttgcggctcatgagccaagatcgtgctgttgcactccagcctgggcaagagcgaaactctgtctcaaaaaaataaataaataaaaagaagaacaatatatatttttaacctgtttagaggaacatttcagaaatgagaggatttatagccagtaataagaacaaaagactttaaattgtgtctgtatgtttttcagtagcattttttatttaccacataggcctgtagcagtttgtggtgccggagaacaaatgttaactgtgcactttgtatgtcctttggagggatgcagtcagtccaggggaggagcaagtgcttagaattctctgctttggttctcatgctgtttcctctcctgccgctgctcctttgctccaatagcttctcctgttccagagtgggcccagcaggagcttggccacaccactccctggagtccagctgttgtggaaaagtggtttcctttctgtaacatcagtggtgccagttccgatttgatggagtcatttgggtaaaacgtttttatatctcttgaatattgattattaaaatcaacgttcagttatctgcatttttttcttaacagaccacattctctgagtatagtctaataatattaaaaagtagttacaaaaataaaatactctcatacttaatatatattgtgagagtatgttagctagataatatgttaacaatatataaatatatacctgccaaaaattctttaaaatttaccaaagtaattcgtcaagttaaatataaataaatactcccttaaagtgagaaaatatttataactaagtatcaatgcaaatagaaaacagcaaacttgaataatgcagctgaatttatacttaaagaagtatttgcagaccgtttttgtaaggaaaaaagttaacaaccgattactaagaatccaacatgagaagtaaataagaaagtaacctccaccctacaaaagataacaacagaaataaatagaaaacaaataaatgtaagtgatcaagagaaacaaaagatggttctttgaaaagccaaataaaataatctatagcaagatcaagcaattaaaagacgaacaatattagaaatgtaaacgatatggcagaaattcaaactattattaagaggtatggttgacgtttattttctccacacatatatccattcagttgttccaacaccatttgctaaaagactatcttttcccactaataactgtggtaccttgtcaaaaatcaactggccacctttgtgcagattgatttctagacagaatacagtccagaaactatgttaataccacattatcttcaatattgcattatagcaataccatatactgtagctttatagcaccagtcactaaatcaggtagtgtaagtcctctaaactttggtttcgtttttttaaaatttttttggttattttagatacttcgcattttcatataaacttcagaaccagcttgtcagtttccacgcacacaaacatctgttgaaactctaggagtgcattgaatcatagataaatttgggaagaactgacatcttaacaatgttgagtcatccgatccatgaacatggtgcagctatccatttatttaggtctctctttaatctccctcagtgttttgtagtttttaatgtacaaatgtggcccatgttattttttaaaattatctctaagtatttttatgagatgtaaatattgaagagtttgaagatagtatgattgtctttatagaaaatccaggcccggcatggtggctcacacccgtaaccccagtactttgggaagccaagccagtgaatctcttgaggcctggggttcaagaccagcctgaccaacatggtgaaaccccgtctctactaaaaatacaaaaaaattagcccggcgtggtggcacatgtctgcagtcccagctacttgggaggctgaggcacaagattcacttgaatccaggacgcggaggttgcagccagccaagatcgcgccactgcactccaggatgggcgacagagcaccacacacttagggaggattaatctgcttcatattggctatatgaatgaagctgatagacccaacacatattccaccctgtgatatctgttcaactaatatcaccgtaactttcttgcactttttaatcagttatatcagataatggaaaatattaaaatacaaataacacattttgaatgttgtgccattttcataatttccttaatgacagatatttagctctaggtggaaaaggatttaataactaatcacccctcctgcctgccctacttcctcctcttctcatcaatcccaaattagtttattacaatgtgaaagaattattcgaagtcattgcaatacttactacaatgtgttaacatcattttgtactttgatatatggaaactgagtaaaaaataactatggaagcttgaagtgaaatagttgccataattagacttgcatcctaattcatgaagaatcctattaataaaagtcaatattatatgtaatggttaatggttttgtgaacaagacagctttggttcctgcattcgttcaaatcgaaaatgagaggagggacattttctctcctaagaaaatatatttttgaaggcatcttgtggggacatctttttggttagctttttagaggatagtgggtattttggtgttatttctaaagcattttgcaaaattagaatgttggttttattctagacatcttgacttcacaggttactacaggctgcctcagctaataaggaagagtcttccaaaactgaaggcgaattaatacattgccttgccgagctctaccagagaaaatctcgtgaagaatccactatagctcatcaagaagacagcaaaaagaaacgtatgtacctagaaaggctgtttcttaaggcattcttttttgagactgtatgttttaaaagatgggcatttcctgaaatgaggttgaaatggtaactaaataaagaagggcaaatttttatatttaaattttaaaataattacattagttcaatagtgatttttaaaaaatcaaccagtcttatctgtctaatgaataagccatcttcatttttaattatgatagaaattcaaatacaactttgtgttctgcttattagtattttttcttttgctaccttgcctttttagatattattccatctcattgcttaactaaatttacaaaattctcatgttgttgaacatttagattgctttcagttttcatcattataaataatactgtagtatacattatgcgtataatttgttttttaagtaattaccttagcagaagtttccaggaaccagttactgtgtcagggtatgaaaactggctctttatgtagattgctaaattgtcattcagaaattttcatcaccatttttcgtggccattgggtaacaccaaaataagtctgtttggcatttgccttatgggaaaaccatccattgagatgtttagttccaatccaatcacattgagatgtttagttcctaaacttcggttaaaagaaaggttctctttctaccctgtgtgtgggcagaaagagatgcaagaacttcctaattcaaatcattctggagggatatgcttcattttgatattctttcacagtaatctgaattaaagtagttcttctttccacagaagtggaaggcaatttactttccctcctctgatgttgttttggtaggaggggtccctcgtactccagtgagacagaagatgaataccatgtgccgttccttaaagatgttgaatgtcgcaaggctgaatgtgaaggcccagaagttacatccagatggcagtccggatgtggctggggagaaaggaatccaaaagatacctagtgggagaacagtggataaattggaagacagaggaagaacactaagaagttctaaacctaaaggtattcctcttagtctataatttactcttttataccccgcttttttaaaaataaaatttaatcgtacccttagtttattgactatctgctacatgcacaaaaaggtgttatggtgaatacagtaaataataagataatgtgctattcttagatttatgatctagctacaaagataagggaggcggaggttgtggtgagccgagattgcaccactgcactccagcctgggagacagagcgagactctgtctcaaaagaaaaagaaaaaaagaaagaaaattctgaggtgtaaattttatgctgctttacagatttttttttttcctgtggaatgtgagagccatagatgataatcagtttgaatgggacagaacacctttagtgggctagtaaaggtgtgtgaaatgtgcttgatacatgcaagggaaggctgaaacaacagtactgaagacagtgtggcaggaacataatttctggactagattctgtctagcagtagacctgcacaatagtgggcaaatgatttttgacaaagatgccccaataattccgtgagaaagacataatcttttcaataaatgatgctggaacaactagatacctttatggaaacaaaattagaccttacttttaatagtattttgtattcctgctatttttaatatttatgccttccatctctctctctttaattgctcaatcttgctatagagttttctgttttattcctcttttctttttttgttgttttttgagactgagttttgctctttttgcccaggctggagtgcactggcatgatcttggctcactgcaacctctgcctcccgggttcaagcgattctcctgtctcagcctcccgagtagctgggattacaggcgcatgccaccacacccggctaatttttgtatttttagtagagacagggttttatcatattggtcaggctggtttcgaactcctaacctcaggtgatcagcctgcttcggcctcctaaagtgctgggattacaagtgtgagccaccgcgcctggccttatttggcttttcaaagaaccgtcttttgtttctgttgattgctgttgttgctttgttttcaattcatttctgttctttatgattaccttcctacctttatttttggggtttactctctcatattacttcacgtgttggacccttagatagttaatagtttttaatttgtctgctttacaaaaataatcacttgtctaaagtctgtacattttctctttaagtataactaactgcattatgtatttactgttttctattttcattgatacttatttataaatattttctgacatccataatataagggagtgttttataattagcttttaatatttttgaactgtgctcaatgtggtctgtaagattgattctttaatatttgctgaaactgacctaatgtgcacttgaaaataatgggtattctctaattgttgaatatctggttttatacgtgtctgtacatcaagtttattaatgtttgaatattcaacatttttagtaatttttttctgctgcttttatctattgctaagatgattgtattagtcttccactattgtattgtctttgctcctttgtcaaagatcagtggaggccaggtgcagtgactcatgcctgtaatcctagcactttgggaggctgaggcgggcagatcacccgaggtcagtagttcgagatcagcctggccagcatggtgaaaccctgtctctactaaaaatacaaaaattagccaggcgtggtggcaggcgcctgtagtcccagctacttggggttactgagtcatgagaatcgcttgatcccgggagacagaggttgcagtgagccgagattgcgcccctgcactccagcctgggtgacggagcaagactctgtctcaaaaaaaaaaaaaaaaatccgtttactatatttatgtaggtctatttccaggctctcctgttacattgatctctctattcttttgctaatatcacacaaactgtcttgattactgtagctttatagtaagtcctgaaggttggtactatcagtcctcaaactttgtttttctcattcaatattgagttagttattctgggtctttcgcctcttcatataaactttagaatcagtttgtcaatatgcagaaaataacttatttgatagggatcacatagaatctatagatcaaattgggaatctgaaatcttgacagtattgagtctttcttgctgtgaacatggaatatctctccacttatttagttctttgattttgttcacagaattttgtagttttccgcatatagatcttatacaaattttgttagatttaatacctgggtatttcatatttagggggggtgctaatttaaatggtaatgtgtttttaattttaaattttgcttgtacattactggcatatgggaaagcaatggacttttatgtattaatcttgtatcctgcaaatttgctataatcacttgttagttccaggagttttttgtttgtttgtttgtttgttttttttagtagagatggggtttcaccgtgttagccaggatggtctcgatctcctgacctcgtgatctgcccacctcagcctcccaaagtgctgggattacaggcgtgagccaccacacccggcccagttccaggagttttgttgtttgttctttcagattttctaatcatgtcatatcaccaaagacagttttatttcttcctacctttaaattgtttgtttgtttgttttgagacggagtttcactcttattgcccagactggagtgcaatggtgcggtcttggctcactgcaacctccgcctcccaggttcaagtgattctcctgtctcagcctcctgagtagctgggattagaggcgcccgccactacgcccgggtaatttttggtatttttagtagagaagaggtttcaccatgttggccaggctggtcttgaactcctgacctcaggtgatccacccacctcggcctcccaaactgttaggattacagacgtgagccaccacgcctggcctcctacctttaaatttttaacacttaaacttggtatacagagccttaaaattaatcacttggctgggcatggtggctcatgccagtaatcctagcactttgggaggccagggcggatagatggcttgagttcaggagttcaagaccagcctgggcaacatggtgaaaccctgtctttaccaaaaatacagaaaataagctaggtgtggtggcacatgcttgtggtcccagctactccagaggctgaggtgggaagatcacttgagcctgcctgggaggtggaggttgtggtgagccgagattgtgccactgcactccagcctgattgtcagagtaagaccttgtctcaaataaaatgaaataaaattaatcacttatctctgtagtttctcagtctctggactattgacattttagaccagataattcttcgttgtagggctgtcctatgtattgtaggatgtttaacagcatccctggctcctacatactagatggccagcagccacccccgcccccaccaccatcagtcatgacaatccagacaaggccaaatgttccctgcaaggaaatattttccccagtggacaacaactggcctaagtaatacaaggacttgagcaagatatgattaatccattttattttatttttttctcagattttaaaactgaggaagagctgctatcatatatacgtgaaaattaccaaaagactgtggccacaggagaaatcatgttgtatgcatgtgctcgaaacatgatctcaaccgttaaaatgttcctaaaatcaaaaggcaccaaggaattagaagtaagagggtccagatattgttgtttgtcatggatgtagtggttggttggttggttggtggtggatttggttagtgtcttggaaaatgtctgttatgtcatatgtgattcaaaaatggtaagataagtaagggagtaagtacagttccagatctcagaaggtggatatggtgaactggtaaggcagaaatcaaagagatggggtgagcggggataattacatataattctctcctaatgaaaagcctttcctcatgtgagctatatgttagctgcatgattaagccagtggtttttaaccctggctatactttagaatcacttacagcatttaaaaaatatatatatgccaactaaccgtggtggctcacgcctgtaataccagcactttgggaggccagggtgggtggatcacgaggtcaggagtttgagaccagcctggccaacatggtgaaaccccgtctctactaaaaatacaaaaatcagctggatgtggtggtaggtgcctgtaatcccagctactcgggaggctgaggcaggagaatcgttttaacctgggaggtggaggttgcagtgaggcaagatcgtaccattgcacttcagcctgggcaacggagcgagactccatctccaaagaatatatatatatgccttgctctctccagatgaactgaaacagatctctggggttggcgcttttaaaaagccccctggataatccttttgcactgggagtgttgcaaaccactgttttagaccgtgttgttgttttattcatgttcagtggccatcacggagctccttctctaaagcaaacaggaggatttgtttatgatacttaggtttcttaagcactgctttatggaacgtttcttttaagacactttatttagggcaggcttgttttatccatgcccactagctctcaaaataacttttaccatgttctttttaaagatataaaagaagaatattcacgtcactttttcattcaaatgaaagaatagagaagtttataagggaatatatttccctttagtcaactgtgaaagaaattagaaataatgacaagtaacactattctcctatgtaataattttgtatttttaggtgaactgcctgaatcaagtaaaaagtagtctcttaaaaactagtaaaagtcttcgacagaatctaggaaaaaaactggataaggaagacaaagttagagagtaagtaactaccattttttaaaaaatcatcactctaaaagctgtgagattagctcgtatcagtttaaaatagattgttcgtgacatggtggctcatgcctgtaatcctagtaccttgggaagccaaagcaggaggattgcttgcagccaggaatttgaggccatcctgggcaatatagtgagaccgtgtctaccaaaaaattttttttaattaggtgagcatggtggtgtacacctgtagccctagctacttgggatgctgaagctggaggattgtttgagcccaggagctcaagactactgtgagctatgatcccagtactgcactctagcctgggcaacagagcaagaccctgtctcaggaaaaaaaaaaaaaaaaaaaaaaagattaccaactgcatgaagatgcttttgtagccaattcttttttatgttataatatgcagcttgaatcacctatttatctaataactacatcagtttttagaaaaggcactggctctcctcctttttggttgttgtgtcttatataaatagatctatgcttacggaaggagctttttgtttagtgacatccaaagtagatatgaccaagtatttttttctctcaaggtgccagcttcaggtatttcttcgtttggagatgtgtctgcaatgcccttcaataaatgaaagtacagatgatatggaacaagtagtggaggaggcaagtatatagtttcgtgccattgaaatacgccctagatgctttcagcttccctgcagagggcatctatatagtaacgttctaaaatctccttcaggtgacagatttgctgcgcatggtgtgtttaactgaggattcagcgtacctagcagagtttctggaggaaattttgagattgtaagtttgatggttactaacttaactttaaaattgttttgtcaaaacctatgtatggtgttgtctctgaattttggagttgtaaggactactttttaggctgggtgagggagggaatagagagggtaagatggtaactgttccgtattcgatcaatctgttccacaggtatattgactctatcccaaagacacttggaaatctttacaacagcctagggtttgtgattcctcagaagctggctggtgtccttcctacagattttttcagtgatgactccatgacacaagagaacaaatcaccacttctttctgtgccttttttgtcaagtgctcgtagatcagtgtcaggcagccctgaatctgatgaactgcaggaacttcgtaccagatcagccaagaagagaaggtaagaggtcaaagaatcaaaggaattatttgcactgttatagttctgataaaagatgtgtttaaactacagtccagtcatctttgtccatataatttgttgaactaatagctgcccttatgtctgaatcagagaagccaactattagagctcctaataggagcatctgacaatctttatattatctaggaaatatatagtcatgttttgcttaacaacagggatacatcctgagaaatgcattgttaggcaatttttgttgtactaacatcagagtgtgcctaccaaaacctagatagtatatattttttcatttatgtatattttttcatatggaaaagctaatgttccagcattgttactgaatagcagtcatttcccctacttgatctgtaatgccaatatcaagtgtcatttattaggtttctatataggctccattataacctatgggaccattgtcatatatgcagttcgtcattgaaggaaacattgcatgactgtatagtgtttatttcctatttcacaaagtcttctttactgtccacatgaggtctccagaaactaggccttctatgaaataagcttagagtttcagctttttaaatttcccttgatgcttttcgttgttcataactggttgaatttgttacttttgaaaattctggggtgacttgttttattataaacccagaacaaccttaagataactggcttttatttaaatcatattttattttacttagactccagttccatttgaatttaactatatataacctctatctagtatgtattaactatttctatttttaaaaggaaaaatgcattaataagacataaaagcattgctgaggtttcacagaatcttcgacaaattgaaattcctaaagtgtcaaagagagctacgaaaaaagtaagtaaaccttccagcttgagatgacacagtaaataagaacaaaaaggcagtgtccctacttttaggaaaatgaactttggaggatacagaaataatattaaatatttttatgaatgtgtataaaactataatccaaggaataaagaaatataaacttgtcaagagattaacaattttactcaagagtgtgatagttagaggtaatgtgaagaaaaatggcaagtaaaagttaggaatgaattaattcaaaatctttaatgtagataggaaaactcataaaacaataactaaaataagcaaagcagtcactggaagagaatatacaattgtaagtggactttggttgcataccagaaggtgcttttcaatatgttatattttactttaataacaaatttaggccaggcacagcggctcacacctataatcccagcactttgggagtcagaggagggaggatagtttgacaccaacagtctgagaccagcctggacaacatagcgagaccctgtctctacaaaaaataaaattaagaaaaaattagccaggcatggtggcacatgcctgtaggcccagctattcaggagtctaaggcagggagattgcttgagcccagtaggtcaaagctgcaatgagctatggtcgtgccactgcactccagcctgggtgacaaagcaagacttcatctcttaagtgaattaatgaatgaataaatgaatgaataacaagttttttgaaaaagatgatgaccatcatggagccaggaggtggagtagtcgccccttatctgcagaagatatgttccaagacccccagtggatgcctgaaaccacagatagtactgaaccctatatatagtactgttttttcctatgcatgcataagttcaatttgtaaattaggcacagtaagagattaacaacaatagtaaaatagaacaattatagcaatataatataataaaagttatgtgaatgtggtcttcctctcaaaatatcttattgtactatattcacccattttggggccatggttgactatgggaaactgaaaccatggaaagtgaaatcacagataatggggtactattgttgtttttttcatggcagttgatataaggacttgaggtttttattggttgaaaaaaaaataaacctagctggaatctgtttactaagtagaattaatgtctcgctgaggaaaaaagggagactaaaaacacaatgaaacttttcaactgcatgaactatctgagaagagttaaaattcaataagaactatctttagaagcattaattattataatagtggtttgttctgtttctagatatttgtagcagtcctttggaattggaggtgggatttcttttaaatggttaatggtgttcactttcttatactttgtgaataaaatgcatatcttatatatctcacaatcctgattgaagattggaaaatccgaaagtgaatggccaaaagttgccaggcctttattctcactagattttacaatgatttgcagatctttctagcacactttgaaactttggttttagattggacaagacagttttcttctctaagatcagaattaacgcctgggcgcagtggttcatgcctataatgccagaactttgggaggccaaggcaggaggaatcacttgagcccaggagttggagaccagcctaagcaacatagtgagaccttggctctacaaaaaatttaaaaattaggtatggtggtgcactcctgtagtcccagctactcgggaggctgaggtaggaggatcgcttgagcctgggagtttgaggctgcaatgaactatgatgaagccactgcactccagcctgggttacagagagagactctgtcaaaaaaaaaaaaaaaaaaaaattgaggtcaggatttgattgtggttagtaatgttttttcatgtcaaagttggtaccatagataagtgacaattgtttaactgaaaggaccagatgttacatttttaaaagaataaatctcagttctctgaaggaccaatatagttaactcgggaagcagtgaacttacaacttaagcgtagacatatagtattaattacattaatgtatattaatttcttttacgtatcttaactccagaagatcacaaggattaaaaaaaaaatatttgatcctgccttaataccttcaggacatactctcctagtttttcattcaattacatggattaacaagggttgacaaactttttctgtaaagggccagatagtagatgttttagcctttgcaggccatacgtctctgcaacatctattcagttctgctatagtggaaaagcagctacaggcattatggaaagaaacgagcatgactatgtttcagtaaaaactttattttcaaaaacaagaggtggcccagatttggtctgtacactgtagtttactgaaccctggataggaaattggatgtatgacttttatttttatttttattttttgagatggagtctccctctgtcgcccaggctggagtgcagtggcacgatctcgactcactgcaagctccacctcccgggttcacgccattctcctgcctcagcctcccgagtagctggcgtgcaccaccacgcctggctactttttgtattttttagtaaagatggagtttcaccatgttagccaggatggtctcaatctcctgacctcgtgatccgcccactcgacctcccaaagtgctaggattacaggcgtgagcctctgcgcccagccggatgtgtgacatatttttacaattatagtttatctctttataagagttattaatcaatataagtaagaatgatcacatctcatgtcttatcagcaagaccttggttatatcactgagaccatttgttaagtttctgcccatatgtggtggcttcttcaattattatgatgaattgaaaaaacaaaaaatctttaaaaaaacagtttccttgttttgatgcatctggggtttagactcttgaatcttctattgtaatagcaagtacatagcagtctgataaagaaatgtttctgagagtatagcctccctctaattaatgtatatggcttttcccttattaggtataaaaggtatgcatgattatcgttaaaaagttaaaacatataaagttaaaagttagggtgttccttctccatccattcatcagaagtaatcactgatgatagtttgttgtgtatatttccaggcccttttctatatgcaccaataacaccaaagatttatgcagatccgttatatacatatatataaatgatataacttagaatacttaatattttcctttttcctccctatcacagatctctatgttagtacaagttgagtatctcttacccaaaatgcttaggagcagaagtgtttccattcttagatgtttttggattttggaacatttgcattacatgtacttactggttagcaccccacatccagaagtccaaaatgctccactgagtgtttcctttgagtgttgtgttggcactcatgaagttttggattttggagcatattggattttcagattagggatgctcaaccatatatagagaggtcttccttccttactcttgtaatgtctgcattggatgggtatgtaatttatttaactgtttcactctttatgggcatttatagtgttttttattttgtgttattactatagtgcagcattgagtgtttttggaacatttctgttgtacattttattatttctattatggatccctataaatgaattacaagagtcaaagagttcatgtgaaatctttattcttttatttcaatgaatgcctatttaaattttctttctggattttctcatgtttcaggagaactctcaccctgctcctcagcagccttcccagccagtgaaagatacagtgcaaggtatactgttttctcagtgtatgtatttattcactagcatgacaactttatttttattgtatgtatttaagcagctgcttacaggtgtaaattaaggctttgtatgattgttggctaataaaatatgtccaaataccatggacatagtcccctaggaatagtctcaaaatattgtattttacaaaataactggtctgaaatctttaaaaacaaaaacaaaattaaaaaaaacatcatgaaagctggaagaaaggaaaaagaaaagaggcagtgggactgtttcagatgaatggagtttaagcatgatagctaaatgcattccatgatccctgcttggatcttaaatttagggaaaaaaatactagaaaggatattactgagacaactagagaaatttgaagaagcggtgtatgctagataatattgtatcaatgctaaagatattttgagtgtaataatggcgttggggttatggaggagaatgtccttgtttttaggagatacatgctgacctttaggaagtgaacagttgtttgcaatttactctccagtgtttaggggaataacgtacatacagagagaaggaaggagaaaacaaatattgtcagttggtgaactttagtgatgggcgtatgtttaattttattattatttgaaacttgctatagaaattaagcttttcaaaacattgggaaaatagagaataacaaaccaaatttggctttcaggtcataaatcaatttcaccaacagcctaagttaggtaacaggaactcttataatggagataaggaaacaatttttaaaactttggtgtgtgttattgatgtccttaataaccttaatgtgaacctttatgtcattgatgggtaaacacaagggttgctcccagtttgtggatcctagattatttggtttgggtttaaatgattaatctttgaagaattcacccttggtgaatttttggatcacttccaccagactatcttaagattaaggtattgtcttgctggctttgccacgtacttcttgacttttcagctatttttttctaactttgagtctagatgatgagaactttcatgctttggagtcaagaataaaatttaaaatgtcccagcagcttagtaaagtagtcagaagaagaagaaagaaattatagaattgaacaattctttgctcaatgctgagctgaatacacagcagcaaaaatgtccaaagtgagaaaaataatcataacatgggatatattaaaaggacgatgacctatgttagccatcctcttacttaagaattatgtccatcttacattgagtagcttctaactcaataagtggtgggggccttccttgtgttcctgaaaagttagatttaaattgaattcgtaatggaatactacaaaccactgtataccaacaaattgtataacctagatgaaatggacagactcctagaaagatacaaactactaaaaacagactcaagaagaaatagaaaatcagaatagatctataacaagtaaaaagtttgaattagttatcaaaaaactactcacaaagaaatgcccaggactagaagttttcactgctgaattctatctagcctttaaaaaagaaattagcactagcatttattatggtcaactgatattcagggtaccaagacaatttgatggagaatgaatagtcttttgcacaaatgatgctgagacaactggatatccacatgcaaaagaatgacattggacccctacctcatgcaaaataacatataaaattttttttaatttgcaaaagtaaatatttttaatgcattatgggaatatgctatttaaggaaaccttattagcatatgtgacaatagcaatctgtagtttcctcaaggagcttctctgttttggttatcttttctcagatacggcatttattgatgataatctttgggtttttctttttcttttaatttttgatgctttcagaagtgaccaaagttcgaagaaatcttttcaaccaggaattgctttccccttcaaagagatcactaaagcgggggttgcctagaagccattctgtgtcagctgtggatggtctagaggataaacttgacaacttcaagaagaacaaaggtaccacatttcagaatagctaggaaaaaggaaagggagattctgtaagattagtagtaatgtaccgtctttctttcctgatttagtaatttgagtcttcttccctcttttttccttcagtctagctaaaggtttgtcaattttgttaatcttttttttttttttttttttttttttttgagacaggttcttgctctatcacccaggttggagtgcagtggcgcaatctcagctcactgcagcctccacctcccaggctcaagtgattctcccacctcagcctcctgagtagctgggactacagatgtacactaccacacccagctaatttttaaaatttttttgtggagacatggtcttatcatgctgcccaggctagtctcaaactcctgagctcaagcgatctgccctcctcggcctcccacagttgctgggattataggcatgagccaccacacccagtcaattttgttaatcttttcaaagaatttactttggtttattgttttttctctattggttttctttgtcttttttttgagtcagagtctcactcactctgtctcctgggctggagtgcagtgccgtgatcttggctcactgcaacctctgcctcccaggttcaagcgcttctcctacctcagcctccccagtagctgggattataggtgtgcaccaccacacccggctaatttttgtatttttagtagagacggggtttcaccatgttggccaggctgctttccaactcctgacctcaagtgatctgcccgcctcagcctcccaaagtgctgagataggtgtgagctaccgcgtctggcctctattggttttctaatctcagtttcattttttttttttccctctattggctttggtttttgtttgctctttttctacttttttaaggtgaagtttaagctattgatttgagatcttttttaataaagcactgctttaggcatatcctataaattttgatatgatttgtttttgttttcatcatctcaaaatattttctaatttcccttgtgatttcttctttgatccattggttatttcggagcgcattaatttccacatatatgtatttcctaaattctcttctctgcttattctagtttcattctattgttgtaaaacatacattgtatgatttcagtcttttgaaacttgagacttattttgtggcttaacatttggtctatcctggagaatgtttaatgtgtgcttgagaagaatgtgaagcattctatagatgtgtgttgggtctagtggatttatggtattattcaagtcttctgtttccttgttgagcttctgttttattgtttatttattattcaaagtggcatattaaagtctccagctattattgttgaattatttatttctcccttcagttctgtcaatttctgcttcatgtattttgagactctgtacttaagtatatatgtcaataattattatgtcttcttgatcaattaaacttcttaccaataggtaatgtactttgtgttttgtaatctttcttggcttacagtctgttttgtctgacaataatacagctccccacccaccagctcttttgcataggatatctttcattgtccttttactttcaaccttagtgtctttgtatctaaattaaatatcttatagacctcatagagttggatcatgtttttttaatccattcttcttatctctgcttttcaattgcagtgcttaatccacttctatgaatgtaattactaataaggaacaactgtcattttctatgttttatgcttttttgtttctcaattcctgtttttttgtatttagctgattttttgtagtatactagtttaattccattctttctttttctgtgtatttttaagttgttttctcagtggttaccttggttaacccagctactggttacctcagttagcatcttaagcttaaaagaacctggctttatgaataaagccaacctcttttcaataatatacactctgctactatgtatttctgtctcttcttctttatattgttgtagactgcatctttatacattgtgtacctgttaatacagacttaaattatatagggtttaaaaaaaaaacaaaattaccataatgctggcttttatatttatctgtctagttacctttaccgttgttttttatttcttctcatggctttgagttattgtctactacctttcattttagcttttcttacagggtaagtctactgattatgaactccctcagcttttatctatttggaaatgtcttactttctactttatttgtgaaggacatagaatttttggttgacaatttttttttcccccttcaggacttcaaatgtgacatccactgccttctggtctcccaaatttctgatgagaaatcaactattaatcttattaagctgcttctctattgctgctttccagattctctctttgtccttgggtttcaacactttgactacaacgtgtctcagtgtgaatctcttagagtttattcagcttggagttcgtggaacttcttggatgtatatgttcatgtctttcatcagatttttggaaggttttaaccattatttcttcaaaaaattttctgccacttttggtctcatttcctccttagactcccatgatatatgtgttggtacacttgatggtgtcctacaggtccctcagactttgttcattttttttttaattattttttctttctgctcaggctggataatttcaattaccttatcttcacgttcactgattcttctgccagctcaaatctgtggttgacccttctagttagttttttcatttcagctccagaatttctactggattcttttttatcatttctattgctttattgatattctcattttgttcatatattattttcctgatttccattagtttcttatatatggtttaagtgagctcattgtgcatatttagagaagttgatttaacatctttgactagtaattccaatgtcttggcttccttagtgacggtttttgccaaatttctcttttctggtaaataggccatactttcttgtttctttgtatacttcgtagttttttgttgaggactagttattagggatattataatgtggtaactgcatggaggtcagatcctgtcacccctcagggattcctgttctttgcttattaaggatctcagctattcatttgtgccttttctgaactatttgtgtaaagtatgtataccttgttgtgtgtggtcactgaagtttctgtctattatctctgtggtcagccaatgacctaagaaggatttccttaaatgtctgattcaagaaacgaggagggggaaggtgtgtctgtcccttaaacttctgataattgggagaaacccactgtagcctaagagagctgaaaccaaggcagtgtctgcactgctcctacaggaatctgcctggttgaccaaagcatgcaacccccaatttttggaggacgaggtcttcactgtctgccctagcaccagccagctgctcctggaatgtgggctgctatcccaatagctacagcagggatgagaaaagggaaatggtagccagttcatgcacatcattcccttcctaaagatcatcagtctctcccatcatcaagcacttcctaggttattacaggtgttcaatcaagttgccaggttccaaaatagtgaattctgatctttttttctagtttactagttatttgggttgagggactgacccctagagctttcttctccatcatgttgcataacctcactccccttggagattacaattaagatattaacttataacagcctagttctcattgataccaatttaactttgacagtttataaaaactttgctattgtatagttctactgactatcccttcttagttctatattgtcatgcaaattacatctatacattgtatgcccatcaacactgatttataatcattactttgtattttaaataacaggggggaacagttacaaataaaaaacacttttataatgtttttcttatatagttacctttaccaatgctgtttaactctttatgtggacttgagttaccctagtgccctttcctttcagcccacaggactccttttagtattatttatagtgtaggtctgctaatgacaaattctgttttattttgtttcattctgagaatgtgatgatttctcctcatttttgaagaatactttcattgggtatagaattcctggttggcagtcttttttctctcagcactttgaatatgtcatcacactgccttttgtcttttgtttctgacgagaaagcagctgctaatctcatcaaggatctgtacacgatgaatagctctctggcttctttcaagatcttctttttttcacttttgatagtttgattatgatttgtctggttttggatctctttcactttattctacttgtattgagtttcttagatgtgtagtgtctttcatcaaatatgggtcatttttagccaatatttattcaaatgttctttctgcctcttcctttctgtcctttccttctggacttccggtatgtgtgtgttgtgcttgatggtgtcacaagtatctgaagctctgttcatttttcttcattcttttgtctttatcttccttagactggatcatctcaattaaccttgtcttcaaatttgttgactctttctttgccacctcaaatttacttttcatttttgttatactttttaactctagaatttctattcgcttttttttttttttttttttttccgtctgttgatattctctgtttggcaagtcattggactcatattttagatctttaggtatgattttctttagttctttgaacatatttaaaacagctgatttaaagtcttgttctagccgggcgcggtggctcacgcctgtaatcccagcactttgggaggccaaggcgggtggatcacgaggtcaggagatccagaccatcctggctaacacagtgaaaccccgtctgtactaaaaatacaaaaaattagccgggcgtggtggcgggcgcctgtagtcctggttactccggaggctgaggcaggagaatggcgtgaacccaggaggcagaggttgcagtgagccgagatcacgccactgcactccagcctgggcaacagagcgagactctgtctcaaaaataaataaataaataaataaataaagtcttgttctagtaagtccaatgtctggactttctcagggacagattctgttggctgattttttttcccctgtgtatgggccatacttttttgttttgtttctttgcatgactcataattttgttgacaactggatttttttttttttttgagatggagtcttgctctgtcactcaggctggagtgcagtggtatgatcttggctcactgtagcctcaaactccctgacttcctggcttaagcaatcctcccacccacctcagcctcccaagtagctagctggactaaaggcatgcaccaccactcctggctaatttttgtatttttttgtaaagatgtggtttcaccacgttggccaggcttgtcttgaacttctggactcaagcagtccgcctgcctcagcctcccaaagtgctgggattacaagcatgagccactgcacccagcatggatattttaaacaatataatgaggcagctgtaacaatcagatccaccccaaccctgccaggatttgttattgtttttgtttagtcacttttctaaactatttgtttaaattttgtattctttatcatgtgtggccactaaagcctctgctcagtggtcttagtggtcaactaatgattggacagagatttccttaaatgcctggaacccataagtttcacagcccctactgaggggctctgtgtgttgggtcatgccttcaacactcagccaggcagtttagaattccacttcactttctgttttgccagagcctcaaggttagccataggtggcagcttacaggcttctcaagtctatcctcggcacatgcacagtgctacacgtgtgtggacttttggatgcctaagaatgtcatcagagatttgcaaagtcccctgtgatgtctcattccccaattttcccaattaaacttttggccagcttgttattgcaccaaatgttaccaccacctcaggcagctgtaacatttaacaattgctgctgattgttttcagtaaatgctgtcagggaaaaaggtggtttacactgtatgagttctgagtcaggtcaaagcaagacaagccttgatttgagtaggattctccagggaactgccagacaggttaatggatgacagttatctgagaatggagttttggaggagctccaaccccattctgccctgtccagaggctgctgggctgttggttttcactgtgattgtgggaaattgatttttaaagctaccgtagggctagggggaaggggcagggactaaggcaagttaaagcttcctgagattcaaccatttttcttgaacaaatactccctagattgttgcaaacctttaattaatgttcagagttctggaaaagatttttgaccatttttcccagtgatctctgttcctttatggaggagagtgttcagaggtccttacctcaccattcttactggcatcactcctctttactaatcattttaagctcactttaaatcagtcctctcataagtagcttggctgcctactctactaagaaattttatgccacctacgtttatcttaataattaacatttatgtggcatatcggcattttcacatatttcatttaatcataaatactagaaccaccaactaggtgttagtcttaacaagtgagcaattttcattttttcaggattgcttattagataaaattttatatttatattgtcttttttttttttgagatggagtctccctctgttgcccaggctggagtgcagcggcatgattttggcacactgcaacctctgcctcctgggttcaagtgattctcctgcctccgcctcccaagtagctgggcttacaggcacgcaccacctcgcccagttaatttttgtatgtttagtagagataggctttcaccgtgttggccaggctggtcttgaactcctgacctcaagtgatccgccctcattagcctcccaaagttctgggattacaggcatgagccattgtgcccagcctatatttacattgtcttatgtcattttttaatctctaatagtgctgacaaacttctatcatgttgagtcctgtaaccatagaacttagcccaaagaccattaagatcctctccagctaggtaataagccatacagaagttcaaactgctcccttggccttactgctgcttcttgatgaggttaaatgaaatttatgatttaagctgtgtttacattttaggttatcacaaactgctgactaagagtgtggccgagactccagtgcataagcagatctccaaaaggctgctgcacagacaaatcaagggcaggtgagtgacatccccatccgggcttcttcatacacccacaccacctcaaagcggccttgtgggccactacttcgcttctcttgaccttcatgacttaaatcttaactatgttgcttaaaaccaaagagcattctataagctctccatgggagcaggagaaccatataaaatatacacttgtctggcctcaattattttgagattcatccatgttgttgcatgcaatagttcatcctgttttattgctgagaagtattccatggaatagatactccacggtttttaaatccattcatctgtgaacatagagaaggtggaagtctgggatcccaactcagcctttgctgacagaggtgtgggtggggctgcagttttttctgcagcgattggttggagtagggctgttattgtctgaaagttttctgtcttgcttggctgaccctttcctagttctttggcttgagagctctccttccttggggcatctgtagtttgctcctggtatacctgggttgtcagcttttctggcacccagtctaggggtgtaggcagcaaacagaaaacccagggagctagctcactgccctcctcaggtcccaaagtccccagccaggctgccttcttctctctgcctttcagaattgtctcctgctcattgtatagataatgtcatgggtttttagcttgatttcaagggtaatagaagcacacctccttctattttgtcagaaacccatctcgacattattcgtatatggattttacacacttgtgaagtttataggttaaattgcgaaaagtgaaattggtgggtcagaggcatatatatttttaattaaattttttataacatccttgacacattggcagaaattaaggctcttaaacagaaacttgaatgttgctgctcattactgtgatagtctgatagtttggtataattttttaatatattaatggggtttataattctgatgttgtaaaattgctttccaaaaaataaaagcaaaacaaaaccacattctaaccatctcactctttttctgagtaggaatctcactctgtcactcaggctggagtgcagtggcacaatcccagctcactgcaacctctgcctcccaggttcaagtgattctcctacctcagcctccagagtagctgaactacaggtgtgtgccactgcacccagctatctttttttttttttttttttttgagacagagtctagctctgtcgccaggctggagtgcagtggcgcgatcctggctcactgcaacgtctgcctcccgggttcaagcgattctcttgcctcagcctcccaagtagctgggactacaggcgcatgccaccacgcccagctaatttttgtatttttaatagagtcggggtttcaccatattggccagactggtctcgaactcctgacctcaagtgatccgcccgccttagcctcctaaggtgctgggattacaggcgtgagacactgtggccagcctccctcttgacaataatcacgtatgagagccctttaccagcactggtgttatcagaccctgtgatctttgtgatcttgttaagtgagaagctgcctgtctccttaataagtgttaattacaagtggtatggagtaatccttgtgcatgtggttcctcgaggtcctctgatcctggtcctgatattggtgttgttgaagagtcccctgaaaaaggagatggtgagtgttatctctttttgtttttaatgcaatctacccagcttctatgaaaacctttctgtatgtattgttacttggcatatcctaagatattttacagaaattgtgatggctctgagtccacaatgcagctcagtaaatatttataagtgaatgttcttctgcatagaaggtactgagagaattctggaaaagaaatatttttgcacaacagatatgaaattcaggatgagggctaaactgtgttatacaaagtgctatgacttattttaaaagtatatataactttgttggagcttttcactacatattttttcaagaaggcagggaaattttttattggggagtgtcttttctgagacattatctttgctgctgccccttatgtatctgtgtattccgtgcccccaacacacagtgcctggcacatagcaggtgatcagtaagcacatgttgaatgagggtgagcagcaggtgtggtggttcacgcctgtaatcccagcactttgggaagccaagtggggaggatcactggccaggagtttgacaccatcttaggcaacacagtgaggtgctgtgtctataaaaaatttaaaaaatcagctggtcatgttggcatactcctatggtcccagctactcgggaggctgaggtgagaggatctcttgagctctggagttcaaggctgcagtgagctatgatcgtgcctctgcactccagcctagcgacagagcaagaccatgtctctaaaaaataaaataataaaagtatacatgatgaaggaggggttttaaaaaactaacttctaagttgctcaagtaattcacatttattgtggaaaaaacaggaaacatgaagccaaaaattttaaagcacttggtaattccacaactcagaaatactctaacattttagcatatactcttactgctattatttctatataaatgcatgtaacatatacatacgaaacctaacataaatacttgttttcgccctacaccattcttctttttttttttttttttttggtgagacagactcttgctctgtcgcccaggctggagtgcactggcatgctctccgctcactgcaacctccacctcccaggttcaagcgattctcctgccacagcctcccaagtagctggggttataggcacccaccaccatacctggctaatttttgtatttttagtagagacagggtttcaccttgttggtcaggctggctacaccattcttaaggtggcagtaaataagacttctgaaggtaatagtctagtgggtcagtgtttttttaataccttgttgggaccatgtatcaaacccctcttagtttgttaagagacacttcagaagtctcttaaagctaatagcttgctgaatttccatcttatatgtggtactatgtaaattttgcccggttttggacaacatgagaaaatgtcaagcttgtagttgtctttggttacttactgtggttctgattttacagaaataagtctgagacgaagtcctcgaatcaagcagttgtcatttagcaggacacattctgcctccttctattctgtgtctcagccgaagtctcgaagtgtgcaaagagtccactctttccagcaagataagtcaggtaacatacgggcccctctgccttcacaagtccgtgctgacttggtgagaagtgtttttgggaaaagaagcaagaaatttgacattttctttcttgacattggagaagtagaataggtatgtctagttgaggttcagggtgatggctagatggacagtccatgactttgtaatcagtcatccctaggactcctacaactggtcatccatgctatcattataggtagctcattcattcaagaggaagctacccataatttcccataaggacagaacctacacatcattatcttaggtggaaggtgatatctgtgtttacgttcttcattcttctatccatggttagcttgctaatagatttgtgtttcttattttatctttttttgagacaaggtctcactctgtcacccaggctggagtgcagtggcacgaacacagctcactgtagcctcaacctcccaggctcaggtgatcctcccaccttagcctcccagggaggtgggactacaggcatgcaccaccacgcccagctgattttttgtttttagtaaagactgggtttcaccatgttgcccaggctggtcttgaactgctgggctcaagtgatccatctgcctcggcctcccaaagtgctgggattacaagtgtgagccaccacacccagccagatatgtgtttttatatttacaaattaaagtagttcagttgtctacattttctaacataggagctggggttaatatgccgtcttactaaaattaaaaaaggcagcagttgttgtagttgctgacataaataggtgggattttcccgagttgctctcaaaaattgttgccttctttcttttatgaactggctgggtttttcttatgttttgtttgtttgtttgtttgttttttgagatggagtctcactctgttgcccaggctggagtgcagtggcgcaatcttggctcactgcaagctctgcctcccgggttcatgccattctcctgcctcagcctcctgagtagctgggactacaggcgcccgccaccacgcccagctaaattttttgtatttttagtagagacaggtttcactgtgttagccaggatagtctcgatctccgacttagtgatctgcccgcctcagcctcccaaagtgctgggattacaggcgtgagccactgcgcccggccttgtttgtttgtttttgagatggagttgtgctcttgttgcccaggctggagtgcaatggtgcaatgtcgtctcactgcaacctccacctcctgggttcaagcaattcttctgcctcagcctcctgagtagctgggattacaggcccctgccaccacgcccagctaattttttgtattttcagtagagatggtgtttcgctatgttggccaggctggtctcgaactcctgacctcagaccatccacctgtctcggcctcccaaagtgctgggattacaggcgtgagccaccatgcgtggctggctgttttaatagtattggaagaacaggaattgagaaagaattaaatattgttgctgtttttgacttgcagaccaaagagaaaattctccagtccaaagtattcggtctcccaagagtcttctttttggggcaatgtctgagatgatcagcccctcagaaaagggttcagctcgaatgaaaaagcgttcaagaaacactttggattcggaggtacctgcagcttaccaggtataatgtttctgtaatgtttgaaataatataatctcctggaacacagagacatggccaaggaactcagagtccattagggaagagaaagcaggtgacctctagataatactagagattggaggtgactgggtggagccacatgaatgattattagacacgtgggaacttcaagcagcaggtttgactgaagccacggtgggggcggtggaggaggagatagagaggatctcatctgttctcttggctttgtctactgtttatattatatactgcacagatacctttctggagtgtgtgacactcatcttttccgtttgattgcccactccatccagtcaccaacattagaaacctgggagtcatccttttccctctccccaggcatagccaatcagtcgagtcctgcccattttatttacaaactgactctttttttttttttttttttttggagacagagtcttactattttgcacaggctggagtgcagtggcacgatctcagctcactgcaacctctgcctcccagttcaagcgattctcctgcctcagcctcctaagtagctaggattacaggcacccaccacaacgcccaactaatttttgtgcttttagtagagatggggtttcaccatgttggccaggctggtctcgaactcctgacctcaagtgatccacctgcctcagccttccaaagtgctgggattacaggcatgagccactgcgcccggcctacaaactgactcttgtacccaccccctcttctcccctactgcaattcctaccctagttcaggtctacctggaacacttcaacaggcttttccctctcaaagggaaatcctccacccagaggtcagagtgatctttctgaaacattcctctcagtttgcttaaaatgttcactttgcttaaagctctatagactccccgtccgctaaagcaaggctttaagttttcctaagtggaactcttgggttcaaaaataatcacctttgtttggaaactcagtaaattgcttggaggttgggaaagacatagagctctggagaagggtctgaaaaccatagatctacacaaccaagatcagtctcctcccccaggcaggcagggtcttccgtggtctgttccctctggcctcacccctccccgctccacctccccagcaacatcaggctgggtgccatcctgcacagccactgcttttcacttccaggcctttgctagtattgttttctatgcctacaggccgccaccaccccacccacttttcctgtgtttgccttcccctgccgacacccaagcttgaagacctgatccaggctgggttaggcagcccttctttgtgttctgtgatgcccctcgcatgtccctgtcactgcaccaatcacattgtattttcacctgcgtatgccccactgaacaggaaatgccagctagactgagagtcccctgacgggatgaaggaaggctgtaggaaagataagcattgatttccttacctgttggagcttttcactacgtatttttgcaagaaggcagggaaattttttattggggagtgtcttttctgagacattatctttgctgctgcaccttatatatctgtgtattccatgcccccaacacacagtgcctggcacatagcaggtgatcagtaagcacatgttgaatgagggtgagcagcagatgaggtggctcctggaggctgctttaggcaaagatcagaaatagctgccttatctgaaaagaaggaagagctagagagtagctgcagtggtagaatgattccattagaggcaaaaagcatggtttagcaatatgtagattattaaaattatttgttctaggacaaactaaacttggatagtgtttggtcctagaaaaagtagacaagtaaaatctgagtcatgttttggagagggaaacgggtcactatttgagatttccatctttagatcattcctttggctgactataaatctcccatttggtcttagagattactaaaacacttcagagatcatgagttataatattcaaggactgaaataagcatttctcttttcagactcccaagaagagtcaccagaaatctctgagcttttctaaaactacaccaagaaggatctctcatacaccacaaactccgttgtatactccagaaaggctgcagaagtcccctgcaaaaatgacccctacaaagcaggcagcttttaaggagtccttaaaagactcctcctcacccggccatgactcaccattggattcaaaaatcactcctcaaaaacgacatacccaggcaggagaaggtacctctcttgaaacgaagacaccaagaactcctaagaggcaaggtactcagccgcctgggtttttgccaaactgtacttggccacattcagtgaattccagtccagaaagcccctcctgtccagcccctccaacttcatcgactgcccagcccaggagagagtgtctcactcccatcagagaccctctcagaacacctccgagagcagcagccttcatgggcacgcctcagaatcaaacacaccaacagccccatgtcctcagagctgctcgggcagaggaaccagcccagaaactaaaggataaagctatcaaaactccaaaaagaccagggaattcaactgtgacttcttccccacctgttacgccaaagaaactgtttacctctcctttatgtgatgtctccaagaagagtccatttaggaaatctaaaatagagtgtccttccccaggagaactggatcagaaagagccccagatgtcacccagcgtagctgcatctctctcctgccctgttccctcaactccccctgaactctcacagagagctacattggacaccgtccctcctccacccccttctaaagttgggaaacggtgtagaaagacctctgatcccagaaggagcatcgtggagtgtcagcctgatgcctccgctactcctggggttggcacagctgacagcccagctgcccccacagactctagagatgaccagaagggactgagcctctctcctcagtctcctcctgaaagacggggctacccaggccctggtctcaggagtgattggcatgcatcctctcctctgctcattacaagtgacacagagcatgtcactctcctcagtgaagccgaacaccatggcattggtgacttgaaaagtaacgtcttatcagtggaagagggtgaggggctaaggacagcagatgctgagaagtcttctctgtctcaccctgggattcccccatctcctccttcctgtgggcctggctctcctctgatgccttcccgtgacgtgcactgtaccacagatgggagacagtgccaggcttcggcacaactagacaacctgccagcatcagcttggcattccacagactctgccagcccacagacctatgaggttgagctggagatgcaagcttctggccttcccaaacttcgaattaagaagatagaccccagctcttcattagaggctgagcccctcagcaaggaggagagctctctgggagaagagagcttcctccctgctctcagcatgcccagggccagcaggtccttaagcaaacctgaacccacctatgtgtcacccccctgcccccgcctctcccacagcacacctggcaagagcagggggcaaacctacatctgccaggcctgtacccccacccacggcccttctagtaccccctctccatttcaaacagatggggttccttggacaccatcccccaagcacagtgggaagacaactccagacataattaaagactggcccaggaggaagagggcggtgggctgtggcgccggctcctcttccgggaggggcgaggtcggtgcagaccttcctgggagcctgtcactgcttgagtcagagggcaaggaccacggccttgaactcagcatccacaggacgcccatcttggaggattttgagctcgagggagtgtgccagctcccagaccagtcgcctcccaggaacagcatgcctaaggccgaggaagcctcttcctggggacagtttgggttgagttccaggaagagagtcctgttggccaaggaagaagctgaccgtggagccaaaaggatctgtgacctgagagaagattcagaagttagtaagagtaaagaggggtctccaagttggagtgcatggcagctaccctccacgggagacgaagaggtgtttgtttccggtgagttcgtttttgaaacccagtttcctcatggtttcttttggtcagagtgcttgacaaggaggcacttgggagttgcttcttgggaggcctgggcttcccggttgggggtctggggacgctgctcttactatgtgggatctctttaggctccaccccacctcccagctgtgccgtgcggagctgcctctctgccagtgccctccaggctctgacccagtctccgctgctgttccaggggaaaacaccttcctctcagagcaaagaccccagaggtaatgtttgttgaaggtctaggaccctttcctgtgacagactgtctgaattcaccagggttgccaggcagctcgattctagaggagccccagggagtgccaagtgtgggataggtgacttcgcgcctacagcgtcatgtgtgcccttcccagagaaactccacattagaacttgtgtgcatgtgaacagaagcccctcaaaatcctgctaaaattcctcggtcctcctgaaaatgttgacagtcgtgggcttgccgcaacatgctgctcatctgcagtctaagaatctgaacaggaaggcgttctgagcagcacgagtgataggcctgtttagagctagttccccacagcgggtttatccgcatgttctgtatattcggtgggacacagtactgactgtagttataatcagcctgcaggctctaggattccccttccccttccaaatcctattcccaaaagacaaggatttggcctgttaactgccctggttagcaatgttgccttctgctgctagaatcaaagggggagtgcaggaggagggggcctttggtggttcagttccctcaagaccatgatataaatcatgcaaaacagcataaccccagagatctgagacctagaaagaatacaggatattaacctgagggaattcaaaccacaggtactttgcattttcagagctgcttcttgctgccagcacggtgcatagctgttaagggcagggtccttctaaaaagtgtaggtaccatttctgtaggataagcgaacctccaagcagtgctgattttcttaaagtctgtttttgtgtgtaaccctctgcaatttaagccaatttttttcagttcggtcctctgtgactcctgcatgctaagcctttctaccttcttctagatgaggatgtggatgttcttccctccactgtagaagactctcctttcagtcgcgctttctccaggaggcgccccatcagcagaacttatacacggaagaagctcatgggaacctggctggaggacttatagccacaaacattactgagcccaaaagatcaaggagtcagccaggaccctgtggacataaagaagttggatgcctggtcccaagcctcttttgccatggtcagtgttcagattgccattagaatgccttagggttttctaattccccttatggatccaatccatctcctggccctgccccttgttggggaagttgcaggaggagaggtggatggcaatgtgattggtgctataactcaggcagcctgggagtcaggaacccagacaaggaatcccattccagcctcaccccaaccatgaccttggcaagtcagggggccactctgcctcatttatgcaaatggagaaaggcgccctccctggggtcccttgagctgctgtaaggctgggctgctgcgacacaggcagcgctttgtaaactgtgaagccatatacgtgaaactgaagagtgcattgggcagtggaagctattttttgccttccctgtgtaacagtaaaatcatctctagtgactgagcactcagtacatttttgtttaatgttgggcctgaggttaactgtgaccatggtccagcttgagtggcttctggagcagccacattttcaaggactgtccaagagccagccagttcagggctcaggcctcacccattgcccactcctggggagaccatcacctggctcatcgtttccaccaagagtgccccacaggagtgccccacagacccgctggaccagcctgctgcgggtcctggccaggggtctggctaacggtgagggctgactctgaactgtctctcagtctccagaaagtgttcaagcctgttgtgttcccaaatctgattcctcctattgtcttgtaaatcaaactctaagtgaaaacttcccatttgtcccttcaaagatttttttttattaaatggttttttaagatcctaa

SEQ ID NO: 1494 - DNA, 46775 bp, Homo sapiens
gaaggcaccaaaccattgaggagggatttgtcctcattacccaaacacttcccaccgggcctcaccttgaacgctggagatcaaattttaacatggtatttggtggggacaaaccctatcagcagctgcttttaatatttaaaaaaatattttgagagagggcccacagaccctctgaaagaagcagactgctcctgcaggacccgggggacaccccaaatactgtgagtgccccaactgcggaagtgggaaagggagaccctcctttccggaacacacaccccctactggagaagctgaaggtctgcttccgggagatgctcccgacttcacctggagctgagtcaagttagagaaccggaccaagcgaaatacaggggcagaggaggcagcagggaggccctgggagctctttgaatccccaggtagcctattcctgcctggcaccactgggattcatcaggagggaggccagaggagcaggaggtaaaaccctaccgggagaaggacttccctagctgaattttgtaacaatttgagtggggcgagaagcctcctggccggaacttgggggaggatgcggatctggcttgcagacttcacaggtgggggaagaactaaagcccttttctttcacaggtgggaggcggaaagcctcgggcaagttttcaagcccgtcctctgtctggaaacagactcagaggtgttgcaggggacacggtgggagtgagaccagcccttcggtgtgcgtgggatctgggggaggcctgtgactgccggctttcccctgcttctctgacaacctgcatgactcagcagaggcagccataatcctggagagccccggtttaagatctccaggtgaagtagatttttattgtaagtaactcctgtactttttaagttgtgagacatgcattcaaggttgaattctgaaatcatgtctgaattaacttcactggagtcttctgttgcccttatagagtagggaattctcatagttctgctagtaattgttttttgagggggcaggtgtggtctaacaaggaaaggctagagagcaattaggaccaagggaaagaccttgggccatggaaggttgagttctctgaaagttttaaaaatataaatatgtatttttactctagagatgcggtctcactaagttgtccaggctggtctcaagtaatcctcctgccttagcctcccaaagttctgggattacaggaatgagccaccacacctggcctcacctcagaacgttttgaaaattttagttttgtctgtttgcttgttcaatcattctgcatgactggatatggtgaggatcatgtaatttgggggacagaggaagaactcttggatttttttggatgactttactggtgcgatgagttccctggtcacttgacagggcaagtagaattcctcaggaggggaaaatttgttctaagagaacaaacagttgcagctgtgggcttcttacgtggaaaagcttctagtcaataagtgaacataaaaacaatggccagggcatattaataacactgacttaggaagttgaataaaatatctttgccaatagagaaagagtcctgctagaggtggctctcttcctcgttctacctttataacttttccaggattctgttgttggcagatattccaagtaaggagtgaagtttccccacaaatgatgatgaaggcattgagtcagtattttcccatgatgaaaaattttgtgaagactgaacttcaggtcagggacgaaggagagcccaagtagccttctcagtgtcttcaaagcctatctttggactttttggtgggtaaaacatccaccttgttttcaattagccttttcatcttcaggggcctttaactgagatattttaatgtcctcaaatagaggataaattggcaaactgagtaggtttaatatctggtctgattacagtgggactgggacagatttataaactgctacttagcatacttatcagctgagcttccccttgccttaggggtctattgcccatataagcttctatcttgagtatggccagctcttgtaataataaggcctctaggaggttacccacatttcccattttaaactagtagtcacaaattccctggctttccacaacaggtcaaagtcatgtaataccctaaaaacatatctgttatctgtgttgatgttaactctttgattcttagctaaagtgtaggttcttgtgagagccacaaattattctatctgatataatttgcactgggtaaagcctcatatgttatgggactgtggatatatgcaatggcatattcagcctggaaacctctttctgaagtcagaggtatgaactatcaacaaagaaaatgagatctggatctataagaggtacttcagaaagatcaggacggggaaaggttagagcttaggtggctgaaatacagtcatggtggttgtacttcagttgggagagaaatggtaacaaggttaagattttggtaatggtgaatagtaatgtgagaaggagcaaacaaaaggatctcataagaggtaaggttagaggttgaaaaacgttgggggttcgcagtcaggacaaagatgtgaaccacttgggcacagaagtgtgcgaagtatgacctagcacaaaatcaactgtggcttgaatcaaatttgctgttgccatgacaactcagaagcaaggaaggaaggcttgagctatagggcctagcaagaaggtaaaatatccaatgggcctcaggctccttttgtatttctgagacaggacatctaaagtatgttctctctcatgaatgaataggcagaagggcaaggagtagttggggagtcccaagctgggggaagaggaaagggaggtttttaaaaggatccaatactgttatagaggttaattctcgttctaggggttcagacaaggaatccacattctacaatagccaaccagtctgagaaagtccaggagttgtctcattgttttagataaagtgtaattaaggatgcttttcatacatctggagacaaagtttttcccttacaggagatgtcatgttttagagagtgaaactgaaaataggaaaactaaggatagtgaaattatattttgtctcttgaaaacaatgtcccttttaagtcagatcatccaaaaggtatcgagtatctgccaataaattatcaaatgtactggagcaaagaaggtggacatctacgtattgcatgacgatgcaattacaaaggaaaaccaaatcctttaaatttgcatttttaaaaatattaaacatttaggttcaggggtacatatgcaggtttgttacgtaggtaaattttgtgtcatagaggtttggtgtacagattattttgtcacccaggtgataagcaggtttcttgataggtagtttgttttgatccccactctcctcccaccctccaccctcaagtacgcctcagtgtctgttgttcccttccttgtgtccagttataagttaaaacacgtagtctttagttttctgttcctgcattagttcgcttaggataatggcctccagccccatccatgttgctgcaaaggacatgaccttttttttaatggctatgtagtattccatgatgtatacgtaccacattttctttatccagtctaccattgatggacatttaggttgattccatgtctttactgttacgaatagtgctaggtgaacatatgtgtccacgtgtctttggggcaaaacaatttatgttcctttgggtatatacccaataatgggatttctgggctaaatggtagtcctgttttaagtactttgagaaaatgccaaactgttttccctagtggctgaactaatttacgctcccaccagcagtatataagcatttccttttctgtgcaacttctccagcggctgttattttttgcggttttattaatagccgttctgactggtatgagatggtacctcagtgtggttttgatttgcatttgtctgatgattagtgatgttgaactttttttcatacgccttttggccctatgtatgtcttcttttgaaaagtgtctgctcatgtcctttgtccactttttaatggagttgttttttgcgtgttaatttgtttaagttctttatagagtctggatattagacttttgccagatgcatagtttgctaggccgtatgtttactgggttaatagtttgtggggtttttttctgtatagaagcgctttagtttaattaggtcagtttgttaatttttgtttttgttgcaattgcttttggtttcttcatcatgaaatctctgccaggtcgtatgtccagaatggtattttttaggttattttccaggatttttatggttttaggttttacatttaagtatttaatccatcttgagttgatttttgtatatgatgaaaggaaggagtccagtttcagtcttctgcatatggctagccagttatctcagcaccatttattgaatatggaatcctttcctcactgcttttgttgactttgtcaaaggtcagatggtgttggtgtgtgactttatttcttggctctctattctgttccattggtctgtgtgtctgtttttgtaccagaatcatgttgttttggttactgtagactcataatatagtttgaaattaagtaatgtgatgtctccagctttgtacttttcgattagggttactttggctattcgggctatttttttgtttcatatgaattttagaatagttttttgtaattatgtgaaaaatttcattggtagttagataggaatagcattaaatctgtaaattgctttggggaatatggtcattttagcaatattgatttttcctatccgtgagcatggaatgtttttccatttgtgtcatcttgaatttctttcagtagcgtttgtaattctcattatagagatgtctcactgccctggttaagtatattcctatgtatttattttttgtgtgaggctgttgtgagtgggattacattcttgatttgactctcagcttgaatgttgttggtgtataaaaatgcttctgattttcatacattgattttgtattctgaaactttgctaaagttgtttatcagatctaggagccttgaggcagagactattgggctttctaggtatagaatcatattatctgcaaacagggatagtttgacttcctgtcttcttatttgcatgtcttttattttttttctgttgcctgattgctctggctaggactaccagaagtatgttgaataggagtagcgagagagggcatccttatctttttctggttctcaaaaggaatgcttccaacttttacccattcagtatgatgttggctgtaggtttgcatagatggctcttattattttgtgttacgttccttcagtgcctagttggttgaggtttttaacatgaagggatgttgaattttattgaagagccttttctgcatctattgagataatcgtgtggtttttgtctttagttccgtttatgtgatgaatcacatttattgatttgcatatattgaaccaaccttgcatcccatggataaagcctacttgattgtggtgggttagctttttgatgtgatgatgaatttggattgccagtaatctgttgaaaatttttggatctgtgttcatcaaggatgttggtctgaagttttccttttttgtgtgtctctgccaggttttggtatcagaatgagtctgccttcaaacaataagtgagggaagagtccctccttctcaactttttggaaaagtttcagtaggtaccagatcttctttagacatctggtagaatttggctgtgaatccatctggtccagagcttttcctggtaggtagggatttttttttaattattactaattcaattttgggacaaggatttcaatttcttactggttcaatattgggaggttgtatgtttctagaaattttatccatttcttgtaggtttcttagtttgtgtgcactggtgcttataatagtccgtgagggttctttttcctttgtatttctttggagtcagtggtaaagtcatttctgacatttctgattgtgtttacttagatctctcttcttctttattcgtctagttagtggtctaccaatcttatttattttttcaaggaaacaatttatgattttgttcttttgtatggtttcccaagtctcaactcagttcatctctgattttggttatttcttatcttctgctagctttgggattggtttgctcttgtttttctaattcctctaggtgtgatattaggtggttaatttgagatctttctagctttttgatgtgaggatttaactttctgcttaatactgctttgggtatgtttcagagattctgataagttctttgtttttattagttttgaagaatttcttgatacctgccttaatttccttgtttacccagaagtcattcaggagcaggttgtttaatttccatataattgtatggttttgtgcaatcttctttgtattgatttctatttttattgccctcttgtcctggagtgtgattggtaagattcagtttttctgaatttgctgaaaaccatttttatggccgattatgtagccaattttagagtgtgtgccatgtacagataagaagaatgtatattctattgttttggggtggagagttctggagatgttgttaagtccatttggtcaagtgttgagttcaggtcccaaatatcattcttagttttctgcctcagtgatctgtctaacactgtcagtggaggtatcgaagtcttcccctattattgtgtggttttctaagtctctttgtagctctctaagaacttgttttatgaatctaggtattcctatgttgggtgcatatgtatttaggatagttaattcttctcgttaaattaaatcttttaccttctttgtcatttttgacttgttggtttaaagtccattttgtctgaaattagaatagcaaccctgccttttttgttttacatttgcttggtagatttttctccatccctttactttgaacctgtgggtgtcactgcatgtgagatgggtctcttgaagacagcaaatagttgggtctagttttttaactcgctactctgtgtcttttaagtggggcattttgcacctttatattcaaggttaatattgatatgtgcagtttgatactgttattgtgatatcagccggttactatgcagacttgattgtgtagttgctttatggtgtcaatggtctatgtacttaatgtgtttttttgtggtggctggcaacagtcttttgtttccatagttagcactcccttgaggacctcttgtaaggcaggtctggtggtaatgaattcccttggcatttgctgtctgaaaaggatcttatttctcctttgcttatgaagcttagtttggctggatatgaaatttctcggttggaatgtcttttcattaagaatgctgaatatatgccccctgtgccttctggcttgtagggtttctgctggaaggactgctgttaagctgatgtggttccctttgtaggtgacttgctccttctctctagctgcctttaatattttttctctcatgttgaccttgaaaaatctgatgactatgtgtcttggggatggttgtcctgtacagtatctcacaggggttctctgtattttctgaatttgaatgtcagtctctctaccatggttggggaaattctcatggacaataccctcaaatatgtttaccaagttgcttgctttctctacctctctttcagggacaccagtaagtcatagattttgtctctttacatactcctatattgctcagaggtttaaaattttttttatttaataaaatagagatggggtctcgctatgttgcctaggctggccttgaactcctgggctcaagtgatccttctaccttggcctcccaacgtgctgggattacaggtgtgagccaccatgcccagccttcttggagatcttgtttattcttttttattcttttttttatttttgtctgactgagttgattcaaagaactggtcttcaagccctgagattctttcctccacttggtttattctgctgtaaatacttgaaattgcattatgcaattcttatacagagttttcagctttatcagctcattttggttctttttttaaatggttatttcatctttcatctcttgtatcattttattggattccttaaattcaattgattgggttttttgtttggtggtggtggtggtggttgttgttgtttttggagacagaatcttgctctgtcacccaggctggagtgcagtggtgcaatctcggctcactgcaacctccgcctcccacattcaagcaattctctgcctcagcctcccaagtagctgggattacaggcatctgccaccattcctggtgtgtgtgtgtgtgtgtgtgtgtgtgtgtgtgtgtgtgtagtagagacagggtttcactatcttggccaggctggtcttgtgaccttgtgatccaccaacctcagcctcccaaagtgctgggattacaggcctgagctaccgtgcctgggcttgattgggttttgactttctaatgaatctcaatgatcttcattcctatccagactctgaattctgtatctttcatttcagtcatttcagcctagttaagaacccttgccaaagaactagtgtggtcatttgaaggtgagaagacattttggctttttgagttgccaaagttcttgagctggttgattctcatttgtgtgggctgatgttcctttgatctttgaagttgctttcctttgcatggggttttttgagtttatattcttcgatgcccttgagggtttgagtgtggtacaacatgggttcagtcaactgtctttgtttaaagtatttcagggggccaagcctcagtttatcactcctggtctgcatgttctaaccctggggggctagtattgggctctagctttgttctctggcccttcgaggttagaaacttgctgcaataagaggggctaaggtgttcctggctcactggccataacactctgctggttgggtgctggccaaagtgctttgttgtggcagtggcagtgggatccgtgcttacatgtgtgtgccagcagccacagcagcacagtagggtgcctgcacatcagcagtggcagggcaccagtgggggtggggtggcagcattcatgcatgcactagcgctggtggtgatggcatggtgggatatgcatgcgtcagtgggaaccaggcactagtgggggtggggtggtggtgtctatatgcgtgcttgtgctggtggtgatggggtagcagggtgtgcacacatgtgctggcaggggaggggaggtgagatctgcccacactcatactgacaaagctgtgagcatgggctgtgggtgactgtgtgctggaaaagtggtgggaggaggctgcagtggggagaggctgcaaggtggttgattgcacaacagtggaaactggcctgctggagccagagttaggcatggtgagcaggtgaaggaattattatgacggcccttggaagcaccctggtttggcatctgagtctgtgctgcaagcagatgcagcagggctggagccccaggagaggctggtaaacaggggcacactcagatcaaactggtcccattccatgggcaagacctcccttctctgtctaggtctggcagccaccaaaggccaaagccacctagaggagctttcttccagcttcagttcagggtctgcgtcttccctctgtccactctcaatgccttccctctgaaggtctgcttggagtatggcagtcttccctatggtctggtgtctcagtgagtgatgctcttcctggctgcatctagtcagccatcattggctcctctctaaatttgcatttaatgtctgggaaaaaataggctgttaatctttgaggcataatagtccaagtgtaccgctaatttccccaggtgtgaaaatgaataaatttaaaagctgttggaaccccaaagaacacttttaagccttgatagagatgtgactgtgatctgagttatgtatggtctcagcttctgttctcagattataatcataggttaactcgttttcttatttttcttgatctgttcaatgactagagagaattaaatgatggcagggacaaaagcttcctgccttcttaattaatgactgttgttgtagattaactcccctttattgtcctgatttgcttagacaagatgacagaaaacccacgattattacagcctttgcaaaaaaaaatgttaaatgtactcttactcataagaaacactgcatataactaatcagatttctgtgactatctatgtgcaaaccctgtatgaataatgcaaccctgctaaaaactcctctgtctctgcctatctaaacgaaatcttaacttccctgcttcggattgctgactctattcctttggagttgggatttctgggtgggccatcctcacattctgtgtgtgaatgaactctctttaaactagactctgactcttttaattattttaggttgacatttgataacctgcagatgggacctgaagtaagccttctgcaatcttcactgctttgctgacatctggagctttggtacagcacaagtggcttttacttctttgacttcattggacctggagagggtctctggcctggcttctctcagattttgaatctctctggttttggctgagattcagactttattgaagcatcctgattccacgctcaagaaaactgaaattgaagctttacttttaaaagtaggagtttcatttgttatttctctagagattctgtggtttgcagatttgtgctttcacattcctttgaggataaggttttgttttattcccaaaacttttcagccttttcccttgttcaactttggtgaaggagaaagtgtttctctttgaaaagaggaagcaaatctttgtggctcaaattaaatttgtgattttatattttctaggttctgaagcttggttcagctgacatagctaaactcttcttgagtgaccagaatttccatttccacggtcttcggtcacttaagagaactcaaattatggactattgtccctccaaaatcaagtctttctccctaaggagagatccacctttagaaactccagctgcactcatgtatgaaacttatggtgccacttcttgtcattatttagaaaatggttgcacataactcatgaaaaactaaaattgcaatggccaaagtgggatacctcaactaatttacctgtgtgctcaataagaaaaagctggttctaggataaaacagaatagttaggagagttcttttcaatggtatttaaaacatccaaaagagattttaatagagttacttctttacaaaaggagaataaaaagttacctaaaacaatttccaaatttaaaaagacagctgaaatttctcctcctcctccctcacctcctccttctctttgtcctttattacctgggctactttacctagaacgacctcttctttctcctccccctgcttctgctctggttccatccctggaacagccagtgtctggtagggattaacctgccctagtgtatcagtcacggtagaacttaaaggtagaattaaggaatttcctgatcctcactaggaccctgtgagtcctagtcttctggttttgccagaaaaatcgcaattaaatatttgagcttatgaccctggctctattttaagatgaataaaaattactttaaatggagaactaacacaaactcttattaacagacctggaatcaccttatctgtaataaagtccaccttattacaaggtcccattccttgaagtaaacaaacaattcaatctgtagttgtcacaaatactctaagagacttcttagaattatttaatacctacatttctttctccccaagaggaaaatgtatttagaattagatgataaaactgaattattggacatacttttgtcaacaatccatattgacatggaagacactaaattattgagtagtaaaaaattataaaacccactaaatgtagtacctaatcaatcatggttaaagtcttccactgattttggaaaatttatcttgcctaccccaatcaaagttcaatagattcatcaaaaccccttccaaaccttaaacaataccctctaagaactgaagccctaaaaggtataaagcctatagtttcagattatttaagaataggacttgattattccctgtaacagccaatgtaatactccagtccttcctgtaaggaaatcaaacgatagaggatggaggtttgtacagaatctgacagcaattaaaaacatagtcactctttgacatccagaagggccaaacttccatatgttgttgactgacatcccaactgaacctgagttcttttctttttactttgagacagggccttactctgttgcccaggctggagtgcagtgtgattatagctcactgaggcctcaatctcctgggctcaagcagttctcccgcctcggcctcctgtatagctgggactacaggtgcgcaccacaacacttggctactttttgtatattttgtagagatggggttatcccccttgttacccaggctggtcttgaactcctgggctcaagccatccacctgcctcggcttcccaaattgctgggactacaggcatgagccacctcgccggctgaagctgagttctttactgtaatagacttatgtagtacattctttaatatttctgtagataaaaataatcaatttctcttcaccttcacttgggaaggaagacaatacacatgaatagtcatgcctcagggatgaactgagagcccagcttacttttcacaaatattaaaagcagatctcccagatattgacttcttgaaaattcattttaataaaatacacaggcaatttactcctctgctcagaggataagcaattatttcttaaaaatgggattcacttgttacaacaattagactcaaagggacacaaagcttctaaagaaaaacaccgcctgtaatcccagcactttgggaggccgaggcgggtggatcatgaggtcaggagatcgagaccatcctggctaacaaggtgaaaccccgtctctactaaaaatacaaaaaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaaaaaaaaaaaaaaaaagaaaaacaccaatcctgtcaaaaacaagtgacgtgcttaggccacctaatatttaaggaaggactttctattagtccataccgactgaaaggagttttagctcttctgccatgaagaaccaagaaacagctgggagagttctgggggctggcaagacatttaaaaacttggatcccaaacttttctttaaaagcctgccccttggccggacacagtggctcaggcatgaggcctgtaatcccagcactttgggaggctgaggcaggtggatcacctgaggtcgggagttcgagaccagcctggccaacatggtgaaaccctgcctctactaaaaatacaaaaaaaatagctgagtgtggtggcgggagcctgtaatcccagctacttgggaggctggggcaggagaatcgcttgaacccgggaggcagaggttgcagtgagccaaggtcgcgccagtgcactcaagcctgggcaaaaagaataagactccatctaaatgaatgaatgaatgaatgcctggcccttacatgcttcttttaaacaggacattccagaccctcttgtttggacagaagaaaatcaagaaatgtcagaaatgatcaaaaatgactttactaatgcccaagctttggtgcatgcagattataatcttctattttcagtatttgtacatgaaagtgatggaaagattttaagggtcctgactaaaaaacatggagcccaaagagacctgtggggtattgtagccaacagttagactctgtaataagaggatttccatcttccatgagagccgtaaagcccctgctttgttagttgaagcaactgacgaaattctcatggtgacagcccttagtggttttgtttctcattcttgtgaaagcatttgctaaactcgcgtcatactcaatattattcagttagtagactagtctcatacgaagttttctttctttcagcttctcatatcaacatctctagatgtaataacctaaatcctacaactcttctgtctccatttccagataaaacactgcactattgcataaccctaactgatcactgatcaacttctttctcccaggactgacctcaaagagaccccccttactactgccaatggtgtttggtttacaaatggatcttacttaaaggataaatctgggacttaccactcaggttatacaatagtatctttaactggggggaaaaaaagaaggaggagaagaagaagaggaaagtgttaagcttctaggcaccacctgagctcaacaaacagaattaattacattagtcaggacttgtcaattggcaagaggaataactgctaatattaatatagagagtagatatgtttttagagtagctcatgattttgaaacactatggaaacacaggatttttaacttcttctggtcagtccttaaaaagtggccacctcatttcatgatttttgaaagctatattattaccacagtcactgtttataattaaaattccaggccatttcaaatcagatatcccagaaagcaaagaaaattagctagctgataaggtagcaaaaagagtggctctaaacaaaaacactctgtattaactcttaaacacctgaatttgatataaaattagctcaatccagagctccaaaatcagaatacaaaatcacactttgtgcttgaataaactccctttaaattagactctgattcttttgattattttaggttgacgcaggtgaaggcaaatagatgctgtgattcagggcagaggaatttactggagaaggtggaaacatgagtcaaccgtgaagtaattggtgtcagggagtattgaaatgaggatggttttagggttagaaactaaagggaatccaggcttcattagtttgtttatggcttgcaggtattggactatttaatattcttcccattaagcttttgaataggctttatttatttttctgagacggagtctcgctctgtcgcccaggctggaatgcagtggcacaatcttagctcactgcagcctccacctgctgggttcaagtgattctcctacctcagcctcccgagtagctgggactacaggcgcacaccaccatgcccagctaatttttgtatttttagtagagacagggtttcaccatgttggccaggatggtctcgatctcttgactttgtgatctgcctgcctcggcctcccaaagtgctggaattacaggtgtgagccacggtgcccggccaataggctttattttttagaacagcatttgatttacagaaaaattgagtatatagcacagagaattcccacatatccctgttcctctttacacagtttcgcctattattagcatcttgctttagtgttgttacagttcatatactttacattgttaaatatagtctatttaaagactatagtttatattagttcactcttggtattgtatggttctaagggttttgacaaactcataatgatttctccgttacaagatcatgcagaatagttttacctcctaacactgtctatgttctacctattcattcctctccagctctctccaagcctctgccaactgctgatctttttactgtctctatagttttgtcttgtctagaatgccatcagtgtgaagttcctccatgtcttacttttttcttaaactcagtggcaagaagctccatgtcttttaattgtgtgatagctcattttaaaagttgctgaatcgtattccatcgaatgactgtactacagtttattcactcacctattgaaggatatcttggttgcttccagttgttgacaattttgaataaaaccgctataaacatttatgtgcaggtttttgtgctgaaataagtagttaaatatctaggagtacaactgctggatcagatggtaaagctatatatttagtttgtgggaaacttccaaattttccaaagccactctgccatcgtgcattcccaccagcaataaatgaaagttcctattgctcttcatccttgtcagcatttggtattgacactggtatctattgtagtttgtttatttatttaatttttagtgtttgagacagggtcttgctctgttgctcaggctggagtgcagtggcacaatcatggctcactgcagcttccacctcctgggctcaagcaatcctcctgcctcaacctccagagtagctggacctacagacacatgacaacacacatggaaaatttttaaatttgttttgcagagatggggtcttgttgcccgggcttcttgacctcctggtctcaagtaatcctcccacctcggcctcccaaagtgttgtgactacaggcatgagcttctgcacctggcttcactgtagttttaatttgcaatttcctaatggcatatgacttgagcatcttttcctatactcatttgccgtatgtctaccttctttcatgagatatctgttcagatcttttgcccttttttttttggttttttgttttgagacagagtctcgctctgtcgccgaggctggagtgcagtggcactgtgtcagctcactgcaacctgcgtctcctgggttcaagcaattctcctgcctcagcctcctgaatagctgggattacaggtgcccatcaccatgcccagctagtttttatatttttagtagagacggggtttcaccatgttggccaggctggtcttgaactcctgacctcaggtgatccgcccgccttggcctcccaaagtgctgggattacaggcgtgagccaccgtgcacggcctcttttgcccatttttaagtttttattcttaattgtgacaaaatatacataaaatttaccatcttaatcatttgtaagtgtacagctcagtagtgttaaatacattcacattgttggcagtcattctccagaactcttcgtcttgcaaaactgaaactattcccattaaacaactccctattctgcaacttgccctcctccccctagttcccagcaaccaccatttgttatgggaaaaagccagaacagtatagaagcaagttcccccatactgggaaggagccaagacaccaaagaatgacttagataagttcagtttgaggagtagatgagtttattgggacttacctacagggtactcctgggcagcagcaaggcagcaggacaacatggaggtctgctctgccacctgtctgcttttcatttatgatctatttatttttactttaaaataattttatttttttgagacggagtctcgctctgtagcccaggctggagtatggtggcactatctcggctcactgcaagctccgcctcccaggttcatgccattctcctgcctcagcctccccagtagctgggattacaggcgcctgccaccacacctggctaattttttttgtatttttagtagagacggggtttcaccgtgttagccaggatggtctcgatctcctgaccttgtgatcgacccgccttggcctcccaaagtgctgggactacaggcgtgagccaccacgcctggccaactttaaaataattttgtattaattttcgtgggtgcgtagtagatatatacctactcatatacctcatagtaggtgtatggggtatatgagatgttttgatattggcatgtaatacataataaacacatcatggaaaatgaggtattcatcccctcaagcatttattctttgtgttataaacaatccagttatgctcttagttattttaaatttatttatatatatttatacatttatttaatgtgtaaatattattgactatagtcacctttctaagctgcttttttttttttttttttttttttttttgggagacggagtctcctcgctctgtcgcccaggctggagtacagtggcccgatctcggctcactgcaagctccgcctcccaggttcacgccattctcctgcctcagcctcccgagtagctgggactacaggcacccgccacctcgcccagctaattttttgtatttttagtagagacggggtttcaccgtattagccaggatggtctggatctcctgacctcgtgatccgcccaccttggcctcccaaagtgctgggattacaggcatgagccaccgcgcccggcctctaagctgcttttaggctaattttctggctcttttcctactgtgtgtgcgcaatgggactgttttccttggtatgctctcagatatactctgggatgtttcggttctcagggatacctgctccttgggtgggccactgactcactgcctagctttcagggttcaggcagcagacatagatccttaagtaatctggtgggtgactcatcacactacactcagccatttcattttcttatagcagtgtctaatcttaggtgttgtacatggaaaacaaaggcgttacaggaactgcaaatagggatgcggaaccttttgtcaaggaatccttgaataataaacagatctgagaccttcacttgcttcagattttgaaggaaactgggatagtccatggagggggaatggtggagtctatttctacttttaagggccctacttccccaatatgtctgttgatcctgtagccaaagaaactgatggatgtgagtgagcatgttctgagtgagggatgccaagggcttggggaattatggggggagcaaggaaacgggtgatctatcagagctgttggaggataaaggccagggggaaggagttccagaacttcaggaattagtacgtcggataaacaaaaatattaacattccaaatagaaagtaaatccctgctaatagattaacagggattgtgaaatttaacaaaaagctgtgttgggcatgatggagtccaagagacaccaaaaggggcttagaaagaggcaaatcatccacccccactactgaggcattatggtaaggaattgtgagggttaagggtagagtaggtggttctagtatctattagaaaggtcatagggtgctcactgactgggattattatttctccctgtgtgttcaagggtatcagggggtgcacaagagcagattcctcaaaggggagtcactgggatgctgacgtttttctttttggaccttgagataattacaggtgctccagactactcatgatcgtagggatgtcgaggtgacttcaaggccttggggtgattccccatgagttgtttcagttggagatccatgagtttgcatttttcagattatttagatgcctgtacatcttttgggtttctgctaaaacatggatcttaaagagaggggcattttggcagtggtacctttggccagttacttaagtggaatttcattctctcttggcttccttcacagatgatgtatgaaagcatgaaattcaaagagacaaagggaaattgtgtaaaaagcagatcagccctctgctttactcttaccttctaggtccacaaataggtataacttgaattaggacaggtggagaggagcatataattaatacgatgttaattagtatgagtaaactctctgagtttagtatggagctcattaacaaaactggtaactaaagcagatgccgtttagagttaaacctgggtaatctttccagttgttttctaagtggtattcatagacagagactaattcatctctttgttgtcggtactcttaagtctttgatgagttgattttagttgagaaggctgtggaaatagaatctgaaagcttttctctgatttctccatctgtgatagcccctaggtgttttgagatttaactgtaggtcttcattaattttggtactctcaaaccctagggaggcatctctaggtcctataagaagtttgaataattagtaaagatcttaaagctctagagaagatgcccctaagattgactaacttgtgtaaaaaatttctcccttcatggccgggcacagtggctcatgcctgtaatcccagcactttggaaggccgaggtgggtggatcacttggggtcaggagtttgagaccagcctggccaacctggtgaaaccctgtctctactaaaaatataaaaattagccaggcatggtggcatgtacctgaaatcccagctactcaggaggctgaggcacgagaattgcttgaacctgggaggcagagtttgcagtgagccgaggtcatgccactacactccagcctgggcaacagagcaagactccatctccaaaaaaaaaaaaaaaaaaaaaaaaaaaaaaaaaaaaaaaaaaacaagaaagaaaatttctcccttcattgtatgtagtttcattttcaaaactacagtttcaaaaggccacaacatgacaaccattacaattgatgaccccgaggtggtccattttgtgcactggtcttcttcatctttagttacaagctcagcttcctctctaagtcttgaggtatccttgtatgtaatgatgatatcatttgtcgaatgcttattaaattgtatagactgtgttaagagcaagtttgcacagtaacccttttaatcctcaagtatctctatgatgtaggttttagtattttgattttatagataaggacatagaggctgtatcctcagtaatatgtcatgggtcacacagcaagttaggggcatggccagaatgtgactgaagtgtgttcagctcaaaaccctatggccttaactactacaccagtctttctccattatctcatcctctgagatgcttcccatgaggcagtctcaaactcttaagtccaactcaaagaaaatggcttatctgaatatggtttaatactgttttgatttagaggattttcctattgcctaaaggctttgcagtggtgagaatgggatgggaattcccaaagtcacctggacaagtttaatattaatttttgtgggtacatagtagatatatatacttatgggttacatgagatattttgataaagcatgcaatgcgtaataatcacatcagaatggagtatccatctttgctaaaggataaagcatttatcctttatgttacaaaaaatccaattatactcttttagttattttaaaatgtataattaaattattttttactatagtcaccctgttgtgctagcaaataataggtcttactcattctttcttgccaagaccagctcggtcggggagaccctaacccagtggcactagaggaattaaagacacacacacagaaatatagaggtgtggagtgggaaatcaggggtctcacagccttcagagctgagagcccccgaacagagatttacccacgtatttattaacagcaaaccagtcattagcattgtttctatagatgttaaattaactaaaagtatcccttatgggaaacgaagggatgggccggattaaaggaataggttgggttagttaactgcagcaggagcatgtccctaaggcacagattgctcatgctattgtgtgtggcttaagaatgcctttaagtggttttccatcctgggcgggccaggtgttccttgccctcattccaataaacccacaaccttccagcttgggtgttaagggccattatgaacatgttacagtgctgcagagattttgtttatggccagttttggggacagtttatggccagattttgggggggcctgctcccaacatgtctcccttctttgatttgcaaagagataaaagcaaaggcagctttgtcacagtgagctacttctcacaggagtcaggatccacatctgcacactatacaaagacaaacaacatggattaaaagcacaatcatcattgaaatacagagcttccaagtgtttttatccattctaatgggttactagctgctaatttgtctgcagctcctttaaggactccagttcctggcattaaggtcaggtgtgcctgggatgctttaaatatttgttcttttaattttgccatatccaaaaacaagtttgtagagtgtccttctagatgcctttttattctttcccaaattttgatcttattaagaacatctaatagtttccacaaatccttatgttaagcttctagagcaggccatatcatttgaggttgaggtgccactataccgccacggttccagataataggaacttttgccatacttcttatcatttctaccatctgaccgttttgttcagatcatctgaacatagtgtggccatggcacgcagactgagaggtgcaattcaagctaaacatccccttagggtaccaattaataatgattccataggaatcattgtgcagcacctctgtctgttctgcaaagcaatcttcctaaacaagtacgttcatctttttctaactgggtccaatcctgtttacaaaaaggtttttgaggatggtatgcctcaattatatgagcagatttattatggtaaatactgagatcagaaagcatgtgtaactgtgtcagagtgattgcatccaggcattattgccggccaagattgataaatatgcccaataagtataactgttctctgtgtcagcccctgttgaaggaatactcatggcagtggtgataaccgctatcatagctaccattaaattattcattgtgactggttgtcccgctttcctcaggttttcttccgccatctgtgacagcttcttgatctgtccccaggtgggtggctgtgtttgacgggtgttgctcgtgacaattggggtcctcctcagcatcagtcttgacatggctgcaactggggggtcctcgggatcctcctgtaatctggcttatgctaaggtttcaggtgtattgatggtatccagatcagctgttgattttggcctggagaaacacaagcataacctctaccccaggttatcttcttttcaggtaatgctgtatctgcgtttgagaccagaggcattaacatgggttaaattgtgagtgtctagcattagatattgcattagcaactaggcgatcagccatttgattcccttcagtcaaagatcctggaagaggtatatgagccctaatgtgagtgatgtaaaaagggtgcattctacgtctaactgctgtttgcaattgggtaaataaagtcatcagttgtgtatctgtatgaaatcataactgagcatttttaattaactctgttggaatgaaccacatatgaagaatcagaaatcacattaataggcacatcaaaagcagtcaatacctcaattaccactacaagctctgctttttgagctgaagtataggacgtctggaaaactttactttttgagccaaaataagaagctttaccattactagacccatctgtaaaaacattctcagccccttcaattgatttaaacttagttattttggggagaatccaattagttaatttcaaaaactgaaacagcttcattttaggaaaatgattattgagaatacccacaaagtcagctaaatgggtttgccaagtaagactttttataaaagcttgctgtatttgtgccttcgtgagagggacaataatttttctaggatcatatccatgtaatttaacaatctgagttctcctactccctatagtagtgatttgatctaaataaggagttagagtccatgaattagtatgtggaagaaaaagccattttactaagtcctgttcttggacaataacaccagtgggtgaatgctgagttgaaaaaattagcaaatctagagtcttctctggatctattctatttatttgagctttatggacttgcttctcaatcagttgtaactctgcctctgcctcgtttgttaattgccaagggctagtgagactaggatttcctctaaggatagaaaacagattactcatggcataggtaggaatgcctagagcaggtcgtatccaattaatatcccctggtaatttttgaaaatcatttaatgtttttaatttatccctaagtatggttactttctgtggcacaatggtagtgtcatttactaaggtccccaagtaagaataaggagtagtagtctgaattttgtcaggagctataattaaactaacgcaagaaatcgaattttgcaagtgatcataacattggagtaatatttctcgagtggggcagcacaaagtatatcatccatatagtgaataatgtaacactgtaaaaactttttacgagtaggttcaattgcttgccccacatatgtcaggcaaattgtggggctatttaacatgcccctttccaatgaatacgctttccaatgaatacgcttagcaggctgcaggttgtttactgcaggaattgtaaatgcaaactgttcacagtcttgctcagctaaagggatagtaaagaaacagtcttttaaatctttgactatcaaaggccaattttttggaattatagcaggagaaggcaatcctggctgtaatgctctcataagttgtgtaactgaattgatgtctcttaagtcagttaacattctgcatttacctgattttttcttaattacgaaaactggagaattccaaggggaaaatgttggagctatgtgcccattttctaattgttcagtaactaatttatctaaagcctccagtttctctttacttagcgtccattgttctatccaaattggcttatctgttaaccattttaaaggtataggttctggaggcttaacaatggccgccatcaaacattatttcctaatttttggcgagaactttgtttttccacttgaagcagttctttcaaaccttgcaaatttttttctagtcccataccagggacataccccatttcatgcattgtatgttgactttgagggctatataattgttctggaattagaacttgtgctccccattgttgtaataaatctcttccctataaatttacaggtacagaagttataattggttgaatagtcccaggttgtccatcaggcccttcacagtgcaaaatataactactttgatatacttcaggggctttaccaactccagctatgttaaattgagcaggttgaattggccatgcagatggccagcgctgtagagaaatgattgaaatgtctgctcctgtatctaccaaacctttaaatttctttccctgaatagttatttcacaggtaggacgtttatcagtaatttgatttacccaataagctgctttgccttgtttatttgtgcttccaaatcctcctattcgtttaatttcactttttcccattcccacatacggcaaaatcaggagctgtgctatgcgctctcctggctctgctctccaaggaacagaagtagatgtaacaatttgaatttccccattataatctgaatcaatgactcctgtatgtatttgtatgccttttaaacttacactagaccttcctaaaagtaatcctatcgtccctgctggcaagagtccacagactcctgctgggaccttttgcgggggttccccaggcagaaagctcacagcttttgtgcagcataaatctactgtggcactaccagctgtggcgggggacagacattgtacagcagtgagggaaaggcctgagctggaaatgccccggtttagaatggggcccgggatgggcccctcatggcatttcccgaaattgggttcccttctttatcaaacttagagtgacactgattagcccaatgttttccttttttacattttggacatatttcaggatcagcagttttcttttttcccctaactgacggcctgactcactgattttttctacattctatttagtatgaccatgcttcccacagttaaaacaagttccaggaaacagagtatttcctttatccactctcagtcctgctattgcctgtgctagcagagtagctttatgcagattacctccaataccatcacaggccttgatataatcaactaaatgtgctttccctctgataggtcgcagagcagcctggcaattgggattagcattgtcaaaagctaataactgcaacactatgtcctgagcagccgaatctgcaatcatctttttaagagacttctgtaaccgagctataaaatcaatgtatggttctcttggtccctgttttatagcactaaaggaagggtattgttccccacctgaagtgattttttcccaagctctaatgcacactcctctaagctgttctaaggcatcatcctgcatgaccagttgtgcatcaaaaccagcccaaccaccaacccccaaaagttggtgtgcagttatattaatttgaggttgggcctgggcattgtgagaagccgaatggaagcttcgtctgcccaccaagttttaaattgtaagaactgagcaggggttagacaagctcgagtaagagcatcccagtcagtaggaatcatctgactggaaacagcaacattctttaacagtcccattacaaaaggagaacctggtccatactgatttatagcttgtttaaattatttgagtaatttaaaaggaaaaggctcaaatgtggctataatatttcccttttgattgggggtgggaggggtgtattctaacagggaactgccaagcctctaaatcaccctctcatctagcttgctgaattcctacctgaatagaactaaaagcagtcgcttgaggcgctgctcaaatagtcacaggggcaactacttttcgccccgtgtcctccggaaaagaaagatctggagggtctttttcttcaaaataataatgagggggtgcagaagggtagggatgaacctctccttcctttgctgctttagctggtaaatgaacatgctctgtaacctcttctgttacttcactatactctccttcctcctcatgatcagtgtgaaaaagttccaagatggaatgaaccagaccccacacttgtcccattgttacccttccaagctccccttcttactcaccacggggattgctttaagagtactcctgtgtcctccagctggttttccattccaactgttgctctggcgacccttcgacctggatttgagcccccacgaatggacaccacttgccgagaccagctcagtcggggagaccctaacccagcagcgctagaggaattaaagacacacacacagaactacagaggtgtgaagtaggaaatcaggggtctcacagccttcagagctgagaaccccgaacagagatttacccacgtatttattaatggcaaaccagtcattagcattgtctctatagatattaaattaactaaaagtatcccttatgggaaaagggatgggctgaattaaaggaataggttggactagttaactgcagcaggagcatgtccttaaggcacagatcactcatgctattgtttgtggcttaagaacgcctttaagcagttttccgtcctgggcgggccaggtgttccttgccctcattcccataaacccacaaccttccagcttgggcgttagggccattatgaacatgttacagtgctgcagagattttgtttatggtcaattttagggacagtttatggccagattttggggggcctgctcccaacactttctaatttttttgtacccattgaccatctccattccccacgccctacccactccccccaccacattatgcttcccagcctctggtaagcatccttctactctctacgtctatgagttcaattgttttaattgttggctcccacaaataagtgagagcatttagtctgtctttctgtgcctgactgatttcacttaacataatgacctccagttccatccatgttgttgcaaatgacggaatcttatttttttatggctgaatagcactccattatgtaattgtactatattttctttattgattcagctgttgatgaacatttagtttgcttccaaatcttggctattgtgaatagtgctgcaagaaacatgagagtacagatacatcttcgatattctgatttcctttctttcgagtatatacctagcaatgggattgctcaatcatatggtagctctacttttagtgttttgatgaacctccatagtggttgtattaatttacaatcccaccaacagtgtacaagggttcccttttctccacatcctcaccagcatttgttattgcctgtcttttggatataagccatttttaacctgtggtaagatgatttctcattgtagttttgatttgcatttctctgatcagtgatgttgagcaccttttcatttacctatttgacatttggatatcttcttttgagaaatgtctattcagatattttgtctgttttaatcagattattaggttattttcctatagagttgtctgagctccttatgtattcttgttattaatcccttgtcaaatgggtagtttgcaaatattttcacccattatgtgggttgtctcttcactttgttgattgcatcctttgctatacagaagtttgtttttttttttaacttgatgtgatctcttttgttgatttttgcttcaattgcctgtgcttgtggggtattactcaagaaatttttgcccagaccaatatcctggagatttccccctatgttttcttgtagtagtttcatagtttgagaacatagatttaaatctttagacttaagtctttaatgcatttgatttgatttttgtatgtggcaagagataggagtgtagtttcattcttctgcatatggatatccagttttcccagcaccatttattgaagagactgtcctttccctgatgtatgttcttaacatctttgtcaaaaatgagttcactgtagatgtgtggatttatttctgggttctctattctgttccacttgtctatgtgtctgtttttgtaactctaccatgctgttttggctactatagctctgtagtataatttgaagtaaggcaatgtgattcctccagttttgttctttttgctcaggatagctttggctattctgggcttgtgtgtgtctgtgtgtgtgtgtgtgtgtgtgtgtgtgtgtgtgtgtgtgtgttcccatataaactttaggattgttttttctatttctgtgaaaaatgtcattgatattttgatagggattgcattgcatctgtagattgctttgggtagtatggacatttaacaatattgattcgtctaatccataaacatggaatatctttccatttttttgtatcctttaaaatttttttttagggccccataactttgagtatagttttattctgaataaagtgaatatattcttttcgtgtgtttatatgtttatacaaaagtagatgaacagatgtaggcacaattgaaataaaaggaaattctttaaaatattaatattgtattattaattgatgagattataggttatttgaaacgtcttttttatagtttttgttatctttttttattatactttaagttttagggtacatgtacacaacgtgcaggtttgttacatatgtatgcatgtgccatgttggtgcactgcacccattaactcatttaacattaagtatatctcctaatgctatccctcccccctcccccaccccacaacaggccccagtgtgtgatgttccccttcctgtgtccatgtgttctcattgttcagttcccacctacgagtgagaacatgtggtgtttggttttttgtccttgagatagtttgctgagaatgatggtttccagcttcatccatgtccctacaaagaacatgaactcatcattttttatggctgcatagtattccatggtatatatatgccatattttcttaatccagtctatcattgttggacatttgggttggttccaactctttgctgttgtgaatagtgccgccataaacatacgtgtgcatgtgtctttatagcatcatgatttctaatcctttggctatgtacccagtaatgggatggctgggtcaaatggtatttctagttctagatccttgaggaatcgccacactgacttgcacaatggttgaactagtttacagtcccaccaacagtgtaaaagtgttcctatttctccatatcctctccagcacctgttgtttcctgactttttaatgatcaccattcttactggtgtgagatggtatctcattgtggttttgatttgcatttctctgatgaccagtgatggcgagcattttttcatgcatcttttggctgcataaatgtcttcttttgagaagtgtatgttcatatccttcgcccactttttgatggggttgtttttttcttgtaaatttgtttgacttctttgtagattctggatattagccctttgtcagatgagtagactgcaaaaattttctcccattctgtaggttgcctgtttactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacatgtaagtctttaatccactttgaattgatttttgtataaggtgtaaggaagggatccagtttcagctttctacatatggctagccagttttcccagcaccatttattaaatagggaatcctttccccatttcttgtttttgtcaggtttgtcaaagatcagatggttgtagatatgcggcagtatttctgagggctctgttctgttccattggtctacatctctgttttggtaccagtaccatgctgttttggttactggagccttgtagtatagtttgaagtcaggtagcgtgatgcctccagctttgttcttttggcttaggattgacttggcaatgctggcccttttttggttccatatggactttaaagtagttttttccaattcagtgaagaaagtcattggtagcttgatggggatggcactgaatctataatttaccttgggcagtatggccattttcacgatattgattcttcctacccatgagcatggaatcttcttccatttgtttgtatcctcttttatttcattgagcagtggtttgaagttctccttgaagaggtccttcacatcccttgtaagttggattcctaggtattttattctctttgaagcaattgtgaatgggagttaactcatgatttggctctctgtttgttattggtgtgtaagaatgcttgtgatttttgcacattgattttgtatcctgagactttgctgaagttgcctatcagcttaaggagattttgggctgagacaatggggttttctagatatacaatcatgtcatctgcaaacagggacaatttgacttcctcttttcctaattgaatacccttgatttccttctcctgcctgattgccctggccagaacttccaacactatgttgaataggagtggtgagagaaggcatccctctctcaagacagggcatccctgtcttgtgccagttttcaaagggaatgcttccagtttttgcgcattcagtatgatattggctgtgggtttgtcatagataccttattattttgagatacttcccatcaatacataatttattgagagtttttggcataaagccttgttgaattttgtcaaaggccttttctgcatctattgagataatcatgtggtttttgtcgttggttctgtttatatgctggattatgtttattaatttgcgtatattgaaccagccttgcatcccagggatgaagcccacttgatcatggtggataagctttttgatgtgctgctggatttgttttgccagtattttattgaggatttttgcattgatgttcatcagggatattggtattaaattctcttttttttttgttgtgtctctgccaggctttggtatcaggatgatgctggcctcataaaatgagttagggaggattccctctttttctattgattggaatcgtttcagaaggaatggtaccagctcctccttgtacctctggtagaattcggctgtgaatccgtctggtcctggactttttttggttggtaagctattaattattgcctcaatttcagagcctgttattggtctattcagagatccagcttcttcctggtttagtcttgggagggtgtatgtgtcgaggaatttatccatttcttctagattttctagtttatttccgtagaggtgattatagtagtctctgatggtagtttgtatttctgtgggatcggtggtgatatcccctttatcattttttattgcgtctatttgattcttctctcttttcttctttattagtcttgctagctgtctatcaattttattgatcttttcaaaaaaaccagctcctggattcattgattttttgaagggttttttgtgtctctatccctttcagttctgctctgatcttagttatttcttgccttctgctagcttttgaatgtgtttgctcttgcgtctctagttcttttaattgtgatgttagggtgtcaattttttctttagttaattcttacgtattatattttatttttaactattgtaaataggattactttcttaatttctttttcagattgttcgctgttggcatatagaaatcctactgatttttgtatgttgcttctgtatcctccaattttaataaatttatcagttttaatttggtggagtctaggtttttccaaatataagatcatatcatctgcaaataaagataatttgacttcttcctttccaatttggatgcccttcatttctttctcttatctgattgctctagctaggacttccagtactatgttgaataacagtgatgaaagtgggcatatttgatccttgagcagtcttattgaaaaagaaagaaaaaataaaaaaagaaagtggacttcgttgtcttgttccatattttagaggaaaggctttcagttttccccattcagtgtgatactagccataagtctgttgtatatggcttttattatattgaggtatgttccttctatatcttgtttattgagggtttttatcatgaagaggtgttaaattttatcaagtgctttttaatcatcaattgaaataatcatatgtcttctgtccttcattctgttgagatgatatatcacattgattgatttgcatatgttaaaccatccttgcatccagggataaatctcacttggtcatgatgaatgatctttttaatgtattgttgaatttggtctgctagtatttgttgagaatttttgcatcaatattcatcagtgaaatattggcctgtagttttattttttggtgcgtctttgtctgcttttggtatcaggatagatctagcctcatagaatgagtttgcaagtattcccccctcctatactttttgtaatagtttgagtaggattggtattaattcttctccaaatgtttggtacaattcagcagtgaagccattgggtcctggctttttctttgctgggaaaatttttatttttttattaacagtttctatctcataccttgttattagtctgttcaggttttggatttcttcctggttcaatctgggtaggttgtacatatgtaggaatttatcaatttcttctagattttccaatttattggcatatagttgctcataatagccactaatgagcctttgaatttctgtggcatttgttctaatgtctcatttttcatttctaatcttatttggctcctctctcttttttttcttattctgtctaaagatttgtcaattttgtttatcttttcaaagaccaactttttgtttcattgatcttttgtgctactttatttcaaaatctttaattctgctctgatttttattatcttttcttctactaattctgggtttggtttgctcttgcttttctagttctttaagatgcattgttaggtaatttgtttgaagtttttttttctttttcgatgtagatgcttttagttataaacttccctcttagtacttcttttgttgtatcccataggttttggcatgttgtgtttccattaacatttgtttcagaaaacttttcaatttcccccttaacctcttcattgacccactggtcattcaggagcatattaatttccatgtatttgtatagtttctaaaatttctccttttattgatttctacttttatttcattgtagtcagagaagatgcttgatattatttcaattttttgaatgttttaacacttgctttgtgacctaacatatgatctatccttgagaataattcatgtgctgaggaaaagaatgtgtattctgcagctgttggatgaaatgttctgtaaatatttatgaggtccatttggtctatagtgcacattaggtgtgatatttctttattgattctctgtctggaagatctctccagtgccaaaagtggggtgttggcgtctccagctattattggtctgtctctttagctctggtaatctttcctttatatatctgcgtgttccagtgttggatgcatatacatttgtaattgttatcctcttgctgagtcgatccccttatcattatataatgaccttctttgtctcttcttatagtttttgtcttgaaatctattttgtctgatgtaagtgtagctacttctgctcctttttagtttccattggtatggaatatctttttacatcatttttagtctgtatgtgtcttccataaatgaagtgtgtttcttctaagcgacagatcactgaatcttcattttatgtcttttgattggagagtttagtacatttacatccaatgttattactgataagtaatattcatgccattttattatttgttttctgattgttttgtggtcttctcttcgtcctttcttcttgtcttccttttagtaaaggtgattttctctggtggtatgatttaatttcttgctttttacttttgtgtctatttgttgtatgtttgtgatttgagttaccatgagattttccagcactattttataagccattattttaagcttatcactgttatcacaacctaatagtgcttgcataaacaagcaaaaagaaaactaataataactctatgccttaacttcatcccccacattttaactttttgttgtttctatttatatcttaatgtactatgcatcccttgaaaatttcttttagttattattttcaattggttgatcttttggtctatttagtataagactagtttacaaggctgggcgcggtggctcacgcctgtaatcccagcactttgggaagccgaggtgggtggatcacgaggtcaagagatcaagaccatcctgccaagagatcaagaccatcctggccaacatggtgaaaccccgtctctactaaaaatacaaaaattagctgggcgtggtggcgcatgcctgtagtcccagctacttgggaggctgaggcaggagaatcacttgaacctggaaaaaaaaaaaaaaaagagtagtttacaaatcacagttacagtgttttcatattctgtgtttttctgtgtacttactattaccaatgagttttggaccttcagatgatttcttattgctcattaatgtccttttctttcaaattgaagaactcgttagcatttcttgtagatcaggtcttgtgttgatgaaatcattcagcttttgtctgtctggggaagtctttatttcttcttcacatttgaaggatattttcacgatatgtattattctagagtaaatgttttcttttccttcagcactttacatatgtcatgccgctctctcctggcctgtaaggtttccattgaaaagtctgctgtgagacctattggagctccattttatgttatttgcttcttttctcttgctgctgttggaatctttcctttatgcttgacccttggtagtttgattattaaaagccttgaggtagttttctttgggttaaatctgcttggtgttctataaccttcttgtattaggattttgatatctttctctaggtttgggaagtttactgttattatccctttaaactttttactcctatctctttctctacctcctctttaaggccaataactcttagatttgcccctttggggctgttttctagatctcatagatgtgcttcattcttttttattattttttcttttgtcccttctgattgtgtattttcattttttatttctttatttttttatttgactattttcaaatagcctgtcttcaagctaattctttcttctgcttagtctattcttccgttaagagactctgatgcactcttcagtatatcaattacatttttcaccctgagaatttcttgattcttttaaattatttcaatccctttgttaaatgtatctgataggattctgaattccttctctgtgttatcttgaatttgagtttcctcaacacagctacttggtctctttaaatctattttctatctttatgctttcttctttcttccctggaaggatactattatgagctttcatacccttcggctagttacttctctctttcctctttcctttgggcccagggatggtgccagctacactgctgccagcctcaggctcctgcactatccctttttggttccatcacaccctatccaccataagttgttcctttgtaaataaaccctcctctaattattctaatttaagtgttccaactgttttatattgagtccttgactgatatgggaaaattggcagaatatgaatctcctagtaccatcactgaggtgtagaatactgaaagttattatggaagagttctgagatcttagcagtatagagcattgcacagtcttattcctccattatggagaagaaggggctatttggcatgtattttctgaatttgggagcatattttaatatagcaactcatgtttgctactgtttgaatgaagaaatttcactgagcattttttaatgagacactggtcaagagtgccaagcctgaaataatcataatgtattgtgccttagaagaagatgcaggccattttcaactcattttacttctctgcagcccttaaagggtaaacaagagcatgtcagggattcctgtggctccatatgaagggtcgtggagactagcagaagggcagaaaccatcagactgcagtttctccaggctaaacaatggaacatccaacctgaaaatgacgttgggatagtgtcccgatgaaatacggatttcattctagaaggagttcttttggtagcaaagataggcatgaagctgaacattgctccaagaaaaccaaacattgcttataagaaccatataatgttcacacaggtagccagtagcagatggcagagatacatttgactacttactaagtggtttcttcattctctctttgcttccttcataggagatgtatgagaatatgagactcaaagagagagaaaaaagggaaagttcatttttaaaaaaaaagataaaaagataagccctctcctttactgtaagcctctaggttcaaaaacaggtttagcttgagttaggacaggtggagaggaacatagtttaggaaaggaggctggaggcaaggagatgagtctagaatggactttgatatggaagctataaaagaagcaatcttgaatattgaaacaagagtatactattaaacaagaatgattggaaaattgtggagttggccacgaaactgttaagcaaaccgctactcaggagaaaggaagagttattagaaaaggaacacaagttcatgtttatacttcaactcttgagactcactgcaattcccttctgacaggaatttttttttgtcttatatatggtagagttaattgttctagaagcctacttcaagctaacttaagcaacaaagtgggatttattggaaagccgcttgggtgtctcacagaacccaaggaagagaattgagctggatttcacaggacctggaaaaccctcagaaactcaattgttctctctctttcttctctctccagtcagaaccttcaggaaggggagagtggctcatgggctgagtggataaaccacaaaatgggtaatatactataggtgagttttaagtgacaaatgaagtctaagctgttattgcactggtcggtgactgaaactgaaaatgggaattagaggttaagtggagggaatatgttgccaaaatgttagaaggatcttcttcaaagagaagttgaggctctagaggataatggtagggcacagagtggaggtgaagcttgtgaggggtgggggtcaatggggaggataggagagcattcctgattttgaggaggaaggatagagggttttactggtgaatgacgtgagtaagtgtcatgaccgctcgtattctcaggattcttcagtattgggagatgtgactgcagtggacagggcagtgtcagagagactagattttataatagaagcttttaaattacctacccatcaccaacttatcaggagactgacactgtccatctcctccaaaaaaaaaaactgacctgcccggcactttgatgtccaccagttgagctttatgtttatcaagaatagttgtgtaaacttccaaaactgtttatggcaggcacagtggctcacgcctgtaatcccagcactttgggagggtgatgtgggtagatgacttgaggtcaggagtttgagaccagcctggccaacgtggtgaaaccccatctctactaaaaatacaaaaaagaaattagccaggcgtggtagcgggcgcctgtaatcccagctactcaggaggctgaggcatgagaatcgcttgaacccaggaggcggaggtggcagtgagccgagatcatgccactgcactccagcctgggtaacagagcaagactgtctcaaaagaaaaaaaaactgtttatatcagttatatttgttattgtaatgatgaaatttatagacaaactaatgaaataggagtataaacataccagtattttttaaaaataagttgaatattttatgactacataaacaataatcttttaaaagtcactgtcaatttgatgactaggagtcagccatacaactataaaaggttttgagaaaactgtaaagatctaaatagaggctgcatttagtttttttccccacaagaacctttaggttctagacatttatttcaaataaatgtcaactcatctggatgtagcttatgcaagaaagacctagaagagctcttattatggacccccattcaatgaaaacacaatggccctttatttctctttcaacatgaggaggtggaagggctgttcaagcccttctgttcacgatagcccaggaggtccaggagagaggcgagccgtgggtgagcaggagtgtctggggagtgtcaactttccattgaaaaatacccctatgatcaagccatttcacttccgtggcaatcttatttatgtattcaccaaaattgggtgggagctagtgtttagctgtcatcgtccgtaggctgctgtgtttggctcatggcagggtgtgaaactggcatcagggagtgtttgccaagtgaataagggtgaggctgccctttccagagccgccgggagaaactctggatacagagaccctagcctggcgccagtcccagcgttcctcctagtcggggaggaatctgtgggtgggaggtggggagcctgaaacccaaatacaacagccactctgggctgggcgtggttccctgggagctgggtctcagatccttttaaagctgatttctccccggatctccgggcaagatgggcaagtacacggtccgcgtagccaccggggatttgctcctggcgggctctcccaacctggtgcagctatggctggtgggcgagcacggggaggcagacctagggaagcagctgccaccggtgtggggaaaggtgagcgcggactgcggtgagagctggggccctgggactcagaggtgtcactgggggccggggccattcggagggtgctgctgccccacccatgagaaacctgggaagcggggtaggggctgaggtcgggtgcacttggtgcgcctgataggaaaagcgagaggaacaggagagatgagaggcattttcctgcccgagcggaaggacagagacgcccgctggggtgggcacggcaggcccggggggaggctggcgccccgcagtaccagctgctcctcctcacctccacctctccccggctgtgctgtggaggggaaacggagccaggattctctgaaggttcaccgaccccgccgtcctccctgaagaccccaaaacctgagctgtgtactgtcgcgcaggaggcagagtttgagatcgacgtccccctgcacctggggcgcctcctgatggtgaagctgcgcaaacacaacgtgctgttgagtctcgactggttctgcaagtggatctcagtgcagggcccggggacccaaggcgaggcctttttcccctgctaccgctgggtgcagggccacggaattatctgcctgcctgagggtactggtgagctcggtggagaaggggcacagcccctggcaggctggaggaagaagcgggtggggggaggctactgtaaaagagggaaaatgagagatgagggagatggggagaagtgaagggggagggtggctgatggggagacccgagcgcggaggggtgaccagggagggcatgtgctcttgtccctctcccccagcccggaccgtgagtgatgacccccagaacctgtttaagaaatatcgggaacaggagctcgaggaaagaaggaaggtgtaccgttgagccccaggaagtctttgatcccctaccagatcccaagaaacctgccacctgcctccttacccctacctgtgtgttcttcctccaggtggggctcctggaaagatgggttaatcctgcctatagcagggaataggcaaccggaccttcctagggacgagcgattcctcgaggataaggatttagactttaatgtctccctagcaaaagggtgagtaccaggtagaggctgggcacttgcttcctagggcacaaggtgggatgcttccttgatcttcttgcactccattctttccacaggttgaaggacttggccattaaggggacactggatttcataaattgtgtgaaaaggctggaagatttcaaaaaaatattcccacatggaaagactgtcctggctggtcagttttcacaacctcccaaaaccaatatacagacttccaacccagggatttgaaaaaggagggggatggaggattagatcagtgggattaggagttcggagctcagagctcacagggtgctccccaattgatgttcctagagcgggtttatgattcttggaagaatgatgccttctttgggtaccagtttctcaatggtgcaaaccccatgctcctgaggtgttcttcaaggctcccagcctgcctggtgctgcctccagggatggaagacttgaagacccagctggagaaagaactccaggtgctgctgggctttctgcccatccaccatcccagccattacccccacctcccttctcctcccatctccagccccttctctcatctcctccatctacacccaaggtttctcaacgttggcactattaacattctgcaccacataattctctgttggctggcggggggggggggggggggctttcctgtggatcgtagggtgtttagtagcattcctggcctctacccattgatgccagcagcatccccccggttgtgacaaccaaaaatgtgtctagatagtgctgaatgtcctggggttggggagaggaggaattgcccctgattgagaacattgatctacaacatctcctcctgtatcttcttttctttctccacattcctctcttccttcttcattgaacatatatcagccttagggaaaagcgcaagcttctggagagaaatagcaagaaaaactaaacaaagccttggagagctaaaagctgaatctgtttttggggggagatgggtagctaaaggaaatatttttgctacattggctaaagctggcagaagaggggatacgtgaagaatgcagtggccttatgtggtggaaaaccagaaacttcgctgcagggagctccaagtctgaaggaagacatcagtcatgaaaactttgcattcagttttttggttctgcagaaagtgattggtgtttaaagtaaaaaagacttgggtgggtagaggaaggatccaccctggaaaatgagagaagggcagctccagaaacaactccaaccctgttttctattcctgcccctggccctgtaggctggatctctgtttgaagtggatttctccttgctggatggagtcaagcctaatgtcatcatttttaagcagcaatgcgtggcagcccctttggtcatgctgaagcttcagcctgatggaggactcttacccatggtcatccaggtgagagggcccaggtatttttctaccagacactgatctcctttagggacttagatacacaagttctcagcccccactctctctcctgctctagctccagccaccttgacacggatgtcccccacctctgctctttctgccctcgcatccccccatggcctggctcctggccaagacctgggtccggagctctgatttccagctgcagcagttacagtcacatctgctgaggggacacttgattgctgaggttattgctgtggctacaatgagaagcttgcctagcctccatcctatctacaaggtacttcagcatctctgtcattctgtatctgactgtccttcatatttcagactcctacaaagagtctaaccttgtacatttcagtctagcagcaatcaatttatatgtggagacacatacacagatacatacacacacgcgtacacatacacagtaatatggaaacacccaggacacacacttactatgagttggggggagaagtgagaataggttttgcaaaggagttgaaattttggctgaggaggtttccaggtgggcaagtgaggggtggaacattacagccacaaagatctaaagaggcgaggaaagaagggaacatggataatggctgagattgggtgagattaaagtgtagggcatgagttgggatgaggaggaagaagaagtgggaggagatgagagaagaagccatgttacttagcggggagaagaatcaagagttattttctgaccatgtggggcttccaatgcctataaagacccatttgcacatgtcaggagggcaactggatatgtgagtctggagttcctagaagaggtgtaggttgaaaatacagattttagagtcattagaaaacaaaagtatcaaagtcattgtactggatgaagttctctagggtttgtagagaatttgaccgagatataactctagggtgaaccaacatttacagactgagagaagggagcagagtgagaaaagaaacaagagaaggaacctcattgaggtaggaggaaaatcaaaaagtgcaatccatggcagccaggaaaagaaagcgtttcaagagggacgcgtgattatctgtctcaagtgctgctgagagatcaagaaagttacagagaagtgacatttggatttctcaatatggaagtcattggttaataaatggacatgcgccatctcagggaagtggaggaagcctgattcatgggggtgagcagcaaatgtgaggtgggtaagcaaagacaacactgagtgaagatttgctgtgaaagggaaagcaagaaacagggagatggcaagacaaggatgtgggggtcaagcacaggttttctttagggtatccaatattgcacatgtttgtatgacagagagaggagaaggaatataattataggagggtgaaggcaaaaagggatgggctcatatgtgggtacctgcgaggatatgggatttttagaattcttccaaggacatgaaactgtggaaataagtgaactcctaaaactttcaccacgggatgctctgagaagacattttcccatctctatattcccaaatgttaccctgacccactccaatttaacgagaagtctctccatttcataaagacccatcctctcccttcttttctgtcacttcctttaacatcctcttccctcatggatgctgggaactctcttatttgaccatgtcccatttctttcttccataatcagctcctgatcccccacttccgctacaccatggcgatcaacacgctggcccagagtagtcttgtctccgaatggggaatttttgacctggtatggaaatggatgggtgaaggggaggatggttcaatattggaagaatcctaggggttgtttccctttcccattcctcccccaagctctccttcctccatggaaggcctctcccaaacctgcctcatgcctgaagagcttcctgcttaaaagggctagagtaggatcataggcctggagtttcctgatactcatctccctccctctgcaacttggcatggctgtgggttatcctcaggtggtgagcactggtagtggaagccacgtggacattcttcagagagccatggcttgtttgacctatcattccctctgtcctcctgatgacctggctgaccgtgggctcctggatgtgaaatcttctttttatggctaagatgccatcaggctgtggggaatcatcagccggtaggtgaaggtggcacagagaggcaatgaacggaggggcgggggactgtaggtccagaaggtcctgcattggcccctgagactgagtgtcttcttcccagggaataggtacgtggaggggatggttgggcttttctacaatagtgaccaagccatgaaggatgatctagagctgcaggcctggtgcagagagatgactgagactggactgcagagggcccaagaccaggggtgagacatggatccttccccactgaaccctgtcaacacccactcctctgcaaacaatctgcttcttctcacatcatcatgagacaccccacctgcccaaggaagctgagaattctccagagtgtgtccagaaatgctaacaagcactcctgatctccccagccctgttcctacacagtgttctctctcctctgcactaagagcttcctctggaactagatacaaaacttctcttaggtattttccctcactcttccctcccctctccccatagctcaaggttcatcccaagtgcattaacctttgagcacacacaaggtgggagtcctagggtgtgcaggccagaaccacagaaaagttcttttctgtatctccacatagctttccctgcgtgagacctatttcgtgttctggtttcgagatctctgattctcatttcaccaggattctcatttcaccaggttcctcatctccttagagtcccgggctcagctctgccactttgtcaccatgtgcatcttcacatgcacaggtcagcatgcttctaaccacctgggccaggtaacctatgtgatcatcccacaacggctcctgggatggagaagtgggggatcaaatgcccaggtcatcagcctgcatttctctgggctctcctccctgcagctggactggtactcctggatccctaatggcccatgcaccatgcagaagcccccgcccatctctaaggatgtgacagagaaggatatagtggacttactgcccaatctccaccaggcacgtatgcaaaagaccttcacaaagttccttggcagacgccagcctgtcatggtgagaagcaaatgcctgggtcctgggaaggaggcagctcaaaggaggggaagtattctgggctgagagtcccaaggggctgagccaacttgtcttctgcctctcagcatgaggagaaatatttctctggtcctgagccccaagctgtgctgagacaattccaggaggaactggcttccatggacaaggagattgaggtccggaatgcagtcctggacctgccctgtgagtacctttgacccagcatggtagagaacagcgtgaccatctgagaggccttgcccgcctcagctccaaagctccaccatccctgagtgcctttgagtattccgtcctcctcacatcctctggtgaacaaattgtccccaaagctttgtggtcagggtatccagagctgctcaccacacaactatggggaatacacagtgatggtccccattgcatttggaagtggcatcccccaaagctgccctaccttaaatgtccatccagtcctgcacttcctcaccccgatccctgcacacctcctcattgccaaaggacctggcttagatacaagtaaaaatatatgattaaataacaaaacgga

SEQ ID NO: 1495 - DNA, 22387 bp, Homo sapiens
agaaacccggaagtggaactctgagccattcagcgtttgggtgaagacggaggcgggttctacagagacgtaggctgtcagggagtgtttatttcgcgtccgcttctgtttctccgcgcccctgtgctgccccgactcacatactcgtccagaaccggcctcagcctctccgcgcagaagtttcccggagccatggccgagtactcctacgtgaagtctaccaagctcgtgctcaagggaaccaagacgaagaggtgggtcctgcagcttgggcgggagcctcctccgttcttttcggacgcactccacccccgcaactccggtggaagccgtggcgcggagagccggctttgtggcctcccaggcttcgccctggcccctgtccgggctggacggaggccgggccgcggttcccggcgtctgtgcagagaggggcagcctcccgcgcggacgaccctggaaacaggatagacgggcaggtgacccgtgaccccgtacccacgagtttgggtcccctgaggcatctctccaggcctctgcctggggggtctgcattagtctgatctcgtagttcatgataatttcctttattagggattattattttctccattgtctcttttctttctagaaaacttattaattttttctaatctaatatgtacagtgaaaccaggatgaatcacacagtggttgaggtgtatatgggctttagggatatgggctcgaacctgcactcttgtcatttactagttttgtaatttgtggcaaattggttaatatgtctgaacttccatttactcattaagagatcaaatatctgaacctccgtttacacatttatactttcagacgttttttatacttttagaagactgtgaggattaaatgagagaacatatatgcagaaaataaattgagccaaatgtgaggaggaggtcgtaatggtaatttattagctttttaggaaaaaatacctgtgcactcatatccccgcttcttttttaactggcagatttgcccgaggtacatacaaatgtcgagtatttcctcctggtctccgtgataaacagaggttttgatatttttaggcgagatagaaagtatcaaggagtgagttgaagccactggccttgagaaccctctcgaggagtctggcctcatgaagatgccagaataaatggcaggtttatcctgaatgaatgtgagatttttactctgtgaatttcctgggaggagaggagagttatcttctgaaaactttataatgaaaatgcagacacgggtgtcttaagatcatcgtaataatcataattaatgctcatatagcactgtcaatgtgccaagaaattgttgtaggcactttgcacattaactttttttcaaatcactcttggttttttatttttttattgagatataattcataattataaaattcacccttttgtacagtcaggggtttttagtatatattcaagaggttcaccactgtctagttgctcagcattttcatcatctcagaaggaaatctccccctacccattaaagcagtcacatcccatcctccccctctcctagtccttggcaaccactaatccgctctctatgtgaaatcgcctattctgaatatttcctaagaaatcatgcaacatgtggccttttgtatctggctcctttcacttataacattattgaggttcatcattgttgtagcgcctgttcctttttatggctgcatagtattccattgtatggatgtatcattttgttcatccattcatcaactgatgaacatttgggttgtttcccctttttggctattgtgactaatgctagtgtgaatattcttatgtaagtatttttgtgggtgtatgttttcatttcccttgggtatacatacttaggagtaaaattgctgggtcatgtggtaactttaactttttgaggaaccccaaactgtttcctgtagatgctgcaccattttacatttccaccaggaatgtgtgaaggtacatattacctcttaatcctcacaatagccttaagagttaggttaagttactatcctaattttttaagtggggaaactgactcagagagattcagtaccttttccaaaaatcacggagctaagaagtgaaagaatcaggatttaaaatctggcagtgtggctctacaatctgctttgaactctaacgtaatatgtgcaaagcctgaagcaacttctcagtactgtatttaagagggcatatcaatgtaagtcttcctaaatcaataatttataaatgaaacagcttaaaagactttcaagtttcaatcttacaatatttatcgtacaaatcaatatacctaaactcgtctatataaattatgtcctgtagtaagaagaaaaagagcaaagataagaaaagaaaaagagaagaagatgaagaaacccagcttgatattgttggtgagtcagttttcagtgctctattctgaaaaaagttaatgtttcttgagatctccttgaaagtgttttcctagttagaaatttatgatgtattcatatttgtcttaaagtgcttaaatattacctacagttataaattccatttattctttaacacagtagatgctactgatgcctttacttcattatcaggagagaaaaattataactctctgacttagtaggcaccattagactgcttaatagccagagattctaatacataattttaaaggcctaatgtaaatgttattcaaccaaatatcttttacaagttattttctttgcacatgtatgcattttaattgtagaagtcggttgtctcttaaaggaagtatcttcacaggaaaaatcattattttgtgaactctgaaatgaatgaaaattttaaatacaacatcagggtagcctgtaaatgatactagaaataaactgacctaaacacacttaaccagcctgttttccgtttagttcttttccatacatatttttttctcttttaaaacttggcaagttgcattttgaatcttcataaattatggtaacttaatatataaaatatggaatggtataaagctaatgttctggaagaatcattgctttcaaaatggcaaatcaacaattctaaaattagggtaaatatctagggtagatatgtagatgtggaattgctgtgtcaaaggataggtgaatgtttaactatataagaaaatgccaaaagttttctaaagtggttgtgccattttaccctcctaccaagaatgaattagtgctccagttacatccttgccaagagttgatggtgttatcagtcttttctcccagtctgagttttaccttttcagtttcttaatggtggtttttggatgagcagcttttttttgagacaaattctcactctgtctcccaagctggaatgcagtgatgcgatctcggttcactgcaagctccacctcccgggttcatgccattctgctgcctcagcctcccgagtagctgggagtgcaggtgcctgccaccacacccggctaattttttgtgtttttagtagcaacagggtttcaccatgttagccaggatggtcagaagcttttaatttttataaagctcagtttattttttttttcttttatggttactgtcttatgtctttgatctaagagatctttgcttaccccaaagtcaggaaaatattctacattgtcttttagaggcatcatagttttagtttttacattaaatctgtcattcatctcaaattaaattttggcatgatgttgtgagttcggtttcaagatttactttttttttttaaacatcttgatagccagttgtgccagcaccactggtgtttcctttttccattaatccactttggtatcttcataaaaaatcaattaactttctatgtattggtctgtttctggactctgttctatcgatacgtttgtctgtttttctgttggtatatttctcttgattgctataatttcatgaagtcttgagatcaggtagtgtgagtcctccgactttgtacttattaactgttaatttattaatttctgcagtgaagtttgttggattttctcgagaactgtattgagtccagatcatttgggggagatcaacatcttaatattgggcctcaatatttcataattttcaatgtagccatcttgcatgcctgtttaaacatttattcttaagtattttataattttacattactgtcaatagaacctttgaatttgattttccagttgtttgctgtcagtatgtagatatacaattgatttttgtatagtgactttgtagtctaagtctgtttcacttattacttctagtggtttgcttatatagaaaactaagaaatttgcaattatgtttcctgtgactatcgttttacttctttctttctaatccttttgtcttgtctttctttttattggtttattatactgtccaggacttctatagcattgaacagaagtcatgagaatgggcataattgcattgctctcaagcttaggcagaaagctttcagtagtccaccatatggtatgacgtctgtaggatctgcagagaaaacttttatcaaaatgaggacattccttttaaaactttgtttcttgggagtttttatcataacgatgtttaatgctgtcagatgcctctttctgtatctgttgagatgattatacagctttcttcattctgccagtggattatattggtttcattttcaacttttaaactaactttacatccctgagataaaccccacttggttgtggtgcgttgtcctttgggatattgctagatttgatttctaggtgtttgtgttttttgtttttttttaagatttctatattggtgttgatgggagatattggacttttgtatccttttcttgtaatgtctttttttgattttggtgtcaaggtgatactgggtgtcacaaaattagatggaaagtgctgtctcctttcctatttttggaaatagctgtgtagagatgggtatgagttgttctttacatgtttgatagaattcaccagtgaagtcagctgaacccggagggttttgtttggtttggttttagttttttgtgggaaaattaaaattttttaagagatattttcagatttttctgttgtgtcagttttggcaatttgtgtcttttaagaaaatttcatctaagttgttggatttattggcatagaattgttcagaatattcctttaatatgcttttaatgtccgtagaatctcatctgtattgcagtctcttcatattggtaatttgtgtttttgctatgttttcctggatcagtcagtctagctggaggtttctcaattctttacaagatcatttattttagatcgttaatgatcgtttagtacaggtgtattcaatcttttagcttccctgggccacaatgaaaggagaggaattgtcttgggccacacataaaatacactaacgataagctgataagccaaaaaaaaaaaaaaagcaaaaaaatctcataatatttcaagaaagtttatgaatttgtgttgggctgcattcacagctggcctgggccacatgtggccctcaggttggacaagcctgtttcaatattacttattttctctttttttcattttctatttcatttattttcagtcttttatttttttcctccctttaacttattttcagtttactttgctcttgttttattgcttcttaggaagggagttagatctcttcattccactttagtttcagttatagtcaacacattttgttttcattttcattccattcaaaatatcatctagttttccttgtgatttttcttttcatggacacgtgagttatttaaaagtatattgtttttaatttctactacatagagatattataggtatgttattgttgctgatttctaattcatttatagtatagttggagaacatactttcttagtgaatttccatgtagacttgaatgtgtattctgcagatgttggttcagggttttttgtttgtttgtttgtttgtttttttggagatggagtctcgctgttgcccaacaggctggagtgcagtggtgcaatctcggctcactgcaacctccgcctcccaggttcaagtgaatctcctgcctcagcctccggagtaactggaattacaggcacctgccaccacacccggctaattttttaaatatttttagtagagacagggtttcaccacgttgaccaagctggtctcaaactcctgacctcaggtgatcctcccgcctcggcgggatccaggcgtgagccgcggtgcccggccagttcagtgttctttagatgtctgttagatcaactggtagagcttgtgactatgcatatcttctgtgtccttactgattttttactaatgctacagtgtattgatagttatgttaaaatctccagcggtaattctagatctgtctacttgagcagtttttgcttaaagtattttgaagccgtcatgtgtacacatttaggattgttaagtcttccttataaattcagtctttcattttcataacattttaaccttatttctgttaaatgtcttgatgcctagtcaaattatttgaccacccttttgctcctgtcaagcctgggcctttgttagtttgtgcttatttattagggttttgctcgtagacttagacagtgactcttagtctaggaaaggttcatcctcatgggcctcagccacatgttctaggtatacttagtgagttctctccactctgctgtgtcccaaatttgtgtgatctctggcatctccagtcagccctcagaagtgccagccactctgcagaggccttgtggagcctgcctgctgcatgcactccccccagcccttggccacagacctgcagagaacttttgcgtactcttttgaggcctcacctgtatgtagttccctcttctccagtaccttattctataaactcccaacatgttagcactgtaagactctcagcttagtgacagtgacattgcctcatttctggaggtctctacctctctccgtgtggtcaagaaactgccattgggcagaaaacacaagtgtgtatgagatttgcctccagtgttttcctgttctcaaatatcacagtcctgttctgcctgtgttccaatctctgaaaacagttttctcaaatattctatccagtttcagttttctcgttggtcatggtgggagggcaagtccatcttggctggaagaggaagtccttctgcgtctttttctctttgtccttccacatggttttgcattgtggattttctaaacttgccgtataagtaagcatgtgcctatttgtgaagggaaagaaaaaaaaccttttaattttttaaagctgttctgttggttcctcacaaggatctgaagggattggtaaataggatgaaagaaattctgtctttcacatggagaaaaccaagtgtgacattaataaaaacgagcatgtctgtaggcaaagagtttcactgagctctgctagattcagaagcagttggacttacaacatcgtactttgcaaaacacatatattttatttacccaggaactaaagctaagtcagctgtggattaatagaaggtctgtgaagggtacttagactacagtaagattggggaagaaaattccatttccaaatctaagatatatcattcctttgtgccaagcacataatgatagtagagatttaagggggcccttagcacggaagcactgggttagtcagaaggtgaggtgagctgtcacacagccttgatgctagaatgagggtgccctggtactatcttatcagccatgacactggtgcattgggccatttttttgttttgttttttttgagacaggctcttgctttgttgctcaggctggagtgcagtgacatgatcgtggctcagtgcaccctcgacctcgtaggctcaagcaatcctctcacctccgactcccgagtagctgggaccacaggctcgtaccaccacacccagctaatttcttaatttttttgtagagatgggggtctccttttgttgcctaggctgattttgaactcctgggctaaagtgattctcctgcttccacctctcaaagtgctggattacaggcatgccagacatatgtaaacattctaaactatgtgacaatatgtgtaaagctttctcatgcattgtgagacaacacagcaggaatatttcaccatctgcctaaggtttaaaaggaaataactttaagcatgtgtctaaatagcaagtaatgttttagagcggattctcttaaattcagcttgggcatctgcaccatatacacagcttgagctgtcacctgacgtagagacaggcaacttcagtgcccgtgttcataggatccactgctttctcacagctaaaaccccagagtggcaccattaagtattatgttatgttactttagtcgataaacatataagcatacctccaaaggttgaatgtaggccacttgcagaaagtaggcagaatgctcacatttaattcttgatgatactgtgtttatatttcttattctttgaaattgcattgagaaaaaatactggcatctgctcaaagtaatttctttttcagttgacaatattaaagtaacgttattgtatcatttccctacttggacagagtgtgaaaattttaaggagcttgtctgccagaaatttcttcttcatttgcaaaacattaatgagttattatatttaaatgattttatttaatattaagtgtacttggtcaatgtggcatagaacatacaaaataaatctaatttaaaatcattaactattatatttataagaaagacttgctaatcataacactgttgataatgattctgaataaagcattatttcttttcctgaaaacaattgtagctataattcaatcatctaaattgcttattagttttatttctttttaattgtctttagctgaaattttaattttgattaattttctttttctccattggttttgtgtgtgtgtggaggtaaaatatacagaatatagaatttgccagtttttctatttttacgtgtatgcttcagtggcatttaaatacatgcaccattttaccttcccaccagcattgcacagggtttccgtttctccacatcctgcccaacatttgtttttctggctttcttggtttctgttttttgtttgtttgtttgttttgataatagctattctaatgggtgtgaagtggtattgcattatggttttgatttatatttccctagtgactagtgatgttgagcgtcttttcaagtgcttattggccatttgtatatcatctttggagcaatgtccgtgtatatcctttgcccagttttgaattgtggtatttgtctttttggagttctctatatagtctggatattaattccttataatgtatgtagtttacaaatattttctccattccctgggttgccttttactctgttgatggcggttcttgatgcacaaaagtttttaattctgatgaagtccagtttgtccacgttttcttttgttgcctgtgcctttgatgttctacataagaaatcattgccaaattcatgtcgtgaagcttttcccattttcttctaaaagttttctaactttagctcttacatttaggtctttggtctgttttaagttactttttgtatttggcattagataagggtccaacttcattttagctaaaattttatgtattttaaaatttattatggaaagcatgaaatgtttagttgaatagaaaattttgtgcagtggaattaactgaatctttaaaacctttttattatggaaatatccaaactattccatacatagaagaatataatgagtcccccatgtgcccaggccccagcattaattatcaatattttgccaatctcatttcatttacacacatgcccccacacacattttttcttagaaaattttaagtaaaatcacagatgttatgtcattttacccatgagtacataaacgtacatttcttaacgtggtatgtctttctgtcatcacctgttttgttctttatttttatatattatactatgtcattatcagaccttgtaaaattaacaagaattccttaatatgtcatatccagttaatgattgactcatttctactctagctaaagtacaatttaggaggaggtttgaggatattttttaacattaagatataaacttttataacaacggcttaaataattgttcctagagtctaatatttctattggcaaattggaaattagtatacatagacatagattctgctcattttactttcaatctaaaatcatagttaagattactggccaggcgcggtggctcacacctgtaatcccagcactttgggaggcagaggcgggtggatcacgaggtcgggagtttgagaccagcctggccaatgtggtgaaaccccgtgtctactaaaaatacaaaaaaaattattcaggcatggtgataggcgcctgtaaccccagctactcgggaagctgaggcagagaattgtttgaacccgggaggcagaggtcgcagtgagccgagatcgcatcactgcactccagcctgggcgacagagcgagtctccgtctcaaaaaaaaaaaaaaaaagattgctatgctagaaagtcttcctgtagaggcatttttaagaaacattatgataggcattggctctggaaagcaggcatgaaatagatgactggggtctatcatgagagagaccattctctatatgtcactttgtaccttcacatgttgcctcttgttttgttttggtctttttttgagacaggaccttgctctgtcactcaggctagagtgcagtggcatgatcatagctcactataacgttgaactctgggctcaagtgatcctctttccccagctccccgagtagctgagattacaggcatgcacccccatgcctggctgtatgttgctattttatgttttaaaaacctaatcctgactgtgctggtagtcgcatgaatctctgcacatacatgcaaacaagtacatgtaaaactggtgaaatctgaataagcttcatggattatatcaatttcagtttcctgattctgacagtgtatgatacttatgcaagatttaatcgagacaaagtgagtaaagaatatgtgagatctttgtattatttcttacaactgcaaaataagaagtttttaaaattaagttataataacaaaaaaaagaactctgtgtcaaaactaaaatataaagttgaaatattgattttattttttaggaatctggtggacagtaacaaactttggtgaaatttcaggaaccatagccattgaaatggataagggaacctatatacatgcactcgacaatggtctttttaccctgggagctccacacaaagaaggtttgtgtctggaagggaagaggctgccacaagtgtagattttaggacattcattcacttaggccaaactctaactagtctcaaacattttccaaaggaatggaaccattgcatttgactcttccatttttttttaattccttaatatttaccagccattggcaagtccctctttctaatataagcatttgaaaacattccgtatagttccagaagagtatctttggaaatcaaaataacatgaataattaaaatagtaagtggaaagaaaaaagaaaacctatttgagtcaaaatgtttgaatttcttttttattcagacctattgccaaaactaacctgggtgcgtttaacagtttgaagtttcctcattttctttagcccattagaggaagcactaatgagatatgaagtaattagaagataaaaagcagtatcatttggtcagcaaggccatcccttgaataagtgaaagcatttagctttttaaataagtgcttatttatgactgtattttaaaacataaagagaagctatctcaaaagttattaaataagcattatatcaccctgtcttactcagtgtataaaattaacactgtagttaaaagaaggtaaaatagatcttgattccaaagatacagtattacagtgacatcagtatatctgaatattcttacatttaattgcagaagaaaatagccacattttttaaaacaaaataatgtctttatatttatagcaaatgtcaaatttattttcaaatgttttttctccaatagttgatgagggccctagtcctccagagcagtttacggctgtcaaattatctgattccaggtgagcttatgttgtaatataattagtaaccagttattttaaaaatttaattgtattcattaaaaattttagtatctgtcttaagcccacagggtaattttgatgtaaaaaacaaaatagcttttttgaaaagtagattttgtgatctacttttaatggatttcctatcaatatataatgctaggctggaaaaaaaataagttaaaaagtgaagattaataatttcacataccgaataagatagattaaaaaatgaatcaaatagtacaaaacctggttcactgttgctgtgatatttaaactcactgtttggaagtccaaaggcaaacaggaagactaaaaaaaggaatattgttgaaaccagcagagaatgttacagaatcataacgaccaaaagaatatttttactcactatttttacagtcattttataaagtaaccttttttattctcaccttgtgcaaaagtatagaacgattctttgggcagaagatactgaaagtgaatttacatattttagtaattggttacatcaatatgataatgatttctgttatataatcattaatgtataaaggagtaaaagtcaattctggcatcccaggagattctcggtaaggtaaaagattagaaatcataattttaaaaaatcacattaagatgattatttctgtactttctttgaaagtctgataagtatggtgaaagacagaataaaagcagaggaagaaaaaattcaatagttttaaactgctttacaattataaacaaaaaaggattataaagaaaattaactgacaaatgaggaaaatatttgcaacaatcttaataggcagtgagttcttactcttcatatgtatcttgtatagaattcatagcactgatgaccccagtagaaaaactgcgaacaatcagatctcaatagaaaaatggacaagggacattaccagataatctaaaaactaaaaaggaaaggaaaagaaaaacaattgttattctagttaactactaaaatgcaaatttataggatactgttttttccatatcaggttttcaagtatttttttaaagtcataatgtttaaaaaaaaatgcgtgatacaaaacatactctgttaatttgaggtaagaatgtaaatggaagcagcattttctggaaaacagtttgatgacataagaactttatactcttcgatccagttatttctaggaattttttctaaggataaagcagttttatgtacagaatagatgtacatagaactatttataataagagaaaaagtaagttttagtaatttattcttgaactttataactaaagaggtataattgaagaatgatgaatttcaaaaatatttgttatgtaatatataaggtacaatgtttatattaaaaaagcacaatataaaactaaatttaaaactgcactgtccaacatggcagcaactagtcacatgtagcttttttcttttttttttttttaaaggcacagagtctcactctgtcacccaggctggagtgcagtggtgtgaccgtatctcactataacctcaaatttctgggctcaagcaatcctcctgcgtcagcctcccaagtagctggtatcacatgtgcatgccgccatgcccagctaactttttaaattttttgtagagatggggtctcactgtgttgtccaggctgatcttgaacttcttgcctcaagcaattctcccgttggcttcccaaagcacagagattacaggagtgagtcaccactcagccacatgcagcttttgaagacttggaatatgtgcagtctgaaattttagatatgtacacagccacacacatacgcatgtcctgttttgatgtcctataattaattttctctcagtctttaacttttatctatgttattaatgtacagaatcgccctgaagtctggctatggaaaatatcttggtataaattcagatggacttgttgttgggcgttcagatgcaattggaccaagagaacaatgggaaccagtctttcaaaatgtaagtgctgttattgtttataaaaacttcctgtcagtttaacagaaagtctgttaacagtcaatcataatatatttaaaaagaaaaagtaggatgcaatagtgtaatacattaaataggaataaatcaataagaacatagagccttaaagagatctcaaaatatagtgcaacaaaaatcgcattagtccttttgcccacaattatttctgtatacccttagtgcctagatatggatctcatttccattgaagaaccagtcaattttaggtctcagagtaggaaaacagagtagttcctaagtatctttgtagcagaaatcatggatgctttcagaaacattagagactgtaagcgaacagtggagcttgctaagaccaagttgtgacaatttgtgcataaaataaataataatagttcattgaagtaaattatctctaaaagactttcagttcataagcttaaaatagcatacgaaaagatagttttaatataagaagaaaaaagataatatactaattcttaattttagtaagtagacagttgtatatggatgttttgttaaatctttgttgacacagaatacataatttcctttttctgtttgtgtgagaagtaaagattgaacaaaaatatgtgagtgctaaacagtctttaaaaagtagataactttatcaaaaacagtaaggaccaatgggcaccacgcagagcaagcaaatagaagataagcttagcctttgagtagcagctttggtagtatacactaatgaattgaaaataggaactcagcagtgttttctaagatgacagattaaacaaacatccctccagaaagaggtaatcacttagactaatttcctcatcccctaggataaaatcttaactcagtgacttgaaaactattttggcccaacccattgagaaatgcatttttacattgcagcccagcacacatgtataactgaagcaagagttgtacttaacaatacttacttatccatgtgttatgcaccttgatatttcttattctcttttaccccttcctctgtgagtctgtgtgtattccttcccccgccccccataccgtacaggaaacaacactacattgatttcatgacccgctaatgtgttgcaacccctttgagatgatcctactagttaggatgagatacttctaataaaagttacaccggtagaaaaggccaatatatcataaggccttagatgatgacttagatagtactaataatacaacactttaggaaagttcgtttcattttatttttaggaaggacactaagtttcaaaaatttaaatttaaatgaaagagggtcttaaaactattgcaaaagggactcagctgaataatctgtggcacaggtttaaatcgtcttggaccacaccaccatgttccagggctcaccaggagccatccagatgagagaccacccagcccttgtgaccttgactaagaaattaaatccatgttatcagcacttttttaacttgatgtgatataaggttaacatattttgtaatcattgtatttataaatattttgtctaaatgttatggtattccaagttttccaaaagaatcaaccaaatacaagttataaataaacattatatttgttaagggagttaagctaaccaaatttataacccagatttagatacacaagaaaatcagtctttaaagttttaatagaaagcagtgtaatatatcaaacattaaacaactaaaaaagtatatgaatatttattttcacacacaaaagtccctcagacattgattcttaaattcaaaacaccaaagcattgtatgtaccttttcatgttttctaattgtgaagaaaataaattttacttaaaatgctaatatttgaataaagtatgcattcataattatgttcttgtctttaaagttaatttttcaaactgaactaaatcagttatgtcttcagtagatcttttagaaaggaagcaatcctacctcatctacttagaatttagtcctactaggaagatacactacaaatgtttattgtggtaatctttgaatagtaaaatgataggtgattttggtttcttttctatatgttcttgtattatatttttcaggtttttctctaagttcttttctgtgatttttaaatcagggaggaaaaattaattcagtctaaacacttaatgtttctcccacaagaagtatcctcatggctattttgttatttgtttcacttaggggaaaatggctttgttggcctcaaatagctgctttattagatgcaatgaagcaggggacatagaagcaaaaagtaaaacagcaggagaagaagaaatgatcaaggtaatgatgacattttatacagatgactgcattcacacatgcgatgtgactgtatctctttaaaatgttaaatggtcatttactgtcactttaaagatttacttaatagctttttataatgtggtgtttcaaatagactcatttttaattataaatcccatagttgatgtcttgtttatacaatgtggtagagaaatgagtgcatctaggagctaccttgccattatctccatggattagtatcttcttctggtagttccacatgctctttttaagctttcattttcttgttttcttgcttgtattttaaaatctaatttttaaaatagataacatgtacacgtggtccaacattttcaaataaaagcatgtgaagacgtatgcctgccatgcgtcttactcacctgtgtcccagcacctgttcgtctttccctttgtttttttatagcctcctaaaatttctttataaacatatgaatatgtttataattttcaactgttttacgctaaaggtagcctcctctatagtctagacttcaatttttttttttccttaaaattgtatcttggagagttttctactatgagtttgaatgtagaaagttttctctttttcttgcttttcctctctttctctctctctcaacagccacataatattccatttcagggatgtaccttaatttatttagtcttttatagatggaaatttaggctgtttccagtcttttgctcttataaacagtgctgcagtacataacattgaatatgcatcagtttgtagatgtgcgggtggacctgaaggtaaatttccagaagcagaattaccaggtcggggtatatgcgtttgtatttacgtaatgcttgagcttctgtgatgataatcactctatgaaacataaaaaatcatagcagaacttctggggccttagccctcagattttaaaaatatttttattaatagtacccgtcttctttgcattaggagaaacatgaatcacataaaacatgatttttattttatttttaaaatttgtgtgcgtcactaagctggaaataaaagttccttattccaggctaaattccctcatccgtagtcagacgcgttatccattgcaccagtggcctgtgccctctctaatcctactctttgttttacatcattgtaaaagttacacagacatcttcatatcaaggtgaaattctaaataatactgttaatataacctagataaatcaagtagttaattggaatctgatgaaaacatttaaggcttaattttttagactcacagaagccactgatctttaatgataaacatataccaggatgtgtctaaagaataactccccacttcttgacacatggcttttctgtgtcttggcattccatctcagtactgagcatcctgaaccttgctttgtttgtctctgttgggaatcacaggttgcatccagtctgacccagatttcctctgtaaggcattgtgggggccagagtggaaggctctaagagagggggcaagtgccttttctaaaatgcccttcgttcttataattagagcataaaaatttatgttacatttttctctactaccagtgcaatttaaaagcatctatcaaatctctgtacatacttcatgttagatttcctgtcataagtttgattttctttttagaatagtcttgatttcaaataatttcaaatctaaagctcaaacaatttcaatctaaaatgtaggtattttcttacagaagggaaatgttatattttttcattgcatgcacccagcacatgcgttgtagtcttgaatttccataatgcccctgtgaggtggatgtgagctcagcattacagacaagaagacagcctctgaccctccttacatcctcgtggtttttgtcagtcagttcatggaaatcacagtgatttcaaggtgtggtaagacaggatgtgtacccaggcccagctgactccagaggccactctcaatatttcatagcacattgcttctcaggaaacaggtcattggggaaatgcagatgggtttgtgacttacatttaattttatttatttatattttattgtatcatgtttaaattattttgcatctggatatcatcacaaaagtgttactgaaggcaacaattgcaaatatatgtgcagtgctttgcacttatacaaagatacaaagatacttacacaaagattgcctttttcactatttaaagcaattttcagacgaaatacaaagttttctgggtctctttggttagtcaagtacctggaagctctgaacagtgattatttaggactcttttcctttaccatttaattgcaggctctcctaatctctgtcagcccttcacctttatgaccttgccttatctaccagaacacagatccctcttactaaaggtagccttgtgttacctctgtcagcccttcagctttatgaccagaacacagatccctcttactaaaggtagccttgtgttacaggccctagcagggaatgttttcaggtctgggacccctctaatcagaactgtcacaaagatgtcatttgcacaaacacgttatttgtcatcactttctaagcagccctggaactggactctggccacagagatcccttaggagacatgagtccttaccattgctaattgcctgttctgtgggtgatcctaattgttgaatgcagattaattaacttatgacatgtggtagtaaacatctatccaaacttaggaggatataagaagctagtaaaagaggtgggttccaattagttaaaaacaagttgtgtaatgttaaaagttttaatactttggtaatagtctgtgcaacataaaatagctattaagctttcaatccgatcaaatgaacacttgtctactagggataatttgatcctagtgtattcacttggaggacaaaattaaattagttaatgatcgctttatttcctagcaggatctgatgtgtaaaatgtttctgaaataattttgtctgtagtgtttctgacacaatgctgtggaggaagcatgtgatagcacttactcatatagattatatatatgaagtaaaaacacatagccagaacctttttctgaatatagttgctcagttaattttttcttctgcataagaaatcatctcgaatgttcttatgtgatacgtaaagtggggaaggtggaagataaacatataacccattggattctcttttccaatatctagattagatcctgtgctgaaagagaaaccaagaaaaaagatgacattccagaagaagacaaaggaaatgtaaaacaatgtgaaatcaattatgtgtatgtattcttttccttttagacctacagatttgacagtgaagtgcttctcaaagtgctttcaaaataaattacctacttagctgggcatggtggtacatgcctataggcccagctactcgggaggctgagacaggaggattgtttgagcccaggagttcaaggctgcagtgagctctgatcaccactgccttccagcctgggtggcagagcaagaccgtgtctgaaaaaatgaaactgatggacaagaagagacgacacaatgtagcctctaggacagagcactgagctaaatgcttttcttttcttgaggcttcagttttcctaatcatcctaccacctcccaaagctagtcactcaggttagtcaatctctctattcattcatagaatgggtgtgatgccagtcaaaggctgtgctatggccaggacacaggggactctagccagcatgccctaatagaagtggggccttgtgctacccagtcaatgagtggccctcctcttgagaggtcatgaaggtcatctttgttgaaaagctccagcttatttaaaaaaatacaattagacctttttttttctcccccaagatggagtctcgctctctcccccagactagagtgccatggcgcgatctcggctcatcgcaacctccgcttcccaggttcatgtgattctcctgcctcagcctcccgagtagctgggactacaggcgcgtgccactatgctcggctaatttttgtatttttggtagagatggggtttcaccatgttggccaggctgttctcgaactcctgaccttgagcgatgtgcctgccttggcctcccaaagtgctgggattgcaggcatgagccactgcgcctggcctacaattagacttttttacaagtgaaaaagaaattaacagtatttataaatttaatagtaaatatgtataatcagagtttgaggtatttttcaatgaagacattttctttacagaaagaaatttcagagcttccaagaccacaaacttaaaataagtaaagaagacagtaaaattcttaaaaaggctcggaaagatggatttttgcatgagacgcttctggacaggtagctatttatttacttatttccactattttcagtagccaatagaaatggcatgtagaaaacctacattctcttaaattactgtagtttttcacatttttgtctttatttctaatttatgagtgtggcaatattacctaaagaggacatcgtaagtttgggaaaagactgtcatgaaagaatatctaaaaattataaccgattctaagtatatacttgaagaaattcaggtttgactgtatctacttcataaatttatcatctttttataactattagaaccagagttagaagcagtttgactaatataaaaattatgtggattctgttagagtagttcaggttccttaaaataagaatagatcaactaaaaaactaagtataaaagctaaacaagtgaaattgaagcagttttattataagatttggaagagtgcaggatgtttatcataccacattattaatatttattactcttcctaggtagataagtaatgtcctagatttatgacatagaaaaacagagacgtttagctgtgagtgtacaagtataaatcaattaagtgccagattttgataatcaccagccgctcattcaagtcgtatgttgcaaagttactcttacccttttttttacattacttgataaaggcaatgtttaattacgtatttcctgttaactagctggtagtgttcatacctaaagtcagtaaataatgttaagaattttttccagctgagcaaatgaatatgtatctcattgtaagaaatcaagaagaggatataaaatataatcaggatgtggactctaaaacggaataagctctatgtcctgtaacttttatcacttgtaataatacagcattctcaccctgttaaatggaaatttagagcagccttaaattccggaataattaaaattgctatttggattgaaaaagcccttaggcaacatttattgaatattaggaaataacttttataagattagaatccattttttatagaaaccaaatttaaaagtatacatattttaataaaagtgttgtggtaataaccaaaattgaacacacagttttaaagctttttatatttagtagcagttgaatatatatggcatgttttacatagattaattttatttttctttgtttaaacaggagagccaaattgaaagccgacagatactgcaagtgactgggatttttgtttctgccttatctttctgtgtttttttctgaataaaatattcagaggaaatgcttttacaga

SEQ ID NO: 1496 - DNA, 21089 bp, Homo sapiens
cattcagcgtttgggtgaagacggaggcgggttctacagagacgtaggctgtcagggagtgtttatttcgcgtccgcttctgtttctccgcgcccctgtgctgccccgactcacatactcgtccagaaccggcctcagcctctccgcgcagaagtttcccggagccatggccgagtactcctacgtgaagtctaccaagctcgtgctcaagggaaccaagacgaagaggtgggtcctgcagcttgggcgggagcctcctccgttcttttcggacgcactccacccccgcaactccggtggaagccgtggcgcggagagccggctttgtggcctcccaggcttcgccctggcccctgtccgggctggacggaggccgggccgcggttcccggcgtctgtgcagagaggggcagcctcccgcgcggacgaccctggaaacaggatagacgggcaggtgacccgtgaccccgtacccacgagtttgggtcccctgaggcatctctccaggcctctgcctggggggtctgcattagtctgatctcgtagttcatgataatttcctttattagggattattattttctccattgtctcttttctttctagaaaacttattaattttttctaatctaatatgtacagtgaaaccaggatgaatcacacagtggttgaggtgtatatgggctttagggatatgggctcgaacctgcactcttgtcatttactagttttgtaatttgtggcaaattggttaatatgtctgaacttccatttactcattaagagatcaaatatctgaacctccgtttacacatttatactttcagacgttttttatacttttagaagactgtgaggattaaatgagagaacatatatgcagaaaataaattgagccaaatgtgaggaggaggtcgtaatggtaatttattagctttttaggaaaaaatacctgtgcactcatatccccgcttcttttttaactggcagatttgcccgaggtacatacaaatgtcgagtatttcctcctggtctccgtgataaacagaggttttgatatttttaggcgagatagaaagtatcaaggagtgagttgaagccactggccttgagaaccctctcgaggagtctggcctcatgaagatgccagaataaatggcaggtttatcctgaatgaatgtgagatttttactctgtgaatttcctgggaggagaggagagttatcttctgaaaactttataatgaaaatgcagacacgggtgtcttaagatcatcgtaataatcataattaatgctcatatagcactgtcaatgtgccaagaaattgttgtaggcactttgcacattaactttttttcaaatcactcttggttttttatttttttattgagatataattcataattataaaattcacccttttgtacagtcaggggtttttagtatatattcaagaggttcaccactgtctagttgctcagcattttcatcatctcagaaggaaatctccccctacccattaaagcagtcacatcccatcctccccctctcctagtccttggcaaccactaatccgctctctatgtgaaatcgcctattctgaatatttcctaagaaatcatgcaacatgtggccttttgtatctggctcctttcacttataacattattgaggttcatcattgttgtagcgcctgttcctttttatggctgcatagtattccattgtatggatgtatcattttgttcatccattcatcaactgatgaacatttgggttgtttcccctttttggctattgtgactaatgctagtgtgaatattcttatgtaagtatttttgtgggtgtatgttttcatttcccttgggtatacatacttaggagtaaaattgctgggtcatgtggtaactttaactttttgaggaaccccaaactgtttcctgtagatgctgcaccattttacatttccaccaggaatgtgtgaaggtacatattacctcttaatcctcacaatagccttaagagttaggttaagttactatcctaattttttaagtggggaaactgactcagagagattcagtaccttttccaaaaatcacggagctaagaagtgaaagaatcaggatttaaaatctggcagtgtggctctacaatctgctttgaactctaacgtaatatgtgcaaagcctgaagcaacttctcagtactgtatttaagagggcatatcaatgtaagtcttcctaaatcaataatttataaatgaaacagcttaaaagactttcaagtttcaatcttacaatatttatcgtacaaatcaatatacctaaactcgtctatataaattatgtcctgtagtaagaagaaaaagagcaaagataagaaaagaaaaagagaagaagatgaagaaacccagcttgatattgttggtgagtcagttttcagtgctctattctgaaaaaagttaatgtttcttgagatctccttgaaagtgttttcctagttagaaatttatgatgtattcatatttgtcttaaagtgcttaaatattacctacagttataaattccatttattctttaacacagtagatgctactgatgcctttacttcattatcaggagagaaaaattataactctctgacttagtaggcaccattagactgcttaatagccagagattctaatacataattttaaaggcctaatgtaaatgttattcaaccaaatatcttttacaagttattttctttgcacatgtatgcattttaattgtagaagtcggttgtctcttaaaggaagtatcttcacaggaaaaatcattattttgtgaactctgaaatgaatgaaaattttaaatacaacatcagggtagcctgtaaatgatactagaaataaactgacctaaacacacttaaccagcctgttttccgtttagttcttttccatacatatttttttctcttttaaaacttggcaagttgcattttgaatcttcataaattatggtaacttaatatataaaatatggaatggtataaagctaatgttctggaagaatcattgctttcaaaatggcaaatcaacaattctaaaattagggtaaatatctagggtagatatgtagatgtggaattgctgtgtcaaaggataggtgaatgtttaactatataagaaaatgccaaaagttttctaaagtggttgtgccattttaccctcctaccaagaatgaattagtgctccagttacatccttgccaagagttgatggtgttatcagtcttttctcccagtctgagttttaccttttcagtttcttaatggtggtttttggatgagcagcttttttttgagacaaattctcactctgtctcccaagctggaatgcagtgatgcgatctcggttcactgcaagctccacctcccgggttcatgccattctgctgcctcagcctcccgagtagctgggagtgcaggtgcctgccaccacacccggctaattttttgtgtttttagtagcaacagggtttcaccatgttagccaggatggtcagaagcttttaatttttataaagctcagtttattttttttttcttttatggttactgtcttatgtctttgatctaagagatctttgcttaccccaaagtcaggaaaatattctacattgtcttttagaggcatcatagttttagtttttacattaaatctgtcattcatctcaaattaaattttggcatgatgttgtgagttcggtttcaagatttactttttttttttaaacatcttgatagccagttgtgccagcaccactggtgtttcctttttccattaatccactttggtatcttcataaaaaatcaattaactttctatgtattggtctgtttctggactctgttctatcgatacgtttgtctgtttttctgttggtatatttctcttgattgctataatttcatgaagtcttgagatcaggtagtgtgagtcctccgactttgtacttattaactgttaatttattaatttctgcagtgaagtttgttggattttctcgagaactgtattgagtccagatcatttgggggagatcaacatcttaatattgggcctcaatatttcataattttcaatgtagccatcttgcatgcctgtttaaacatttattcttaagtattttataattttacattactgtcaatagaacctttgaatttgattttccagttgtttgctgtcagtatgtagatatacaattgatttttgtatagtgactttgtagtctaagtctgtttcacttattacttctagtggtttgcttatatagaaaactaagaaatttgcaattatgtttcctgtgactatcgttttacttctttctttctaatccttttgtcttgtctttctttttattggtttattatactgtccaggacttctatagcattgaacagaagtcatgagaatgggcataattgcattgctctcaagcttaggcagaaagctttcagtagtccaccatatggtatgacgtctgtaggatctgcagagaaaacttttatcaaaatgaggacattccttttaaaactttgtttcttgggagtttttatcataacgatgtttaatgctgtcagatgcctctttctgtatctgttgagatgattatacagctttcttcattctgccagtggattatattggtttcattttcaacttttaaactaactttacatccctgagataaaccccacttggttgtggtgcgttgtcctttgggatattgctagatttgatttctaggtgtttgtgttttttgtttttttttaagatttctatattggtgttgatgggagatattggacttttgtatccttttcttgtaatgtctttttttgattttggtgtcaaggtgatactgggtgtcacaaaattagatggaaagtgctgtctcctttcctatttttggaaatagctgtgtagagatgggtatgagttgttctttacatgtttgatagaattcaccagtgaagtcagctgaacccggagggttttgtttggtttggttttagttttttgtgggaaaattaaaattttttaagagatattttcagatttttctgttgtgtcagttttggcaatttgtgtcttttaagaaaatttcatctaagttgttggatttattggcatagaattgttcagaatattcctttaatatgcttttaatgtccgtagaatctcatctgtattgcagtctcttcatattggtaatttgtgtttttgctatgttttcctggatcagtcagtctagctggaggtttctcaattctttacaagatcatttattttagatcgttaatgatcgtttagtacaggtgtattcaatcttttagcttccctgggccacaatgaaaggagaggaattgtcttgggccacacataaaatacactaacgataagctgataagccaaaaaaaaaaaaaaagcaaaaaaatctcataatatttcaagaaagtttatgaatttgtgttgggctgcattcacagctggcctgggccacatgtggccctcaggttggacaagcctgtttcaatattacttattttctctttttttcattttctatttcatttattttcagtcttttatttttttcctccctttaacttattttcagtttactttgctcttgttttattgcttcttaggaagggagttagatctcttcattccactttagtttcagttatagtcaacacattttgttttcattttcattccattcaaaatatcatctagttttccttgtgatttttcttttcatggacacgtgagttatttaaaagtatattgtttttaatttctactacatagagatattataggtatgttattgttgctgatttctaattcatttatagtatagttggagaacatactttcttagtgaatttccatgtagacttgaatgtgtattctgcagatgttggttcagggttttttgtttgtttgtttgtttgtttttttggagatggagtctcgctgttgcccaacaggctggagtgcagtggtgcaatctcggctcactgcaacctccgcctcccaggttcaagtgaatctcctgcctcagcctccggagtaactggaattacaggcacctgccaccacacccggctaattttttaaatatttttagtagagacagggtttcaccacgttgaccaagctggtctcaaactcctgacctcaggtgatcctcccgcctcggcgggatccaggcgtgagccgcggtgcccggccagttcagtgttctttagatgtctgttagatcaactggtagagcttgtgactatgcatatcttctgtgtccttactgattttttactaatgctacagtgtattgatagttatgttaaaatctccagcggtaattctagatctgtctacttgagcagtttttgcttaaagtattttgaagccgtcatgtgtacacatttaggattgttaagtcttccttataaattcagtctttcattttcataacattttaaccttatttctgttaaatgtcttgatgcctagtcaaattatttgaccacccttttgctcctgtcaagcctgggcctttgttagtttgtgcttatttattagggttttgctcgtagacttagacagtgactcttagtctaggaaaggttcatcctcatgggcctcagccacatgttctaggtatacttagtgagttctctccactctgctgtgtcccaaatttgtgtgatctctggcatctccagtcagccctcagaagtgccagccactctgcagaggccttgtggagcctgcctgctgcatgcactccccccagcccttggccacagacctgcagagaacttttgcgtactcttttgaggcctcacctgtatgtagttccctcttctccagtaccttattctataaactcccaacatgttagcactgtaagactctcagcttagtgacagtgacattgcctcatttctggaggtctctacctctctccgtgtggtcaagaaactgccattgggcagaaaacacaagtgtgtatgagatttgcctccagtgttttcctgttctcaaatatcacagtcctgttctgcctgtgttccaatctctgaaaacagttttctcaaatattctatccagtttcagttttctcgttggtcatggtgggagggcaagtccatcttggctggaagaggaagtccttctgcgtctttttctctttgtccttccacatggttttgcattgtggattttctaaacttgccgtataagtaagcatgtgcctatttgtgaagggaaagaaaaaaaaccttttaattttttaaagctgttctgttggttcctcacaaggatctgaagggattggtaaataggatgaaagaaattctgtctttcacatggagaaaaccaagtgtgacattaataaaaacgagcatgtctgtaggcaaagagtttcactgagctctgctagattcagaagcagttggacttacaacatcgtactttgcaaaacacatatattttatttacccaggaactaaagctaagtcagctgtggattaatagaaggtctgtgaagggtacttagactacagtaagattggggaagaaaattccatttccaaatctaagatatatcattcctttgtgccaagcacataatgatagtagagatttaagggggcccttagcacggaagcactgggttagtcagaaggtgaggtgagctgtcacacagccttgatgctagaatgagggtgccctggtactatcttatcagccatgacactggtgcattgggccatttttttgttttgttttttttgagacaggctcttgctttgttgctcaggctggagtgcagtgacatgatcgtggctcagtgcaccctcgacctcgtaggctcaagcaatcctctcacctccgactcccgagtagctgggaccacaggctcgtaccaccacacccagctaatttcttaatttttttgtagagatgggggtctccttttgttgcctaggctgattttgaactcctgggctaaagtgattctcctgcttccacctctcaaagtgctggattacaggcatgccagacatatgtaaacattctaaactatgtgacaatatgtgtaaagctttctcatgcattgtgagacaacacagcaggaatatttcaccatctgcctaaggtttaaaaggaaataactttaagcatgtgtctaaatagcaagtaatgttttagagcggattctcttaaattcagcttgggcatctgcaccatatacacagcttgagctgtcacctgacgtagagacaggcaacttcagtgcccgtgttcataggatccactgctttctcacagctaaaaccccagagtggcaccattaagtattatgttatgttactttagtcgataaacatataagcatacctccaaaggttgaatgtaggccacttgcagaaagtaggcagaatgctcacatttaattcttgatgatactgtgtttatatttcttattctttgaaattgcattgagaaaaaatactggcatctgctcaaagtaatttctttttcagttgacaatattaaagtaacgttattgtatcatttccctacttggacagagtgtgaaaattttaaggagcttgtctgccagaaatttcttcttcatttgcaaaacattaatgagttattatatttaaatgattttatttaatattaagtgtacttggtcaatgtggcatagaacatacaaaataaatctaatttaaaatcattaactattatatttataagaaagacttgctaatcataacactgttgataatgattctgaataaagcattatttcttttcctgaaaacaattgtagctataattcaatcatctaaattgcttattagttttatttctttttaattgtctttagctgaaattttaattttgattaattttctttttctccattggttttgtgtgtgtgtggaggtaaaatatacagaatatagaatttgccagtttttctatttttacgtgtatgcttcagtggcatttaaatacatgcaccattttaccttcccaccagcattgcacagggtttccgtttctccacatcctgcccaacatttgtttttctggctttcttggtttctgttttttgtttgtttgtttgttttgataatagctattctaatgggtgtgaagtggtattgcattatggttttgatttatatttccctagtgactagtgatgttgagcgtcttttcaagtgcttattggccatttgtatatcatctttggagcaatgtccgtgtatatcctttgcccagttttgaattgtggtatttgtctttttggagttctctatatagtctggatattaattccttataatgtatgtagtttacaaatattttctccattccctgggttgccttttactctgttgatggcggttcttgatgcacaaaagtttttaattctgatgaagtccagtttgtccacgttttcttttgttgcctgtgcctttgatgttctacataagaaatcattgccaaattcatgtcgtgaagcttttcccattttcttctaaaagttttctaactttagctcttacatttaggtctttggtctgttttaagttactttttgtatttggcattagataagggtccaacttcattttagctaaaattttatgtattttaaaatttattatggaaagcatgaaatgtttagttgaatagaaaattttgtgcagtggaattaactgaatctttaaaacctttttattatggaaatatccaaactattccatacatagaagaatataatgagtcccccatgtgcccaggccccagcattaattatcaatattttgccaatctcatttcatttacacacatgcccccacacacattttttcttagaaaattttaagtaaaatcacagatgttatgtcattttacccatgagtacataaacgtacatttcttaacgtggtatgtctttctgtcatcacctgttttgttctttatttttatatattatactatgtcattatcagaccttgtaaaattaacaagaattccttaatatgtcatatccagttaatgattgactcatttctactctagctaaagtacaatttaggaggaggtttgaggatattttttaacattaagatataaacttttataacaacggcttaaataattgttcctagagtctaatatttctattggcaaattggaaattagtatacatagacatagattctgctcattttactttcaatctaaaatcatagttaagattactggccaggcgcggtggctcacacctgtaatcccagcactttgggaggcagaggcgggtggatcacgaggtcgggagtttgagaccagcctggccaatgtggtgaaaccccgtgtctactaaaaatacaaaaaaaattattcaggcatggtgataggcgcctgtaaccccagctactcgggaagctgaggcagagaattgtttgaacccgggaggcagaggtcgcagtgagccgagatcgcatcactgcactccagcctgggcgacagagcgagtctccgtctcaaaaaaaaaaaaaaaaagattgctatgctagaaagtcttcctgtagaggcatttttaagaaacattatgataggcattggctctggaaagcaggcatgaaatagatgactggggtctatcatgagagagaccattctctatatgtcactttgtaccttcacatgttgcctcttgttttgttttggtctttttttgagacaggaccttgctctgtcactcaggctagagtgcagtggcatgatcatagctcactataacgttgaactctgggctcaagtgatcctctttccccagctccccgagtagctgagattacaggcatgcacccccatgcctggctgtatgttgctattttatgttttaaaaacctaatcctgactgtgctggtagtcgcatgaatctctgcacatacatgcaaacaagtacatgtaaaactggtgaaatctgaataagcttcatggattatatcaatttcagtttcctgattctgacagtgtatgatacttatgcaagatttaatcgagacaaagtgagtaaagaatatgtgagatctttgtattatttcttacaactgcaaaataagaagtttttaaaattaagttataataacaaaaaaaagaactctgtgtcaaaactaaaatataaagttgaaatattgattttattttttaggaatctggtggacagtaacaaactttggtgaaatttcaggaaccatagccattgaaatggataagggaacctatatacatgcactcgacaatggtctttttaccctgggagctccacacaaagaaggtttgtgtctggaagggaagaggctgccacaagtgtagattttaggacattcattcacttaggccaaactctaactagtctcaaacattttccaaaggaatggaaccattgcatttgactcttccatttttttttaattccttaatatttaccagccattggcaagtccctctttctaatataagcatttgaaaacattccgtatagttccagaagagtatctttggaaatcaaaataacatgaataattaaaatagtaagtggaaagaaaaaagaaaacctatttgagtcaaaatgtttgaatttcttttttattcagacctattgccaaaactaacctgggtgcgtttaacagtttgaagtttcctcattttctttagcccattagaggaagcactaatgagatatgaagtaattagaagataaaaagcagtatcatttggtcagcaaggccatcccttgaataagtgaaagcatttagctttttaaataagtgcttatttatgactgtattttaaaacataaagagaagctatctcaaaagttattaaataagcattatatcaccctgtcttactcagtgtataaaattaacactgtagttaaaagaaggtaaaatagatcttgattccaaagatacagtattacagtgacatcagtatatctgaatattcttacatttaattgcagaagaaaatagccacattttttaaaacaaaataatgtctttatatttatagcaaatgtcaaatttattttcaaatgttttttctccaatagttgatgagggccctagtcctccagagcagtttacggctgtcaaattatctgattccaggtgagcttatgttgtaatataattagtaaccagttattttaaaaatttaattgtattcattaaaaattttagtatctgtcttaagcccacagggtaattttgatgtaaaaaacaaaatagcttttttgaaaagtagattttgtgatctacttttaatggatttcctatcaatatataatgctaggctggaaaaaaaataagttaaaaagtgaagattaataatttcacataccgaataagatagattaaaaaatgaatcaaatagtacaaaacctggttcactgttgctgtgatatttaaactcactgtttggaagtccaaaggcaaacaggaagactaaaaaaaggaatattgttgaaaccagcagagaatgttacagaatcataacgaccaaaagaatatttttactcactatttttacagtcattttataaagtaaccttttttattctcaccttgtgcaaaagtatagaacgattctttgggcagaagatactgaaagtgaatttacatattttagtaattggttacatcaatatgataatgatttctgttatataatcattaatgtataaaggagtaaaagtcaattctggcatcccaggagattctcggtaaggtaaaagattagaaatcataattttaaaaaatcacattaagatgattatttctgtactttctttgaaagtctgataagtatggtgaaagacagaataaaagcagaggaagaaaaaattcaatagttttaaactgctttacaattataaacaaaaaaggattataaagaaaattaactgacaaatgaggaaaatatttgcaacaatcttaataggcagtgagttcttactcttcatatgtatcttgtatagaattcatagcactgatgaccccagtagaaaaactgcgaacaatcagatctcaatagaaaaatggacaagggacattaccagataatctaaaaactaaaaaggaaaggaaaagaaaaacaattgttattctagttaactactaaaatgcaaatttataggatactgttttttccatatcaggttttcaagtatttttttaaagtcataatgtttaaaaaaaaatgcgtgatacaaaacatactctgttaatttgaggtaagaatgtaaatggaagcagcattttctggaaaacagtttgatgacataagaactttatactcttcgatccagttatttctaggaattttttctaaggataaagcagttttatgtacagaatagatgtacatagaactatttataataagagaaaaagtaagttttagtaatttattcttgaactttataactaaagaggtataattgaagaatgatgaatttcaaaaatatttgttatgtaatatataaggtacaatgtttatattaaaaaagcacaatataaaactaaatttaaaactgcactgtccaacatggcagcaactagtcacatgtagcttttttcttttttttttttttaaaggcacagagtctcactctgtcacccaggctggagtgcagtggtgtgaccgtatctcactataacctcaaatttctgggctcaagcaatcctcctgcgtcagcctcccaagtagctggtatcacatgtgcatgccgccatgcccagctaactttttaaattttttgtagagatggggtctcactgtgttgtccaggctgatcttgaacttcttgcctcaagcaattctcccgttggcttcccaaagcacagagattacaggagtgagtcaccactcagccacatgcagcttttgaagacttggaatatgtgcagtctgaaattttagatatgtacacagccacacacatacgcatgtcctgttttgatgtcctataattaattttctctcagtctttaacttttatctatgttattaatgtacagaatcgccctgaagtctggctatggaaaatatcttggtataaattcagatggacttgttgttgggcgttcagatgcaattggaccaagagaacaatgggaaccagtctttcaaaatgtaagtgctgttattgtttataaaaacttcctgtcagtttaacagaaagtctgttaacagtcaatcataatatatttaaaaagaaaaagtaggatgcaatagtgtaatacattaaataggaataaatcaataagaacatagagccttaaagagatctcaaaatatagtgcaacaaaaatcgcattagtccttttgcccacaattatttctgtatacccttagtgcctagatatggatctcatttccattgaagaaccagtcaattttaggtctcagagtaggaaaacagagtagttcctaagtatctttgtagcagaaatcatggatgctttcagaaacattagagactgtaagcgaacagtggagcttgctaagaccaagttgtgacaatttgtgcataaaataaataataatagttcattgaagtaaattatctctaaaagactttcagttcataagcttaaaatagcatacgaaaagatagttttaatataagaagaaaaaagataatatactaattcttaattttagtaagtagacagttgtatatggatgttttgttaaatctttgttgacacagaatacataatttcctttttctgtttgtgtgagaagtaaagattgaacaaaaatatgtgagtgctaaacagtctttaaaaagtagataactttatcaaaaacagtaaggaccaatgggcaccacgcagagcaagcaaatagaagataagcttagcctttgagtagcagctttggtagtatacactaatgaattgaaaataggaactcagcagtgttttctaagatgacagattaaacaaacatccctccagaaagaggtaatcacttagactaatttcctcatcccctaggataaaatcttaactcagtgacttgaaaactattttggcccaacccattgagaaatgcatttttacattgcagcccagcacacatgtataactgaagcaagagttgtacttaacaatacttacttatccatgtgttatgcaccttgatatttcttattctcttttaccccttcctctgtgagtctgtgtgtattccttcccccgccccccataccgtacaggaaacaacactacattgatttcatgacccgctaatgtgttgcaacccctttgagatgatcctactagttaggatgagatacttctaataaaagttacaccggtagaaaaggccaatatatcataaggccttagatgatgacttagatagtactaataatacaacactttaggaaagttcgtttcattttatttttaggaaggacactaagtttcaaaaatttaaatttaaatgaaagagggtcttaaaactattgcaaaagggactcagctgaataatctgtggcacaggtttaaatcgtcttggaccacaccaccatgttccagggctcaccaggagccatccagatgagagaccacccagcccttgtgaccttgactaagaaattaaatccatgttatcagcacttttttaacttgatgtgatataaggttaacatattttgtaatcattgtatttataaatattttgtctaaatgttatggtattccaagttttccaaaagaatcaaccaaatacaagttataaataaacattatatttgttaagggagttaagctaaccaaatttataacccagatttagatacacaagaaaatcagtctttaaagttttaatagaaagcagtgtaatatatcaaacattaaacaactaaaaaagtatatgaatatttattttcacacacaaaagtccctcagacattgattcttaaattcaaaacaccaaagcattgtatgtaccttttcatgttttctaattgtgaagaaaataaattttacttaaaatgctaatatttgaataaagtatgcattcataattatgttcttgtctttaaagttaatttttcaaactgaactaaatcagttatgtcttcagtagatcttttagaaaggaagcaatcctacctcatctacttagaatttagtcctactaggaagatacactacaaatgtttattgtggtaatctttgaatagtaaaatgataggtgattttggtttcttttctatatgttcttgtattatatttttcaggtttttctctaagttcttttctgtgatttttaaatcagggaggaaaaattaattcagtctaaacacttaatgtttctcccacaagaagtatcctcatggctattttgttatttgtttcacttaggggaaaatggctttgttggcctcaaatagctgctttattagatgcaatgaagcaggggacatagaagcaaaaagtaaaacagcaggagaagaagaaatgatcaaggtaatgatgacattttatacagatgactgcattcacacatgcgatgtgactgtatctctttaaaatgttaaatggtcatttactgtcactttaaagatttacttaatagctttttataatgtggtgtttcaaatagactcatttttaattataaatcccatagttgatgtcttgtttatacaatgtggtagagaaatgagtgcatctaggagctaccttgccattatctccatggattagtatcttcttctggtagttccacatgctctttttaagctttcattttcttgttttcttgcttgtattttaaaatctaatttttaaaatagataacatgtacacgtggtccaacattttcaaataaaagcatgtgaagacgtatgcctgccatgcgtcttactcacctgtgtcccagcacctgttcgtctttccctttgtttttttatagcctcctaaaatttctttataaacatatgaatatgtttataattttcaactgttttacgctaaaggtagcctcctctatagtctagacttcaatttttttttttccttaaaattgtatcttggagagttttctactatgagtttgaatgtagaaagttttctctttttcttgcttttcctctctttctctctctctcaacagccacataatattccatttcagggatgtaccttaatttatttagtcttttatagatggaaatttaggctgtttccagtcttttgctcttataaacagtgctgcagtacataacattgaatatgcatcagtttgtagatgtgcgggtggacctgaaggtaaatttccagaagcagaattaccaggtcggggtatatgcgtttgtatttacgtaatgcttgagcttctgtgatgataatcactctatgaaacataaaaaatcatagcagaacttctggggccttagccctcagattttaaaaatatttttattaatagtacccgtcttctttgcattaggagaaacatgaatcacataaaacatgatttttattttatttttaaaatttgtgtgcgtcactaagctggaaataaaagttccttattccaggctaaattccctcatccgtagtcagacgcgttatccattgcaccagtggcctgtgccctctctaatcctactctttgttttacatcattgtaaaagttacacagacatcttcatatcaaggtgaaattctaaataatactgttaatataacctagataaatcaagtagttaattggaatctgatgaaaacatttaaggcttaattttttagactcacagaagccactgatctttaatgataaacatataccaggatgtgtctaaagaataactccccacttcttgacacatggcttttctgtgtcttggcattccatctcagtactgagcatcctgaaccttgctttgtttgtctctgttgggaatcacaggttgcatccagtctgacccagatttcctctgtaaggcattgtgggggccagagtggaaggctctaagagagggggcaagtgccttttctaaaatgcccttcgttcttataattagagcataaaaatttatgttacatttttctctactaccagtgcaatttaaaagcatctatcaaatctctgtacatacttcatgttagatttcctgtcataagtttgattttctttttagaatagtcttgatttcaaataatttcaaatctaaagctcaaacaatttcaatctaaaatgtaggtattttcttacagaagggaaatgttatattttttcattgcatgcacccagcacatgcgttgtagtcttgaatttccataatgcccctgtgaggtggatgtgagctcagcattacagacaagaagacagcctctgaccctccttacatcctcgtggtttttgtcagtcagttcatggaaatcacagtgatttcaaggtgtggtaagacaggatgtgtacccaggcccagctgactccagaggccactctcaatatttcatagcacattgcttctcaggaaacaggtcattggggaaatgcagatgggtttgtgacttacatttaattttatttatttatattttattgtatcatgtttaaattattttgcatctggatatcatcacaaaagtgttactgaaggcaacaattgcaaatatatgtgcagtgctttgcacttatacaaagatacaaagatacttacacaaagattgcctttttcactatttaaagcaattttcagacgaaatacaaagttttctgggtctctttggttagtcaagtacctggaagctctgaacagtgattatttaggactcttttcctttaccatttaattgcaggctctcctaatctctgtcagcccttcacctttatgaccttgccttatctaccagaacacagatccctcttactaaaggtagccttgtgttacctctgtcagcccttcagctttatgaccagaacacagatccctcttactaaaggtagccttgtgttacaggccctagcagggaatgttttcaggtctgggacccctctaatcagaactgtcacaaagatgtcatttgcacaaacacgttatttgtcatcactttctaagcagccctggaactggactctggccacagagatcccttaggagacatgagtccttaccattgctaattgcctgttctgtgggtgatcctaattgttgaatgcagattaattaacttatgacatgtggtagtaaacatctatccaaacttaggaggatataagaagctagtaaaagaggtgggttccaattagttaaaaacaagttgtgtaatgttaaaagttttaatactttggtaatagtctgtgcaacataaaatagctattaagctttcaatccgatcaaatgaacacttgtctactagggataatttgatcctagtgtattcacttggaggacaaaattaaattagttaatgatcgctttatttcctagcaggatctgatgtgtaaaatgtttctgaaataattttgtctgtagtgtttctgacacaatgctgtggaggaagcatgtgatagcacttactcatatagattatatatatgaagtaaaaacacatagccagaacctttttctgaatatagttgctcagttaattttttcttctgcataagaaatcatctcgaatgttcttatgtgatacgtaaagtggggaaggtggaagataaacatataacccattggattctcttttccaatatctagattagatcctgtgctgaaagagaaaccaagaaaaaagatgacattccagaagaagacaaaggaaatgtaaaacaatgtgaaatcaattatgtgtatgtattcttttccttttagacctacagatttgacagtgaagtgcttctcaaagtgctttcaaaataaattacctacttagctgggcatggtggtacatgcctataggcccagctactcgggaggctgagacaggaggattgtttgagcccaggagttcaaggctgcagtgagctctgatcaccactgccttccagcctgggtggcagagcaagaccgtgtctgaaaaaatgaaactgatggacaagaagagacgacacaatgtagcctctaggacagagcactgagctaaatgcttttcttttcttgaggcttcagttttcctaatcatcctaccacctcccaaagctagtcactcaggttagtcaatctctctattcattcatagaatgggtgtgatgccagtcaaaggctgtgctatggccaggacacaggggactctagccagcatgccctaatagaagtggggccttgtgctacccagtcaatgagtggccctcctcttgagaggtcatgaaggtcatctttgttgaaaagctccagcttatttaaaaaaatacaattagacctttttttttctcccccaagatggagtctcgctctctcccccagactagagtgccatggcgcgatctcggctcatcgcaacctccgcttcccaggttcatgtgattctcctgcctcagcctcccgagtagctgggactacaggcgcgtgccactatgctcggctaatttttgtatttttggtagagatggggtttcaccatgttggccaggctgttctcgaactcctgaccttgagcgatgtgcctgccttggcctcccaaagtgctgggattgcaggcatgagccactgcgcctggcctacaattagacttttttacaagtgaaaaagaaattaacagtatttataaatttaatagtaaatatgtataatcagagtttgaggtatttttcaatgaagacattttctttacagaaagaaatttcagagcttccaagaccacaaacttaaaataagtaaagaagacagtaaaattcttaaaaaggctcggaaagatggatttttgcatgagacgcttctggacag

SEQ ID NO: 1497 - DNA, 18256 bp, Homo sapiens
cacttctggtgagagaaagctgagcagaatggatctaatctgattcctccacccagaagcccttaaaatgcagctttgttttaagccttcttgaagatttgggctagatctagaaaagaacctcaccacggaggatgtgcaaagtacaacacgtgaccccggagacggaagctcttctctacctccgtaaagatgatctctgatgaacagacatgatcatgcctggagaacagggatggacagtcccgcttctgaaagaccctgtctggctgatgattcatggtgcgccgggcagaccccaggccaagagaccccacccacagtacctgagtgctcagctgggaaccagaccagacctcaaaacaggtttgcagaattaagatgaggagctgagctcaacacagcctccgcagctccccagggcgggcctgagccgagggagagcccatggccatcagggtgctggaatgcatgtcacactgcattacgtgcattacgatccacgctgcaatgacagcccagagcgtggagaacccagagagggtggggagatggaatcccggcgagccagcgctggcagggaccacggggagcagctggtccagccgccggttttccaagagagaagactaagaagtgagtcacttgcccacagccacagagagaaggagggcaacgaggccggcaggtcagcagcgagcagttagttcaaggccttgagggcttccactaactttgaagggcgaggatgggcggagctctggaggccgccggggtaggttcgaggggagtgttcaagaagcctcttttttttttttttttttttttttttttttttttttgagacggagtcttgctctgtcacccaggctggagtgctgtggcgtgatatcggctcactgcaacccccacctcccaggttcaagaaattctcttgcatcagcctccggagtagctgggattacagacacccgccaccacacccggctaattgttgtatttttagtagagacggggtttcaccatgttggataggctggtctcaaactcttgacctcaggtgatccacccgccttggcctcccaaagtgttgggattacaggcctgagccaccacaacaagccaagaagccctttttgtagagttctaatcctgggtctgcggctgagccatggttgtgttcacaaagcagagcaatcaaccgggcatagggatggacctcctggggccaaaatggcggctgacatctccaccctgacctttcttctcaggttcccaaggttaccacccaaccctgccaactttcgcaccccgcaaggagcaagaccccgcccgctcaccacctgcctgtgcagccaacgggcctcgctgagctgccctgggccgctccctccattcacacagttggccctccctctccctgcctcccttcgcctaccccacgaactacttcatccctctgggccggcactgtagaagccccattgttcacatcgacctcccaattatctcctctttccctctccctctgctcctgcccagaccagccccccagcattgacctggatgcctgccacagcctcctccctggtctccggcctcccacctctgctcctcggtctcctctacccagccagtaactgcagagagcactaaagcacagtcctggcatctcacccccttaaccctggccacggcttcccagtgcctccaagataaagcaccaacacctgaggacagcaggtgagtcctcccggagctagctctcccccaccttcctgtcaccctctgccccaggctctgcccgtgctgctgccccctgaacccacacttccgtcttttgctttccctttccctgggatgctcttataccccctggccccctgggatatcttctcatctgttaagtctcaacccagagctgcttcctctgggaaaccctcattggtctcctcgggcagaggctggtgtttttctctcatgcgtcctcgggcagaggctggtgtttttctctcatgcgtcctcgggcagaggctggtgtttttctctcatatgcctgcaacagcctgggatttcctctctcagcgctttttttttttttaatcaaaaaaatttcgacggggagacaggatctcactatgttacccaggctggttgtgaactcctagcctcaggtgatcctcctgcctcggcctcccaaagtgctgggacgacaggcatgagccaccgtgtctggccctctcagcactcgctaccgagggtgttctaatacttcattcgcctgctgtgggaggcagcctctaagatgacgctcagtgatccctgcctcttggtatttcctgtgtaaaaccgtccccttgaatgtgggctgggctaattgactcactttttaatttatttttcagagacagttttaaatttatttttcattctattgcccaggctggagcacagtggcataatcatagctcactgcagcctcaaactcccgggctcaagtgattgcccaccttagcctccctagtagccaggaatccaggcgcacaccaccacgcctggctctgattgacagacgcacaccaccacacctggctctgattgacaggcacacaccaccacacctggctctgattgacaggcacacaccaccacacctggctctgattgacaggcgcacaccaccacgcctggctctgattgacaggcacacaccaccacagctggctctgattgacaggcacacaccaccacgcctggctctgactgacaggcgcacaccaccacgcctggctctgactgacaggcgcacaccaccacgcctggctctgactgacaggcgcacaccaccacgcctggctctgactgacaggcgcacaccaccacgcctggctctgattgacaggcacacaccaccacagctggctctgattgacaggcacacaccaccacgcctggctctgactgacaggcgcacaccaccacgcctggctctgattgattcacttcaaaccaggagaatctgtaactgcccatgtgctcttcttgcccaatgcccagttagagctgatttattacaacaggggaattgcaatagagaaagagtttaatacacgtagagccagcgaaatgggagaccagagttttattattactcaaatcagcctgccccaaaattcagaggcgaaggtctcttaaggagagtttggtgggcagggagctatgggacgtgtgctgctgatcagctgggggggcaatcacgggggtgtggaaattggcccttgtgctctgaggcagcctctgggtagtggccacagaggagctgctggtttgggtggggccttccggtcatcagtaacctgaaaccctgaaaagagatctcaaaaggccaatcttaggtcttacagtagtgatgttatttacaggagtcattggggaagttgcaaatcttgtgacttctcatgggaatcatctcacagcacccacatattcgcggaattcatgcccctttcctcctcttaacccagtggcctttggaatagtggctgggaatcatctcacggcacccacatcttcgtggaattcatgcccctgtcatccccctaacccggtggcctttcattagttttacaaaggcaatttagttttggaaagggctattatcatttaaactataaactacatttctcccaaacttagcttggcccacacctgtggatgaccaagggcaccagcctgaacaacacggtgaagcccctcatctactaataatacaaaaattacccgggcgctgtggcgtgcccctgtagtcccagctactcagggggctgaggcaggagaatggcatgaacccgggaggcggagctggcagtgagccgagatcacaccaccgcactccagcctgggcgacagagccagactccgtctcaaaaaaaaaaaacaaaaaacaagcagtgaatgtggatctaaacaaaatcacaacgtaactcaatcaggaggaagagaagggcagagagtttctgtgtggtggggacagggagaacaaaaatgagctacatcctcattgttcacagtgaaaactcaatagatttatctcaggctgggcacagtggctcacacctgtaatcccagcacttcgggaggttgaggccggctgaccactggagtccaggagttcgagaccagcctgggcaacataggaagaccccgtctctacaaataattttaaaaattagccaggtgtggtggtgcatgcccgcggtcccagctactcagaaggctgaggtaggaggatacctgagcccctggaggtcgaggctgcagtgagctaagatcacaccactgcactccagcctgggcgacagagagagacctgtctgaaaaaaaaaaaaaagaatcatctgaaaaaattgacagtggttgaaaatcattgacatgaggccaactaattaacagaaaaaaggcataaaactaatttacatgcacatagggagagtcagggtgcctgcgccccagtggggttcagaagctcatacagcatcctggcagcacagtttatgggaggcaggaaaagagggggataaaggattactagggaaagtaaatggatctaggaacagagatcagtttacatactattttgtggaaagttctgttcaagtttggttacattcctggctttacaaataattgctccttgtgggtctggaacttgaccaattaaaaaacttcaacttctttggggaaaggtcagagagacctcaaggcttcttcggtcccatatgtcaaagcaccatattctggggtattggtttctgagttccagcacctgtaaggagtagaaaaaggagtctgagttgcaaaggatgggggttttcacaccaagtaaactcataaaactatgttcaagtataactctattacaaattaaaatacaaatctaccacggctgggcacagtggctcacgcctgtaatcccaacacttcgggaggctgaggcgggcagatcacctgaggtcaggagtttgagaccagcctgaccaacatggagaaaccccgtctctactaaagatagaaaaattagccaggcacggtggtgtgcacctgtaatcccagctactcgggaggctgaggcagaggaattgctcgaacccaggaggtggaggttgaagtgagccgagatcgcaccactgcactccagcctgggtgacagagcgagactctgtctcaaaaaaaaaaaaaaatctaccacaatgtctacatatggaaggtgctccaaaagcgtgaaccattagaattcctatggaatgacgttttcatcaaacagcttttgctatacttacaggtggatgtgattgcaaacaacaaagcctgaactcagatggggaaagaatcagtggggatcatattgtgtcatgtccaagaggttcacagatcaaattcaggcatggctggatccaggcgttcacagcgtgccaacagagatcttgctgtctccatttcttggctccattcactgtgttgactttgctctcaaacaggctcctctcagaccttagcacactggcctccagcggttgcaggattctatactgctggcttagtgctcccaacagaaaaagagtgtctctacttggtagttgcaaccaaatgcctcagatagacactgacatggtttggctctgggtccccacccaaatctccagttgagtcctaatcctcagtgttggaggtggggcctggtgggaggtggttggatcatggggtggatttctcatgaatggtttggcaccatcctctcggtgctgttctccatagtgagttctcgagagatctggccgtttgaaagtgtgtggccccaccccctcgctctctctcttgcttctgctcctgccgtgtgaagtgcctgctcccgcttcgccttctgccatgattggaagtttcctgaggcctccccaaaagccgggaagaggccagcgtcatgcttcctatgcagcctgcagaactgtgagccaattaaacttcttcttttttttttttttgaaacggagtttcaaaaaaacaacggagctcttgttgcccaggctggagtgcaatagtgcaatggttgggattacaggcatgcaccaacacgcctggctaatttttgaatttttagtagagtacagacgaggtttcaccatgttggtcaggctggtctcgaactcccaacctcaggtgatctgcctgccccagcctcccaaagtgttgggattacaggcgtgagccaccacatctggccaattaaaatgatttcttcttttctttataaattacaccgtctcagggttttttttgttttgttttttgttttttgtttttagacggagtctcactctgtctcccaggctggagtgcagtgatgtgatctcagctcactgcaacctccgcctcctggattcaagcgattctcctgcctcggcctcccaagtagctgggaccacagtcacacaccaccacgcctggctaattctgtatttttaatagagacagggtctcaccatgttggccaggatggtctcgaactcctgacctcaggtgatccgcctgcctcagcctcccaaagtgctgggattacaggcgtgagccaccgcactcagccagtctcaggtatctttttacaccagtgtgagaacagactaatacagacactcattgatctggcttgggtcacatacccacccttgaacagattgccgtgaccaagggaatagagcacttggattggctaaatcccagtcctaagccgaccgctggaaccacggacaaagtgggggcagagtggtctcacaaagaaaaatatggatgcttttattagaaagagagaagacgctgcaaaaccaacaggtctcccctgtgtctgaagactgagactaggccaggcacgatgactcacacctgtaatcccagcacttcggggggcggaggcaggcgaatcacttgaggtcaggagttcaagaccagcctggccaacatggcgaaaccccatctatactaaaaatacacaaattagacagatgtgcttgtttgaacccagggagtgaaggttgcagttagctgagagtgcgccactgcactctagcctgggcaacagagtaagactctgtctcaaaaaaaaaaaaaaaaaaaaagactgagactgctgtttgccttcatcagcacagaagccgctagttaggaaccattctcctagcacacccactccctgtgcttcacaaaagcaggtcaatgtttacagaagtcccctcttcccacgtcttctcatcttcaggggaaactgttgcgaggaacagaggactggagagaccaatacgggaaacaggaggatgtttatttaaggtgcaccagctcagaggattcgtatccaaaaagctgagcattgaacaaagtcagggtttagcttatataggccagcgcaaaggctgtcaatcacacagtgacagcttctgtcatctacagcataactagtgacttggcacaacctgtgcccttgcatagcgggtaaccttgcagctgaggcaaaagaaaacaggaacttacaaatctgactaagtacaagcattggcaaacatagtcagaattattagttcagagaaggagagacagtcaaggaatttggttttggggattttttgtttttcaaccatgctcgggggtgtctggagcctattcttgcagcttttgcttctcagactaggtcaccgcgacctttttatagccttgcctgttactatccttaaagtaaataaatgcagtacttatgtttctttaaatttctgcctcaaaacaacactaattctcctgattgtctttcatgacagtttccagacctctcacttttctggctgtctttcctggatgctgagtaatgtcaaatgtggcactaaaattcagcacccagggctgaatgaagcttcaggtgtgccccgatcagcccagaggccagtggcatgctcagctcaattctgcttggcagcaaagccacttacagatgcactggcttttcaaacgactgaatgcattgttgactcttactcagcttgcagccaatatctttttttatgtgagctgtcatcaagccagggattcctcattctccattggtgcaactggctcttgaacctacatcaagaactttgtccgtgttcatttcacattgtaggtcttagtgcatttttgctgttctttgaggtgtttttgaatatagatcctgtcttcagtactaaccatctctccgggttttgcacaatctacccatttgaatggagacattcttaattttcatccaagaggataataaaataaatcagggtcaaggttaaaactcacaaccaggcgtggtggctcatgcctgtaaccccagcacttttgggagtccaaggcgggcagatcatttgaggtcgggagtttgaaaccaggctggccaacgtggtggaacccaccccccatctctactaaaaatacaaaaattagccgggtgtgctggcatgcaccggtagtcccagctactcatgagtctgaggcaggagaatggcttgaacccaggaggtggaggttacagtgagccgagatcgcgccactgcgctccagcctgggcgacagatcaagactctgtcacaaaaaaaaaaaaaaagaaaagaaaaggataaaactctgtcccaccacccaagcccacgtgacatgtggacaataattagcatattctggatgtgaagccaaatccctatggaacaaccaaactctattcgttttccagttttgccataacacgtaatcacaaactagatggcttaaaacaacagaaattcattctctcacagttctgccatcagaagtcctaagtcagcagggccatgctccttctgaggctctagggaagagtccttcctagcctccttctagcttttcagggttgttgtgtatccttgatattctgtgggccgtagctcatccttccatccctacctctatctccacataggggtccctcctcttacaagtcattgaatatagggcccaccctaatccattatgagtttatcttatttgattacatctgcaaagacccctatttccaaacaaggtcacatgcccagggactaagggttagaacttgaacataactttttggagagcacaattcaacccacaacacaagtaggatcagtttccgtctttctgtctccttgacctccaggctctgaagagcatctccatcagaaaacttgctgcagcctcgacctcctgagttcaagtgatcctcccacctcagcctcccaagtagctgggactacaggtccaggccaccatattcagctaatttttttattttttgtagagatggggtctctgttgcccagactggtcttgaactccttgtctcaagtgatcctcctcctttggctgggattacaggtgtgagccactgtgccctgcacttgctgacatccagatggccataggattccatgtacccctggcccccaacaccagtcaacctgatccactaacccagtctagagtggtggttgtcagcgggaactctgtgtggctgccctctccctttccaactctttgagattcagacaaaatctgccctgggggaggaggctggagactcctggttgtggaggatgcaggccatggagtgacttgctgaagagaatggcgtgagacagacctcagtgactttgggcttactcagcctcccttgcaactcattttcttcagctgtaaaatgtaaataataaaacctatccagctgggcgcggtggctcacgcctgtaatcccaacactttgggaggctgaggcaggcagatcacaaggccaggagttcaagaccagcctggccaacatagtgaaactctgtctctacaaaaatacaaaaattagctgggcgtagtggtgggaacctatagtctcagctacttgggaggctaaggcaggagaattgcttaaacccaggaggtggaggttgcagtgagctgagatccgtctaaagaaaaccaaaaagcaaaaaacctatcacctttatgaggattaaatgacatcacatttgtaaagtgcttagcccaggcagccgtgagtagcagtggtcgttgccaattgttgccgctgttagctgcttgggagtcagataaagctagatttgaatcagatcttttcttttgttttttttttgagggacggggtcttgctttgttacccaggctacagtgcagtggcaccatcatagcttattgtagtctcaaactcctgggctcaagtgatcctcctgcctcagcctctcaagtagctgggactacgggcgtgtgccactggcccaccaactatgaacccagattttctttttaaaaattgttttttaatttttttttttttgagacggagtttcgcttttgttgccaggctggagtgcaatggcacatctcggctcaccgcaacctccgcctcccgggttcaaacgattctcctgcttcagcctcctgagtagctgggattacaggcaggcgccaccacacccggctaattttgtatttttagtagagacggggtttctccatgttggtcaggctggtctcaaactcccaaccgcaggtaatctgccctcctcagcctcccaaagtgctgggattataggcgtgagccactgcgctcggcccagtttttaaattttttgtatattcttctcttttttccccataggttattggggtacaggtggtatttgctcacatgagtaagttcttttgtggtgatttgtgagatttgggtgcacccatcacccgagcaatatacactgaaccctatttgtagtcttttatccctccctccccccacactcttcccccaagtccccaaagtccattgtgtcattcttttttgctgttgttattttttgtttgttttttgtttttgtttttgagagagagtctcgctctgtcacccaggctggagtgcagtggtgcaatcttggcttattgtaacctctgcctcccaggttcaagcaattctcctgcctcagccttccatgtagctgggattacaggtgcatgccaccacacccagctaatttttgtatttttagttgagacggggtttcgccatattggccgggatggtctcgaactcctgacctcaggtgatccgcctgcctcggcttcccaaagtgctgggattacaggtgtgagccaccacacccagcctagatggcttttattatattgagatgtgtcccttctatgccgattttactgagagttttaatcataaagggatgctggattttgtcaaatgctttttctgcatctattgagatgatcgtgtgatttttgtttttaattctgtttatgtggtgtatcacatttattgacttacatatgttaaaccgtccctgcatccctggtatgaaacccacttgatcatggtggattatctttttgatatgttgttggattcggttggctaacattttgtgaaggattttagcatctatgttcatcagggatattggtctgtagttttctttttaggtcagttttctttttggttttcctggctttggtattagggtgatgctggttttagagaatgatttagggagcgttccgtctttctctatcttgtggaatagtttcagtaggattggtaccaattcttctttgaatgttggatagaattctgctgtgaatccatctggtcctggacttttttttgttggtaatttttaaattaccatttcaatcttgctgcttgctgttgttctgtttggggtatctaattcttcctgatttaagctaggaggattgtatttttccaggaatttacccatctcttcttggttttctagtttatgcatgcaaaggtgttcacagtagccttgaatcatctttggcatttctgtggtatcagttgtagtatctcctgttccgtttcttagtgagattatttggattttctctcctctctgtttttctttttcttttctttttctttcttcctttctttctttctttattattattatttttttgagatagaatctcactattgttgcccaggctggagtgcaatggcacgatctcagctcactgcaacctctgcttcctgggttcaagcgattctcccacctcagcttcccaagtagctgggattacaggcgcccaccaccacgctcagctaatttttgtattttgagtagagctggggtttggccatgttggccaggctggtctcaaactcctgacctcaggcgacccacctgcctcagcctcccaaagtgctgggattacaggcgtgagccgctgcgcccggccctcttcttttcttggttaatcttgctaatggtctatcaattttatttatcttttcaaagaaacagcttttggtttcatttatcttttgtaattttttgtttgtttgtttcaatttcatttagttctgctctgatcttggttatttcctttcttctgctgggtttgggtttggtttgttcttgtttctgtagttccttgaggtgtgaccttagattgcttgtgctctttcagacatttttttttttttagacagagtctggctctgtcgcccaggctggagtgcagtggcgcgatctcagctcactgcaagctccgcctcccgggttcacgccattctcctgcctcagcctcccgagtagctgggactacagatgcccgccaccgcgcctggctaattttttgtatttttagtagagatggggtttcaccgtgttagccgggatggtctcgatctcctgacctcgtgatccgcccccctcggccttccaaagtgctgggattacaggcgggagccactgcgcccggcctcagactttttgacgtaggtgtttagagccacgaactttcctcttagcactgcctttgctgtgtcccagaagttttgacaggttgtgtcactattgttgttcagtttgaagaattttttaatttccatcttgaattaatttttgacccaatgatcatccaggagcaggttatttaatttccatgtatttgcgtggttttgaaggttccttttggagttgatttccagttttattccactgtggccatgagagagtgcttgatagaatttcaattttcttatatttattgaggctcgttttgtggcctatcatatagtctatcttggagaaagttccatgtactgttgaatagaatgtgtattctgcggttgttgggtagaatgttctgcatatatgttaagtccgtttgtttcagggtatagttttaatccattgtttctttgttgactttctgtcttgatgacctgtctagtgctgtcagtggagtattgaagttccccactattactgtgttgctgtctatctcatttcttaggtctattagtcattgctttacaaatttgggagctccagtgttaggtgcatatatgtttaggattgtggtattttcctgttggacaaggcctttcaccattatatactgtccctctttgtcttttttaagtgctgttgctttaaagtttgttttgtctgatgaaagaatagctacccctgctcacttttggtgtccatttgcctgaaatgtctttttccagccctttaccttaagcttgtgcgggtccttatgtgttagacgagcatcctgaaggcagcagatagttggctggcgaattctgacccattgtgcaactctgtgtcttttaaatgcagcatttaggccattggcattcaatgttagtattgagatgtgaggtagcattccattcatcgtgctatttgttgtctatatggctcggttttttgtttttattttttaaattgtgtttttgtttcatacgtcctgtgagatttatgctttaaagaggttctgttttgatgtgtttccacgatttgtttcaaggtttagagctccttttagcagttcttgtagtgctggctgggtagtggcaaattctctcagcatttgtctggaaaagactgtatctttccttcatatatgaagcttagtttcactggatacaaaattcttggctgataattgttttgtttgaggaggctgaagataggacctgaatcccttctagcttgcagggtttctgctgagaaatctgctgttaatctgataggttttcctttataggttacctggtgcttttgcctcacagctcttaggattatttccttcgtcttgactttagataacctgatgactatgtgcctaggcgatgatctttttgcgatgaatttcccagatgttccttgagcttcttgtatttggatgtctaggtctctagcaaggccgggcacgttttcctcgattatttcctcaaatatgttttccaaactgttagatttctcttcttcctcgggaacaccaattattcttaggtttgggtgtttagcataatcccagaatccttggagcctttgttcatattttcttgttcttttttctttgtctctgttggattgggttaattcaaagaccttgtctttaagctctgaatttctttcttctgcttgtttgagtctattgctgagactttccagagcattttgcatttctattaggtgtgtccaatgtttcctgaagttttgattgtttttcatttatgctgcctatttcctggaatatttctcccttcacttcttgtatcatttttttccttacattggggttcgcctttctctggtgcctccctagttagcttaataactcacctcctgaattctttttcaggtaaaccagggatttttttcttggtttgggtccattgctggtgagctagtgtgattttttggaggtgttaaagaaccttgttttgagttggttttctggttccttctcattttggtagtctctgtcagagggaaggtctagggctcaaggctgctgttcagattcttttgtcccacggggtgttcccttgatgtagcactctcccccttttcctatggatgtggcttcctgaggacaagctatagcgattgttatctctcttctggatttagccacccagcacgtctaccaggctccaggctggtactggggttgtctgcactgagtcctgtgatgtgaactgtctgtgtgagtctctcagccatggataccagcacagtatttggggtgtctcatgggtcctgcaggagcgatctgcttccttcatggggtctgtgggtgctctcagctttcctgctttattcctgcagtcattccagagcaaaaattcactatgtgagtctccacagctgctctgtccatctgagtcacagctgcaatctagtcctgcctcccgtccgccatgatccctgtaactctctatttattattattaattattattactgagacagagtctcgctctgttgcccaggctggagtgcagtggcacagtctcagctcactgcaactccgcctcctggattcaagggattctcctgcctcagcttcccaagtagctgggattacaggtgtgtgccaccacgcctggctaatttttctactttttgtagagacaggacattgctttgttggccaggctggtctcgaactcctgacctcaggtgatctgcccacctcaacctcccaaagtgctgggattacaggcgtgagacatggcacccggcctgaacccagattttcaactgccccctgaagcaaatttctttttttttttttcactttgctcattttattttattcaatcctcacaacaacctaagaggtgtattataatcagcactagtttaaaaatatgaaaactgaggcttagagacattaaataatatgtttaaagtccttgagctaataggcagaggagctgtgattaaaaaccaggtttgatgacataatgtctacattcttaatctgtggtgttgaatttccaaacacatttaagtaattaagtcccataatgtttcacacaccacacaactctgagaggagtttctcacaacactcactgcagcccttcagtttcggcatctgtaaaacgagacacctgactaacccttaggctgctgtgagcgctcaggtcacccagcatggagcctggagtgagaaacctgttacagatgtttgcttcttcccttcccttctcctgtgaataaaaggggctgttcacctgacatggcctacccttaggaaactcaaggtgcctcttttttttttctgagacagagtcttgctctattgcccaggctggagtgcagtggcacgatcttggctcactacaacctctgcctcccggattcaagctattctcctgcctcagcctccccagtagccgggactacaggcacacgccaccacgtctggctaatttttgtatttttagtagagacagggtttcaccatattggccaggttggtctcgaactcctgacctcatgatccgcctgccttggcctcccaaagtgctgggattacaggcatgaaccatgatgtccagccatgaccactctcttttctatgtccctggggagagacctcgaattttatttggagcctgtctttataaagactctaaattgtggccaggcacagtggctcatgcctgtaatctgagcactttaggaagccgaggcgggtggaggtcaggagttagagaccagcctggccaacacggtgaagccccatctctactaaaaatacaaaaaattagctgcgtatggtgccgcacacctgtaatccccagctacttgggaggctgaggcaggagaatcgcttgaatctgggaggtggaggttgcagtgagccaagatgacaccactgcactccagcctgggcaacagagtaagactccatctcaaaaaaaaaaaaaaaagactctaaatagtgtttatatatggtgtatatatatatatatatctttgatgtatatctttgtccatcaggtcagcttgttctttcgaaaccctctccagtcactagttttgttgtcgttgttgttgtctgagacggagtttcgcgctcgtcacccaggctggactgcaatggcatgatcttggctcactgccacctccgcctcccaggttctagcaattcttctgcctcagcctcccaagtagctgggattacaggtgcgggccaccacacccagctaattttttgtattttgagtagagacggcgtttcactggttcagtgtttgtacgtgagtgcgttcccacaaatggcagtgtgtgctgtgcgtggtttggtaaccttcattgttttactccacagcttgttttgagagtcccctccattgaaacacgcacatctaatttgtccttcagttcgctggactccacgctgaacgtgccatgctccattgccccgtgagtaactccatgctcttgccggtttcacacggcctctcagagctggagcctttgttcaggagccctgggcagctttcaggaagctcttgggctcatcagcttcctctggctgaagccgccccagtggaatcatggggatttcttactttgaaggtggggccacccgcagactgtaaccggctggttcaagatcaaggacttccccaggccacctgcctcagaggcaagaaaggctcagctgagtcccagacactcctcgctgtggcccctccttcctccctgctgggcaggcccccctcaattctgtttgccagcagggcctagtaacactgaaagacgaaaagggaaataaaataaacacaattaataggctaaaggttactgaataaagtggcagcagtaaataaattgactactgtgcaaatacaaagacatgaagacatgaaacccctgctctaaatgaccactcaccaagagcaaggcctgggctggaggcagggagcacctccctaaggagcactccctctttcccggagtgagtcctccttctagatggaattcagtccgggttcctcttgagccacagtccctgttggggcctatctcagtggactcaagatcctgaacttcttccagattgctgactacacatttgagtcacccagagattaaaagaaaaaacaaataatttcccagtgatcaggagtaaatcagctggggcagggttggtgctatgaatgaccacactgatttgtacacttcactgatttgtagtgtttgctatttccgtcgtgtaaatactgccaacatggacaatcttcagttgctaatggtttactaactggcttgtaaatgaattcattcagtattcaagaaaatggcactacatttag

SEQ ID NO: 1498 - DNA, 13979 bp, Homo sapiens
gtaagaggcaggcaagagtatttaatgggcattgagggtcttggcagtcccaccaggggagtgggcaaagggcaaggcacagaaaggcttccactcagggctcaggaagtgggaggtaaggaggcaggttcaggaggcgggttcaggaggcgggttcggaggtgagctcaggtgctggtgctgtgggcatctccgggtgcacaggggcgagaggaaggccgaacctcgcctgggggctcctgcagcagcaggggcagcactgggcccgtgtggaactaaacacagaacaggggcatgagtgctctcaacaagaccccgccccgcagctcgtgccaggtctcctgctcctggaggcaaagggagcgggctggccccacagaatgtgctgcagaggccccggggcgcaggggttgcccagccccacggtggcctcctgatgctccacctccatgtctcacggggcttcgagtcaatgtttcctttaaataaaagagtctcccgccacccgcaccccctggccaaattataaaccacgagactcatctcagtcctgcgagtaggtgactggcctgaggcccatcagcacatgtagtgggggagtcatcctccatttgtctttgtgactccagggactcctgggtgtattctagaggcctgggccctgcttccaacgcccctccagtgtagaaccctcctccccccaagctcggagcgctccagcttcagggtcagccaaacctcaggggcctccccccacaccctcacaacctgcagacacccccctcccgacacgcacagacacccacgcacacacacgcttcttacctcctggagagctgcagcctcaccacgccccgggggtcccttccctgctttgtagggacccagaggttggggctggggggttgagagcagagggggacattggagggtgcagattcggcatggatgtccagtcaggccccaccactctctgcagctggacagcttcagccatgtacctggggagcagcaggccagatgcaggggccaccgtcctccctggtccggctcccctgcccgcctcagcttgggaagcacacggcccagggcttagctctgcaggaagctgaggccagcctcatccaggatgcagcagccctgtatgccatagtggggcaggaacacacagagccaaggacgtagggaggccccagagctcccagtgccctggagaaaaccccagaggagcaggaacagtgagtgtaagggcctggggctgtggtaaggagccagggtgaacccacctctgccccacccccagggttcaccagttgggcctctggcttgccaactcacttgggtcccagtggtgcacaaattgttaaataccagttgctggcacagccctggtcgaaggggttgtatccctgaaggtgtctgcactggtcggggatggaaaccggaagaggagctcagaaccagcaggaatggctgggccatcgcccagtggccctccctgagctggtcagctagccagggctcagcccagggcaccagcaagctggaggccaggagactgaaggacctccccaccactgccccatcctcctcctcttggtctccactggccacacacatcctcctgctacctccttccagatactgaatgtcactgtctggaaggtcagttgagcaaggcccagtcgtatttccctaaccatgatcacatggcccaggaaaatctgggctaaaagccttgaacacgcaatgcggtaaaggccaagtcgtcccctgggcactcttgaccttgatcaggttctctccctcctctctccccttcgcccactcactctacccatccacctcaccccctcccaaactccctctccgccacagggcaggctgggcctcacctgacttcaagagcctttgctgtcatgttttgtcactgaaagtggcccagcagcatctctgcccaccaccaactcccctgtgtcccatgtccccgctctccgccgcaaaggctgagattttcaacaccattctccaccaaaggaaccaggactccatgcaaggacagctggcactcactggagggaggaaaagtctggacagctccataacagctcactgtcgccactcactgttgccatagggcaatacgcatccttgcactatttgagattctgcctactttaaggtatttaaagcatgtaaaagaaacgtattggccgggtgagatggctcacgcctgtaatccctgcactttgggaggccgaggcaggtggatcacttgaggtcaggagtttgagaccagcctggccaacatggtgaaaccccatctctactaaaaatacaaaaaattagccaggcgtggtggcgggtgcctgtgatcccagctactcgggaggctgagacagaagaatcgcttgaacccgggaggcggaggttgcagtgagccgagatcatgccactgcactccagcctgggcgacagagcgacactctggctcagaaaaaagaaactggtattgtattagtcatttagaagattttgattaaatttatggaatttgggccaggcatggtgattggcacctgtaatccgagtgttttgggaggtggagaagggaggatctcttgaccccagaagttcaagaccagcctgagactttcatctctaaaaaaataaaaataggtggctgtggcattgtgcacctgtagtctcagcttcttgggaggctgggatgagaggatcccttgagcctaggagttcgaggctgcagtgagctatgattacgccactgcactccagcctgaatgacagagtgggaccctgtctctagaaaaactaaaatctaataaaaatatattgacagaattttaaaatttagggatatatatatatatatgtatatatatatataatttttttttttttgagatggagtcttgctctgtcacccaggctggagtgcagtggcgcgatctcagctcactgcaagctccgcctcccaggttcacgccattctcctgcctcagcctcccaagtagctgggattacaggtgctcgccaccacgcccagctaattttttgtatttttagtagagacggggtttcaccgtgttagccaggatggtctcgatctcctgacctcgtgatccgcccaccttggcctcccaaagtgctgggattacaagcgtgagccaccacgcctggccttttttttttttttttttagacgcagttttgctcttgttgcccaggctggagtgcagtgatcataggtcctcacaaattcaaactcctgggctcaagggatcctcccacctctgtctcccaagtagctgagactacaggcatgcaccactatgcccagccaatttttaattttttttgcaggaatggggtctggctatgttgcccaggctggtcttgaactcctggcctcaagcgatcttcccacctcagcctttcaaagggctgggattacaggtgtgagtcactgtacccggcattagggaaataaatttttatttattagatgtatataaggtatagaaaaatgttgattgtatatgaggcatagaaaaatgcttaaaggaatgatgatctttaataaattcataagactgacccatacatttttcttttttttgagacggagtctcactgtgtcgcccaggctggagtgcagtggcacgatcttggctcactgcaacctccgcctcccgggttcaagcgattcttctgcttcagcctcccaagtagctgggattacaggcacccaccatcacgcccagctaatttttgtatttttagtagagacggggtttcactgtgttggccagtctcgaactcctgacctcatgatccgcccacctcggcctcccaaagtgctgggattacagccgtgagccaccgcaccgggccaaaactgaccaatacatttgtacctgcctctcccacgcaagatgctttcagatatgaatgaaaccaacagctcttggccgggcaccgtggctcacacctgtaatcccagcactttggaaggccaaggcgggtggatcacttgaggccaggagttcgagaccagcctggccaacatggaagaacccggtctactaaaaatgcaaaaattagtcgggcatggtggcatgtgcctgtaatcccaactactcaggaggctgaggcaggagaatcgcttgaacctaggaggtggaggttgcagtgagccgagatagcaccactgcactccagcctggacgacagagtgagactctgtctcaaaaaataaaaaaagaaaaagaaaccaacagctctgaagcactcagactgtccacctcactgtctccagacctggggctcctgctccgattctgtgtctgaaactgcctgacactccacgggaccaaagccagggtgagctgcttcttgctccgtctcccacccaacccccctctccccattccccgccagggatcagggcatctggcttctctctctttttgtcttttcgtccctcccaaagtgctatggattcctttgttggttggttcactcactgtttcaggaatattttggggccttaaaaatgttccaggggccgggcgtggtggctcatgcctgtaatcccagcactttgggaggccaagatgggtggagcatttgaggtcacaagttcaagaccagcctggccaacatagtgaaatcccgtctctaataaaatacgaaaatttttagtagggtgtggtggtgcacgcccgtagttccagctgcttgggaggctgaggccggagaatcacttgaacccaggaggtggaggctgcggtcagccgaggtgacgccattgcactccagccgggacaacagcgtgagagactccgtctcaaaaaggaaaaaaaaaaagttccaagggctggtctgaaagcagtggtttatctcgcctgttcagtaagttacagacccaattccttgttctactctttcctcgctgctcactactgtccttgccgtcaagaaaaaataaaaataaaaaaaggaaagttccagtcactgtgctgggggttgaggacgcactgcacacgacatatcccgggccagcctcaaccttcagggtggcgagggcagcaccgagggaaggagcaggaacccaggcagaggcgcccaggcacacgcagaggagccgcgcaggaggccagaggctgagccctgaggggcggggacaggccgcttccctgcgtgcagtttcacaagctcaagctgctgtgtgcggtccggaaagagtagtatgaggcctgaccactggctttggccgcctggtgagagcagcatccgtgtgacagtgagcacagcggccggctgaagctgccggggaagggggagagtggggcaagtgagcactgccggccctgtcaggagacttggctgctggagagcagagtagagcagcgggagtggaggctggcgatgttaagggagggttttgctttgcttttaagatgagagagacaggagcatgtgtaaatggtgatgaaaatgaatggtgccaggcgcagtggctcagcctgtaatcccagcactttgggaggccgaggcgagtggctcacctgaggtcaggagttcgagaccagcctggccaacatggtgaaaccccgtctctactaaaaatacaaaaaatcaggtgggcatggtgacgtgcacctgtaattccagctactcgggaggctgaggcaggagaatcgcttgaacccaggaggccaagatcacaccactgcactccagcctgagtgacagagaaatactctgtctcaaaaaagaaaaaaaaagaaagaaagaagaaagaaagagagagagaaattgaacggtattaatagtagcgacatctagagcactcacttgtaccagctgctactctatgtcttaaactcacccatgctgcccattttacagttggggaaagtggacgcctaggtggctaagtaatatacccaggatctctctgctggtatgctgtggagctgtgatgtgaacatgtgtgaactggatccagagaccttgctatcaaccacaggcagagttgcagcccagggatggaggaggaagggaatgagatttggggcatgtgaagaaggcctgaggcaggtgctgcgggctgcgggaaggagccctgcctggtgaatcgcaggccacgttagggtccctggaggctggagatcctggatcaggagggcagcattctgggcaggggagggagggcaggaagaaccacaggatgtgagaagggcgaaggctgcccagaaaaggctgaaacgatgcactgaggctggggagggtccacatgcagaccagagcgggctgatgaggaagggcggagctggggagtcacaggtgggggagccaaatatgggtgtggtggagtgattgaagggtgactgggatgggaggtggtgggcagagagggcgcctgtgtccttccagctgtctgatacctgcagctcctccctcatcaatgctgcccatcagttttcctagaacagccagtgacctgctgaaggagtctcatggcgcggatgtccaccctcaccactcctgctccacattgtgctagaggtccaagacagtgcaataagaagagaaaaaaataaagccatacagattggaaaagaagaagtgaaactgtcctttttcacagacaacaggatttcctatgtagaatcaacaaaaaagctattggaactaataaatgggtctagcaaaatggcaggattcaacaccaattcaaaaaaatccattgtatttccttataataatgaacaaatggaaattgaaattttaaaaaacatgcttacaatagcacaaaaaaagaaatacatataaatctaacaaaatggatacaaaatctatatgctgaaaaacacaaaataaggatgaaagacatcgaagaagacgtaaataaatggagaggtgtggcatgttcatgaattcactcaatcttgttagaatgtcaattctccccaaactgatctataggctcaatgaaattccagtgaaaatcctagcagatttttttgtaacaaataataaggaaacaatacaattttttaaatggacaaaagattggaacagacacttcaccatagttacacagatggcaaagaagaacatgaaaatatgcttaaaccattagtcattaggaaaatacaaactgaagccacactgagatgccactacacatgtcttataccggcttaaacaaaaaacaactgacaacatcaaacgttcgtaaggatgcaaagcaattggaattcttatatattacgggtaggaatgcaaaatagtaccactattttggaagacaatttggcaatttattatgaaattaaacattcaggccggacacagtggctcacgcctataatcccagcactttgggaggctgaggcaggcagatcacttgaggtcaggagttccagaccagcctggccaacatggtgaaccccatctctactaaaaatgcaaaaattagcccggcgtggtggctcacacctgttgtcttagctacctgggaggctgaggtgggaggatcacttgaatctgggaggtggaggttgcagtgagccaagatcgagccactgcactccatcctgggtgacagagtgagactccatctcaaacgaacaaacaaaaaaccacattcaattaccatatgaccccttcaagtatttaccccaaagaaatgaaaacttatgttcacatgcctgtacaccagtgtttatagcagctttatttattataatcccccaaactagaaataacacaaacatcttcaattggtaaatggataatctattgaacatccatacaatgcaataccgtacggcaatcaaaaggaataaacgactgctatgagcaacaacatgaatgaatctcgaatgtattgtgctaagtgaaagaagccagactcacaagccaacaatttcagttattctggaaaaggaaagtgataaggacagaggacagatcagtggttgccaaaagccacaggtagggggagaaattgactacaaaagaccatgatctctgatttttgggtgggatggacctgttctaaatattgattgtggtggtggctgcaggactgtatccgtgtgtcagaactcatactgtatactagaaaaggatgagtattacataggtagattattgctcaataaacgactttttgttttggtttttgtttgttttgagacagagtctggctctgtctcccaagctggagtgcagtggcatgatctcagctcactgcagcttctgcctcccaggttcaagagattctctgcctcagcctccaaatagctgggattacaggcacatgccaccatgcctggctaatttttgtattttttgtagagacagggtttcgccatgttggccaggctggtctcgaactcctgacctggcctcaagtgatccacccacctcggcctcccaaagtgctgggattgcaggtgtgggccatgcacccgtccaataaacttggcttttaagaaattctaccctggctctcataccatgatttcatcatcaagcctaaattctccacctgactttctggggttgttttgttttgtttttgagacagagtctcaatctgtcacccaggctggagtgcaatgacacaatctcggctcactgcaacttctgcttcccaggttcaagcgattcttgtgcctcagtctcccgagtagctgggactacaggtgtgccccaccacacctggctaatttttgtatttttagtagaaacagggtttcaccttgttggccaggctggtctcgaactcccagtctcaggtcatctggccacctcggcctcccaaagtgctgggattacaggtgtgagccactgcacccagcctgggcatttttttttaagacagggtcttgctctattgcccaggctggagtgcagtggtgcaatcacagctcactgactgcagcctccatctcccgggctcaaacaatcctcccacctcagcctctggagtagctgggactaaaggcacgtgccaccgtgcctggctaattttttaattttttgtagagatgaagtctcgttttgttgcccaggctggtctcaaactccggggctcaagtgatcctcctgcctcagcctcccaaagcgctagaattacaggcatgagccacggggcacagcttggaactttttcttttcttttcttttctttttttttttttttttttggaggcagagtctcgctctgctgcccaggctggagtgcatggtacgatctgggctcactgcaagctccgcctctccggttcacgccattccccagcctggacctttttaatgtggccaacagaagcagtcgacttggttgcccacaccaccttcttgccccagttagaattgtttcctctccatcctatcaacattccacagactttcaggcttccctgagtttttgcaaaggtgtcccctcacccgcaatgccctcctctccgtcttctgtctctcccgaacccctaagctgcacgtcctaccctaccatgtggtcctccctcaaccctcaatgcctgagtctgcgccacacagctcaggaccggccccctctctgagtgttcgtgggtatctggtgggtgttactctgatttcaggttcctcatcaacacgagtgtggaatgtagccttactcacctctattcccatcgctcaaagaatccaaaccgcctagcacacagtaggcccccaggaaggacagggaccactgagctcccggaggaggcgagattggagcctcttaagagctgggtctggagggacctaacgaggcaccatcgcgggtgggggtcaggctatcagggccaagggcagtggagaaagcgcgggaagcgcggaggtccccgaggtgcaagctgaccacccgcggccccgcgtaccttgcccttgtaggtgcggtcggccgagctcacggacagtgcctggatcagcagcaggagggacagcggcaccaggaggcccgcggcggacacggccaccacgatgctgcgcgggttaaggaaccgggctgcgggacccccacgcctggccccgccccccaggcccgactccgccccgagccccgccccgcccccggacgcccgcccctcaggcccgactccgccccgagccccgccccgcccctggccccgcccccaggcccgactccgccccgagccccgccccgcccccggacgcccgcccctcaggcccgactccgccccgagccccgccccgcccctggccccgcccctcaggcccgactccgccccgagccccgccccgccccccggacgcccgcccacccgccccgtcccctggctccaccctcatcccgcccacccccttgaaagcctgactccaccccgctgtccccgcccgtccagatctgcggtgcacctttagcacccgctccgtgaccccgccagattcctttttcttttcttttcttttcttttgaggcacaatcaccgctcactgcagcctcgacctccctccccggttcaagcggtcctaccacctcagccttccaggtagctgggactataggcgcgagccatcacgcccggctaatttttctatttttttgtagagacggggtctatgttgcccaggctggtctgggtctcgggctgaagcgatcctcccgcctcggcctcccaaagtgccggaattacaggcgtgagccaccgcgccggcccgggggaggcttaacgctccgccccttctcctagccccgcccatcccccgaccccgcccacctcacctcgtcccagactggtcctcccaggcggcttctccctctagccccgcccccatagccccgccctctgcagccccctccttggctgtccccgcctcctctcctgcttccccacgtgggcggatacgcgatggccttgtcggtggagaagggcaggtgggttgtgcgcaccaggaagatgagacaggtgaccagcatggcgcccgagtagaggcacagggacaggacaagcagcatgaagaagcggaagttgcggtgaccgatgcagttattgacccacttgcagtggtggtcaaagtcctgggcgacagggagaggggccaggcttgaggacttctcctctggcccaaattccatcaccccaaatcctgaggccctccccctgccttctaggccacctgcccttggcccatgcactggcttccacccccagggagaaactgagccacagaatgcctcatgctggcatttcccttgttagagcacagttaggactctggtatatacggtcacctgtcagaagacctttagagagaagactggcctggccttctgtgagacacatcctactgtaactctgggcagaacgtaaaccatctctggacctccactttctcatccattcgatgaagatgacagtaacagtaacacccttgcccagccagcctcctgcacttgtaaacctatgcaagccgtgctctcgagagagatggtcactcagagccaggagaccctccaacttggacacccaggcgaggacaggcaaggcctcccagaccaggcgggcagccagcctgaggggcttgggtatctcgtgttagcgagcccaggggtgggacagagggctgcctctcctcccctggcctgacccagcccaggacagatgcggatgccctgtgcatgtcagcacctctgcaggcaacggccagcctcccaggacaggtgcaggtggagaacacatgagtgaccaagggtggctgggagttactgccacccttggcctttagcagtcctgaaaacagcttcacacccagccctggcccctgtatgagggaggctcctggtcccagccagatgtggggcgatggctggtggacaggtagaggggcactcacctccacacagatgttgcaccaggggcagtggtaagtccggggcgggcggtggaagcagcactttggacaccattgcaggcggaaggccccgtggttcacccacaccacgtgcaccgtcaaggggccctgctcagcggagcctggcgtgggaagaggattgggcacagcagaaggccctgcggtcaccccgcggcgggggcagctccacggcatcacagggcacaaggaagggtggggacaaggtgggcaggggaacccctgtccccactgagcaagctgtccaagctcagagaggatggcagtcaaagggaagacgggtttccagccaggagagttttgtatgaaactcaggcgtttggaacagtgagtgctgctttgagtgtcattgtgtagtgaagggaggaagtgcatacagtggtttggaagagcccactggcttctggccctggcctgcccggtcctcccatctaaggcaactgggaaacctcaacaattctgtttttccacaccttggtggcttaagaaacggggtagggccgggcgcgggggctcacgcctgtaatcccagcactttgggaggccgaggtgggctgatcatgaggtcaggagttcgagaccagcctggccaatatggtgaaaccccatctctactaaaaatacaaaaaattagctgggcgtggtagcatgctcctgtagccccagctacttgggaggctgaggcagacgaatcgcttgaacctgggaggtggagcttgcagtgagcggagattgcgccactgcactcccgcctgggcagcaaagcgagactctgtctcaacaaaaagaaaaggaaagagagaaagaaagaagaaaggaaagaaggaaagaaagaaagaaaaagaaagaaagaaaagagaaagaaagaaagaaagaaggaaggaaggaaagagagaggaagaaaggaaagaaggaaagaaagaaagaaagaaaagagaaagaaagaaagaaggaaggaaggaaagagagaggaaggaaggaaagaaagagggagagagagaggaaggaaggaaagaaagaaagagaaagaaagaaagaaaagagaagagaagaaagagtgagcgagggccagagcaatgaagacgtggggtgaaggggtccagaggctggaggagggtcagtaggaagagcactttaggaatcccccctgcaggttcccagcccttgagtgacacctccttttcccagggggctgatgcctcaccttgatgtaagatgccagggtctgagaagttgagtgaaacaagactgaagaaggtaaggacaaagagggagcctgtgataacaggaaaggcccactccccgttctgagccagccacctgcaactgagaccagaggcaggctcggtcctgagcaggggcagcccaaagcccccggcccaaggcctgtggcttgctcaggtcaggacccacagaccttcaagccagatctaaaaatccaggctccaaatacccaggcagactcataatggctccaccaaatgtcaccagcatgaccagccacccaaagctcccaaaatgcacaggcacccttgacctctgcgcctttgcacgtcggttcctggaacagaatatccccttttccctgcccgcacccttgacctctgcacctttgcacgtcggttccctcgaacagaatatccccttttccctgacctctcccccggtcttctgcactcccctgcctccatcctatcatcttctgtttccctggctgtctctttgtgggaaacctaacggcttgcctggaaaactcacgggaatgcgaagaagaggccactgaaaaagaccagcagcaccacattgaaggcagcaaagaggctagggaggaaccagggacgtgggaccagaggcaggggatggggctccttcaccagcggcgtggcatccgttaagagtgtcatggctgggcctccttcgcctccaggggaggtcagagccaccaggcttcctcccccagcccagcttccagagctccatggccacggcagcctcagagccgcagcccagggtgaaag

SEQ ID NO: 1499 - DNA, 19810 bp, Homo sapiens
aggtagatgcggctgtgacagcagcaaagaatgacggccaagggcgacagcaggggctggccatgctgtaaaggggcttcttgggagggtccagcctcaggaatcaaggggaactcctgagccgagaattctgaagatctcctccctccctgaagctgtgggctgggccatcggaaaactttcagttttgtttccttgcctgcaagaaacgaaactcaaccgaaagcctgcagagagcagaacatggaaggagacttctcggtgtgcaggaactggtaagaaagtgctttctccagcggcagacccgggctggcgagggagagacgtagacgacatagggctgtttctgaagggagcagaaagtggttcctgcataagaacacttaggaggacaagcagctggagaccgtgggccccaagggtaggagggtttaaacttggtaatctctgggtgggggtgggcagcattacctccacttcactgcagcccctttcccccaaatgttaggctttctgggacagttctgaagccaaatagcccggccagtggtcccaactgggctactcatacttgtgagaccttgggtcctaatttggggttctgatactatgaccttcacacccatctgtgaaagaaagtgtcccacggagattctccaggactactctcaccctccttggaaagggagccgtggggcggggcaggggggacagagcagggggctgggaccacacctctaacgggagggggggcgcggaatctgaccgatcaaaaagccccattctcaaagctccctacctgtgacagggacctgagtggaccctccccagagagctttgctccagccagacccttcaagtactctggtttctcaaccagcccaggaagagcagggggagaaggggccaggtcaggcagaggagagagagcagaggaagggaagatgatgctgcctgtgtgcccgctgcctgggcagaagaggagtgaggctttgacagtccctctcggagcacgtcccctgtgccaggaacatgggcatgtaactcttctcgtcccctgggcctttacggctacagccaccccatttcccttctcccaagctgccacaagcaagagctgatggaaatgaaaggagtcatttctttctttcttcttcttttttttttttttttaagatggagtttcgcttctttttgcccaggctggagtgcctggagtgcaatggcgcgatttcagctcactgcaaccttcatctctcgggttcaagtgattctcctgcctcagcctcccgagtagttgggattacaggcgtgcaccgccatgcccggctaattttgtattgttttagtagagatgaggtttcaccatgttggccaggctgatctctaactcctgacctcaggtgatccacccgcctcggcctcccaaagtgctgggattacaggcatgagccaccacacccagccaaaagggggcacttcttggcaaaaaggacggttagagaaaaatgccctgcccaggaagtgggaggctcagaacccttccttcactgtggtctccaggaagaacctcggagtctctgtgagttagcgcaggtgaacctgaaggcaggggagacttgggaagctctcgctttggagattttggaagttggcatggccctggcaggaagcgtgagcctagcagggctgcgttcctaacactgtggaccaaacaggggcaccagaaaacaagaaaaaagattcaagagaatttggcacttctctcaaattatttaaattgaaataatttaattatttacattatttaaaatgaaatgtttcattttaaaaacagccttatagaggtataattgacctacaataaacctcacattttaaagggtagcaattgataagttttggcctaagttatatacatccatgaaacaccatccccgtaattgagataatgaagcttcctgtcaccccaaaagctccccatgcccctttgtaattcctccctcctgctccttcccatgccctgccccagcaatgtaagagctctgtagatcatccttattcttattagatgctgcctcactgttctgacttttggacccacacagggagtgtggggcaggtggtgtcatcatcatcacatgttcagtgcttaaggcctctggagatctagccctgggtatgaaatacagctccatgttttataatatgaaaataagtctatttttctatccccacaccttgaccctgtagtaaaagacatgtagtctctgccaacttcaccctccatgaggcttactgcctgcggttcctggtcctgtgtccggagtgtgaggagcctgtccccaaggaaaccatggaggagcactgcaagcttgagcaccagcaggtgaggaggcggcagggaggatggggtctgagagtcaaggtgagtgttcagtcctccctgcaggtgagatggggtctgagagttgggggacgagggtctagtcctccctgcaggtgagatggggtctgggagtcaaggcaagtgttcagtcctctctgcaggagagatggggtctgagagtcaaggcgagtgttcagtcctctctgcaggtgagatggggtctgagagtcaaggcaagtgttcagtcctctctgcaggtgagatggggtctgggagtcaaggcgagtgttcagtcctctctgcaggacagatggggtctgagagtcaaggcgagtgttcagtcctctctgcaggtgagatggggtctgggagtcaaggcgagtgttcagtcctccctgcaggtgagatggggtctgggaggggcaagtgttccatcttccctgcaggagagatggggtctgggagtcacagagtgggtccagtcctccctgcaggagagatggggtctgagagttgggggacgagggtctagtcctccctgcaggtgagatggggtctgggagtcaaggagagtgttcagtcctccctgcaggtgagatggggtctgggaggggcaagtgttccatcttccctgcaggagagatgggatctgggagtcacagagtgggtccagtcctccctgcaggagagatggggtctgagagttgggggacgagggtccagtcctccctgcaggtgagatggggtctgggaggggcaagtgttccatcctccctgcaagaaagaaggggtctgggagtcagggaatggctccagtcctccctgcaggagagatggggtccgggagttggggtgagggctggggacttaaggcaagggtccagtcccccaggcagagactcacttgagggccatgggaagtcatttagcccctccacacaaagcccatggaaaggaaatgttaatcctgcctttttcatgctaatctgagtctacctccagttttcctatttccaatcctttccctacaggcttatggatctggcataggcaagaggttctggtttcaggaaagactggctgttctcttgagatctgtaaagagaggatgtgaaaaaggaaggtcctggaaggcagtcagatggagccctgtttcccgcctttccatgtccattcctcctggggcccctgatctgtctctctggagatactcaagctcaggcagccgttgccaactcagactggtctgacaaacacttcttgaacactgggcggggtgctagagagacactgaggtagccacatcggatccctgccctctgggagttcacagacccaaacccggaacactgtgagccaaagtggatgtggggcaggccctgggtgctgggtggacccacatctggtgtgtgtgtgtgtgtgtgtgtgtgtgtttaggttgggtgtacgatgtgtcagcagagcatgcagaagtcctcgctggagtttcataaggtaagagccccatgtgatttctcctttacagccaaatagaccaacctgagaaaaggagaggaaggggaaacgggaggccagtaatagagatttccacctgaccactcttttcaccccattaggcttggagagcagtggagaactagcccaccgcataacacaggttctcctgtcccccagatactgatcagaagggttttccatggtccatgagtccatcagagctcagatcccccgaaggcagtcccgcactctggcccttctcatctgctttctcgtattggccctaattccctagggagatgggcacaagtccttgatctgcctacagtcaaagaggccagtgatcggccaggcgcagtggcacacgcctgtaatcccagcactttgggaggccaaggcgggtggatcacgaggtcaggagttcgagaccagcctgaccaacatggtgaaaccccgtctctactaaaagtacaaaaattagctgggcgtggtggcacacgcctgtggtcccagccacttgggaggctgaggcaggagaattgcttgaacccgggaggcggaggttgcagtgagccaagatcaagccactgcactccagcctgggcaacacaatgagactctgtctcaaaaaaaaaaaaaaaaaaaaagggccagtgatcatgcccttcctgctgcctcccacaggccaatgagtgccaggagcgccctgttgagtgtaagttctgcaaactggacatgcagctcagcaagctggagctccacgagtcctactgtggcagccggacagagctctgccaaggctgtggccagttcatcatgcaccgcatgctcgcccagcacagagatgtctgtcgcagtgaacaggcccagctcgggaaaggtaagcacacaaactggggtggaagagagacgttccaagggccagagcctttcctggatgggatgcaaggaagggaagctctcaacaggacggatgacaagtgtatttgctgtatagatctcaattcatctggctattctaattctaaaccatgcctcagagtggccttcctgtgtgtctgctgtggccttcaaatgactggtccagggagactaggaggccggggctagagcctagctaccacaaagttgagtaaagaggccatggagaaggctgggcggggtggctaatgcctgtaatcccagcactttgggaggctgaggcgggcagatcacctgaggttgggagttcgagaccaccttgaccaacatggagaaaccccgtctctactaaaaatacaaaattagccgggcgtggtggcggacgcctgtagtcccagctacttgggagactgaggcaggagaatcacttgaacccggtaggcggaggttgcagtgagtcgagatcgtgccattgcactccagcctgggcaacaagagcaaaactctgtctcaaaaaaaaaagggggggaccatggggagtcctaggaaacaggaggctttctttgagcacctctagcacagtcctagcctggcagagatccattgcatccttttacagatgagaaacctacacacagaataaagcagggacttgctagaggcaaaaataagactggactcccgcacttcctggcactgaatctagggctttttccattatcaacaatggccagaagggagttagcaatggctcctggcctgggggcctatgtattggctccctggtaccattttatgttcacttgaatcactcacctctttatgagggtgtatttactgtcacacaaccatcagtgtgacagatcctttggtgtctttgctagttgttttggtaacatggtaacatgggagagagcctaaaactccccagacagtaaccttctcctgataaacaatccacccaagggcaaaactggccaatggaaacctggaaattgtgagagtcatgtatatttccttcatcccagcatggctggacgtcaacagaatcaaacacagtcttcaacacaacttcagtgcaacacaacacaacacaacacaacacagcttcaacactgtcaacaaaaatgtgttcaaccaacacctggtctgatcacagagtctgaaaactggtgcaatgaaagagcacagtcagaatggagggggttggcatccgtggctacagctccattcatctccttagaaaccagtcctgatccaggaaaatgtctctccattacggttgctgctgccctgagtgcacatctgtggccataaaggaaatgatgtgggtgattcggccaagagttgcctgtgtggtcaaggatgccggcagcgcaggaaagtcaagaccaggcaggtccggggggcagttcgtgctcatgagcacaggccatgtatgcagttgtgggagagctgggctagccgttgacaaggacaatcatttgtggtgttgtttctctgcttattcaggggaaagaatttcagctcctgaaagggaaatctactgtcattattgcaaccaaatgattccagaaaataagtatttccaccatatggtgagtagcacttagtaattttctaatggtgccaatagttcatccacattctgaaaagtgtgataggaaaggcagattctgggcccaattttacatagcatggatattaaagggtcccatatttattttttgctttgttccaaaagatagtttagtgacttgcttaggctaatcaagcacacaaaaattggtcttcatttgtgcccagcccttcaaaggggcttcccttgccactcccaacacccccgatcacctctgaccatctccaaacttcatggcctggacattgcaatttggtcctcagtagggcctgtcttactgttttcggtcccatgtgggagtcttctctattagactgtgagcttcctgcaaaactgcatgactttttccattttcctgacatcagagcttggtgcaaaaagaggactctgtagaggcgcagttacgtgattgactgactgactgattttgcctgggaacactcacaggttcttccctccatagcccctaagcgccgtttagtgcattgctgtgccaagttgctcccttcttttgcacagaatggagcatttcccctttgggaaacttaccaaggcttctctccaaagaactcttctccttctccttgggcagaaagttgtttacctttcttaacacttcagtgcttaaaactacagaatatcaaaactaaagaaaccatagagacgatccagcttttcgctcttttctttttctttttactattgtggtaaaccacgtataatgtaaaatttgccatcactatagagacatttggtacattcacaatgttgtgcaatctggttctagaatattttcatcattccaaaaagaaatcctatacccattagcaggtactgtacattccctcatcttcccagttcctggcaaccactaatctgctttctatctctatggatttgtctattctggacacttcacatcagtagactcatataatatgtggtcttatgtaaccatcttctttcacttaccgtaacattttcaaggtttgcccgtgttgtagttgtggcatgtgtcagcatttcattccttttaatggccttttcttttcttttatttttttgagacagggtctcactctgttgcccaggctggagtgcagtggcgtgatctcggctcactgcaacctctgcctcccgggttcaagcgattctcctgcctcagcctccggagtagctggggctacaggtgcctgccaccacgcccggctaatttttgtatttttttttagtagagacggggttttaccatgttggccaggccagtctcaaactcctgaccgcaggttatccgccttcctcggcctcccaaagttaatggcctttttacggtcatcccacattttgtttctctacttgttggtaaacattcggattgtttccacctttcagctctttgctttttgaagtgcagtctgtggaccagctgcatgagcatcacctggaatcctgttagaaatgcagaatctcaggccctccccctagaaatgctaaatcagaatatgcagggtcacatgatttcccaggcatttcaagtctgagatgcgctgccccagccacgggattctcagccttggctgtacgtggaaatcacctactgacttgttttccttagtactgatgtttattcgatcctataagtggtccatgtgttctgtttgaatgagaaaatacttggtgagcaccaaaacaagagtaaagctgactacttcccttcaaatgtccagcctggcaaccagggcacctacacacttatttgaaggctacagggaagtggggagctccaatacacatggaactggatttgtgctcagaaactctgaattttagttctgctgtgccccttactggctgtgtaacctctctgagcttctttcttcttttgaggaaaatggggataatggtttatctccttgttcaggaaaagaagacatccacaaccagccaacaccagatctatctccttggcagcatccacactcacttactttgccttcccacctcttaaccatagaggagcttcctatgtgcctctctaaagcctatcccctcctactggtataatataccctctctttttgcctacacaaggtcacacaagttttttgctacactgctccagcaattctcccctctctgtcctgcaacagagagaggttaaatgagctgtacacgcaggtaacaacaaagtctcacatctctaggttgtcctaacatttcttacaataactttttaaaggggtaccactattgaatatttatatatcaatggccttgcacgaaaagaatttttttttaattttgaaaattaaggattgaaatcatgtatactaggtggttttgtggttttcagtctttaactttttattaatatgacccaaagccagaaaaacatgaaatacttctgatcccatttcctataagctaccatcttgtttctttgttcccctccgtagaaaaacatttgagctagttgtctataagtaactgcctccatcttttcttctctcattcttattcccactccagtctggctctccattttaaccaaatctgctcttgtcaaaatcaatgacctctgcattgctaaatccaatgctcagttctcagttctcaatttatgggaagcatttactgctcatcactccctcttcctcagtggactttctcggcttccagggtaccacactttcctggttttcaaggacattggtggtctctcattctctacctccccagcctcttaattttggggggccccagggcttagtctctggtctcttctctacctatattcactgccttcattatttcatcctacctcctgatttttaaaaatgccatatgtaaggccgggtatggtggctcatgcctgtaatcccagcactttgggaggccgaggtgggaggatcacaaggtcaggagatcgagaccaacctggctaacacagtgaactctcgtctctactaaaaatacaaaaacttagccgggtgtggtggtgggtgactatagtcccagctactcgggaggctgaggcaggagaatggcgtgaacccaggaggcggagcttgcagtgagccgagatcacgccactacactgcagcctgggcgacagagcgagactccatctcaaaaaatagataaataaataaaaatttaaaaattttttaaaaagccatatgtagtcagacacttccaaatttatatctcagtctgggtttttctccccaaactctagatttgtatattactatttactgcatcttcacttgaatgcttgatagacatcttaaatgtaacacatctgaaatggaatcctctctgccacagcttggcccatctcagttgatggcaactctatctttccagttgttcaggccaaaatctcaggttcactctcgacttctctttccctccgcattgctaccctggtatgaaccatcatcttctctagcccagatgctgcagcagtctcctaaacggtcttcctacttctcaccttgccccctacagtctattctcatcacagaggtcaacgtgatcccttaaaaatacaagtcagattgtttggctcctctgttcagatctctgtactgattcttgccccattttatgcaaactcaaaactacagtggctttagagatctatgtcatctttgcctcccttcttatctcatcacctctttgatctcatgtactactcctgttcagctcactggcctcctgattgtttcttgagcataccatgccttagggccttttcactggctactgcctctggctggaagctacctcctcaccttccccaccctactccaggagctaactctctcacttctctcaagtctttgcccagatggcaccttctcaaggagatgtaccacaacaacctatttaaaattgcaactccctctccatcacatatttaccaaccccttaccttcttctattattttttccatagcatttgccaacttctaacatattatctaatttacttacttattatggcccttgttaattgtctcccacgacctcagaaaaactataagccccactggtccccttcatgctaactactccccagacacaaatactctacttttgcttttagctgtttcttctggtaatcaccttcatatgtctaaagcaccttcttatattttttccagttttagatattacttattgactcataaggatttaggaatatagatttcacttttttataccacccatcccacacacacacctccaaagttcttcatttcatccttccaatgtattgatttcactcattctggttaaataaatattcagtattacattagtataaccatgtaaacattataaatggttttccacatgaattgtgattatgtgttctttctcctacaactttttgttttacctggacttaataattgcttcggtttttcatttgcttcactttctaggtacctatcactaaatcatccctaaaattctctaccagatctgaaaattcccctgagtacaactacacacatcagatagtctgtccatttcattttgggagcatgttatgccccaggcttgatgattagctgttggtctggaatttcttccactctctccacggttggagttctgattcccaaatctcaggtctcatctttctctttcttaggttactccttgtttgatagaacatatccccaaatagtttcttgagaaagaaagcatgagaggcaaattttttaggccttatatgtctgaaaatgaaagcttgggtggctatagaatctattgaccatcttaatctgtttattaaaaatcttattacaattctgatttggccactacacactgtatacatgtattagaaaatcattctgtattctataagtatgtatcattattacttgtccactaaaaataaaagaaataaaattgattacaaaaactttcaaataaatatgacagtagaaagttaatacaataaacattcatgtatttactccccagatacaacagttgttgttctaaacaaggtgaataaaaataaatctactcttagatacattacaggtaaaaggcaaaggttgatttctttgaaatcagccgaagaagattacaagcaaaggaatggcagttaggctgaaagcaaatatatcgacagcaataatagaagtgggtatgcagtggaataatcttcaaagtgctaagagaaaatagctgttaacacgtggaaatcaaaagttttccaggcttgaactatactttgtttgttttcttttttctaaagtatgttaaagcaaatccaagatatcctgttatttcaccatcattctttaatatctcaaaaatacagtcattttcttaatcacaatgcctttatcactctcaatgatgttaacaataattttcccccatcgttttggggccttgcatttaccactcttgttcattactactgctgctgctgctgctgctgctgctgcttgcttctcccttgtattctattggattgagcaagatttctttattctctttcttctttcctactgattcgtcaattttacatttatttctatcatttcaatagttacccttaacattttaatataaatacttgacttaataaagtctaaagttagtcattatctctactttccttacaaatagtatatagatttgagaacatgttaacactgtaactatcttacatgaaaatgctgccagaattttgtttcattttgctttcatactacccctctttactgattattgttgttatttatgtaactcatgcctgtttagatatactcacatgtttttgtttttgctttttttctttctttctttctttttttttttgagacaaaagtctcactctgttgcctgggcttgagtgcagtggcacgatcttggctcactgcagccttcgcctcctgggttcaagcagttctcctgcctcagcctctcaagtagctggtactacaggtgtgtgccaccacgtctggctaatttttgtatttttagtagagatgggcttttccatgttggccaagctggtcttgaactcctgacctcacataatctgcccacctcggcctcccaaagtgctaggattacaggcatgagctactgtgcccggctggatatactcacaagtttacccttctctttactcacattcttccttggatcctaagctttccttctgggtatgatttctctcttcctgaaatacatctcagtagcttcttcaccaagaaccttgagtagtaaatctttagttgcctgaaaataagctttttgttttttgcatccatgaatgatagtttagctggatatcaaaatctagattaacagctattttctcttatcattttgaagattattccactgccatcccacttctgttattgctgttgatgtattttcttccagcctaattgccattcctttgtacgtaatctttatatttggttgatttcaagatcctctttgccttttacctgtaacgtgtttaagagtagttttatttttattcattctgttcagaacaatgtactcaaatgtgtttgcttttctcctgctcaggatttctctttccttaatataaagatttatgtcactaatcaggcctgaaaattctcatctattatctctttgaattcccaacattccccaactctcccacattctctcaactctccttctggaacataacacatgtatattaagcattctcattctagcttcatgactctcttttttttcatgactctccttttttttcatttctctcttttaatcgccttatgtctcttaacctttcatattttctctatttctatctcttatattctgggtaatttcctgaaattatctccaagttcattcattctttcttggccaaatctaattttctgtttttagcccatccatttaggttcaatacctgcatttttcatgtctagaagttcaatttatctttctttcaaatttgcctatttttgttctcactacaaaaaaaagataggtatgtgaagtgattgatatgttaattaacttgatttaatcatcccacaatgtatatatatattaaaatatcacattgtaccccataaatatataaagttattatttgttaattacaaattagaaaatttcaaatttacctgttctgtttttcatgagatgttattcttttcccagatttaatcatttttaattaatttattttacagtctctatcctatagttgcattacctgaacttcttggaggctaatctgactacttttgtgtctgtgactcttactcaaggtggattgcttccttgtgtgtttgtaattttggattgtgagtttctatctggtgggactctacctatgaggatcctctatgacctattttgaggctgttgtccctccagaggaattttgtgattgcttctgccagacatctcaatgtttatgttaattcttctgctcagggattcccagaccatgaggccaaagtaaatcctaatcccacacacaggaatggcatggacctgtgattttgagttttcaggggcataagttttcatctccacactcaaataccgacccaagaaagaaaagcttccttgccactttccttttctcattagctgatacttttcctcttacccaccataatttatcctttaaagtttccagctttatgcaggatcaatagagtcttacttccaaatccccacctgtgtggatgggactttcctgtcatccaagcccctagttacaaagttgaccctacatctcccataagcagtgtcaactcctgtgcttaaccagtccatttgtgctgctataacaggatgccacagacagagtaataataaagaacacaaatttatttcgaacagttctgaagactgggaagttcaagatcaaggcaccaccatttggtgtctggtgagggccttcttgctgcctcctagcatggtagaaagcaaaagagtagaaggctgtagccaaatacttcatgaatcctcttttataaggaccctaatctcattaaaaagggaggacctttcatgatctaatcacccccgaaggccccacctcttaataccatcacattggcagcacctgaattttggaggagacacattcaaaccatagcaaccagtcagaccttcattcctggaatgcaaaattttctttctttcctgcaaagccagctattaaattgaatgtctgtcacattttatacaccatataaaagtgtttacagtgggaatttcttgtgttatctagtctactgtattttctgaccattaaagctgaagtcattttaaaatttgatatattattcacaattgcagggtaaatgttgtccagactcagagtttaagaaacactttcctgttggaaatccagaaattcttccttcatctcttccaagtcaagctgctgaaaatcaaacttccacgatggagaaagatgttcgtccaaagacaagaagtataaacagatttcctcttcattctgaaagttcatcaaagaaagcaccaagaagcaaaaacaaaaccttggatccacttttgatgtcagagcccaagcccaggaccagctcccctagaggagataaagcagcctatgacattctgaggagatgttctcagtgtggcatcctgcttcccctgccgatcctaaatcaacatcaggtactcagcctctgttctctgcttacctttctgggaaccatccgcacagtgtcttaaaaaaatccaagacctgaaagatgttcacaaatgttgtggctgaaaaggccgttttctctgactcccacttctctgggtgcccaaatgcactatctcgtagcacttaccacctggtttatttgcatcacctccgagagactgagtcacctttgactcaagccaggtctttgaaggtagagccaggtccctcttctctgtgtctccagcttctaggccagggattgatttggagcaactgcttcaaaactgttgagtaaatgaatgaatcagaggatacccagtctatctctctcatggtgtagatatggcactgaggcccagagatgagatgtcttggtcaagatcctaagccagttggtggtggcttacctccagcagatcaaggtttgcttcaagaagatcagggtttgtaggcatctccctgaatatcatgatttttatgtcctaggttattttctagtaataataataactggcattagaggttgttaaccattgtgtgccagttacaatacagagctctttataatcttcatcataaacaataggcatgcattttatctccattttacagataaggtgaagtagctttccaaggagtatacaattagaaggtggcaggatccagcctgagtccacatgtatatagctccaaagtttatgctcttaagctccagattaaatgccttacttaaaaaatttattttttttcaaaatacataagtactagattttgttggagctagttgatataatatcatataaagaagtataaaagcaaagctaaccctaattccccaaccccataccctgagataccactttggacagtcttatgggcatcttttcaaagctctacctttgcatatacaagcctaaacaagcatatactgggttttacttgtttctttttccacacatattatcttactatactttttactctgccacatgcctttttcacttagtatatgatgcatgcttcttacaaaagacttagtatgccaaaacctttttttctaacttccttgtgcatctatgtatgcacataagcatataattttacaaaaatgggttcatttcatatttgctgggggtgttactagtgccatttttccttgcctcccacaatttggtatatttcctttcacagttttctccatccttatataacagagtcgccagatttagcaaataaaaatacaggacattcagtcaaatttgaatttcagagaaacaaagaattgtttttagtgtaggtatattccatgcaatgattgttttgctaaaattaaaatttaaccaggacaccctgtattttatttagcaatttcttatataaccaccatacaaacatacacatttggagtcctgttatatacattttttcacttttttttttttgaaccagtaaagctgccatctttttttttttttttttttttttgagacagagtctcgctctgtcacccaggctggaatgcagtggtgggatctcggctcactgcgatctctgcctcccgggttcaagcgattctcctgcctcagcctcctgagtagctgggagtacaggcacccgccaccacacccagctaatttttgcattttagtacagatggggtttcaccatgttgtccatgctggtcttgaaatcctgacctcaggtgatccacccgcttcagactcccaaagtgctggaattatagggcatgagccaccacgcccagcaacatttctttacatcctaatgtaaattcagcaatacccaaggaaatccctacaaacaaaacagtgtggcttatttttattaatggctgcctaagattccatggtgtgagtgttctcccatctgtccctccacccagtgatagcaacaggcccctgttaaactttgtcgcaagcctcctatacttctggctcagtgggctcctgaccttttctatgccattacactccagtctttgggcagggctcatgctctgtaacaagggacagcaatatccagagatattctaggagctagcacttcttactttaaccatatcaaactttttttatatccatttcttaggagaaatgccggtggttagcttcatcaaaaggaaaacaagtgagaaatttcagctagatttggaaaaggaaaggtactacaaattcaaaagatttcacttttaacactggcattcctgcctacttgctgtggtggtcttgtgaaaggtgatgggttttattcgttgggctttaaaagaaaaggtttggcagaactaaaaacaaaactcacgtatcatctcaatagatacagaaaaggcttttgataaaattcaacttgacttcatgttaaaaaccctcaacaaaccaggcgtcgaaggaacatacctcaaaataataagagccatctatgacaaaaccacagccaacatcatactgaatgagcaaaagctggagcattactcttgagaagtagaacaaggcacttcagtcctattcaacatagtactggaagtcctcgccacagcaatcaggcaagagaaagaaataaaaggcaaccaaaaagaaaggaagtcgaagtatctctgtttgcagacgatatgattctatatctagaaaaccccatgatcttggcccaaaagctcctagatctgataaacaacttcagctaactttcaggagacaaaatcaatatacaaaatatggtagcatttttatacaccaacgacatccaagctgagagccaaatcaagaatgcaatcctattcacaattgccacaaaaagaataaaatacctaggaatacagctaaccagggagatgaaagatctctacaacaaaaattacaaaacactgctgaaagaaatcagagatgacacaaatggaaaaacattccatacttatggataggaagaatcaatattgttaaaatggccatactacccaaagcaatttatagattcaatgctattcctatcaaactaccaataacattcttcacagaatcagaaaaaaaaagcattaaaatttatttgaaaccaaaaaagagcccaaaaagccaaagcaatcctaagcaaaaagaacaaagctggaggcatcgcattacccaacttcaaactatactacagggctacagtaaccaaaactgcatgatactggtacaaaagcatggtgctggtacaaaagcagacacatagatcaatggaacagaatagagggcccagaaataaagctacacacctacaaccatctaatctttgacaaagttgacaaaaatacgcaatggggaaagaattccccattcagtaagtggtactgggataactagctagccatatgcagaggattgaaactgaaccacttccttacaccatatgcaaaaatcaactcaagatggattaaagacttaaatgtaaaaccccaaactataaaaactctggaagataacctaggcaataccattctggacataggaacggaaaaagatttcatgacaaagatcccaaaaataattgtaacgaaagcaaaaattgacaaatgggacatgattaaacagaattaccatttgactcagcaatcccattattggttatatacccaaaggaatctaaatcattctgtcataaagacatatatacacaaatgttcacggcagcactatacacaatcgcaaagtcagggaatcaaactaaatgtccatcagtggtagaaaggataaagaaaatgtggtggcagggagtggtggctcatgtctgtaatcccagcactttgggaggctgaggcgggtggttcacctgaggtcaggagtttgagaccagcctggccaacatggagaaactccgtctccgctaaaaatacgaaaattagccaggcgtggtggcgagcacctgtcatcccagctacttgggaggcctaggcgtgagaatcgcttgaacctggaaggtggtggttgcagtgagccgagatcctgccactgcactccagcctgggcaaccaagcgagactctgccttaaaaaaaaaaaaaagaaaatgtggcacatatacaccatggaatactatgcagccataaaaaagaatgggatcatgtcctgtgcagcaacgtggatggagctggaagccattatcctaaatgaactcactcagaaacagaaaaccaaataccacatgttctcacttataagtagaagctaaacattgagtacacatggatacaaagaagggaaccgcagacactggggcctacctgaggtcggagcatggaaggagggtgaggatcaaaaaactacctatctggtactatgctttttatctggatgatgaaataatctgtacaacaaaccctggtgacatgcaatttacctatatagcaagcctacacatgtgcccctgaacctaaaaaaaaagttaaaagaaaaacgtttggattattttccctctttcgaacaaagacattggtttgcccaaggactacaaataaaccaacgggaaaaaagaaaggttccagttttgtctgaaaattctgattaagcctctgggccctacagcctggagaacctggagaatcctacacccacagaacccggctttgtccccaaagaataaaaacacctctctaa

SEQ ID NO: 1500 - DNA, 11415 bp, Homo sapiens
atggagttggcgtcggagcaacagctgcgcgggcggagcaggtaggcgcgctccagtccctgcagcccgagcggggttcagcgaacgggtaacgggagaatgcgggccggagcaggctggggtggcggtgggatgccccgaggcccgcggcggggaggcgggctgctctcatcaccccctctgggaagcatctttggctgcaggagttgccaggccaactccccctcccgcggtgggtaggacatctttagatttccctccctggttggcagctgtgtgatatggtggaccaaccctgggttcgaatcctatctccccacttactacacgttctccctgggaaactttattcaccttccaacacctccgtttccgtatttgtgaaatggatgtgtttgtattcctatcttccttggcgggacgttgcagaagtacctcggcaccaactttcttattaatggcagccagctcttgtatagcgtttactacgtggcaggcactcactgttcccggtgctttccaggtatcagctcacttaatcctcccaacactaagagaaaggcactattattaccccatatacagatgtgaggattcacacataaagaaattgacttgcctaaggtcatccgactgtaatgggcatagctaggatgcagcccactaagctacactgcctctgatggggtctcggggggtaaggggaggctcccagtcattaaatagaatttggagtctccttacagcaactcttccagacacacatattcttccaaccccacccttacagcaccagtgtctgatgacttttcctgacctacaaccttgctaggccaaaaggtttcatggagcttttatttacttatttattttattatactttaagttctgggatacatgtgcagaacatgcaggtttgttacataggtatacatgtgccatggtggtttgctgcacccatcaacctgtcatctagaatttaagccccgcatgcattaggtatttgtcctaatgctctccctccccttgcccgccaccccccgacaggccccattgtgtgatgttcctctccctgtgtccatgtgttctcattgttcaactcccacttatgagtgagaacatgcagtgtttgatttcctgttcctgcgttagtttgctgagaatgatggtttccagcttcatccatgtccctgcaaaggacatgaactcattcttttttatggctgcatagtatttcatggtgtatatgtgccacattttcttaatcctgtcgatcattgatgggcatttgggttgattccaagtctttgcttcgtggagcttttaaactggtttatctcttctgcagcaccttttaggagctttgcttggtggtgagtgctgtggagatccctagccttgggcagtttgcaagtgattgaagagacctatttcttcatttgttaaatgtttaagtaccttctcaaaagcagaaggaggttgtcaaggggtgtgtgggtcccttgggagagaaaggcaaggacacagattatacaaagaggggcactggcaagaggtagcagaaggaggcaagctaaatacggacacagccatgctgggaaccactagggcgccacgtcatgggcgggacgggctgctgttcagtcctttacggaagtctgttcggatgtggcggtgggaaggccagctggagacaggggccaaatcagtgagtgggtggtgagagaaagtgatggcgtagtgaggacaaagcctggagaaggtccctagggaggcccacaactgtgcttacttgaggatgctcactgccactgtggtgttggtgggagctggaggagacttggggtccatcaaaggaaagaggatgggagacaggcaggatacctgccatgggttctattcagctgctagacgcaatgggtgaaatgtacacagagccacaggaataagtccgacaaacagtaagtacacatttggcaagcacacatacagacaaaaagacacacgtcaaacacacttgaacagttgcctatggtgggggcaacggaatgggacagagggttaaaatggaacacatgaataaataaaactagagaggggtcttgcacagacgaataatgtcagtcctgaattgggaaatgtgattcacttgcccctgcacccttgtggtccaagaggtggggacaggaaaaaaaagtacagaagaaagagtcaaaaagcccaagttccagtctggggcccgatactaacttgctgtgagactataggtgagtcccttcacctctctggccttcagtgttcatctgaaaagaaatcaattctcaggtctctttccagcaccacaattttatgagccatgatcaataatcttgggtttatctggtaaagtagtcagtgagagctttaaggagtggtagggcttgaactttgaacaatgggggtttgggaggggcaaacaacatgaggagagtttttaggcaaatgaaactttgaaagcaaaaaactgtaaaaagtttagcagatggctataaaatatctatggatgaagcaggccttcgctcagatctctgccgggactctctagttgggtcagaaaatttccagccttccccacctcttccttcaacagttaccaaatcgtgtcttctaaagaacttgcaaacacatccccattcccaccacaatgcctggactctgctcttgaccatccttcctctgtcccccaggagtgtcctttccacacctcaaaactcaccacatggcttccagacatttgaccaatcaaccttcatggctctctgtgacctcagctggggttttccaccctgttctgctgttacacctcttgaattttacacaactgtcagcaatgtagctagatacaggaaggggacaggccatgtcagaattccagaatcttggggaaaggggaagtgggactctctggcctctaggacataatctttatcacatcacgcaggaccccttgatccagcacttcccactgctcccacgtgatccagttcctccatttccagcccacttaacaagttaagtgccaggtgaccaaaccatttttagctccctgaatgggaacacatcacatacattcacagttctgtggctttgcacgtattgttccctctgcccagaatgcatcagctcctcatccactaccactaggcccacctgatctgccttgcaaatcctactcacccttcaaaacccaactcagacgtcgcttcctctgagcagccctctctacttccaaacactatatttagtcaaacagagtaagtcaccctgcatgtgtgctaccccacactatgagtctgcctgaaccttcctgctctctcacagggttataattgagtactggtctgtatccctggatagactgtgaaatccttgcaggtgtggactgtgtcatgaatgtatcattgaaccacccacacctggcacagtgcctaatgcacttgggaccacagggaaagctggttcatttgagtttaatctctgtttgacaggtaatggctcttcctttttattccccacagaaagcaagtgattgctttcctttcctcatttttggaagccctgcctaacacacagctgcactgtacatcccagttcctggatggacgaagaaagtgaactgatccagccccaagaccagagctgctgggcctttctgcccgatttgtgtctgtgccgtgttttctggtggctaggagacagggacaggtccagggctgctcttgtctgcagaaagtggaaccagatgatgtattctgctgagctctggcggtacagaaccatcaccttcagcgggagaccttccagggtacatgcatctgaagttgagtcagctgtttggtatgttaagaagtttggtcgttatctggagcacctggaggtcaaattcatgaatccttacaatgctgtcttgaccaagaagttccaggtcaccatgcggggcctcctgtcttgtctgagtaagagcaacaaccgtctgaaatctctttccatccaatacctggagctggaccgcctggtatggaggaacagcatcaggagctcattcatcagcagcttgagcttcttcttaaagaagatgggcaaacgcctggattatctcaacctaaaaggggccaggctgaccgtggagcaaggctgccaaattctcgactccctcagctacatgaggaatgagaatgtgatctcagagctcaacatcgaggactatttcagccatcaccttgctgtctacaacagcccccagttcaaaaagaccatgtccacattccacaatcttgtgtccctgaacctcaactacaactgtatctccgacgagctgcttgagaacttgtgtgagaatgccagcaccctccggaccatcaacatcaaatgccacgttcatgacccccacggacaggtcatctggggtatgtcctgggccaagctggccaggcaggccaccaatctgaaggtgaacttcttctttgaacggatcatgaagtacgaacgcttggcccgaatcctcttgcaggagatcccgatcaggagcatcagtctgagaagctgctatttcagtgacccagactgttcaatgagacccactctgatagatctcctgcccaccttccggcacactctgcaggtaggtaggacttgtgaggagtgactgctgttcaggtgactggcttccccagaagaaagcccactgctgcctgctcttggctaggctcccaaatgttcactcaatctcaaattgaagttctaggaaataccaccaactaagcctcctgccctcctcccaagaccacagtaggcaacagaagctgctactcacttcctacatgtggtacagacacaaggaattatctggttagctgtcagctagggaaaacccctaagtccccactcagagctatgaagcctgagccaggaggtgccttgcaggcgaatagcggctgggctgcctcttcctacttttccacgaggtcacagcagcatgcaggagaccctgtggctcctatggtcagatctcagtgggggatctgtctggttatagcagtgccagtgcctggtaattggggagatagaatggggaggaccaggccagacaaaaagtcaaatttgatttacacaaccgaagagctcagagtttctgggttgttccctaatctagtagctttctcacctgtaagatcaggatcattttgtctttccaaggacctcacagtggttgtgacaactgatattaacaggtttatgtatctctacaaacatggatggactccaaggtgctaatacctcattaggtacccacataaaccaaaggtggggtacggcagacatcatcatgacccttgtgtgctgcagaagaacttgaggttcaatgaccagcccacagtcacccagccagtccactgcagggctgggacgagcaccttgtatactccaagtacactgcctccaaattccaagttttgcaaccttggatgagatcaccatcattctcaaatctcttcctctaagaactacatgtccaatgtcccttatctaaaaagcccccaaattccattaacaccagacctgtcctacaagaaatgctaaagggagttcttcaatctgaaagaaaaaggcattaatgagcaataagaaatcatctgaaggtacaagacgtatacttactattacttactggtaatagtaagtacatagaaaaacacagaatattgtaacactggaattgtgtgagtaaactactcatatcttacgtagaaagacaaacatataagctgatcgaaaataataacaacaacaacttttcaagacatagacagtacagtaagatacaaacagaaataacaaaaagttaaacagtagggagacaaagttaaggtaaaaagtttttattagttttagttttgctgtttattagtttgtttatgcaatagtgttaagttgtcatcaatttaaaataatgagttacaagatattgtttgcaagcttcatgataacctcaaatctaaaaacatacaacagataaaataaaaagcaagacatgaaacatacctccagagaaaatcaccttccctaaaaggaacacaggaaggaagaaaagaaggaagagaagaccgcaaaaaaccagaaaacaaataacgaaatgtcccgagtaagtccctacttagtaataacattgaatacaaatggactaaaccctccaatcaaaagacataggtggctgaacagattaaaaagaaagactcaattatctgctgcctacaagtaacacatttcacctataaagacacacatagactgaaaataaagagatgggaaatgatatttaatgccgatggaaaccaaaaaagaggaggagtagctatacttatatcagacaaaatagatttcaagacaaaatctataaaaagagacagagtcattatataataataaaagagtcaattcagcaagaggatataacaattgtaagtatatatgcagtcaacaccagagcacccagacatataaagcaaatattattagagctaaagagagagatagacccctatataataacagctagagacttcaacaccctcctttctgtattgggtagatcttcaagacacaaaatcaacaaagaaacagcagacttaatttgcattatagaccaaaagggcctaaaggatatttacagaaaatttcatccaatggctgaagaacacacactcttctctttagcacatggatcattcacaagaataggccatatgttaggtcacaaaaaagtcttaaaacagtcaaaaaattgaaattatagcaagcatcttctctgaccacaacagaataaaactagaaattaataacgagaaactttggaaattatatgaagacatggaaattaaacaatatgctcctgaatgaccagttggtcatgaagagattaagaaggaaattgaaatatttttgaaacaaacaatatgcagacacagctaccaaaacctgtgggatacagtgagcaatactaagagggaagtttatagctataagcgcctacatcaaaaaagaagaaaaacttcaaataaacattctaatgacacactttaaaggactgaaaaaaccaagagcaaaccaatcccataattggtagaagagaagaaataataaagattggagcagaaatgagtgaaagtgaaacaaataatgcaaaagatcagtgaaataaaagctttttgaaaaataaacaaaattaacaaaccattagcaaaaataagaaaaaatgagagaagacccaaataaataaaatcaagagatgaaaaaggagacattacaaccaataccagagaaatacaaaggataattagagcctataacgagcaactatatgccaataaattggaaaacccagaagacatggataaattcctacacacgtacaaactaccaagattgaaccatgaagaaatccagaacctgaacagaccattgacaagtaacaagatagaagctgtaataaaaagtccccaagcaaagaaaagcccttgacctgatggctgtactgctgaattttatcaattttatcaaacatttacagaagaactaataccaatcctactcaaaccattccagaaaaatagaagcagagggaataattctaaactcattctacaaggctgatattaccctgataccaaagccagataaagacacatcaaaaacaagaaaactataggtgaatattcctaataaacattgatggaaaattcctcaacaaattattggcaaaccaaattcgacaacacattacaaagatcattcatcctgaccaagtgggatttatcccagggatgcaagaatggttcaaaatatgcaaataaatcagtgtgacacctcataacaacagaatgaagaacaaaaagcatatgattattttaattaatgctgtaaaagcatttgataaaattcaacattccttcatgattaaaactctcaaaaaactgggtatagaaggagcatacctcaatacaataaaagccatatatgacagacccacaactagtatcatattgaatggagaaaaactgaaagccttttctttaagatccagaacagagcaaggatgccactgttaccactgccattcaacatagtactggaagtcctagctagagcaatcagatgagagaaataaagggcacccaaatagaaaatgaagtcaaataattcttgtttgaagatgatatgatcttatatttggaaaaacctaaagactccaccaaaaacaaaaacaaaaaaaactatcagctaaacaaattcagtaaagttgcaggatacaaaatcaacatataaaaatcagtagcatttctatatgccaacagtgaacaatctgaaaaagaaatcaagaaagtaatcctgtttataatagctacaaataaaattaaatacctaggaattaaccgaaggaatgaaagatctctacaatgaaaattataaaatattgatgcaagaaattgaaaaggacacaaaaaaatggaaagatattctatgttcatgagttggaagaatcaatgttgtcaaaatgtttatactatcgaaagccatctacagattcagtgcaatcctatccaaataccaatgacattcttcacagaaatagaacaaagaatcttaaatttatatatatatatgtgtgtgtgtgtgtgtgtgtgtgtatatatatatatggaaccacaaaagatgcagaatagctaaagctgtcctgaccaaaaagaacaaaactgtagaaaccacattacctgacttcaaattatattacagagctatagtcactaaaacagcatgagactgacataaaaacagattttaagccccttatatattctggttatttattaatcccataaagaccaatggaacagaatagagaacccagaaacaaattcattcatctgtagtgaactcatgtttgacaaagatgccaaaaccatacattgggaaaaggacgatctcctcttcagtaaatggtgctaggaaaactggatagccatatgcagaagaatgaaactagaccactatctcttgccatatatgaaaatcaaatcaaaatggactaaagacttcaatctaagacctcaaactatgaaactgctacaagaaaacattggggaaactctccagggcattgaactgggcaaagacttcttgagcaatacccacaagcacaggcaatctaagcaaacatagacaaatgggatcacatcaagttaaaaagtttctgtacaatgaaggaaacaatcaacaaagtgaagagacaacccacaggaagaatgggagaaaatatctgtaagctacccatatcacaagggattaataaataaacagaatatacagagctcaaacaactctataggaaaaaaaaatagtaatccaattaaaaaataggcaaaagacttgaacagatatttctcaaaagaagacatataaatggcaaaataagtatattaaaaggtgctcaacatcactgatcatcagagaaatgcaaatcaaaaccacaatgagatattatctcaccccagttaaaacgatttttattcaaaagacaggcaatagcaaatgctggaaaggatgtagagaaaaggaaattctcatacacagttggtgggaatttaaagtagtacagccactgtagagaacagtttggaggttcctcaaaaaactaaaaatagagcttacatatgatccagcaatcccactgctaggtgtataccccaaagaaagaaagtcaatatatcaaagagatgtctgcactctcatgtttattgcagcactgttcacaatagccaatatttggaagcaacctaagtgtccatcaatggataaagaaaatgtggtacatgtacacaatggagtactattcagtcacaaaaaagaatgagattctgttgtttgcaataacatagatgcaactgaggttgttatgttaagtgaaatatgctaggcaccgaaggacaaactttgcatgttctcacttatttgtgggagctaaaaattaaaacaattcaactcatggagatagagagtagaaggacgcttaccagaggctgggaagggtagtagggggtgcagagggaagtggggatggctaatgggtacaaaaaaagttagaaagaatgaacaagatctagtatttgatagcacgacagggtgtctatagtcaatcatcatttaattgtacattttttaaaaactaaaagagtataattggattgtttgtaacacaaaggataaatgcttgaagtcatggatactctatttaccccattgtgattattacacattgtatgcctacatcaaaatatcccatataccccataaatatatgtacctatgtaccacaaaaattaaaaattaaagttaaaaacccccaaatcatcatggctatcaggcccagagccaggtcgtggaaatgttacagaacaactcagccaggctcagcatctctgcccacacacatcttcccttttggtgctcttccagaaattaacttgtgaattcaacaacaaccatgagtcactcgacgaggagctgcacctcctcatcatatcctgcaggaagttgttttacttcaaaatctgggctttccttgatgttagttttgtggagcggatcctgaagagtcagaaagaacggcagtgtgccctgcgtgtattcaaggtaagaggtccccaggctggttccacggcgtagagtgggggcatccaggaatggtgcttctgctctggaacgaagggctgaataaggcagtgggggacaatcatctgttcattgaaaatcagcagtttcaaagaagggaatctggagctctcttttctagtagttgggtttggtctttttctgattctgccaacatattttcctgattcaacaactgtatgtgtagatcatttaagttgctgtcaagccctgaaaagtgtagtcaccgtgtgtgtgtgtgtatgtgtgtgtgtgtgtgcgtgtgtgcgtgctcatatgtggatgtatttctctgttggcacaggcgagaatttatacaaacagatatgagacgaatgaagaggacaagaccctgcaggaaatttacaggaagtacagaaagctgatcgaatcagagcttagctattttgtcatcgtttactctgtgatgtaatgagcactctacagatgaagaaagctgggagcactttgaacttgaaaatcatttctcttagaactacacttgggcactgccggcccttttgctcctctctctcccctccactttttttttttgtcagctccatgacaacatgaccagctcagcaaaggctgagactgcccatgacctgaaggctccaggtggctttaaagcgctatgtttaccaacta

SEQ ID NO: 1501 - DNA, 19810 bp, Homo sapiens; identical to SEQ ID NO: 1499

SEQ ID NO: 1502 - DNA, 19810 bp, Homo sapiens; identical to SEQ ID NO: 1499

SEQ ID NO: 1503 - DNA, 19810 bp, Homo sapiens; identical to SEQ ID NO: 1499

SEQ ID NO: 1504 - DNA, 19810 bp, Homo sapiens; identical to SEQ ID NO: 1499

SEQ ID NO: 1505 - DNA, 415915 bp, Homo sapiens
tttttactaaaacagaaagactttcaggaaaatgtcatttaatgatttcagctatacattacatatacaactctgtagcctagcaacaatcattgctacaccatcattaactttaaatattttgcttggtgagctattctcaaatgtagcacattttaagattttgccatcattatgactgtggaatcattgtttggttttcataggaaacagatctgtcacagtatgaagctttgtttattttaagaaactggtacacaattacatttccacttacaagagaacgccacagatataactaaaggcaggcttcgatggctccacaaaggttgcgtgctggaccaaccccacacctcctgcttccccgtcgcaccgccctggccaggttcacatggtttcatttccagagatgctttgctcttcgcagttaggtagttttaattccttcaaaggcacacagcttccatcttttttccagcgtggctcccacacccgtgaattcctgtttgaacatgcgtggcagcctcatcaaaagcatttctatttcatttgcagatatctgttagaaaggaaggaaagtcactttggggaaaggaactcatcttaaaggaggaatggattggggaaggatgagctttcccagtgatatgaacagcatttagttttctactgggctgtcagggggatgtccttatagaaggaacattcagaagtactgaatgtgattatcccacctcccgagcagctggcggggtggggcgtgggttggctgggcggaaagtgccaagttcacccttcatatggatggctaccttactggcagcaccattcctgaacagccctcccctgatataaaaggagatggggagggaatttaagagggctcccagcaaatccatcaccactcctggaaagctactagtggcttcatcctcatctatgaaggacagcaattttctttaatgctgccaggagcagaagacattcgggtggatttcttgccacccaaatttctttctcttccttaattttcacatagaccagagaccataaagcttttggaatggaatctaaactccaaaacctacaacaatacaagtcttgatatctagtcataaaattcaggtatattttttaatgcaacttttttcttctccatatttttatttgatgaatttttacaccaataattcattttaaagaacaaatcagccataatccctctgctctagcacagtgattgcttttgttgtcctgtgttagcatgccaatccatgtgtatgcatgtggattttatacagcagggcggccaatttggggtctgatattctgtttgaatatccccaaaatttggggtctgatactctgtttgaatcctgtatcttcattctcacaagttaaatgacccttacagagataattagtctctttaagcctcagcaaatggaaataacatttaataaggatagcatgaaaattactggcttaccacagatatgggcacatagaaatgttcattgaatcagagctattacactttttcatggtgtaatcactgtagagatatcattttagagtctacactttccatttaacaatattaggattcatttaaaagagacaccaaatagaccaagaagtcaaatcaactgtttatttaatattctcatggaaaagacttcatatgacacattcaatattcctgggcctataatacaaaactttagttaaatagaggcagttctgaaaattgaaatacattgtattctaaaatttttgggaattgttttgaaatctgaatgcattttctgatacacaccatattagatggatggttaaattcccaggtcaaccgacaaaagcctatgagacagattatgtgaaggttcataataactttgagaagtaagttttctttcagtcaccaccagtgttctcatttcattctcacagcactctggtgagattcgtgagcagatattaagatgcatctccattttatagttcagaaaacggtgtgagctacagagggttaagtgttttatcaaagacacaacttgggaaagaacccaagggttctttcatgggttggggcctgggccttgattggtgtgccttaagcacttcccatgattgtcaacagccaggggtgaacaaccaggggtgctgggaggtctttctcagtagcggtcacctggaggcacttgttaaaaaaatcagatcccccagccagcctcttctctggagatccggattcagctggtcttgggtgtagcccacataatctatttttaacaaccatcccagatcattcttatagtcaggcatatttgggttaagaatggggacttaggccgggcgttgtagctcatgcctgtaatcccagcatttggggaggccgaggtgggtggatcatgaggtcaggagatcgaggccatcttggctaacatggtaaaaccctgtctctactaaaaatacaaaaaattagccgggtgtggtggcgcgtgcctgtaatcccagctactcaggaggccaagaggcagaagaatcgcttgaacctgggaggcggaggttgcagtaagccgagatggcaccaccgcactccatcctgggggacagagagagactccgtctcaaaaaaaaatggggacttaagccagacaagcttggattttactctggctaggcctcaagctgtgtgactttgggaagattacttaacatttgtaattctcagtttcttcaggtgtgtaatagaagtcatatctctcagggtattgtaaggattatatgtaaaatgtaacacagtgcctggcacaagttctctctccttatgtagacatgtatatgtgtgtgtgtatggaatattgatagaaaatgacactattatctaaccttttgtagtacggagtggtatgtggtcaaaactagtttttcataggtccaggaggcagctttttttaagcctcatgagaccaagttatcttctcaaagagttcccttctttcttttggaggaggacagcacagatcatctatggtgggctctagtctccagtcaaattcaagtgccacccctggcatgtccttccccagatcaaggagaggccatagcggaacacacaggccgaggtgcctgccagcccaccagcaccttgtttacagtgtaaccgccacctcccttggaaatgtagggaagaaggtttgtgccattcattagggaggggataaaaagctaagtttttgagggtaaaataaatatctgatttaaatataacgtgtaggaggccagctggggtcagaaggggcagtgccacccagcagccctgcagctggctgtaaaaagtgtgacaacttacaatcaccaggaaacttttccttgccaaactcttctgaaaacactatttaattctcaccacactctcataagatagggaataatttaccaataagaaaactgaggccctgagagactcagtaaatcccacagggtaacacaggcagtaagtgtggaccagacctcctggctgtggtgccttgttcttaaccacccctgcccacctccaccagggagaggaccatggagtaaggacaggaaataatcctcttggtcactgcctctctggccctgggtgggtgtggatgccatggcaggcatctgtgtacaggagggcagggctcctctgtgatgaatactattagagtgatagcaacatcaacagcaaaaaactgaaaattcccaactcacctggctcacacacgttcatattgctgatgctcgggcacccccacattaaccatccatcaaaacggtaagcaaatcatgggaagtcttggctagcatgtactgaaatgtggcaacatcttgttttccatggtgtcttttgacctgagcctagactttaaccacaaaggaagcaggacaaggcttgcagcgggacagaggtagctaccatttaccgagtcttcactgtggggcagggaagagtaaattcttcaccagcattatctcatcagaaagctcattaaacaagcaagtgcccccctcacttgctggagtaaagaaaaggagacacaaaagatttggatcacagtgatagaacaatcagtaacctcttccagtttagtagttaagtaaccagtcacttaacttctttgggcctgtcttctcatttccaagacaagggaattggaaagaaacacagggaatgccctgaggacttggtttgtgtgctggcctctccatatcctagctctagccttaggacaagccattcaaaatttatctgtcaattaggttgtggcaaagatcttaaaatgagaggatgtgataggtcttttgcgcaccttaaagcacaaaacaaatgacggtccccactttagtagcacttattgtgtgccaggtactgttctggaatgcttttcatctactaagtcatttaatatcaaggataaccccccaaaaaccactttacagatggtggaacttaggcacagagatgttaaataagctgtccaaggtcaaacagctaagaagtgatgaaactgggatttgaaatcctcgtaattacttaatacatacttcagattttgagaaagccagaaattagtgtaatgggaattaatctcaaatgtattagctgtagtttctgttggtagtgtaagatataacagctgggttctgccacaaagatgcaaataatacagagttgtgtcataattatggaacagaccacttcaaataaaaatctatctaaaatatccatttaataaggctctcagcagctgggcatggtggctcacacttataatcccagcactttgggaggctaaggtgagaggatcacttgagcccaggagtttgagaccagcctgggcaacatagagagacccaatctctacaaaacatacaaaaattagccgatatggtggcatgtccctgtggtcccagctactcaggagactgaggcaagaggattccttgagcacaggggttggagcctgcagtgagctgtgattgctccactgcactccagcttgggtgacagagtgagaccctgacacaagaaaaaaagggatctcagctaattctagaagaattccttaaagttgtttaaagatatttatatctcatgacagaagaaagatcagggagaaagctgtatcaggtaagttagttttatgattttcaaacttttcccctaccctgacaaaataacctttatgatattttatcttttgggatttttaagacaaattcaagagaaaattcaatttgtcctttgttttctccctatggccaaagaatttttactttataaatacttccacttacttcagttctgttctcttcctaataatttgtcagctattatcatcttgccatcacaatatcctttgccttcccaccagtacattctttgtctagagaattgagactctggagtcattacttaaaccaagcacccagacctcactggctgagctctgagtgaagtttacccctttcctcatctcctgcacgattttcttccctgaatcacttctgagaccagggattctctctaagctcctacttctgttcacacatggagccctgggttcctgggaagagctgttgcttgcccagcaggtaagtgaaggggtagaacttggagcaaggattatgaatccagcccggctttcagagtgacgcattccctcactcccaagcatattatgaggagatgattgcaatacacgtggttaagggagcactgtgtagcactgtgatatagattagagatagatgccatgactatgaaatcttttccccatacaccatgtatttggtgctctagcaagtggagaggatagtcataaccctgaagttttgattaccctcttacccaggtggcttttgttccaagaaatttgtggcctatatattttcaatctttgatattgtcagtggattcttctacctgttttgtttgaaactttcttaaatttattcttttaggaaggatttatttgctacaaatacaaaaaagaaagaaagcaaacatcagaaggaaacaggctgtgtgtaactaaggagcttgtgtgctgttgataccgcagaggtcatttataaaatctgcttgatttattttttaatttgctcactctaggccaagcctactgcctccttgcccggcctctaatcacatgtacaaatggacacaagcagatgcaaatcaatttgttctcatcatggttggctccataccccgtatcatcaggcaagggaagcctggtgaagaggggctcctgtttgggctactgaaaagacgccggcagaggccggagcgtcagggaagccagttgaaaaccagacttccttccatgggcaaaactgacttctagcctttaaatgcacatttaaatcttgttcattcttcacatcctgggcagggcacagtgttagcacacacagacacctcacaacaaatgttcacagagagaaatacaaaatgtagatggggcaaagggaggggaggaaggaagggagaaagaaggaaaagaggaaagaagacaagaagtcaggaattcgaaggagtgaagcaagaaactggtagaggaagggaaggaggcagaaaaaatgtgatgaaagaaggtaaacaggagagaattaaaaggagaaaagaatatggaaggaaaatgagggcaggaaggagagaagaaagggtgggtagaaagaggagaaaggaaagaaatgtggcaatgttggctaaagcatcccagagggaagccaccagaagaagcatggactcgagggtaccttgctgttaatcatgactcacagatttcacccttctctaactcctagttcagagagtatcttccctacccaatttagcacttcattagttcatgtctgagtctcaaatcatttcataactaggctacaagcttgttgagaatagggttctatcttaggtttcttttgtgccttggtcatctcctgttcttctctggtccctaagacagtgctgggtacatgaaaagcagtgaattatcccagcattcattaggtccctggtaaccttaccaacttctctcactgtggtgcacagccttttttttgttctttatgtagtcaagtggggagtattgttatctctgctgtcatatgctttccagaagtgctgtaatatctaaaaaacccattcattatagtctgtctaaaggatcactcattgatattactgtgacaggctgctcttaaggagaaccccagaatatgcatactattaaggatcattcaggtgggcaatctcataaacactactgagagcatttccccaccctcatcacctggttatagtctgggaaagaatgctatccaattaattaaacaggatctgaatctcctttccatagccaagacatttaaattttgtgtttgcagaggtatgctattagtacagaagtgcgaatgattctcccctctgtgggaaatgtaacacatgcccatgacctctcaagctggtcacagtggtgtcgtgccaaaatagcaggtccttctatatcctccagcctctgtggccacattacgctgagtctggttttcagaaccaaatcttccacaccatgggccttgggaagaggctgcaggtgtgtagagggggcaaccagacacgcttggaaaactgagccttcatctcctaaaggatatataaacagggaagagcagacgaaccctcctcttgactgtaagaagtattcatctgctaatgctcaagtcaaatgtttcttctgggctgcttcggagagacaagaggttgggcttgatgggccctggggctgacatgggagattctatgtactgatagaaaccattttcatcatagtgctgcctattttaaagagtttgcctgctgtgctctgggcatgatttttgactcagcaaagcttcagaagccatggctgcccccaacccggaccctgttttcctctgaatgaatcttcctttttcaagtgtttctgatacaagagaaccgggtgaatgagagtgggtaatttagaaaaggccaagaagagaaaaatatgcaaatatgcaaatatcaacagcaggaataatatttaactggaaaatagcttattattgggctacatggttttaggaagccatgtgcaatgtacatgcccggcataatttaaattaattccttccattcctagtcattcttacacccatatgtagcctttggggaaatcctgaccacaacagtgacattacaggactgggtggagcctgctttccctgttctcatcagtacagggtgggcactggattttgctctctggattaaaaagtctaaatatcctctcagcctcactggaatagaaagcatgtggtctgatccctggtgcccagcagttttagagtactttttcaatatactttctaccccaggcatgagaaggaacctgacagctctgtgggcgtttcattcagaagatggagagctatctgggagtaggcaggggacacctcgtgtgtttcctctgtgagggaaatactttcttcatcactctaaaataaaagtaccagtctgcgatgagatacaattcctttgactgaatcccatccagaaaggcccatcatctaatggccagggacaaggcatgtgaattctctctcctcagagactggtaagggaacgtcacaaatcttacctgagccctgaggataagaatagaacaagagcttctacccgccaccccctccccgccagccaaaacaaatcaattcattacttatcaatccctgcccattcccaggagatgattttacacacacacacacacacacacacgcaggcacacacacttcactggtgatcatcatagattctcagcctgcgatgatggagtggaggaaacaaagtgtcctgaaattctttgataaacgacaagtggattgttggccattttagctcctactaaaacaacagctgcttctcaacaaaggcttctcacttgggacttgcagaaagggagaacagaaatgtcaacagtacaagggaaggatggtagcaacaataggaatcatttcttgaggggttattctttgccaaacacattggtgcaagcagtgttttgtttaatcctccaggcaaaggtggtggtgatattaaggaacaataataccagtaaaggggaaacaacagcagagaaatccttcaaatctatatgacaacaaaggaacattgtgcagcaagtccttcttatttcatctgagtttaacatgaatgctttctctttcttacctgtgcatgtgaggggaaaccacaatgaaaaaaatagatgattctgaacctctagaattttaaaattctctaactcctttcaccctgttttgttctaccctgtcatgaaaggcatgaaatctgtatgactgaaaagattcctctcaaaggggaagtgttagatccatttaagaggttaaacagttttgggatcatgtattgggaagattatttgaatcaaaataagaacacatgatagtcatttgatgcatgctagccattgaaaatttagcatgatttagctgtgtctgttcagggacacagcactgcagtctgctggtctggtcgtaccaatcccatgcgttttgctgtgctctatggaggaccttcttacttatttccattttccttcatgaccagaaatttgacaggcaactcgctggcttctctagcttctctgttttgcttctgtgtccaccccgctcctgggcttccctagtgttggttaatgatgttgttttattttgtcagggccccttccattgttcacatgaatttgacacataaatcacattctttttgtctcttctctatgggtacacaaatactgcggtggggtaggagtacagctaatttgtggatgggaaaaaccgagcttcagggaggtgaggaatgatgtctggctctggatgtgagcctggaggggcacagctgagaagaattttgcagccacttttttctacttagagaacaacgctggaaaacagccattaatacagctttcttgagtcatatcagatctttatattatttgggatgatttttcctcaattgtgtgaagtccagaacatggaatcctataagaatatggtctgaggataatgccctattagccacactcacctgatttcacccttattttgggaactttcaggtgaacctatatttttaaatctctcataagctttccaaattaacttggcatctgctaaaagtcattgtcattttagataactgctcttctttttacaaagacaaaagcaagcaaaaagaggagaacaagctgccaaaaactgaggtccttgcaaaagagaagggctgatcaacccccataggctgctacagccctagttcagttcatgcagagtccacctgcaggcagcaatcaacatgctaaatttgagcaacgaaagttcactcgagcaaaataatttaccttggagtccagctgctgcatgtatgaccaaagatattctatgttggctccaaaaggatggacgtgaagaaacgttgatatgatacctgaattaaaaaggcaaacattggaaattattcaaaggcatatgagagtctctggttaaataatgctgtctaatcccagtgactattttgtcaggctgagttatggtcttgccatttctagcagcactcaacaagcattcaataatagcacattctgaaggcagtaagagtaacatggcaaacagaacactttatctcctggaatgatagtagttagcaaagctagactctgagataatatacagctgaataaagatatttcaaaacaaagactcctggaagcatttcaactaccaattttatgcttgatttaccaatataaaattatagttattggaaggataaaattatcttttctttccctcagtggactttgcagtatgaaaatggctcatacaactgtgtcagaaatcacactgcctcagattttcctgataattacaattgctagatatgaaaagtatttaatctatatttcccccaactgccattgaaggaagcccaaattcttcctgaaacatttgctgttctctctggttgtcgctcttgtttaaaaggagccagctcattctccccttcttgctgctgtaatttacaagatcattttaaaaggtctgggaatggatggtttggctgcagtttgattataaattataaggctcttccatcgtgcaaatcagctgtcaacattgtactgacaaatgaaaagctggacgttgaagtcaggaatgaagtaaaaagcattaccttcctcttctccctgctcctggatccaaaatcaaaatagtgaacatgaggaagtcaactccaaaaactgtagactgctttttgttaagaagttgtgcacttgttattcacgatagcaaaaacatggaatcagctcaggtgcccatcagtggtggattgcataaagaaaacgtggtatgaaccatggaatactatgtagccataaaaaagaaggaaatgatgccctttgcagcaacattgatgcacctggaggccattatcctaagtgaactaatgcagaaataaaaccaaatattgcatgttcttataagtgggagcttaacagtgggtactcatggacataagaaggagaacagtagacactggggactgctagaggcgggagagagggatgagggaaagggctgagaatctccctattagggattatgcccattaccagggggatgggttcagtcataccccaaacctcagagtcatgcaataggcctctgtaacaatcctgcacgtgtacccctggattctaaaataaacgttgaaaaagaaacaaaagaaaagttgtcctcagactgatagttttagctttctgttaaaaaagtttcaagatgaattaaatctgagggtaagccttcatgttctgttttttgtgagccttcatgcttgggagccagggaagaccctcacctgtatgaaatgccatctgggtgggcacaggtgcacacagcattcttgtactaggtcatcctataggtgaccttggattgatctgccatagggtttcatggctccctgatgctatgggatgagtgtcaagtttttaaagaaaagttcccagttcatcctcaggctgagaacagaaaaccaaagggactctccaagacctatcctcagaatgttgctttcccagggcttctagaggatgacagtgagatggggaggtagaaacaattcccacatttccctgtaaaggtagaatctcagtttttaaagactgacctgttcttcctgagatacaaagaactaccacttcattctgaggttatattcttccttttttcttgtcaaaatgtccttttttgaaataatggcaatggtagaaggcaatgatgatactttaaaaatatctttaagtggaaaaatagccacttttaatgtactcagggagcattgtgttgtcccctccccttatttatttacttatattttaattttagagacctgacagctacttccctgtaactgaaattctcaattctggtgaagtggcattctaagtaattctattactaataagagttaaaatataaaagctcaggagtgatttctttaaaaaaattagaatatagtagaactatttaaaaatgattattttcatttgcatttccttttttgttttacaaagttttaaattgatatataatatttgtacatattttttgggtacctggcatattttgatacctgtatacaatgtgtaatgataagaatcagggtaatttgcatggccatcacctcagacgtttatcatttctttgtgttgagaacatcccaaatcttttcttctagctattctgaagtatacagtaaattactgttaactataatttccctactgtactatcaaatactggaacttagtccttctatttgttgaatgagagagtaagggctgaatcacagttcgtgtagagggaatcccctgtttcacgatggtgagtggggctttcactgaccatcccaggtactatggccactgctttccacagagagcctcccacaagtgatgggcaggagaaggacaggggagggagaaggaagagtcagctttggctttgtgagcaggtgagggggtgctcctagtcggaagctttttttctcctcctcccctgcagggttctcccagggaggtgagggctgctgcaaggtggggagcagcattcctcgggtggacatctgcttacgcagcagggctgagacagggagtggcagcagcactgcagactttggggtgacaagggtgtataagtctcccatggagaaagagggcataagacttgagcagtcttaagtaaactaccccaggcaaataaataacaatatttttcatatttaatattccccctggccagagagccttcaacatctcctgcataacctacagccttttgtaaatgtccataggtgtatggttatcaacataaatgtctttaataggatgaatagaacaagtcagaggaggatggggtgggttgggggagaggttgataacccttagcctaggagacgaagtgttgacatgggtcatttagggacaccagaaatgggaggacctagagtgcctctgtgaagttggcaccctctgtgaacatggatttgctcctccactgtctactacctttcaaccctaatcctgggtctgcaccccaaggagctgtgctcttagtctttgtgtgttctggttccatatccagaacatagtacacattcataagaggtatatgttgaacgtatttatttgccagaactggaaatctccagtatacttgtttaaaaattctattagtctattattgataaatgggaataaataagaaccttaaacatttctacaagtagtaacagatctttcaaaaaccaggtaactttgagatattattcactgaaaattcttactcttaacccgtcctgtcatggatttagaaggatggagtaacttggatgttttgagcaaggaaaattttcattgaaactattttgctcataactaaggggaaaatcagattctaaaatcagattagaagtcctgacgtggacttgagtgttcttttaggagggtattcagaaccatctctgtggtagctgatattaagaagccattagcttttccttataagagttcagcaattgccactagatatatgtagggccaaggcaggcagtcacaaataggcttcccaagcttttcctgtggatgacaacccaattatccagtgttgctagagacacagccgaaaggaaagcatgagtcatcatcctccccggtaccttgcctctcctcagcccacctcccactcctgcatctgtccatccctgtagcaccacagaagcatcagtcatgccacttgagaaaatgtttctaggccctgtgattttggatcaggttcatttgagggaatctttctaaataaacaagtaaagcctctttgcagcttttttttttttttttttttttttttaaaggaactgggacattccctggggatggaaaaaggatggctgtaactcaaaagttaatgaaaaatgccacaaacctggaatatggagactattttatggtcctctggaatagacctaaaggcttggtaaaatgaacactaggaatggagggtggtggatttagctgttactgaactggtggatctccaaggggatggctcaacaattggacttgcttgtttccatggagatgtagaaggcctccatattggagaatgggtttccaaaagtggaaaaaaaattttaagtgcctaatttaaaaaaattttaaaagaacaaaggaggttcagtaccattgggctttttgcacatctcagaatcttaaaaactactttagaaagagtaactagctctagaggcctgtgccaaacctcgttaggaaggtccatttaaattggctacccaaaagcactctgagcttctcccatcaaaaccatctagtttatttacattattgggtctcactaagactaaggatgcagtatttaaattaaccaaatagtgccagatttgtactgcttcatcacttattttaatacttgaaacacttagcagccaggaggtggcaaggtgctagaggcacagcattgtataagataggcaaggggctggtcctgtggaacttttattccaggtgagcaacacagataataaacacaaagatgaaaaataaaaatttttagatagtgcttagcacaatgaagaaaacacatcagggaagaggacagaagagacagcaacctgcagtttgctggaacgctaccttacacaaagcgattgatgtggtttggctatgtccccccaacaaatctcattgaattatagctcccataattcccacatgttgtgggagggacccagtgggagataactgaatcataggggcagtttccccatactgttctcatgctagtgaataagtctcgtgagatctgatggttttataaggggaaacttctttcacttggttcttctctcttgtttgctgccatgtaagacatgccttttgccttccaccttctgccatgattgtgaggcctccccagccctgtggaactgtaagtccattaaacctctttttctttataaaacacccagttttggatatgtctttatcagcagcatgggaatggactaatacagcgattacgtgaagccctctccctgagaaagcagaccttctcaagtgtgagatgagaaggagtcagccatggaaagcccgggggagaccattccaggtacaggccacatacagtgcaaaggccctgaggtggaagtgagctggcagaacacactgggctggagagtggcacatgtgtttagaggtaggtgggggccagatcacgcaggaccttgtgtgccaggggaaagagtttggattagatttaaattctaaatgtggcaggaaaccaaaagagtggttctaagcaggtgcttgacatgatctgaattatgttttaaaaacttccctcaagctgctgtatggagggtagagcagagggggaactgggaggccagttggaagtgtttgcatgagactggagtggtgagtcatgatctggactgcaaagggagaagcggactccaaagggagagccagggggctggtgtgagcagtgaggctggggaagaatgaaagatgagtaaacagtttttcacttgagcaactgggtgggactattttctcagatgagaatattggggaaggagcacattagggcaggaaaaaggggaatcgggagttctgttttgtcctcattaaatttgagatgtgcattagcatctaagtgaagaatattaaatggcagctggagatggtatacatttgcaatggcaacaaaaagggatttgaagccaaagtattcattgagattacctaggtagagaagaggcctcaagactgaaggctggagaagcccaaaatttagaggtaagctgaggaaaactcatcagaggactctgagagggtttaatcaataagaaagtgtggcatcatgatggcggagagaagtatttccagatgtgagtagtcaaccacgtaaagtagctgccaggtagagggagttgagaaattggtgacataaaattctctggtgatgtggaaaagaatggttttggtgtgaggatgcaagtcagactggaggaggctggagagagaggggaggagggaatggtgactgtgagcatagtgcgttggaggaatcctgctttggacaggggcaggaaatggactgttgctggaaaggggtcatggtgtcaagacagattttccttctcgtttgttgcaaaggtacaagatagtagagttcatgtttatatattgatgcacatgatgctccacttacatacaagatcactaaggggtaatgcagctttcataatagtcctcatacattacagagaattgagttgaaaaggaccatctaatcaaacttcctaattttatgcagtatgagggcttacacacttaccacagtggtttggataagtgatttgccttagattacccggtggatgaaatgcctcaatccacaaatatttaggaccactccccctcccccaccgctcagggctgcttagagatcattaggtattatggtttctcctttgcatccttatacaaaagatgggagtgggatgggttagccctgttatagtttaattatattggttacccgatgagaataaactatcactttgtgcattcagtttggtcagcacattattctctttgagtggaatgagaaatggaatattgccagaatatactccccactacccccaggctgcttggagttttcattccaaactctctgtgtcaggttctaaagttctggctgagatttgctttctctacacctacactggttgatagtctcctaggaagcttcaaaagaccctggggcccatcagctcactgggatagaggagcaccttggggctttccagagaccttggctctgcagatgaacagctgtgtctctagacacagtcacatcttgctgggaattaccagaggcctgaccataaaccagcctgaaatagtcttgtttcatgttgacacccatataaatggtccacggatgttggagaatcagcaggaaaaaaagccatgcaaaatctgggtctcctagtaagccctgaggggacagttgtctgtgggcagctgcagagtgatgaagcgtatatgggaagtggagagaaactgtaggaaaccgatcaaacacttgtggtttgggctgatgcttctcagtgccttgggattccaaaaagctttaattttccaaaaaagtttattccgcttacttggtgagtacaaaacctaatcttgtatggttggttagttagttttgtgttgtaatatttgtctgtcttattttttcgattaaacccctcagactgtatttgaacctcttagtagtaaattgttcctggtacctgaaatgcccttaacaacttctttatccatccagtgaaaacctcttcatcctttaggactagctcagctgtcctttcttctgacaaggcatctgtagcataagtagctccttctctgtgtctctgattttactacgaaccacagttcattgtaattaactgcattctttctcattatctatgaacttcttgaggggagatcatctttccaccatcagttaatgcatgggatagcataaatcaggccagcgtttctcaaaacatagtaccagatatgcctgctttagcatcctctcagatattagtattgcaatgaacaggatcactttcttttttttcttttttgacagggtctcactctatcacccaggcagttgtgcagtggtgctgctcacagctcactgcagcctgatgctcgtgggctcaagagatccttccacctcagccccccaagtagttgggactacaggtgcatgccaccatgcccagctaacttttttttttttttttttttgtagagatgggagtctcactatattgcctaggctggtcttgaactcctgagctcaagtgatcctcctgccttggcctcccaaggtgctaggattataggcgtgagccaccacacctgtgtgtggggctaaagattctgccttataaataggctgcctagataattcttttccacaatgaagacggattattcttatcgtaggctcttgataaatgtttgttgatttattgatatggacatttgtgccttggaaacaagatttaggtcaatgactcattctttatggtcagtagttttcagagaggaacatactcccaagattacttttctcaggtacagcctaaatatagcctcaactttattcactgaaatcaccaaaaattattgcttaaccttctttaaaaatatttttccatattctactcagctgtttctttatacccacattaggaggagccttctgcttctggtatagtctggttttgtgcacgtgtgagatggtgactgtgatggaaatgatgtgtatgtcctgatctgcagaggactcaggatatgtaagaaagtttgcccaatcattgtcaacctgaggacagttctcaggggaccagggaggttttagagaaaagctgctttgttacagttaaaagttgtggagaagtttttgactacatctggatagtatttacaatgactagcatcaacagggcgtcaatcagagctgctgggattgaaatctattgtgttggaattattataaaaagcaagagaatatagagtgatacggacccagagagttatactctcagctctctgcagaactattagcttgtcaataaaaaaaatttgatccatttttcctttataacaatatccagccaaacacagctcccaaactttggccccaaatcaaaagtaatgactcattctatcccaaacaacttcagtgtatgccaatccaacatgcaggccatatgtgaaataaactagttctggcatagacattgagcaatgtcaagctgaccttatgtgtggttactatagcattatgaaacaaaatgctaccctgcaatgcccccataaaaacagaattctctaaggtccaattatatgtcaacctgtctccacaaaaattgattacaaaatgaataacccagaaatcacaaaaataaagtattttccaggggcctgtcttctttagttgaattggaagacccattaattgtcaagaagaaagtccatcagaatggtcgaactctaataatactcaggatccagatctgcaaaattccaaattatgtcaatgaaatcccacggatcctctctaataaatatcaactttatgccttgaaataaagactctagttttatacaatagtcataagaatgtctgggcagaatacacccttttgcccagataaatcagtgtcacaaataattatatgtaactagaattgctcattgtttaggaagttctagcctcagttttattctttctgtagatggaatccatttgaagagcttttttctcactccctttctcttccagggaatgctttctgccagtgtgcgtttcttatataacatttatgtgccccaagagggcactgatcatctgactatattggcatacagcatacactataagcatgcagatatgatgaagattttgccaattaatgtttccaagttgtgggagattttctgctgtgtccttggccttctaggctggcctagagcatgacttttgtgtcctctctactgacttaattattccaagggaagatttcagggggaattgcaaagagtatttatgactgctccagatgtaccagaaggccagagggctcctagaatcattcagtgcatgagaattcttcagaaaagtgtagccccagcaccaggaaatcctttttctctattctgatccagagcagttttgtccctaccacagtctgtatctagattccagaagcttcaggggagctctttatggacgcaagattcaggtatctacaaagtatgaatgaccaaactcaatgagtagataggatcatttagtggcaggcagaaactgcagcttttggcaggatccattttgctggtcttggaaactctttcccattgtggcattcttttggaggattatcctcttttggaggattatacaaaagagtagaagtatatagatgttttggaagtgggtttggcaaggaaatcacatctgttgccaaactgtcattaagaataataaaataaaatattgagaaaggtagcaaggtaatggataactgaagggaaagttaaactcctaagtttattttaatcacttaagtctctggcctcccttctacctaaatgttctcatatattgattcaaaataagtgtcaccccctgtttctcttttgctctactcctaacttcaaatgctaatattagtaaactagttcaaaagaccaacagtgaggggaaaagtcttggaaaatttagaattggttgtatatgctttttattggagatcctgactaatatttttctttctaacacacttgatttaactaattttatatagttttttgtgataccaaagacatcagcaggcatagcatgttataaatgtaatcttcctacctactcccattaatgtactgcatataaagcacatcatttaaaaatatttgaagtagccaactgaaaaaagtacatgtatgtgtatacatatataaataaaacctaataactacttagaaaacattttaaatgaactgtgttctccaattaaaacataaaagaagcagctatctctagtgaaaggaaggaaataaaaaaatagagactggttcccatttttttaaccttcaagtggacagaattcttcctacttaaagagggaaaagtttactgcagatcattaattgctttgttcataccctaaaagcattatagggaaaaatcacaccttggtcacactgagtgacagagaaacagttgtcagacttggacatgttttccaatagaagaaaaatccagttaccaactacatatgggttcgttttgggttcctggaactgatagcacatcagcatgtcttctgagactcatgcatggcatgttattacagctgtatatcatcagagcaaaaaaaaaataattggttttcctgggagtatctctaagttgatgtcatattcaataaccctgtagttgaaaaatctatatatgatggatggactctggactgtcttttgaatttaattcctcatgtgccagcttctctaggtcctgttgtacctgtcatttttaggtgagcacatgcagtatttacaaaatgcacccagggaccaggcgcggtggctcatgcctgtaatcccagcactttgagaggccaaggcaggtggatcacctgaggtcaggagtttgagaccagcctggccaacatggcaaaaccccatctctactaaaaatacaaaattagctgggcgtggtggtgtgcacctgtaatcccagccactagagaggctgaggcaggagaatcacttgaacccggcagaaggaggttgcagtgagccgagattgtgccattgcactccagcctgggcaacagagtgagaccctgtctcaaaaaaaaaaaaaaaaaaatgcaaccaggcactatttctgccagataatgaactgctgaagaacagtttgtcttgcatgtacattggcctcattcttcagtcttaaccatgccaccatggagccagtctcacctggcaaccccacactggggtcagtgccaaggtgcagcttgaatcagttctgtgcatcacagcatgagggtggtggcttcccttcctctgaatttgagggcttcaaagacagccttaaacatacaggcatctaagatgggcttccatgcacactgccggcacatcctcatcaagaattcttcctcgtgaaaataagtaagacatctggatccactgaggatgcttcttttgttcatcctggacaaaaggatccatacttggacagggaagcctgaagccgattgtcctggattagcctagcatcagtaccctgcatggccctatttgtcagcattgcaggtctagccttgggagtgactttaggatgtggcctctgctaaggggcttagagtttaatctcagggttcaaagctgctcttgagcctggggatatggcttggtttggaactagatgcaacctggcctccagttggaagtgacatgcccaagctttgaaattcagatttgtaacatgtgagatgcaacttagcgtattcttgaactcagtttcatgtctgacaatcagttaatatatacagttacagaaaggcaaaacccccattagtttgtatgccactaatttgaaatgtatgtaatataatcttgatgaaattaatctcaccttttaccagaaggcaatgctgtttaaattaataagttaataactaaaatattaagttaattacctaataattatttaagagaacagatgaagaaaacagaatttccttacctattagcagagcttctttctctgattttaagccttggcttcttttctcaatattgttctctcggtcttggttgactaatgcaactgtcaacacattgatttcctataaagttaaaagccaaaaaccatatatgggtttatgtagattctgtgcatgtcaataaaaaacaccagatctcttaaactctataaataaggtcatcacttctatttataactaaagatcaaatcttttatacaattgatctatttgcccaagagtagaaaagtaattatgtaaagttaggctcctaggtactgctccccgcataccaagtaattctctgcacaagtggcaaatttggcacaagttatcttagatttttgtccatgttttcattaaactctgttcattaaaactgtgtttgattatagctactttaacatgttttatttcaaagatgaataatctttgggaaagcatacaggaaactgatttataataccatgctaaaaatttctgagtgtgtggagaaatagggcctattggggagctaagatagaattgttagaagtgtttttaaattgagtaggtatggatcctcatgaataaatgcaagaggcagataaagcaaagcttggtaaattcttttttttgaaaactaaaaatgaagagttgtacaacaagccaataacacgtgaaacattgaggctggactatttttagttctttctgtagtcttttacatttaaaaacagagatgaagatttaactcatatcatcctagacttttgatattaggactcaaaatggagagtgatttaatggaaagtcaaattaatgatctgcatagatgacctgcatatatgggatagtagaatcattagggaagttgagtcttactggaggaaagttgctcactgaaagatggctccaaagaaggactagtatatgagcagtggtggggaacctgcagggatgatagagaacaggtacggagagccgaatggacgaagaattcagaaggtttgaacaaatgtgttgacaggtgtccctagaactggaagtggttataggagagatatttagatagttagtacaaagtaacaaaactggtcagatccaagagtacaggaagtattgggagcatgccgagcctgcaaaaagtgaaaaccacacccgaaggcattcaaagaaaaataaacccagcacatgccatcaaaacagatctttgagcttaatttaacttatgagctaccactttgtaatccaggggtaattagaaattgccatgaaagaaggctctactgagaaattgcagttggtaatatctgataagcattttagaggctccacttaaggtcccacttatttgctgaagaccaagtgatgaagactgaatgagaaatgaaaatggataaggtaaagaattgagaaaatcacagtgatgtgatgatatatcacagggaagaacttggttggctagagggtataacaggcctcaggctgatggtaggaaaatcccaataaggacaggagtcagaaagagtttggggagtggtctaagctaagtctggagccagctgtacatcaaaggttactagagatgaaagatgctcttacaaatcaaaaacaggatcttgggagcaagcctcaatggaaacacaatgaagaattttaaaatagaacaaatccaaaggcttattatgtagatgggattagaacatttataaagaggaattgcaggaaaggaaatagaaattcctgctatgataaaataacatttggtactttccgattaggctgattaggcactttctccattggaacagagcaggtctgtgtgtacacatcatctttctagggtagtggggtcaatgggcctgctgaattctgttagttgtatgccctaaggacaaataggtcccacagggacatggcagatggacttccaggcctgggaggttaagattgttgagcagacgcaagctgaagctttgtaaggtctcccaagagaggtgtaggaagaaagtggatggaagaacattaactaggataatgattgcatcattaaaaaaatacaaaaaatgaaccctggagctgagtggaaataatatctccaagagagggtgatctgttcacagcctggatgataattggggccaaatgaaattattcagaatgagtttagcagataacaggcccacattaattgccaagactgagtggtgtcctggggccatcacacagttgaagatccaggttcattgagggaaatggactgtagagggcaggcagatgtcaggagccagcagagaaaggcaagggtggaacagacagaccacctgagaatgctgttttctccccaggtccaaaagtggagtcacatagaaagggggactctgagcaaggttcaaagaaatactgctgcatcaacaatgtctacaaggagccagataagacccagtgactcttgctttggtgatgttttagggttgaaaaaattagtatggagagataagagtcttagggtcaccattctgtggaagtatttcttgagattggatactggagtgtgtgctctgctgaccacaaatggtgtgttctcatgcagtcatggccagtgactggagtggacacatctctctgcatggctcccacaacagtccagcaggccttggcttgatggacacctaaggcttggcagacatctcagcttttggggacatctgtgagttttgtccaggttggagatggagctgtttttctgactcctctaggaggcagaagaactatgctggaagtggtacagtatcattgaagctgatcaggcaggctccaaggaatgcttgcttgcatcttataataaactggcctcaagaatctccaaaagggaaaacatcatttccattagagtcaagggtgtgtccaagcatattaaatagtctatagcatagcattgagtgaagtggaccaacttgtgaccactcaaaagagtcactactgactaagctccagatgctaagcctgccttgggcatggtataagctcaggctcttgctgacaaagtcacagagctaattagatgggtgaatgcttatgtcatccattttgccaaagagaacagttaaagttaatatagctgtgtttcaagggatagaagacaggatagtgattttagacagccacattatatgttgtagttttaccttttccaattattagaaaaggagagttttgttttaatgactcactaatcatgggttccttagaaaaataaggttaatttgatttgtctgtatttatattggtattgttcagttgaacaagataaggacaattatcgataatctccaagtatggggtagtctacaaagtagatataagcaacaactgtaccctctctctttgtttttatttaatgtctagaaatctaagttatcacatttgtcaaaagagctccatcatcatgattggttaaggcgaagggaatacacagagagaatgtggaattaattaattcccaaaccaattccctgttgcacttaagctaagcctgtttttactttcagccaccaaataaatatttctgctacatatatacatcacatgcctactatatgccaagaagttctaagtttttaaggatatggcattcaaactgatcagaagtgcaagcttacccagggaccagcaagcaattcttataaaaggtctaaaagaaagaaatatgagaagatgaagctggagaagtaggtagatcatggtaagaagtgtagattttatctgggaggcttaacaagtgaagagttttcagttctgcattttaggacattggtttggaggcaaatgaaactggagtcagcctactgcaaaaatgtatccatttttgccttttgatgatgacagtcaaaacccatgcagagtgcaaacagcatttaagaggtggaactaaaaaaaaaaatctggtgacctggtggctgatgaaaatattgagaacaagtaggtggctcagtgaataggcaaatggagaaagaagctagtctgggagaagattgtgtgttcagttttggaaatgttcaacttaaggtttctatagcatcttgtcaaaatattttggaggaagtaggattagccaggaagtaggatgtgcacgtttctgaacttagaagcaaggctctgacagctctttttatggggcctttctctggttttgtttgcagcaggaaatcttgatgttttcttgtgggacaaagagcaggcttgcttacacttgatataaaaaaggtagattcctaagctcagtgtttctatcttgtaacacaaaccactgcatgtgctggcatccttctggacccctctacggagatactgaggttataagatccatgagagtagactggtgaagccaaaattcttctgggaacagtctctcagtgggatttcatattctctacacaggacattccaacttatctttttagtaattggggaacacataaggacattgaatcataaattacacatggttttgctcctttcttaaaaagttcatggtccttattactctctccaccccaaatctctagagaatggaaaggaccttatcagaatgggaaagttttatcattagaaacataaagttatgaagaccctttatccttttatcaccttaaaatcctttagcctgatagatgcaacatgcccagaagaatgatgagtctaccagatattccagaaaagaggttccagatgcctagcaattacaaagtagaagtgagtgagtggggatggagtgggaggtgaggaaggttactatgtatgaattgttagtggtatacaaagtacacagcgggacgggaacattaggatggagatcaagagtttcctctcagtgagatctattggattatgaagtagtctcccaaaggaagtgggaagaacacagtaaaagcacaccagactagaaaatgcactgcagctaacaattctgcacttgacatgagattggagattacctaataaatcttttctcagcctaccttttaactctaatttctgtgatacgtagaaggaatcattaaagggctggagaagaggttttcagtaactggaaactagatgtcacagactttttaaaagacttcttaaagagttagctacttgaaggcagaaatttcccttctaagagtcctcatcacttactttgagaaatgatcaaagtaatttatcatttagaggagctctttttcaatagcttattgagctagaatcatgctttgttattttgtttttgtttctctccacctacccaagcccctaaggaccaagaaaatggcttccctgccttataaaatccttctgctactgctttcacttaattattcctgtggcttccttacctttagggctgttttctttctgttgcaaagcttcttgaatacatgttgtccacctgtgtctactgcctcatcatctgaaatctcagctttttcatcagtcactccaacaaatctactctgagatatttccagtgaccctcttcttgccaaatgattattttcccagtcctcttaccatgtgatatttgacacccttgacattggcccctcttaaaccatctgcctcacatctgctacacaggaggtcctggtctttttcctcttaatttcctgtttagtcttcactggcttttttgtttcctctgctggcccagtgaatgtaaagaagaggctactctcttcctcctcttctctagctttggcccttgccaaagtgtgctccccaatttttcttacctgttccctttctttcattctcgtgggttcagctatgatcaatcttaattctttaagcttctgttctttaccaccaactgaccactgggcttgtctgcctgaatttaccaatgcccagttcaaattcagaatgagaggtggccatgaggcagtggaagagacactaaatacttgggtttcagccttggctcttcctccagcagccaggtgaccttggcaaattactcaacatcttcaagacccagatcacttgtctaaaaatgaggggctgggtagggccaatcatctttgaatagtacttgatggaacctcattagctttatagaggtgacatggatggtccaaggggacacatctctggaattctactctttcactcctttcttttgcttaatgatacagggctcctatgtaaagcttcatttaaagaaatgtccttaggccgggtgcagtggctcaagcctgtaatcccagcactttgggagactgaggcaggtggatcacttgaagtcaggaggtcaagaccagcctggccaacatggcgaaaccctgtctctactgaccatacaaaaattagccgagcgtggtagtgcatgtctgtagtcccagctacttgggaggctgagacaggagaattgcttgaacccggaaggtggaggttgcagtgagctgagtttgcaccactgcactccagcctgggcaacagagtgagactctgtctcaaaaaaaaaaaaaaaaaaaaaaaatctgagtccaggtccttcctaatgtaattttctaaaattctataattttatgactaaaacccagttcatctcactcgtcaaactgcatcctcttctaacttttctgtttttattaaagtcagcatcattcttccacttgctggcgctcaaaccctcattttgtctttgattcattctctactatcccctaagtgcttttaagatgtctctaaatccaaattctctcaagtgtctgtgagatgtctctcctgctgcattcccatttccactagtgctctactctcggttctacgtgtttcatactttgttttagggatgcggtctcactatgttgagcaggctggtcttgaactcctggcctgaagcgatcctcttgcctcagcttcccaaagcactgggattacaggcatgagccactgcacctggcagatttcacaccttgaccattttaaccgctgcaggaacctcctactttgtctctgcctctaggctcttcctcttccagtctatcttacataataccaccaggtcaattttctaatatgtgacttttatctcatctatctctggttaaaacttcagatgctttctgataacctacaggaaaaagtcagatgctgctgcttggcattttgggcttactcctatcaaactagcatatcttctttctatgctatgtccagaaatgctcttggaaagctctctcctccttgccttgccacttcctacttacattttacacacagcacaagtcctgtatctcccagaggcatctgtttcaggccacttgcaaggcttccttatctgcacacatttcctacgccacttatatggcagttcatcacttatacatcacatttcacctatttgtttcctccacaaaaccactgccttctttagacagtaatcacatctaagcaagtgaggcagaatggccgaatggaagctgtgttctaaatctgtcacattatttacatactagataactttaggcagggcatttctctaagccttaactttctttaatgaaaaacatggataataccatgtgcctcttccccatggttgctgtgaggaccaaatataagtgagacagcgctttcaaaaactataaatttctaggaatagattgtggcatgattattacaaccattactcacttttatgattcacaggattgattggatatggaacaagtgttaatatatacttggggtactgaatccatgcaacaattctgtataagactttgactacaattatataaaaatatttatgcaaaaataactgtggttgtattcaaaaatagtggatattttctattttctctatttttctgtcagtgttgttgttattatccttataagtaaagaaagaaaaagaaaccaatgatatacagttgttgttttgaagagctataggtaaggacagccagttgctgaatacttaattaagtaacatactgagtgacatcacccacaccctaaatagagaaaccaccgccatgtgacttcccctatgaccctccaagggctggcggcctccatagctgctagtgcaagatgagtgggacagtcgacaagatctatgtggtaaagattctccatgtcaccccggactctgccagcagcataccacaaggctcgttttccttccctgcctgcttgttccatggccttcttgtgctgttggctcagttctgctaattgctcataggccctactcttaaacatcacacttcatgaaatcgggggccctatagataattgtcaagatgtgtatcagctacattcttatcctttactcacattttgcaaagtttcaaaagcaatccatcaaatgatgtgccagttgccaataaccttcaaattattccttatatgattagaactgtggttgggggaggatggagaatggagatatcccttcacactttcctttatgggcacatagcaggtgcccagtggctgataaatgaaagaatgagcctcaaacaatggcctggaatattgaaaacatgatgatttggacatagaagacactggttctatttgccgctggcctgctgtgtttctttgtttcatttttgctgtttgtacaaagacaggattgaagtggatgacctccacagtgtcttcctgctccctgattccatgcctgctctgtgcccttttccctgacttggaccttcccttcagattcaggtagccagcttggtacagaccatataaacttatcctttatttctgatgccagtaagaattagagaggaaagaggaagcagagtgagaaaaacaataaaaaaccaaatggatgaggaaaggattgatgagcatgagtgactaagctttagaattttttatggtttcttatgggaacataagaatgcatccatcccccaatagtgagcaggatcgcaggaatttcctgtggggcagcaatcccaaggccttgctgatctaatcagttgtgaaatcttggcactgcccatcccgagggtcgtgggctctcaccacctctgccctttcccagcagcctttgatggtcaaggtctgtataaggggagcctcagaggcccaatagttttcagcatcagagagataatctgaaagcagatgtgtggggctccaagatgcagtgattcatcatgatgtgaccatattttacattctgagatgttccaccttattggggttcaattgccggatcggaagcacatacattatgtctttagacaactccaagaaccgtgttttctaagatttccaattgcaaagattaaaataggcgagaactagttacggctcacacgaaggaccctttaaagaaagataaaaactcagtgtagtttactgccagagatatccagatacagcatttatcctggtggccttctttctaggtcatctttggttatatttatttaacaaacatctgtacagtacttactatatgcaggaagtgttataagcacttgacaaatataaactcaattgtcataagtgctcttcgaagtcaggctattacattcttaatttacaggttaagaaaatgaagaataatgaggctaatgacttgcccaaggtcacaaaactagtaagaagcagactcaggatctgaaccaatgctgtcttgctccagagtcctaaccactacactaggttgccggttgcgtggatattgagtgcctgtggcgctctgtgaccaaatccctcctgagggctgcctatagtcctagctcactcaggagccagccaggctccaggcaggcctggtgagctgtggttcttgcataaacatgaaaggaaaggggagcagggaggaagccacccacgggctggctgaggagcagcattagcagggactgagggggctggctggctgctgctgtttgcgggtgacggacttctttagtgtgacttttaaccacagtctgcaacagggagggatttcaaaggcagagtgctggggccaatgaagaagaagaggtgggacacatgctctcttgatttgaaggatgtgggtaggggaaggccaaggtcagaggagcactccaaaagactgtggttgggccacatgcaggattggctgggcaggtggagaggctcaggcaaggaggccccaggtgcttctccagccacaccccaaggatgtggcaataaggtggaaccacagaggtgacaggaagagaaagaaaaggtggatagagaagccattcggaaggaatggaaagaagccattctgaaggaagaatggaaagattctatgtgtgaagcagagaggggcgagctaaaatcatttaaacaagtcaggtctacacagctagcagaatattgataccagaatcagagatcacgaagaattagaagtattgcctctaggctgggtgcggtggcttgcacctgtaatcccagcactttgggaggccaaggcaagtggatcacttgatgtcaggagaccagcctgaccaatacgttgaaaccccgtctctactaaaaatataaaaattagccaggcatggcagcatgcgcctgtaatcccagctacttgggaagctgaggcagaactgattgaacccaggaggtggaggttgcagtgagccgagatcacaccactgcactccaacctgggcaacagagtgagactccatctcaaaaaataaataaatacataaataaaaaagtattgtctctaatattttaaaatattggagctgaggtcttagaaaggcagctggaaatagggaagatgagggtgatgagctctcaccacctgtgccctttcccagcagccttccatggtcaaggtctgcacaatggaagcgtcaggagatttttcatggtagtacttcaggctgtgaagggcgtggacttgagtagctatagcagtgtgagttacattttctacatactgaagagaaacagctatttttgagatcaagtgtattttttcatttggttatatctaccgtggcattcaggctgggaatacccctttccagcctcttgcacggtcccagtgcacctgttgtccccacagaagtagcaacagtgctgcctttcaccctcaaagacatctgtttgaattttatgtgatgactgtacctataatctctacagagcaacagtgtcctcagtacctggcacagtgctctgtacacagatgcaacatatatatatatatatatatatatatatatatatatatatatatatatatatatattttttttttttttttttttgagacggagtctcgctctgtcgcccaggctggagtgcagtggcgggatctcggctcactgcaagctccgcctcccgggttcacgccattctcctgcctcagcctcccaagtacctgggactacaggcgcccgccactacgcctgtctaattttttgtatttttagtagagacggggtttcaccgtgttagccgggatggtctcgatctcctgacctcgtgatccgcccgcctcggcctcccaaagtgctgggattacaggcgtgagccaccgcgcccggccgcaacttatatttttaaaagaaaaaatataaatagtagaccctctaatattacatcaaatgaatttgttactacatagacaggccagacctcatgggtgaaaatgactggccatcataagggtttggtcagtaccctgggcctggagtcagctagaagtctatgaggaatatatatgtatggtggatagtgaaaaaaactatgcaatcgctttggacattttacagccttttggtccctaaatacatttattgtagtatcattttaaaataacacaatttctttaatctcgtaggctgaaggaggtaaggaagttaatttttcatttgtatctattatcaatgctttcaatgttttaagtattaacttttaatttttttggagaccaaaccataagcttataaccttttttcctttcttttccaaaatatataaccttttctctttcttttccaaaatataagacatattttctagttgactttcttagtaataacctttgttttctcattacaaataaaaatatgtattcactgtagaaaatatacaaagtaaagattaaaaattaactgaaattctactaccaagatataaatgctattaacattcagatatttgccttttatagtttatatataaccccctcccacatacatataacatatatatgtgtttgcatatacacatacatgtatatattgttgtttaactcttatttgaaaaataggattatgatacatatatagcccccaagtagaatattctacataaagaacagagactttgataggaaaggatcatttcaatttcttaatgtttcccattaaatactaagaggatcactgctgcctggatcataacttaataatgactatcacagttcacaccatgcttaaattgtggtctcaagctggcaatgaaatgactttcttttggtctagttttgtgacagccatgttaaacaaaaatgatctaaaaatgagaaaaaaaaaattcctttgtatccagtaaccccattcattatttaaactgttgtagtattttatttttagttttactatatgccactgtagacataaccaaatgaaaaaatacacttgatctcaaaaatagctgtgtgtttctcttcagtatgtagaaaatgtaacccacactgctatagctactcaagtccacgcccttcacagtctgaaaaagtactaacatgaaaaatctcctcaaccaataaaactagagcagcaaacagaagacattcaagtgaaatactttttaaaaatgtatgtatgtgcatccagaattagtcggtttgatttatcttgtatgatactaactctattgctggtaaagattaattttattatggtgctcctggcatgttattttctcagttcatttctcagtatgacatttcttatttttctctgctacaaagcacccactatcataattttcacctgctgagtttatgttactgatgataatattaaaatttagagggttttttgacctttctagtggtaaattaggtcataaaaatagatgggacacaatctgataaatgagaaagagaaagatttgattattattaaagtaaaatcaaattttacaaggttttcctggcatactgtgagatcttagtaaacattgaatatcttccttctctcacacccccaaattgaattctctctattcaccgctgccttgcatatgccacacatgagaactattccaagaaccaagcgttcctgattgcttctgcatggtgcactggagatcttctgattataaaccaaataatacaaataatagtggtgataataatactaacagcttttattgagtgcttggtagatggcaggtgctggtctcttactatctccattttatagattaaacactgaggcacaagtatgcctcgctgtttaatctgtaaaatggagataataatagtaagtagcttccttaagttcacacacctggaagttagtggcatcatgactgggccccaggcagtgataccccagggcctttagtccatgctgccttctgtctgaatgatctctccggaaactatagcttctccacttggttcaagcccttgatcccaccccaagtctgttccttactgagaagcctgcagtcagtcttgagtgagttcccttttcagttgtgtgccctctcttcattgggcatgtgctcctggaggacagtgactgctctgtgatccaatgtgctcccaacaggcggcattgtgcctgtcatgtggacttggatggaccttgttaggagcggctagttatgggtccactgactttttttgcatattatccaaatcaatgtgatttcttaagaaccagagtctcacaattactaatgatgtattttcttttgggggctgaatggcagcaaaattcaacatttggattaaatgaagtatctgtacacctcagttcagtataatttgattgaatttattgagcctcctcctcttttcatttattgagtacctacaataagggtacattttgtgttaagacaacaagattcaaagatgaataatagtggttcctgctatcaaagaatgtaggagtctatagggcagccagctatgtaaaatgtattaaaatacagtatgatataagccatataaaatatattaaatacagtatgatataagccatgacaaaggaagagccagggtgctggggaagcccagagtggcacctagcctgtcctggggtggagagtttgtggaaaagtatggtccacagactggtaacactggcattatctgggagcttactagaaatgcaaattctcaggccccagcttggacctgcccagtggaaaactctagggtagggcccagcaatctgtgttttaaaaagctatctttgattcgattgcttattaaagttcgagaagcatagcctcagagaacataagactcacaggcacaacaattagacaagaaaacatatatctaattaaaacctgtaaaataagaaagttggatgatgtgatctctaccacctcagttttaactgtcagtccacgagacttttatacacatcttaaagttaactggagtgatgtgtgtttatcttcaagatcacctgcagataatatgcagaaggaagatttgtacttctcacctaaccactccaaacagattcatgagctgactgaggctgctgcacttccatcaatgcaatcatcaatcgatgagtgttactaatgtatctacctgcataggctcattactgtgttaggttctgcaaggaatacatacaaattctccactttaaggaacatgatctgagttggggagataagcctgtcagaagtgggttgttcaagatggttggaatgatgataaattgtaggaatctagagaagatggtgattgatttggactgatcttagggtaaggacctaagaaatgggaattgaggtaggcttaaaaacaggcagaatttgcattgcagacaaaaagggcgataagatagatggagaagctgagttatcaatacaaaatctaattacttagaatttttaatgaatggtgcaccaagctgaatttgacctgctgactcaagccatttattcaggaaatcaggccaacattttttctgaataccaggctgatggttattccattttcaccaaggggactagtttgaatactgtcatataaaatggtcaggaatgatatatatgcttacagctgtgagacttatatgttatgcatatatgtgtgtgtgattgtgcgtgtgtgtagtgaggggacagagaattatactgacacaggtactggggcttgatatagattgtagttgtatactgttcccatagtttcaagtcatcttcctaaaagttggcatggaaagaaattgcctttgcaaattagattctgcaagtctcaaacataagtagctcaccagcgtacactgaacagtctggaaattgtccagacagagaaagccactctgtaatctcacagagaggctgatagaacaatagaaacgacgtgttactgagcatcacggccacaagtctcccctgcaaggacagtttcaagctgggaaagctgagactttgaggtttttcttggaaaaaaaaattaatagatttctgctctattaagtgttccaagcctggcggaatgtcttcaggggaacctagagttttcagagaatggcctccatatacctggcaaggtgctgctgcccagagagggtgacagggaaagacttccctggctctgatgtctgcacagcttagaaatgcactctttctttttattttcttcttcaggaaactcttgctgtctttcgataaaaacataatttaaaactgtaacaaaacatgtgaatgtcttttcctttgggcaacagctttccttccaaattcaacttttgctctgcctgaattaggaacacgtggaggagataaacattgaggtgcagtttgctgaatttctgacttttgtgagaccctaggttagatttaaagccaccagtgtggggttcatagtcttggaggtttgatttaaatgcccagttatagctggctacaaacaggatgtcaggtccccctgggcatggtggcaggtcagtaaggagggaaggtgtagctgcatttggtggccatgaactcacaactggggatagttctcactgttaggccccagcaagggaaggggggatctccatcagagctgggaagagttttgaggttggaaggattaagacacactccagtttgttgtgggaaatttaaacatatttattgccaagtccaatctttgtttcccccaggaagaccaccaaacatgttacttgtagactgacatttgagcttttttgcttccaattcaagagccttattttaggataagcatttcattaagtgtggatatttgtgcaactgcaaacatacctttgatgcaagcagatttcacagctagagttggcaggagagctgcatgatggtgaaaactgctgctctgccgcctgccagggtcaatttagaagggctgacacgcagggcaccacgacacttaggcagctcttcctgttccagtctttcccgcctttcttcccttttttcttcattctatctttgtacctacttttttccttgtcattttcctacatatttcctcaaagaaatgccacatcccagtgagctatgtgtcaatgagatggatgaggttggagatgagcagtgtgtgaagaaatagagaatgactgccctttgcagcactgcagaaccatcctgggagagctggagagtaccaggcaaggaatccttgccaaagaccaatgtcaaagatggagtcagaccagcactggctggtgcatttcacaactctccccttcctggtctcacgtgtggttagcagaaatgaagtggtgcgaaaatcactatggaatatttaataatctaaatcataaaaacaaatgtctaggaagccctatggctcctgagtagcatacagaactaagaggaaggggagttcacctgctggtgcatccttgctcctggctgcttttataccactaatcctggtgccttgtcccctcccctgctgccttcatgaggcactagggtaatctgcttctgtccaccttttgggctcccgactctttccatagatgctactgaatgttcctcctgttccttgttgctcagggtatcaggcagtgctaagccatacctcttgtgaggcaggaataccgtaattgagccctctaggtttatttgactttaaaatgatattgcttgcatgcaagtcatgtctgtatgtttgtatatgcatcccttgttgatggtttggagcttacctggaacttcttggccataagtagaaataaatgcttaattttggggttgggttagaactcattttgttaaactttaaattaatcactcttcttaatctcacatattttctcgagaggatggacaagtctcatttgggtacggatggccattaaccttggtctggggtccatacagagcataggctctagaatccctaggccacaaagaaggttcggacatagagttcacagcacacgacctcaaataatatatctaagtattgttctcctaaattatttatgtagtatataaaatttgcctttctcttcaaaatgcaaatattattgaggctatttcctctcctgttgaggaactcagtctcttctctatgtggtaatatctagccattattatgggctgtttatttcattatttaccaagtaggggcttagctttaattaaaaaaaaatcagtgaatcttcctctgttcctaaattccaatcaagtacaaaagcttccctatttataaattgctttaaatgatagctgaattaaccaatacattgtcaatatccactgcttattatccatgagaacaaaaataagattttaaagtcccacagcagggactgattaaagaaattagagtacatctgtggcatgaaatattaggcagtcattaaaaatcacaaaacaactgataccacagaaaacacaaatgatccttagagtctatcatgaataactatatactaacaaatcggaacacctagaagaaatgcatacattcctggacacatataatctaccaagattgaaccatggagacatagaaaatctgaacataccagtaacaagtaatgagattgaagcagtaataaaaagtctcttacaaagaaaagttcagaacctgatggtttcactgctgaattctaccacatattaaaaaagaagaacaaatagtaatccaattgaaactattaaaaaaaccacaggccaatattcatgataaacatagatgcaaaaaatcctcaacaaaataccagcaaacctaattcagcaacaaattaaaaagaccattcaccatgaccaagtgggattcatcccagagattcaaggatggtttaacatatgcaaataataaagtggtacatcacattaacagaaccaagaatggaaaccatatgatgatttcatagatggtgaaaaagcatttgggaaaattcaacatctcttcatgataaaaactctcaacagaccaggtatagaaggaacatacatcaaaataataatgaccatatatgacaaacacagttaacatcatacaagatagggaaaaacggaatgtttttcctctaatatctggaaaaagatgagaatacccattttaccacttttactcaatactggaagtcctagccagagcaattaggtaagtgaaagaaagagcatccaaattggatggaagaagccaaattagccttgttcacagatgacatgatcttatatttagaaaaccctaatgactcggccaaaaaactggtagaactgatgaattcagtaaagctgcaggatacaaagtcaatgtacagaaatcagtagtatttatatatgccaacagcaaacaatctgaaaaagaaatcaagaaaactcatttacaatagctaaaaaaatgtaaaatgcctaggaataagtttaagtgaagaagtaaaagatctctagacaattatgaaagactgatgaagaaattgaagattacacaaaaaaatggaaagatattccatgcctatggattggaagaagtgatattgttaaaaaggtcaatactacccgaagcaatttacagattcaatgcaatcgctatcaagataccagtgacattcttcatagaaacagaaaaatactatgaagccacagtaaccaaaacagcatgctactagcataaaaacaaacacataagactgttaagagtagagaacctagaaataaatccatgcatttatagccaactgattttcaacaaaggtgtcaaaaacatagattggggaaaggacagtcttttcaataagtggtgctaggaaaacagtatgcagaagaatgaaactagacccctctctctcaccatgtatgaaaatcaagtcaaaatggattaaatacgtaaatgtaagaccagaaagtatgaaactactaggagaaaacattgaggaaatgctccaggacactggtctacgcaaagattttttgaggaaaacctcaaaagcacaggcagcagaagcaaaaatagacaaatggaattacatcaagctaaaaagtatttgcacagaaagggaaacaatcaacaaactgaagagacaacctacagaatgggagaaaatatttgcaaactctccatctgacaagtgattaagaaccgtaatataaggaattaaaacataaggaactcaatagcaaaaagacaaataatctgattaaaaataggcaaaatatctgaacagacatttcttaaaagaggacatacaaatggccaacagttttatggaaaaaaaaagatgaacatcactaattatcagggaaatgcaaatcaaaaccacagtgagatgtcatctcacctcagttaaaatggcttttatcaaaaagacaaaaaataatggatggcagtaaggatttgaagaaaggggaaccctagcacgctgttagtgggaatgcaaattactacagctgttgtagaaaacagtatggagtttcttcagaaaagtaaaaatagagctaccatatgatccagcaatcccattactgggtatatattcaaaagaaagaaaatcaatataccaaagagatgtattgatatattgcagtactattcacaatagtcaaaataaagaatcaacctagtgtccatcgtcagatgaatggataaagaaactgtgatatatatatatacacacaatggaatactatttagccatacagagaatggaatcctgtcatttgcagcaacgtgaatgaaactggaggtgattacgtaaagtgaaataacccagacataggaagttagacaccacgtgttctcactcgtatgcgggagctaaaaaagtggatctcatggagttagagagtagactggttgccagagtccaggcagggttagggttggggatgaagagaggttgattattgggtgcaggaatacacttagataggatagagtgtgatagttcagtaggttgacaagagttaacagtaatctattgtatatttcaacatagctaaaagagaagaatttgagtgttcatagaataaagaaaagtgtttaaggcagatgatatccaattgtcctgatttgatcattatacattatatgaatatatgaaaatatcacaggtacctgaaaatacgtacatctattatgcactgataaaatacattttaaaaacctatttaataacatgggcaaatgctcattattgataaagaaaaatgtaggttgtaaaattgtccatatgatatgctataaatttgataaaaatgtatatacatgcacataaacaaagataatggaaatacaaagaagtggaaactgatttgtgagtggtgagatggcaaatggttatctttttattttttctgcatttctacattttccacaaaaagaaaatggtacttagggataacagtatttatgcatatttatatgtatgtatattggctctataaaagttaccaatctccattcaaaacaattgcttttgcatttatctctggtaggattatcatgaacctttctgggggaggacattctgtctccaaaatgggtaacttttgttcagatcttggttttatctatacaggtatccatgtccatgtcagaccatttcacacagcactgaaatttgtttcctttgcctgattttctctaacctggcctggaggaagaaggtattttcacttctctaaactcaatctgtcagctttattaaacttgctaatcctgttacatgctccaaattcactaatgaccaagcaggtaccaccaactctggccctgataaaaaggacaaacttctagccccagcctccagcagtggaaacatagtcagctggcattgaggtgtctgggaaggaaacttctctgagccttgactggatacaagaacattcaccgtgagccagcttctgtctgtttttgacagcagttccctctctaatccttccttggagctctgtacatgctgggatgggggtgtcctaacaaggtacctttgcaatcattgaccttttcaagggtgctgggttgggacatgtgtggattttttcagttggaactatgggtttcacagtgaattgcagcacatacagttaattcacagcagaaaatgtggtgaaacagctggaagaaggcagctgcataggggcaggggttgtagagggagagcagggttagaggtggggaaggaaacattggcaggagaaaagcaataatgttacagggctataactgggggagaagagcaagttctgggtatgagcatttaatatgtggacagggtaatatattcaatagggtaaaggaaatattagtccacgaaaaatccaacttcttgacttcaggcatctgcagagcaaaggtgacctcagacatctacagatatgggcccatccctctctaaagggaagacaaagtggctcctgattttccagttgagcttttctggaggccgtaaagttctctgtaccactcattgtgccccactcctactagactctcctcccaagcctaccatggagccagtccttccaaaaaaggtctcgtctccagaggattgctggaaaaatacaaataaaattacttcaagctcatcattcccactgtgatactgacctacaggcagagaatgaggcctgatggaatgaaacaggactagcaggttttggtaagtgaaaggcatgaggacatggagtcagctccatgtgggggcagaaatcccatctttattactcatcactgggtctccaaaaccttgcccagtgcccagtgtgtccaaggctgggtaacagtaatgtctaacacatgctgatcacatcagcactgcaaagcaaggctcacagtaccctatgaggtaggtatggttattaccttaattttggaggtgaacaaaatggaagtgcaggggttcagtgtatggcttagggtcactcagattgaaactgggctgcttcatgtccagatctgttcttaacctctacactctgctgcctccctcaatgaatgtttgtgggtgtaccaagtagaaagtgatgtcaggctgtgtggggacacaaatgaggtctctgtacaggtcaagggcagcaaggaggaaggctggaaggagaaacatatggagcaggatgcaagagctgcaacacctttggtcccaagctagtgcttgctgggcttagtcctggtgggtctgggctcattttccttctttttttctttgagacagagtcttgctgtagcccaggctggagtgcagtggtgcgatctcggcttactgctacctctgcctcgtgagtcccagttcaagcaattctcctacctcagcctcccgagtagctgggatttacaggcatgtgccactatgcccagctaatttttgtatttttagtagagacagggtttcaccatcttggccaggctagtcttaaactcctgacctcgtgatccacccacctcggcctcccaaagtgctgggattacaggtgtgagccaccgtgcccggccttattttccttttgatagagctgtgggttggggtgaggaaggtgtgaaaccttatatttgtccctttctgctttgtctgctcctctcccagttcaagatcggggcccctaagaccaagcagcaagttctgggaagaaagaatccagcctgagttgttttttacctttagaagatacggtcccattctttcgtacaggttgtctttttcttttttgccttgtttggtacatcagtatgtattctctctcacgcctccctgcctaaagggtggaagctacattcagaaactgagcagaggactcagcacatgcagaggttccctcacatacatcattaaaatacatggttaatgatagccttctgctgtgctgtactaaacttgaagaatgttctttgcacatatctcttccatacgctcctaacgtctttactctgacagacttaaagacagctctgaggatttactttcttaaggaggtgacgtgaaaaactgaaaagtcttttttcttttgtgtttttgtttcactggtgaatgggaaggtgttctgtttgacagtggcaaccttcagcatcaccaattaaacctctttacaaattgcaaatgatttctttaaccccagtgtgggagtgtgaattgagcaaatagaggaatgtgaggtagcaactttactataacagaaacaaggacaggaggagagaaaattcatggaaagcttttagatcaaattgttttaaacattgctggctgaagctgtcactgcatttcattcctcctacctgatcctacagttctccctcctcatccttcccctccaccagacacacacatgcaaggatcataggtggcgatcctgctgggaagaaggtcatcaaaaaagatgcaagataagaacatgatatatatacatatatatttacaatttaagatgttgatatctgttatacataattaccagggaccaggttattcagcagtcctaggaacgtggagatagctcagagacagagatgaaaagaaaatttataggtttgctttccaggaaagaaaattgggtctgaaacaactgaaatccttaaagaaactggaataaaggttagttttaaatttggttacacttaaatggttgacttgcctatctgtcgttaatatatccagttccaactacaaagagaaaacaaccagcaggcatgagcgtgaactgcacaagtcctcttggagaacaaggcctttgcagttgacgtcagtttctggccctaacagttttaaatctgctttcagaaaacttctcctgggcatgcattcgcagatgatcttgtgataaggggcaagggttgggctttttaagggtgtgtctgttttgagacctcaagcatgctggacaatgtgttggtcagatcctggtggtacacagtagaacgtaaaaacaacagaaaagtaatactaacagaccatgagctagatgagtcttgagactaagacaaatgaggaaatacaagactctacgtatcctttagtggattccttcaggacgactaatagatactataagggtgcagcagctgcaccaacattctgaatgccaggcaattccagaagtttgaagctccctgtcagactccaccacacagctattaatatacagaatcccccagaaacaaatatgagatgcaaccaagatttatggatatgttaattacagatttataatagcaaaaacaggaagttaaatgcctgacacacaggcgtgtggttcaattatttcacatctacattatacagccgttaaaaatcatgtctttgacttggaaccaacccaaatgtccaacaacgatagactggattaagaaaatgtggcacatatacaccatggaatactatgcagccataaaaaatgatgagttcatgtcctttgtagggacatggatgaaattggaaatcatcattctcagtaaactatcacaagaacaaaaaaccaaacactgcatattctcactcatagatgggaattgaacaatgagatcacatggacacaggaaggggaatatcacactctggggactgttgtggggtggggggaggggggagggatagcattgggagatatacctaaggctagatgacgagttagtgggtgcagcgcaccagcatggcacatgtatacatatgtaactaacctgcacaatgtgcacatgtaccctaaaacttaaagtataataaaaaaaaaatcatgtctttgaggaacatttggtgacaagaaaaatatttataataatataatgaaaaatcaaaaaggtacaaaactgaagacaagatgatagtatttatttattcatttatttatgggcttttccctctggtcatatacatgactggaaaaaactaaaataaagcgttaatggtggttatctctgagtaatgagataccaagattttttttccttacccctatattcttttctttctataatttgcaagcttcaaacatacttttgctttttacttttataataaaacatagtggttttaaaaacacaattgtcagctctcacaagaacacccagctaagttggcaccagtccactgtataattgttattaataaatgataatgcatgaaattcctgcccccagatataaataattataatgaaaaataatttatttgtctcagacaatagcctttggtccagaggctttaaaccttgtgttctgccttaaaattcatcctgccaaaagtcctgtctgctatattaaatactttgttatttgttgagacagggtctcgctctgtcacctacgttggagtgcagtggtgtgatctcggctcactgcaacctctgcctcctgggctcaagtgatcctcctgcttcagcctcccaagtagctgggactacaggtgcgccatgttgcccagtctggtcttgaactcctaggctcaagagatccgcccacctcggcctcccaaagtgctgggaatacagacatgaacctccacacccagcctatattaaatactattgatgcatgaagagagaattaatacttgttgagtatgtactctaggcttggtgttaatgtacatggtttcatttaacacacaaatgaggaaggtgaagttcagaaataatttgtctcagtcacatggctactcagtgatcaaaatggattcaaaccctctcagtcgggtctgaaggcctcgtctcttttgaccaccacaaggctggtggcaacttcagatgagacgtagacttcatttcagacatttaagaatagatttgcaaaatattgccagtgctcctaatgtgagggcaaaataattgatgattaattcttttctttcacataccctagtggaggtactggggaaacttccaaaaggagacaaagttcagacagaaaagagggtgagtaagtaatccaccacctgggaaacccctgataaaacaggcagtgattgtaaagattagcccagccctctgcctagggagggaggtggccacccgcagtgactggcaaggactgtcaggttctgttacttcacaaatatctcccccaccccctaggtcaaggtgctgctcttccttcctactgagccagaaccccatctctcaacagtcattgctttgagttgataacaaagcctacgtcatagactctagacaggtatcttaaaaaagctgaaaactttcctgtagaagggacaaagacctcgaagattatctcactttactttttccattgaataataagtgacttttaaaatttttcaaaaagggcctatgggctagatactgtgttaggcctgtctatacatgtatcatctaattcaatcagcagatcaatttataatcaaaacatcttagctagaacctcacaattacaagtacttccacatacattctctcatttgcttctcacaataagccttaaggaaggcaaggtaggagttatccccattttacaaaccaggaaactgaggcctactgccactttgtctggcttattggaacagacagcagcttccctggaagccacagagggactggctgtgtgtggagtggatatgaaggttttggttgagaatgtggcagccttgtgtccctggaagacagggtgctgaagaagggttttagggtaaggatgagggtcatgaatatgagagtggaaagataaactatgtctcacaacattgcctatggggagctctgtatgaatggcttcctcctttggctttctactttctcaatcctattcactccccaaaaccaaacccaagtcccacagatccaggaaacctttcttgattatctagcacaaagaaaccatacgtgtaacaccttaaggttttcccaggccttagctcattacaatattatgacatgcttttgagataggctttgccattctttttacaagtgagaaaaaggaagctcagagaggttaagtaacttgtcaggctgatacatttaataagcagcaaagtctggatttcaaactacatcacatcatagctgcctcaacttcctgtacacttatcatgtcctgtatcttgtcatgtgtttcttaattccttaactcagttgtaagttccccgagggcagacaactagtcttatatttctttgtaacccccatttctgttcccctagaacttagcagagtcctatgagcacacaagtcctcaataaacatcatatgttaaatatctgctgggtaggaacaataatgattaagtgggatttttttgatactctgaatattaggctctctgttgtatataattaaaacaagagtgaacaagaaatatataatttctcctagctctagtgtaatcaggcattcattatcatgtctaattctgtgttcagtgaaaagaactgcttagtaagcattttctttgatgaggataatcaaatacagatatcagagagatttaaaaaagacaaaatcatcaaacatatggagaggcaatgatctacagggtataatattccatctgagactaaagaactttcaaggcaaaaagaacacttgtttactttttgacaattggatattcaaggaacactaagagaggaagtcacggtgtaactgggatcttgtaccatcacacattattctttatcaagaagatggatgcactgtgctactgttctgggtgaggaacagagaaggagtacatttcaagggctattctgagagaaggggttttctctgagaccttttcagcatgtcagtcatttaggtaccaccttcgctggcaggcaaacttaatgaatatacatgcaatgcgcaactgattaccctgtcgggtctcttgctatttccctcccagtatatcatcagttatagttttggaaatacaaagagctcaaacagactcactgaaattagaatttttgatggtggggattagctcacatacttctaaattgacatttgataaactaggctgacaatagcagtgcctgtcaatcacattttcttgccaaacccatatattaatcttaagctgctgacaggcagagcttctgatttcctttatgtggtagataaagtgctacatccccatgtgttcaaccaacgtcaagcaagaagaacaaataccaggtttgtggtacctacatttgaatcctcatggctgtggccattggtctcgaccaattccttggtaccttttaactgcaaattttaaggaaaaacaacacaaaacaaaaaaatgaataagcaagcaaatctcttaagtatatcatcttgttaactgatttatctgaggttgcattttataaaacttccaatgagataaaacagatggagcacatatttctaatgagccttattggagccagtttgagaccaatattttatgaagtttgatgcctggcaaaagaataaatgggtcttggtcattattttttaaataataagattagaaagcagttccataggcataaaatgtataaaattggttcttaagaataataaatgatttcatttcctagttggattgctattaatttaaaccctgcagtgtttgcaagttgccaccagcaaaatgatgttatattaacgattattcgtgaatgatgcattttcagctgcttttaacatgctactgtgctaccagacaggtcctccttgagaatatatttgaatgactgacatctctggaggactaaagacggttgcttctttggtagagaaagagtttggatgacatctccttggccgctgaggcattagaagaaattatatttctctaatgagatttttagcagtgaacatttgaaaacatttctctttctcagaggcttaggagtaatcagttataaggaggtttcaggaaacctttaattgtcattttatcctatcctgacgcaaaacagacatttagaatcagacggcaaaggaagagggtgagctggcttgcaactgttttgccagtattttttcctgacttaggaaagcagcatctcctccattatcttttttatacctaatacaaagtattcatggtaggaaaaaatacttaagatttgaaagaaaatcaatgcacatataccaccaatgtgtttgattcataacattggttccttctggctacttgtgcatattaaaatgaaagcttctttagttttttaaggccagtcttaaactcccagcaaaaaaaagccctacccgctccatgccaaagaaggggttttgccaaaggaatggtaacatgaagaaattgaggatcaggtagttgattatggaccaaaggctctttggctcatttccatatcactcccacttaagaaaaaagtctgcccactgttctctagggcaacatcattgatggttctacacacaacagacacaggggagcatgggcgatgtatggcatatatgacaaggcagaggtgtgccacaataataggaatactgtctattatcacaggacacaaaaggactttttaaaatcccctcactcttttcctagctgagggtttcttattgtaggtatccctcatcttcatcaacctctctgctcatcccaccttaggtcctgtagcttgtgctcccatgagttcgagtggggttagctcagaaggtcttgttctttttcagcagaagtagaggactattttgtgaatgtctgttccacctttacgtgtttaccaacataaatgtgccagttgctctcctctcttttaaataaactccattcttcccattccatgatgtcctctaactctgctctcgctttttctgctcctgtttattctcccctcactccctgtctcctggcattgttcactccgctgtgctccattgccagaaccgtggaggaaacccctccccgctgcagcccacccctctccttcctcgagctgcagctccaggacagctgctgctttgttcttctctctgctccctgttcttctctcctttagctgctactctcccccaggtagggctgaacatcctgtctgatgaaactgaggtttgtgaacaagctccagaggtaggaagctatcctcattgtaaatgagatgaaaggcaggagtcagtggggcctggagggacctagaaaagctgcatcttcgcaaatgggaagactgagagcttaggggttagcgtggccttccctggaggggctggggcctgagggtgggaaaggtctgccctcaggacctatcctttcttgtcaggattcccagcacggggcaatcctgtgaatagcaacattccaaatctgcagagcagggtgtatctttccctgcatgtgtccatttgtttaggccacatctatgtgggcactgaaactgtttacgcatagagttactctacacaaatccaaagaaagcctcaaaggcagtggtcagtggaggtgagaggtgtcatcagtgcacatctgtgtgtgggtacagggacatggaaagaaacctgtaccctgcatggccccttttgcaagaaccaccaaggggtagcaggtgaggggctcttggacaaacagcttggtaatggcaccagcacccaaaaacatttggtgtcaggcttaaagattcttggtatctgtgcttgtaaagagctatcccattgaaattaatattgcagatttaaaattcttccttctcaattgtattttctaggtctttaatgattttagctgtttcgaatcttcttcacgttctcttttttttaaaataatggagagtgaagtgtgatgtttcacccataattgtgtgtgctctgctctttaaaaatgcatgccacaacaagatatatcaatactttcagcaaaactcagaatctatttttatgactagggtttggacttcaaaataaaggatttgagtcatttagagaaaagagaaattcacccctccccactctagtcaaagctatctaaaagaaaaaaaatcggggtgagagagcagaaaacaacaaaagctcagagctatatctggttgatttggagcaaatttggaccaactcagttccactttgctgggagtcttttcataatataacagtggaaagcacagtgatttcaggtctcctcaactgcaggtcattgtgaattcagtcaactagatttttcatttcaatctactatatctgaaatcatacagagtcagcctcagtacaagttactgaatctatattcatcatataaagataattattagttttataaagcattttcttccaaagctataaaggtttataaactaatatctgtacttttctctcacaaatcactcatacctttgggagaaaataactaaaaagatattttctggaccccaaaccattaaaaaaaaatcactcataaagtgacacagagctgactttatattttctcaaatgtcacctttgaagttatgtatacagtgtaaggttatttatacaatataaaacgattatgtgtatgaaaaatttaaaacaatctgcatttgattactcacagagggttggggtaactgtatgcaactttttccttcaaattaccattcatacattgttggcagcaagtgaaggccagaaataggaaggcatttcaagagctctcctggctcctctcatgtagatagtgggcttagatttcactctgctgcctgccgagtgttccatcttaccctgctgtaagacaatactttccaatccacttatcaatgtcaggccacacttttgtatcaaagaaagccagaatgaaatgatcaggtttacaaacttcatataaaaggtctgttgctcaccatggttagataagtaccctgatgcacagggaagatactttttaaatgttgctatgaatcagtccttgttcatgtgtctgcaggagtctcatgggttatgctgaactcattttcctcactgttagacttaagaggaaaccagctgcttactttgaaacatacctcattgccagtattttgaaactttatcgaaatttgattgtcttctggaagaaactttcacacaacactggcaggcttgggcaatctaaacaagtacaggagtgaggatagcgatgctgggaatgaggttataaattccgcatagcaaagctgctaggaagtttgacagggttcagactaattgtactgcagattactttcagtaaatgtttgcacgggtgacgcacaagggaggtatgcaatggggtgtttggactgattcataaatcagagctgtttcattcacttacttgttcctgcaggacttttagtaacgcttgtgtatgggactgctcttcctttgcttgttccaattctgactttttgttgtttaactcctcctggatggttagcaattgctgtgaaattaaaggatatttagcataagtaggattgaaggtcaggtgatttaaaaatatccacaatacccattcaaaattatgagtagaagatgtttacaagtcttgaagcttaattcagacctcagttgaccttgtgtgttttccgcactaagtatcaagggcattgcagttttgacacactttaggttgtttgtgatactgatgcacaaaacttgttttcatatttgtgaaggcatcattatattcctttgagcaaatgcctatttgtaaaactatataggatagtgctaatacattacattcatagatgaaaaaattataatatagtcaacttgtccaacgttgcttcatttcacatattacagtaaagctagctttacagtaactctataaagctactttgccaagtggctgggaccacaaaagatccttttactttctctgttatgatggtgatgttttattagatcagtaggactgaagtccaaactgcaatcaatatatcagctgagaaaactgctgatataaactgtcaaaacatcaagctatggcctacactgctatttttaagcagggccactgtatggatttttgtaagccctgagcttcccttgccctatcaactgtaactcatgtgaaggctttccttgtctgccaaaagcacagcgctgcgcagtgcgaattctttgggacatggtgatatgttaatatatacataggctggagaatacattcaagagctgcaaaaaggccctggaaacagctctgactattcagagcttcttgacaacaaaggactggttcgaaaagacagagtgcatttcttctgctactgtacataacaattgctgtactaatgatctggaaatgttagtggattcctgctatgaagagacctgtctccaatagccaggctacttcttcagggccttgacaagctggctgcagagctgcctggccagttcctaaccatcaaagcctggagaaacactggcactggatttctcaggcttaaacctaccaactggaaggattaaattaaatctccaaatctactggtttggggggattttgcagggtaggaagtactcagaaaaacacactgtgctttccctgggacttgcttgttctgctaactactgtggcactgggtataaatgtaagaacctactttggtcctgtagcataaacagtgatttcttgcaattttctaaaagctcagtgtgtcctatttcaccacctgcccatggaataatcaatcacatgtgaggtaatgtacacattccatatgcgctcacttaacaatttgtgggatttaattgtgcatcattgattaaagtacagaaaccaaggagcccattttgcactttggcacagtgacaagcacctacattgtgtccagaccgtggggaatggctctgttccttcattcacattcctgactggccctagaacagttccaaagggaactggtgccctgacttgggtaatgccgagtgaattttacttcatgagacgatttcaaatccaatccttaaatctcttttgaaaaatgagccaaatgaaagataggaagttgtcttcaaaggtaggtagctcatgtttgcttattgcagcacttgaggtggcaaaaccaaaaataactgatgtccagaagaagggaggtggacattaataatcgtgtatctgtatcatcagacactatgcagccatttaagatgaagttgcacaaatgtcttctaatgacacagaagaagctcaaaaagcactgctcagcaaaaaatacattcaggttacaaaatgtaactttgcagcatattcataggaaaggatctagatgctgtctctgggtgggtgggttcatgtatctttcttttttgcttgtcagttttctggtatatctgtaacacatactgctttagtaatgagaaaaaatcaaatgaatttaagatcggggaagaacaaagagaggaatactacttggacacctctctcagctattaccaatactgtgaataaataagagggagaagtgcattggagtcttcattgcatccgcacacttacaactcttccttctattaaaacacacacacacacacacacaagcatgtgtgtgcatatacacccctttctcttgaccactctttttcttttagcctccctcttatctcatccattcttggattcacactttttaaatgaaatgtcttccctctcatcagtgcttccttttcttcttatgtgtcagtgatgtagtgtctagatttttatttcaatgtgtttttccaaaacatatattgtcattgttttgtgtgtttttttatgtgatattatgtttcttattgtttgctatgttttaaattagcattatgtttttaagatccatccatgttactatttttttgttaatgaatttatttaaaaatctaatagattttccccttttattcccaaaatgtgctatacataaggaaactttgaaattcccttgagattttactgagcttgatttattattattttttattatactttaagttctgggatatatgtgcagaacgtgtaggtttgttacataggtatacacgttactattttatgtatctaatccatgcttctgatggggtatatccaccccattttacccaacccactctcacagtgaaggccattcagattaccccaattcttcccactgtatacaagcctgcaatggaatatgctagtgcaagttcccttatggccctgtgggaggatttccctgggatgcatatccagtggtggaactcttaggtaaaagagtgaatttggcaaagctgctctctgggatggttatgccagtctacctgcctgtcagtggtgtgtaagagctgctgtgctctactgaataataacactaaaagcattgttcggctttctaattgttgccagtttaatagaacaccaagattcttcatctttgaaaaattttgtacttctttgattccctgtgattttaagcatcttatatacttgctagctataggggtttatttataatttttaaaatagtcaagagcagtggttcttaattctgactctccattaacattatctgtgaagattttcaaaaaaatacttatttctgggcctgacacaagaccaattaactcagaatattgagaggtgggacccaggcactgaccatttttaaaacaccttcacaggtaattattctaatgtgtaactggggatgaaaaccactgtatcctgaaatgcttatttaatcttgcttatttaatcttcagtctactataatgtgactttaatccctagtactctactcagactgttctcactacagtcaccagtgccttgctaattgccagctagtattccaggttcttttcttctcactacacgctctctccaggggatcctattcacgcccatggctttaactacacatcacatgtgctggtgctttacaacactgcctttacagcctctgcctctttcttaccacctaccagacccttcacttcctgtgtttacaactgtgcccattagcacacctacccttcccaccccaaccagtctaaacgtctttccctggtaaccagagttaaaaccttgaagtcaacgctggccctttcatcaccttcacaacctctttgccggttccttgaccttttctccatcccatccttgctgtcatagtaaaggctaccatctcctctcctctgggtttttcctgttccccctgccatttacccgacactcctgagagagttgacttcccatgaattaaagtgctcccatgattaaaagtactgttaattctctaacccctatagataaaatctaaaccactaaactcatccttccccagacatgccagctgcttccatgacttatgacaagtttaccactcagaattctgcctggcttattcctactcattctttaagcaccacctcaaatgttgcttttggcccaagatcaactcagatgatgcctttgtaaaactgaaaagagccccatcctctctaggtagagacaatccctcaccaggcatatggttgggcactggctttgaggcttgatttcattcccacttacccctttggcctgctgctcttgtccagggcagaacctacactacgaaatgcggtagccttgggttcttgctccaaaaaaatattctctaatcactgaagcaaagttagttcatctatcttcttgctcccaaagcacttaattcaatataccacatttcatatctgtcttcccaaccagactacattcaccaatattaaggtcaatgattaggttacctctaatatataatagctgctgaatgaataaatgaataaatgaagggataaatgaatgtttgctcttgtttccccacttctatgggattaaaccatgatccaacaacaaacaataaaaaacccaccaaaacaacaaaaacaaaaacaaccccccaaaacacctgaggaatgataaactactaatgtattgttctaaacatatggatacataaaactttttgaggaaaacagcagtttcatttaagacattttgtttcattacctggcagttccagatatcctttttaatctgaaaagaaatatttctcaacaggctaaggaaatccaatcaatgaatttataattacgtaatttattcttcaagtttcaccacaataagaacaaaatcaccattatcagaaaaataaaatcactcctagactgttttctgcattctgcaaagttaatgtgctcttttgttttcaaggtataaactcataaactaatatttatatattcaaaacaatggtgattcaaaactgccactcttcatgtgactagaggtcctataaaaacggaggtagttcacaactagatgatttaagtcagcctttctggtctttttcacttgaaatttatgagtctctataatattctttccagtttgaatttttaagtactaaagtgcctcaattatagaagttcataagcagctagaacttaatcagaagagtctcttggttggattggctgatggcagcgtaattttaacatttgagagtgtggcattaaacagatgcactattacattctttggtggttacaatggagtgtgttccaattagacaattatccatatgccaatcaagtggaaacacttgggcggaccataagcaggtaaataaatgctgtacctgacacatcttgatatttccaggccactgatttaatgggatcatttgtaatgctctttggggatgcagacttcagtatgtaatgggtctttctttctgacaaattcaaagagcattacaaatgttatttggagccctagaataagtgaggtcacatttccatttttacagatgggagaatcatgggcacatagagattaaggtcatgctgtctgggagacacctaccacttgcacagttcaattttcctacctcaacccgtggtttctatcctggcaatcacactgcactgtgaatttggaatggaaatcagaacatgccaaacttaaaaatcctcctagcaacgacttctatctaaacattcatcatttccacttaggagccaggcttgttacagacatgcttttgtgtatacttctgtgagcggtgtgtcaaatttgacgtccctttaagaacaacaaccccttccttgtcttttttcttaaattgtataattttgttaccaaggtgaagtttttatatagttaacagactatgtaagtttggttccatgaaagtcatagatgacagtgcaaataccctatatgaaatacatcagccacatcttgttgtaagctgaaattcacaggattgtgattaattcaggaatctttggcaggatagtgtggggttaggagaacttctgtgggatggaggagtaagtaccctttctaaatttaggttggtggtgggtcaggtaaactaacacaaggtagatagatatagacagtgactgacaccaacacacacacacacacacacacacacatacacacaatttcttttcttcttctgtttcaggatttccccagtgcttggctctttgtttagttctaaaacaatctgctaatatttattcattcattcctttagtcaacactgagctcctgctgtgtgcatggtactgggctgggcaatgtgaaagatacagaggaaacaacagtaaatagcctctcctctagatgctgggtcacaaaaattcttacatgtacatgataactaagtcaggacaatacaaaggactcttacaatggctataactagtatggtttccataggaatccaggagatttctggggatcagtttaggggtcaggagaatgagctcaggggatccatcttgaatcataacttgttccacttattggaaatgagccactgaatattcacgataatctgggaatatttgaacccacagaatgttatcaatttaaattcaatgtgttttttactcttttggttcagttttaataactgttgttccatctctgtaactttgctataaatcagatgtcctactcagtgggataatcctttaaggctagcagagtatcacctaaggaaatgagccccagaggtttccaaagggaattctcaccaaaggcgatggtgggtgtgactgcgtctgatggtctcatcccagcagtccttttaacatttgctctacgtggcaatacccatgagtgtcccgccccatcctgcctctgtaaccctgttgccaacctgatttttcccagtattttggcctgcaatctgaactccacctgtgaccagctctgccagatccctgtcctactgtagagcttgagatggaagtatacaccccttaatcccctttctcttggtgggatcctgttacatcccaccgccccacagcttactgtgtcttcaggtctccccaggactctccagaccatccactgctccatcaagttttggttctcactgacttcagaactctttaggaatgtcagccttaggtcccgctgatgaggtctacctatgcttgttttccatctgacactgaatcctgagctaatccctgattgttagagaaagtttgagatttaaaaattcaagtgaacattatcacaacctaagagcaaggctttgcctaaaggcaaacacatctaacaggatttctgacaaaggagagagcctgtctctggggaaggacaatcatttgccacctggtatctacaatgctcacttttctccttggggaaaaaaagaattgaactagcttgaattttcttgttacatgggcttgtaagactactcaagatctattctagtttaaaacgtcatctgcttccacctggggatgaaactgcactcaatttacactaaggcatgagggtatccaagcctatggccagtgtattaaccctggtgcccccctccctgcctcaggcatggtgacccctgggggagaaacatctcttggagagaactccaccattcagacgactgataacaggaatcctggatcatggaaatgaaattgtgttcacagcctaatatgctattacactaggctatacatatttaattccttgggtctttcctcataaatcaattcctctaggcctttaatctcgtcaatatcttttctgatattgaattttaaatgccattctcattgctaggcagaaggcaatctctcattcatgatgagatcaggcttcatttatagctgagagatggtgggagcatggccctgttccctgaccctgctgttaagatcctaatgtcagctagaccgcacagccgaggtgcaggcctgcctgggttgatctctgagaggtcaagataatgaaccctggggtcatgcctatcattactctgggagcctgggacagctatggagaggagtgagaaagctcaagtaagtgtttccaagggtctggcttctcatgggggtgcctgaggcatgaaggaccctgctgcaccctgacctggcaaggatccctgtggaccgagtaaggcatgagctgaaggatgcacactgtgtgcgtacatctgagcaatgtctcccagcgcaggggtgaagggagggcacaggctgtgtgttcgctaggggaaaagagggcatggaggaactccagagaacaaggacttagagctgaaaatgtttccaggttccctagggctggcctggaatgcagtgggatttcctctgctgcagagaaaaggaaaaaaatccaagaatctttgagccatgaaaaatctccaaagggaggagtgagtttttttaggacctcaggaggcacagagaggttgagaaaacacaggaagccatctgagatacagatttgagggcctaagtctgcagcaagtggcggggcaccaaggacggggcctgggctacctgccttggtgtaggagttaagcaggtacaattgtacaaaatgtaaaaacaataataaaactaaaggtgtatccatctatcatcactatgcaccagcaattctaagcaaaatcattgataaaactctccttcctcataacaatcttttgctgatctaaattctaattgttgccattactgttaagatttaataatatgtatgtaatcttcaaattagcatattctgttgcttaccctttaacaaacattttatgtggcaactgatttggaaaatttctagctttatacagtctgccccagctctctctcacacatgacttagctgcacacatttgttctgatttgagcttgctttggatacagtgtctccagcctcctgtagcactacatatattctgcatttctatactagattcaaaataaacaatgacagcacagttttgcaaagacgatgaactagaacttgagctacttccattcatcccacaggaccactctgagaatttttatgtttaaaatttaaaacaatgaaacatttttagttggcaagtgaaaattttagttcatatgtgaaatatgtttacgtttcagtatttttaaaattgaaaattttctttatagattgcttgctttaaaactaaaagacaaatcaagaaaatgttacatcagagacacaatacttgcctaaattgtgccctttgcatttggttttattaatacttatgatttactggacaattatttatatacagcaatatgttaactataatcaagaatcaaagttctaactgttaggtaaagtaaagaaaactattgaatagatagttgcaattttttccttttatcacactatttaattttcttactggcataaatatacatgaagttcaaaagaaaaaaattttagtctgcatttctttcttggccattattattcattccattttatgataattaatgaaaataatgttgtctaaatttagaggaggaaatatttaaaaaaggatcctctgagtgttaaatttcactaggtgcacaattatcaggcagccagtgcctgagacggggagagtcatgaccttggcctgttgggctaggggctggggagaactgtttcatcagacaagattttagagaccatttcctttgcttgaatgtacccctgggagggactggtgtgaaagacagatgcttcgtggcattcccataatccactggagttattaatcatgatatactatatcccaatatggcaacattattctgaaaagaaatatagtcaaggactggcaaaaaggcaaaaatgaagctgcatgtcggcatttcaaaggctagcgtgattagctccattatcagcttgctgtgcaagcttgaacaagctactgctctggtctcctcttttccccaagccttctatccttacaactgccaaatgaggaattattgatcattcacaaagcaagatatcaatgaatttcttgactacagaacacagtaaaggtagatgtaaaagtggtttggaaggctctaaaatctattttctcttctacagatgattttcttaacactgtaatttgcagggtcatctcaggttcccgtttttcactttcttcacatgttaaataaatataagaatacttaccagtgggatattgtatgactaaagaacatgtgttaagtatgtgatgctccttgaatgacaaaaggtgcccgctgagttaaatgaaagtgctgtcattatcctctttgcaaaaatggaaacactaagtcccacgaggtgaagtgacatttaagtcatatgagtgggcagtactggggattaatattcagagagaaaggtcggttgttcagccccagcctagccatgctgggtgcactccttcagcccatgctgaaaacataggccagccaacttgaattaacaccattcatgcaattcacaagagaaggtgtcaaataccttgctgaagtaggaacatgtatcagtgacattctctcccttgcctttgctggcagttcttctgcaaatggtaatccaatttgcttggatttatttattcttatcagttttgttttttgcaattatgtgaggtggtcatcacccatcctctgggcacgtgtacagttgttaatgtagaaatttaaaatattaacatgctttccagccaggttggcccatttacttcaatcaaataagaacttgatggaacagctgggtcttgcactatgccctgaaggcctacagaaatttgttctttctttacagattttataacctagtcatgatcagagattacagctagaaaaacccctatgggtgacttgtagccaaagacctgtggccctctttggaggtaccttttgcaagcgatctgggcctcattcagtttaaccactggagaaccaaacaataacttgttttagcatcattaacaacagatattaccatcatcactagtctctttggttgcaggtttaggaaagaagcttttgccttaatcattatggaataagaatgtgttggagtccagagagcttttagttgaatcttaatggtgagagttgcaatgatctagcctgttttgcagatcagtgaagagagaaaatacagctgaaggtctgatccatcagccatagatgtctgactaaggatggaaaactttattatggatttagaaggtctgtatcacctatattacttaactcctgataattgtagaactttagtgaagttaatccaatgattacaatattcccaatttttctttgttaatacaagtaaacatttttacaactaggagaatcacacatttaggagcagggtaaagagagaagaatagctctgaacttagcacatttaatctttaggtggctctggaacaagatatgtaaataaatgggcacattcatcaatcactaagggaagtgagagggagaggaagtttgctccttcccccaaagtttccaagttatttaaacacatttaggctggtctggaacccaacattttaggaatgtcagagtaactagaacctttggaggtctccaagtttcacctatgccctaatccagggtcaagccctggataaactggtgagggctgcattagacaggaacagtttccccataggctttcaaccacctatagcaactactgaacctctgaactatctcagatttgccctgtctttgaacttcagactctctgtaaggaaaaataataataatagcagcagcagcagcagaaaacctcaacaaatactgccattgtgaaatgtgccacatattcttaatacctgctgctgaaatctatctggcaaaatacaatacagcaccaccatcttgcatagactccaaagtgtagaaaattatcatcttaaaccaatctcctctgcttcagaaacattaaatatagaaagcattaaagaagtgagccgagttagaccttttgcaataaatggtgtcagcatggccatgaatgataacagcaaaaaaggcctccaagatatgaaaattaagagaaattagagccccagcttcacacttattattaatatccacatgcctgtgatgaagtgctcctctagctttagcagtccccctactctcagttggcaattgcatacattttaacattgcatgtgatgtttacccgtgaaaatttccaatcacaagttttgctgaagtcatctgaaagtccagctgctcacagtgatggcacaaaaaagatgatcatttgtgatatatgggtatttaagttttcactgtagaaatacgggagggataacaccaaggttagtgttgatgacttttcaaaagggaagaatagggagaccacgtttttagggtctgctggtagactttatgtagcaatctttttctgcttccagggacaatttgaaaatgtaaatcatgatacaaagcaagtgacataaatcagttgcattctagtccaagtgattatatgaggattgaaagagattatatcgggattaatctgggaaggttaaaaaaatcacattttgtcactgaggttgctggggataacctttaacaggataagaaagttcctttctattccaagttgttaaaaccttcatttttcttggttgttttagtttaaaatcatgaatggatatttggtggccatcaaaatgtttgtattattctggttttgcctgttaatgagatctattacattgatagatttttcaaatgttgaacttaccttgcattcctagaataaatccaatttggtgatttataaaataccagattaattttgcttttctaaaggaattataaatctttgtttataactgagcctggcctataattttttgattttaacttttaactgtccttgttttatttcagtattaagtatactagccttacgaattagttggaaagtgtgtcttccttttgtgttctctgaatgagttagttaaagattggtattcttttttctttttttttttttgagacagggtcttgctctgttgcccaggctggaatgcagtggctcgactgcagcctcgacctcctaggctcaatgatcctcctgagtagctggaactaccggcatgtgccaccatgcctggctaatttttaaattttttatagagacagagttttgccattctacccaggctggtctcaaactcctgggctcaagggatctgcctgccttagcttcccaaagcgctgggattacaggcatgagccaccacacccacccttggtattatttttcttaaatgtttggtagaacttgcctataaagcaattttgggtctgttgctttgatataaaattttaagctattggccaggcgcggtggcttatgcctgtaatcccagcactttgggaggctgaggcgggtagatcacgaggtcaggagtttgagaccagtctggccaatatggtgacatgccatctctactaaaaaaatacaaaattagctgggcatgcacctgtagtcccagctgctcgggagctgaggcaggagaatcgcttgaacccagaaggcagaggttgcagtgagccgagatcacgccactgcattccagcctgggtgacagagcgagactcggtctcaagaaaagaaaaaaaaaaatttaagctattaattcgagctttcaatttctttccaattcagttttgattagttattttttcctattgaaatttgtctgtatctccaaagttaaaaaattgtcataaaactattcctaatattcttatatttctttagtctctgttgcatctatagttataccttatttttaatactgtttttaggttgttctctttttttcttgatacatgttgccaaagattttccattttattcatcttttcaaacatttggctgtgttgatcttctctattgtatggttggttgctattttagttatttttattctttgtattatcccctctactttgtgtttattattttttgtttgtttatttgagacaggatctcactctgttacccaggctggagaatacagcggtgtaatcatggctcactacagctttgacctcccaggctcaagggaattatcccacctcagcttcccagttatctgggaccacaggcacgtgctactatgcctagctaattaattttttttttttttgtacagatggggtctcagtatgttgaccaggctggtctcaaactcctgggctcaagcatatcctcccgccttggcctcccaaagtgttaaaattacaagtgttagcaactgtacctggcctatttttttttcaatagaaattggatgcttacctcactgttactagttttttttcctaaaacaaagttttaaatttttcctttaagttctgctttagctgcgtcccacaagttttgatatattatgttttaattatcaattacttctaagtatttttaagttaattctgatttctttttgaagctgtaaaaatgatgtatgttttaaactttccagatatacaaaatttattttagttatttttggcactgatttctaacaatttagtgtggtcaaaaaaatacaataccactcttttgacatctgttgagatttgctttaaggcctagtatgggattaatttttgtaaatgttcccagtatatttgaaaagtatgattttctttatatgtcctacatattgagcttatagtagtatatatttacaatgttatggacttcacagttaggcctttacaaaaacttcctgaaagtgaagttaagtggcactgaagataagaaatacaaaccgttaggaaagaaatataaacaccagagagaagaggacaaggtgcacggagaatgagagaacaaaatcatggcataccaccctatgtttaaatgactgaaaaatgtgtaacacactgactcagcaaatgactcagtataaaatgtaaatcatgggtggaaatatacatatcttaataccatgaatgagaattccaaagctggccaacgaaagccactctgactgaatctgagtgatacctggtttaaaataaattaagatggtaatggtggtggagggcataaaaaatagaatgcagttgtctggtgggtcagcaggatgaattaagagaacaaaaggaagaagaaaatatgataatttatttttatctctttgaaaagtcactgtgttggtctttcatttataagcgctacttattacactcttccttggaaacttactgacaaagttcaaatatactttcttctttattttcttccccagtaaataaggctgttgtggctatttgttaaaggtgtgtgtgtgtgtgtgtgtgtgtgtgtgtgtgtgtgtgtgtaagagagagaggggagataggaatagagacagagacacagagaagaaacagaaagcgcaaaaactggaaactggagaggtaatgagaggcaattataaaagaggagatagaaatatgtagagaaggagagtcagagacacagagagaagaaacagaaagtacaaaaaccagacagtaattaccagatggaagaagctgcacatagataagaacttgaccatgcagggtgtattcactgatcaattgagtgagatgggtggtctgtaaagtgaggaccagattgggcactaacttgtttaagtttcccttgatgactattcagggtgctttgttaaacagaggagaaaacatagtctttaactaaccatctaacatcttggaactgaattcccaattccacactttggttacaattccagacactttaactgactaagtttggctgttctattggccagtatttaaaaatgattaacactctatgtttatatatatatggagaaaaagactgaaaggctatatgtaaatgttagcaatagttatatctaggtagtgacattatgaatgatttttatttccttttatatggttcttttatgtttccaagttttgtgcattgagcataaattcttttgtaaaatgaaaaaataaaacaaaaatttaaatgacaaaccgagacccaggaaaactgctactcccacctatatttctcttcctctgtgctttctcttagtcatataagaaggattttttttgccgaggcaggcagatcacctgaggtcaggagttcgagaccagcctggccaacatggtgaaaccctgtctctactaaaaatacaaaaattagctaggcatggtggcaggcacctgtaatcctagcactcaggaggctgaggcaggagaatagaatagcttggacctggtaggcagaggctgcactgagccgagattgcgccactgcactccagcctgggtgacaagagtgagactctgtctcaaaaaaaaaaaaaaaaaaaaaagaggaattcccccctcttcttctttcttctttgttccaatgctgtatttctttgtccccccatcaaatttctccctgcattttcttcactgctttcatttctgatgagaaggaaattggctggtcttcctaatcctgttgcctctcctagccagctgcatagaggaaagccctggagcatgaagacccccaactgcggccggagttgaaatgggtaattacatcagtctggctgggagcaggacacctgctatagacagccaaccatgttgctggcagggttcagggcttcagtgtgaatgagtcggcttcttggcattggtagactagaaagaaatgaagtcaaagccagaccacaaggaatcattttagtgtccatagctggagggagaaagatgacaatggtcagcgtggtaggccagtatatgtctgcagcaaaagtccgctttgatgtattacatttaagaaaagatccatttcactataaatctcgtactcatcatgtgatatagactgtaagtcaggaggcagtttccaaaagaggcagtgaaagggaaggtcattcaaaggtcatttaaagactgccaggaacacagcgttgggaaaaggagagttcctttatcctgggaatggaagtctactggagagtcaggatttcccattgcagacatcagggaaagcagcaaaaagcagaagtcaaatgattttaatagtctgcagggcaatgccattatttttgcccctggctcctacattgatttgtctgctagcctcattattttgagaaggaatgattactaatgaggatgcatttgatgatcaaattaattaatggcagagcaggataactaatgatgagatgaagcctctcatagttaaattttattagggcttctcttccccttcccagaagtgaattcagagatttattttcatgattcaaatttaataaaagctgcatctatgttactttcctttcgcaggttcttgctctgctaatgcaaagaccaaattaggggctatgacacagagtcagaaaataggcaatgggtttttgccagtaatattttagcaatctatctccaagcatatgaaggagggaacttcttgtcttctgctgtcttgatgactgcagttctgaagcactgctttcagggtacactctggaaagccatggtgtggggttatagagggaacacaggggctcagacaggcctaggctgcagttctgactctacatggtgtacctgtgccctgggtcagtcacctgacacctctaggtctcagtttcctacttgacacactgggacagtcacatacccctgagttgttgtgaggaccgcataaaataacatgaaggtgcttttgtgagttaactggagagactggccttcctgttgtaaggggcattggagtaaacagcacaggccaccctgtgtcaggaaattatgacctagacttgtcccgactaactctgtgagcctgagtcttcttttaagcctcaacatcttttcatattttcacctggaatatggcaatgacagttcacacttgtgagtagcttttcaaaatgtcctcacgtacatgatcacatgtgatgtatgattttatcgtagcaagcccttactgaggttggaggcacctggtctccaggagaagaactggaggtccagacatcctgagtttcccaaagaagtacagaaaacaaacagtgaagctgaagtcacattttccttctactagttcagtgttttcatttcattattcatgcccttaggtggcatcagtacggcttatcttcttcctcatcttatgacctctggtcagtgaagacggcaagatactcagtgggccatcctcactcaaaactgctaaaaaacatataaggaggcttcctctcatcttcatttttagtctttgtatcttgtccagaatcaaaaggaaaagtgctctgaaaagtcccaaacctcttacagatgtcatgtgtgatcctttcaaacaggtagggctttgtaatgtaaagccctgggccgagaattggagaattggtttctatttctggttccaaatggagccaaccgttccttcaagagtctcacactgaagtgagatacttaccttcttaggatgtaccaggagtgtaatctgcaaatgtcagaaaatgcacacactgccagcaggaaccctacaaatgaccttgaacagcctaaagaaaggtgccaaggaattatgaggattatcatcttgtggcctgttattataatgcaccatcccaatattcttggccgaggaatggataaaaaatgaaattacaaaccctggaatagttaaaggaagaccatggtggaccccaaatttggcaactcttgtgaaccttgatgtttaagtcactaaacctttttaaagccgtgtaatctgagagatgtacatgttttaagatttttctgattctagtaaaatgtcggtggcttttaatatgaatgtgggaaatgtcttctgcatttcccacagccatattctattctatcctattcagaaagaaagaaacttaatctgggttgtcgaagaatcagataaacatggggtatgtctttgcagccacagcttgtaaagactccaggtttttatatgtgtatgtctatttatacatacacatatttattttttgagctttttaaagctgaatatttgactacttgtacatgagagtctaagagaaaactcctttctctacactgttaataagattttcttgccctgtccagtgatactgaattattttctgcactaatgtataatctgtcatatattaaagatattaggatatcattcttcctgaatgagccaataaccagatcattgtgtatgggctattccttccttctaattgaacatttttgaggctcatgaactctacttagaaggtagatcctcctgatacattgcaacttaatttccaaactttctatctttagtttttttttacattctacatctaagtatttacatctttcataatggctcttaaaattagtaaagtttcaggatacaataactgtgtacaaaaatcagtagcacttctattcaccaacaacatccaggctgagagtgaaatcaagaatacaaccctacttacaatagccacgaagaagataaaatacctaggaatacagctaaccaaggaggcgaaagatctctacaaggagaactatgaaacactgctaaaacaaatcagagacaacacaaataaatggaaaaacacttcatgctcatgggttggaagaatcaatgtcataacaatgttcatactgccaaaggaatttacagattcaccactattcctatcaaattactaatgtcattctttacagaattaaggaaaactattataaaattcatatggaaccaaaaagagccccaaacaaccaaagcaactctaagccaaaagaacaaagccagaagcatcacactacctgacttcaaactatatactaaaaaaccacagcaaccaaaacagcatggtactggtacaaaaacagacacctagaccaatggaatacaacagaaaactgagaaacaaagatacacacttaacaaccatctaatatttgacaggactgacaaaaacaagcaatggggaaaggactctctgttcaataaatggttataggataactgactagccttagacagaagattgaagctggactcctaacctttcactgtctacaaaaattattaactcaaaaccggtcaaagatttaaatgcaagacctcaaactataaaaatcctagaagccaatctggaaattctcttctcgactttggcattggcaaagattttttggctgagtccccaaaagcaattgtaacaaaaccaaaaatagacaagtgggacctaattaaactaaagagcttctgcaaagaaaaagaaactatcaacagagtaaacagacaacctacacagagtgggagaagatattcacaaactatgcagctgacaaaggcctaatacccacaatctctagggaacttaaatcaacaagcaaaagccaaataaccccattaaaaaatggacaaggcacatgaacagatacttctcaaaagaagacacacaaatggtcaacaaacatatgaaaaaatgctcagcatcactaatcatcagagaaatacaaagcaaaaccacgaagagataccatctcacaccagtcagaatggttatcattaaaaaagtcaaaaacaacagatgctggtgaggatatggagaaaagggaacacttatacactgttggtaggaatataaattagtaaagccactgtggaaagcagtctggagatttctcaaagaacttaaaacagagctatcattcgacccagcaaggccattactgcgtgtatacgtaaaggcaaagaaatcattctaccaaaaagacacatgcactcacatgttcattgctatgctattcacaataggaaagacacagaagcaacctaggtgcccataaatgataaatttgataaggaagatgggatatacatatatatatatatatacacacacacataccacagaatacaactacaaccataaaaaagaatgaaatcatgtcctttgcagtaacagggatgtagttggaggccttaatcctaaacaagttaacatagtaacaggaaaccaaatactgcatcttctcaattataagtgggagctaaacactgagtacacatggacataaatatgggagcgacagacactgtgggctgctataggggagagagggagaagggcacggctgctggatactatgctcactacccaggtgatgggatctgtacgctaaacctcagcatcacgcaatattcccatgtaacaaatctgcacatgtaccctctgtatctaaaatagaagttgaggctgggtgcagcggctcccgcctgtaattccagtactttgggaggttgaggcgggcagatcacttgagatcgggagttcaagaccagcctggccaacatggtgaaaccccgtctctacaaaaaatacaaaaattaaccaggcgcagtgacacacgcctgtagtcccagctactcaggaggctgagacaagagaatcacctgaacctgggaggtggaggttgcagtgagctgagatcacaccactgtactccagcctgggcaacagagtgagactccatctcaaaaaaataaaaataaaagttgaaaaaaatttttaaaagctcttagaatacaatttatcattaccaaatgttgaatttttcttttaaaggggtttctctttttccatttttcttgtccttctatgcttgtgcattttcctttgaaagcggtttttaactggagaggaagaactgtttgttcttctgcatccctcactacttctgcacatccttcccatccctgtgtctggaacggactctactgttctgtgtcctgcacatgcatgggggcttaggcgtgccctgctctggaccattagtcctgccaccttctcttctagaacagggaaacagaaatagtgtggagagcaagttcactatctatctttgttccatatttcaacctcttcatgtcaccttttcctatttgtcttcctttctcactttcagaaactattttactttgtgcatctgcctcttcttgctgattcagctatcttcactccaaagtgtgccaccttaagttcccttgtccttcctcctagacattcatgaacctgcttgctgttcctcctttctctatatgtttccgggcagccagaacaatttgcaatactctccatgcttcccactgcaccacttccccctgccccaccccagccacatggtaaccaagaattcattcaaagactgggttaaaggtaaaggcccccgaaacaggctcctgttcaagatgtcagaggcaatgtatgtgtttgtattttcttcctccagagactcaattaaaatatctgtcaatgaataaacttacaaaaacaaggagaaaggaaagtgagttccaggagttcctagtgtatgacaggttctggcattcaagggatccccacatctccttaaaatgaagcctgcctgtcaaagagctcttggctggccactgcccaggagaaagactcggccacgcagcagatccagacacagcaatgagcaaagccacagagcttcacagaaaagcaaaccaagccctccacacctaaatatacacagactgccagccatcaccttgctcatgaagaaacctgtacataaaagagagagactgaaacacaatagctaaacaactaatcctggagtaaagagagatgattcaggaaccacaaagatcttaaaaatcctacttagtattcttaaaaagatttgagaagatactgcacccataaaatacgaataagattgcatgagaagataatgattagaggacaaaataacctcttgaaaataaaataatatgattaccaagcagaaacttcaattggaaggatcaaagataaagttaaaatggaagatactaggaaaaagatgatgggcatggagcgcccacctattaggtccattatctgactggtgggtatttcagatagaaattaaaaacagaagacaaaagtgaaaaatgatcaagaaaaaggaaagcctcctgtcacaaactctggtgacactctgtgctcctgcctgcagccctgcatttgctcagttctctggagcactaccttctgaagttggctgggagcatctggtctgctgcacttttgaggctttccacaatttttaagggacaaggtttaaaaaaaaaaaccctataaaatattagtgaatatgctcattttatctctttccctaaagctttctaatcattaaaagcaccaataatgctaccacagcctccttcaccaccatagccaccaacacagccatagccaccgttgccactatggccccttcaccaccatagtcatcatcctcaccataactacccttcatcaccacagccaacattaccatcacagtcaccatttctaccccagtcaccatcttcatcacagccacctttaacaccatcctcaccatggccatcaccacaaccacagccactagccccaacatggccaccttctccaccaaagtcaccatccttgccacagctgcctccatcaccacaaccaacattagcatcagagtcaccatccccaccacagccaccttcaccatcacagccaccaacacaaccacagccaccatcctcaccatggctgccttcattaccacagccactacagccattttcactaccatagccaccattctcaccacagccagcaacacaactgaggttaccacccccctcacagatgccttcatcactacagttgacattaccattagtcaccatcctctcactacagtcaccgtcactaccacagtcaccacagctacctttaccaccatagctaataaggccaccacagccagcacccccaccacggccatcttcaccaccatagttaccttcacaagcacagttaccttctccaccacagctaccttcatcaccacccccaccatagtcaccaaaacaaccacagctaccatcctcaccacaatcaccctcacctccagagccaatatcactactgcagtcacctttaccaccatggcaaccatcacctccacagtcccttcatctccagagccaccatcaccaccacccctaacattattatgatcttgattttgacatataacatcagacttaattacatgtgagttttggggaggaattgagtgcaagcttttctctttctctaaaaaaaacgtacttactaagcaactaaatagtttaaacaagattgcagaagacatgctgaacttacccaaggggtcagatgtaatcactatgtttaatttcaaaaatactttcatttattccttagcagatattccaaagtctgactcttacccaacatctgacaaaactaactggggttactttgtattttaggaaagtagtaatgttatatttcttcatcttccataaaattagtctaagtgggtgagattttaacaatgcatacacagaaaatcacacatatgttctactttgagtataaagaaaaaaatgcttgtcacttaatttctaaaatgcttttgatcataatcatcctacttttcccattttttttttcctgatcttcccttgctgaaagttgtcaagacagtggaccaggcctgcaccttactaatgtcaagctaagagtgtgagagagactgctccacatgggccactggcttgctggcctaagacagctggtcttcagactagatttaacactgttcaaaagcatcggcttatttaggaaggagccctttgacataatcatcattagtcatacgcacttttatgatcagcagtttttaatggtatcctgcagttatccaaatatttattagtcctgtcaatatgatttacacaaggcttcaaaaagaattctgatttttaagcggattattaaaaaattatgacatgttgacctatcctcatgaatgaaaataaaaatactgcaaatttgtgtgtaaataaaaccataatgagatatcactataaatttactacagtagtgaaaaaagacaaactgaccatgccagtgctgcctgatgaggatgcagaactggagtttgcagacagtcccgagggaatgcatgatggtacagacgcttgggaaaagagtttggcggtttctctgaaagtaaaacacacttgccatatgacccaacaatcacattcctaggatttactcaagtaaaatgaaaaattatgtctacacaaaaagcctgtaagtgaatgtttatagcagatttattcccatttgtcctaaactggaaactatccatccactaactattgactagacaaacaaaccacagctctttcttacggtggaatactgctcagcatcagaaggaatgaatgcctgatacgtacagcatcatggatcagtcttagattcattatgctaaagaaagaagcccaactcaacaggttgcctactgttcaattccccttatatgatattctggaaaaataaaagctataagggtagaaaacagagcagtggttgctgggagtggggctgactcaaaaggggcaagaggcagcgagtgctggaactgatttatatattgattgtggtagtggtggttacgtgactgtatgcatttgtcaaacttcatagaaggtatgtctaaaaagaatatatttcattgtatgtaaattttacctcaataaacctaacgaaagaattcagtgtggtaacctgaagaaaaataagagtttaaaatatgtatagtctttacttgtacacctaaaagtacaaatgaaagtcaaaagcctcactatccctgtggcagagacaggttaacttcactgccagtttaagatcaggtaaaggctaccgtgttaccatggatacaagctcttattctcttttgtatgaaacctttcatattattaaattgtgactcacatggtgcaggggtaaactcggaaacttccagacaaagtcacccaagagtttttccatgttaggaaccctgcccatagtgttttcttcatgaacacatgcaaaactgtgtgatgtcagtgaacatatccttaaggggttaaagaaagaaaggttagaaaatttttggctaaactgaaggcgattccaaaagctgtctgctagtcctaaggtcattaaggctctttctttttttgttgtttgttacagaaataatttcccaaacatagactggaaatggtgacatatgggaggctgacccctcctctctctgtcatctttcatgtgaaaccatgattttctgatttatacagtggatagtgtggagattgaaggcaggttttaaagtcaggctaattctttgtggtgggattcaaattagcaaattgtggtcatttattcatacaaggtagatcatgatagaaacaagactttaaaaagcacttatattttaaaactctgtaaaagatgttctgccacagagatagccatacaccgcctaacaaccagtaaacattaacatcatagcagccaccggggacccagtgctttctgtaggttaaagaggcacacctctcaggccttggctctcccgctccctgtcttgctcttcatgatccaggatcccacacagcccagagctcccataggcaccatgctaggcttgcctccaggtctttgtctattcattccctcatttgacacagatattttgactgtctactacgtgtctgttatggattgaattgtgccctgccccccagccccaaatccaaatgttgaagtcctagcccctactaccacagaatgtgaccttatctggaaataagtctttgcagatataagtaattaagatgaggtcatcctggagcagagtggacccctaatcctacatgaacagtgtatttataaaaagcagaaatttggacacacacacacggagaatgacaagggatgatgaaggcagagagcagggtgatgtttccacaagtcaaggaaggccaaagatttccagccaacctccagaatctgggagagaggcaggagtcagactcttccttacagcctcagaaggaaccacccctgcttttggaccctagatcttggacttgtagccttcagaactgtgagacaatacatttctgtctcaactacatttttagctatataaagtacatttcctactgacaaggagattctgaaaagttatgagaagctcccttaactgaatccctccatcaggaggatggctcaggtggtgatttggaacactgctcctttgtggaccaggcacgtggctcctcagtgcttctgcaaccctgactgagcagctcaccctcgcctcctctgacttcttttaggtttgaatttgcaataacctaaaagactttatacacttttaaagcaactgggataatcttttctagagggagaaagggagagttgtgtaaagtgtgacatagtggcttttgggctaggtctggcgtcatggtctttggggaaatcgacggcctctcatcttggcgagggtgccaacaaacacccaatgttggggcacatggacaaccccagaagtctcacacagcagctgttacatcgattttcaagtacagagacttgagcaataactgtaatgacattttcctggctggctctgacctctgaatctcactgattagtctaacacacactgtgaacatcaaccagttaggactctaagccaagactcaaaaattgctttaaaatggcagaagatgtttaagatataatttgtacgagttggttattaacttgttcacttcccaatccgtgattcttttttatactctccctctcaattatttttccctgttaggttgatgtatctgtagtagttacctctaatcactaagatacttctgtaggcaatccatgctctggatgttacagagcagtcaatatggatgggggaattaaaaaaaattgactctatatattttaactttccatcattctacttatatttcccttgtttaaataaaaacaatcttttttttttcagaaaatattgattggatttgtatattcagagggataatttaaaaatacccatgatgataatatatgctctgttattctaaggtaactcaaaggcccaaacaccttaagaatatcaggtaccaattgacgttttcagatacaaatctgactgtgaatctttgactctattccctcactgccaacagtcagattttcccctcctgtcgacattttatatcccacagtacctgttccttttccctactccaaagccctcaactttcatttcctttttaacaattgccataaatatacatctttaaattcagtatgccaggatgaggtctggcactcttcaacaaaaacacagctattgccctgtttctaaagttatttatcccccaaaactctgatgcttcatgtattccatcaacaaacacttcttaaacacgtaatgtgctcaaagaacctgactagatcctaagtgtaatacagaaaaagtggaaacaatataatttacatttacactaaccttgaagacagacaaacaaactgcttttgtaaaatcagttgtcgtgctttgaagttaaaagttctaagattacaaaatgcttgtatcatgcagggatctgctaggtatttgccatggggctatatttcacatgcagcctttcaatctcctaaatccaaatcattttcctttatttcctacctccagggtgatttcttcaacatattttattggcttggcttttctccagattctacccttccacaaacagtcattagcacttttctgtcctagtaacatagctttttggttgtcatttcttctccttcaccctttccagcacacggctgcctttccattttcatttaatacacatatctctttctctcaaaaaaaaaaaaaaaatctgggccaggtacctgctgcatgccttgcatggtttgctgcagaaactgcagttgctggtccttggtgaggttttcttctgttcggaaaagctgttctttttcttgtttcagcagctccacctcattcctgtaggcatccagctgccagcggagactgtcattctcctctttcagagcgtaggcctgggcagccagggctgagggacaaacagaacgagttcaggtgagctaccttcttgcttagcttgaggaggccttctgtgggaaagggagtctgtcacccaagttcttaatgtttgtaccagctcagaaataaaagcaaaatgccactccctgggcctctcttttgtagtcggtatgcatcacttctctcggaacttttatctattctgtttgtcctgtcttacatgtgaatgtttcttatgggcacaggattaattcctcccaaattctcatcccttgacctctccctcaatgctagacaccctcacagacattggtatgtggtgctaggtggtgacaacatttagaattccaggcaacaatcatatctactaaatattgtcttccccctttctacgggattgcttagctacttggagggctgcttgctttcaaataatcagcagttccacaggttgagacatgcggcagcatcccaggggagagaggaaattatatgcacaccactccttcctgctctactgctgggacaaattgcacagattgttttcctccaactcctatcagaatgggaagctagttccatctgtttcaccaacagattaaaactcttttcctctacaaggctgagtggttactctaatacctctccctgaaaccccaaattctccacatttagattcagacttcattcatatgtctatcttattaagaaaccaagacagttaactcagggtctcacacatctcaaggcttcagaaatagccgaaactgaaaaagaaacaaatggtaccaaacaaagattgagggtagggaaatccctttccctagtttctaccttattgcttaggggtctctccgaaaatcaacatagcctgctgagcactcataaagcactggatcaagagctttgtatgaactcactcacttcatacccccaccaagcctgtgatgccggtgctggtcttatgctcatctttacagatgagaaaaatgtggcacagagaagttatgtaactcatccaatcccacaaagtaagtagcagaaagccttcacacccaggctgcaggctccagagtctctgctctcgattaccatcggtccatgtgtttagttcttaccaggctgttcaaaaccagtctcacattcccccaccaactctcccaccactctccctttaatcttccccctcacagaaaagccattccccacttgtgtaagcaagagaaaagtgaaagaaaatttgaaacgcttgttaccagaaacttcaaacatgtaacttccagtagataagggcacggtgtggagcccactgcacaccaggtcgtcagtgcatgcgcgtttccagcccccgctccccgtgtcagaggaccaaatcaaggtcgcctcctgagtgttctacctgcacattacagttccatggtgataaagctttactgaggttctctgagaccacagtgaattctctcctcaaatatcaaatgtcaaattatgttaataatagttttatagttgagtgttttacagtactccatcttgcaaaatgataatctctgtgtagtacacactgaactactaatcagacagaacatgcaattacccagaaatttccctacctcaagccagtagggatcaattacttaacacgcatttacttcatatttactgtgctcaggtccgtgagggcatctcagaccacaaaaagaggagacagaatacatctcttctctcaaagagcttaatctagtagaaactgacacatttaaaaagaaactattgctttcaaaggaagaaaggatagtgtgatgtctggaatacagcagacactcaataaatgttggttgaatgaataaatgaataaataaatgagtcgagatgcatgacaaaaaaatgcatcctataggagttcagagaagagaaataaaaattcagactgaaggaataaaagagggctttggaagatgaaaaccccaagaacttggaaaggatgtctctcagtcagaagccagagcataagcaaaagcccagatatgaaaatcaaaggtagaacacttggggcaagaaggagagaaactcgaccaaaagccaagtgtttgcctggaagcagtgagagaaagggaatccacgtcaggtgatgggagaagatggggaaggttaggttcaatggagtggccaattgagaaccactgacagcgcttggagtagtggaaggacatgatgaaattgggatttaggaacattagtttggcaatggtgcatggaatgaactggaggctgaagagaatgaataaaggagatttcatttggtgtatgtgtgtgcaaaaccaaggagcagccacttttacagttttcagagacctactcataaaatcagaaattatccagcacataacccgcagcatgagccagtgctttttaacattgtgcagcccagcttcagatcttgtccacaccctgagataccacctcctgacagctccgtttaccaagccataaggaaatggttatgaggattcatttgtgagagggatgttgtaatagggcaaaatcacagaaaatgcaaatgatgaagaaagtgttggcactgcataggcacattactacatttagtagcattcaaagacacttaagtcatttccttaggaagctctatttggccctttttcaattcagagtggcatttttattatcataactgatagcaggtgtttgtgaagaaatcgattagtacgcagggatggaaattacattttccaaatgaattgcatagtctgcaagatatgctgaaatctgtatagcaaaatgcaagcagctataaagcatgtgccaacagcattatttaaataaattatctgaacataaatacatataggaaagtgtaccatccattattttaggggatctcttacaaacctatggaatggtactgctgagagttcttattcttggctaagccaagtgactacagtgcctgccaagcagtatataatattgtttgcattcccggaataggaatgtgatatcatcatattaaaaaaacccacaacagctgtaattcccccaccaaaaaaaaaaaaaaaatcaataccatagcaaattccatcaacatttttataattggggcacataactgatttacattcctgattaaatgatttcaagcttggtttttacaaaaaaattttcgttactcatgtggcagcaagtagttatcttctaaagggtgagaaattgtatattgactccacttagcttcaggccacctgtttgtaaacaccactcagtgtcatactgcagccctgaatctattcctcagacaaggctgcctggaagaggctatattatgtttcttgggccagagcgctaacagaaaaaaaatcctaataatttctgacttaatataacttctcagtatattaaaaattcagaaattggaaagggaaactttttatttctctctcttctctttctttctttctggaatactgtactaaattaaagagttttgaaaaaatgtgtcatcaagcttccataataaaatttaccttatgagactgcacaatgaatccactatccaaataagtataaggattaaaaaaaaaaaaagtacagtgtgcatctttcggtaggaattcctaaggagtgcaccgagtgccaataaatggaatatgtaagagacaccccatgtggattaccaatttccgataataaaaaaagaatagaattagacaccttaaatgtcaaccggactgaatgtgattaaatattttgttggtgattttaaaggcactgctgaatctagtggtgcctctggattaccatcaattaattcaccagccacccatttatgtatttattaagaaaacatggtgaggagctgtagcattcacaagaagcttaaggccagcacagtcacccatttctagttactcagtaatttagaaaaattctgaatactggaattttctgattggatcaaaaatgaaataataaaattggaaaaattttgctaggcaagattgttatacttcaaaacttagcactagactaaaaaatgaccaaagtgacactaatgtatgaaaatcaatccaaaggttgaacggcactgctgaagaaaaggcttaaaggtattgcggcatcttgttatattctttactagattctatataaaccattattctttatattaattatggtcaaagtgacctcctcttctgtctcctgtcttactgtgtttccatgggaacagataatgccatgcttaacttctttaagtaaataatctggagaaagccttgaaatctcttttaccagcctgagccagcctcagaaaaatagttagcaatatatgaaaaatgtaagttgttttgggttatgtcccagtaagctgacagtctgttaatatctttttcatgctcaggcaagatgtaactaaataataaaacattttaacatatcgtttctaacaatatctgtgtttctccagaactcttagtctttgtgtgtttggggaactctgtgtttaacattccccctccactttgccagatgtcctcctgaaatgctggaaggacgctgctgaactgtagatttccttcccacatgcaaagaaagtctttttcaagaatttcattggctgctacccaggaaggcagttgtaccgatagcccctgaacacaggagggcagaggcaggctggcctggcaaatgtcaccacaatatctgtgtgccttcaacggctgcctcctcagccacgatcctgcctcctgctccactaggaaagggagctgtagttatggcccagtgacagggactctctccagcttctatctgcttctctgcattctgaatcttcttgtgaggtgccttgaggcctttagaagctattctgtggcagagacattatcacgctgtgtactcaaactcatgcttctctttgtatagagcagtgttgctcctgagaggtgactgccctagagggtgccatgtgagcagtctcatcaatggagtgtgagggggagtgaggatgccttctgcacagtccctcagtctctgcctgctgctggaataggcttgggtctctgagtcaccacatggaggaaaggtgcccacaggcccagaatatctgccttggactgttgtgtgcccaaaaagtaacacttttttttttggttaggccatctttatacagcagctggtgttactctaacccagtgttctccaaacattggcctgcattacaagctcctggcgggcatattaaaacacacttttctgggccctaccctcagtttccagttcagtttgtctgggaggaagcccaagaattagcattcttccaagtcccccaggtggtgctgatgctgctggtgcagagaccacactttgagagccactgctcagaccgctgctcattctatcccgattcctaaactggggttgtggttggcttgtttggagaaatgcttctgaaagaaccacatgcttggcttgtcattctggttttattccttgatctccttttgtatgagccccgactccatgttctgcacctgggaaggcagccctgttgcatccctgtgcccaggtcccatgagctcagcttgccccgtgccctggctatctcctatggaagatttgggcaaaaggcacagtcactattctgctttcttcaaataacagtagcagtaatgggaatagcaacagtggtagtgacagctaatgatttttatgtgccaggcactgaggtaagcatattctttacacagtatcctttcaccatcatgaaaacatgatacagtcaatatgattattatttctattttccagatgatggaagtgagtttatgggagacagaggttgctggttggaggtaaaaggtgtggctctaggactatattcctccatgtaatgccaccaggctagcttagctccatgtaagtgccgcccatcccagagaaaggagtaaaccagggaccctactgtagtggctagtttgctcctaacagaagtaaaacattcaatttctggctctatctggggagtgttctgctggagagagactctgctatgaaagcagagaggatgatcctgttttaaaataaacatgcaggtattttctgcaggacaaacttggggatgatttatggagaagttaaactcactcttcaggaaatcttgaggcctggctggaaccacttagggatcctactttctgccctgtgtccctctcctctcaaacggccacactgatacccactaatcccagagctcaagagcctgagttgctaataatgctttattgagagagttttgtccatagacccatgctgatctcaggattcccaaagatccagtatgagactattcaccccatccatctgaactcacctatgtttgatttttaaggtgtctgtgccttcagttagaataaaggtgacagaaactcctctgcgttatgctgacctcccatgaactctgtcccctgagtctactttgcttgggctaatgaaggccaaagacaaggaccagtaccatgtcagaagattaacagaggcttggggtccttcatcattggtagcctcattctcagtggctgctgttgccatcagtgcctcccagtggccaggcacagagctggaaagtatcctaggatgacatctgccaacagccagtctcctgctggagagcctcttatggtaccaacaaagtacaattgatctgcttttcaataatacctgtatcaccactgatcaatcttcctcaaattgctcacggaaatttcttctgctacatttttgcaggattattattattacaacttagcattgacataacatttcatatgtgcagtgtgtattcgaatctgcacattagctattattagggaaagctaaacagaagcacaatgcagtgtctatttccatctttgtgtgaggccagcggaataagggtaatttcgggagtgcagggtaagctagatcctgttacgatgatggcttaaatgtgagtctggaggcacaatgggcagcaggtgactcaggaaaaaaaaattctctgctccttcctccagagagctcttcctgaggaagtactctgcaccagcagcagaactaggaggtgctgctgggctgctgccactatggagacttcacatcatgcctcatcacttttccatttacattactatcctctgctccgacccaaaaccatccccattttcctcagaggaaaataagcaaaggaaagagacatgttcacttcttgcaaaagcaggataagtctgtcatttaaaacactgttgaaggatgctctgtcaggtgaggatgcctttagagtcctccgggaaacacatcagaagtgaacgctgcaagcatgagctgagctccctactctaagccaagccggggacagggcagggaagcagagctctcagcccctgcccagcctggcctgcgcagctcccagcccagccgcaggaagagctacagatatggaacctggtagaaactggttagaagggctccaggaggggccatcctcacactgtgtagtgggagtcaaataagggagagaaggcttctggctggaacataagagctgggggaggctctttatggaaggcagtggttgagctcacacattgaaaagctgaaggaaagcagagtgggactgctgcacagtggacactgctttaccaaaagattcggcgatctccaggaggatgtgccatggctatggagaggcgagcaggctgcttcctactgagccccaaggccaggcaggagcatctcaggagggggcacttttccccactcttccttttcttttaattcgattttagttttctttttcactttcagtccctattttgatttccaagattatagggccatttaaaaaaaatcttctaaaggctttaaagattcttttttaggaaagtcaggcttagctaagccaagctagacaataaaatgacactggctttcaggaattgtaccccctcccctgcagacagtgcacctcccttgggtgtagtactccaccatgggcttggctctgtgtgacttcatcctaactgacagtagttggtcttggccaaagacagaaactttaaacagcaatccttccctccaaaacaactcctctcattttctcaccaatctacagtataaaagcagtgatctctttttcctcccatcttacaaatgtccttcctttttaacaagtggtcatttctaattttcatcaagaaactttccccttaagaagtgtatttcccctctcctgctctaccctctacatagaaacacacacacgcacacacacagttatattagtatttgaattggtgcttctaccatataaaacacatccacactatgaaatgtgaaatgatggccagctcaaacctaaagtatatcttctcagttctatgcattgctctttgcaaggagtagcatctttttttgtaaagtttttattttatagtgccaaatacttgcaataatgggttgaacagaaaactttttttgaaagttacttccgccttaggtaaaccctaactatccagactagtaagtgggcaccaagacttcacttttatgcttgggcaatgactctgcttgggctgtctctgagcctcctcctccccactgttctcattaccaacattgaaattgacttatgaacacttacttgtgtctggcaataggatagaaagtatctgcatcctctctaaatgtataaccaaggtgggaggacccagtatgaacaggtagctggcatcttgaggtatctgtaccactttggtatctcttaaatgagaaacctgggactcatcccagatgttacgaatctgagattctggaatggggcccagggatgtgcctttcagcaagtttctagggtgattctgatgcatgccaacattttagagccacctccctggcctttagggaccaggtccccacttcctaatgctttcttcatgactttcttctagtcttagatttctttcattagtttttcatatttgctttctttcagccttttccaacagctgaaaggaccttctctcctgcttttacaacccaacacagccttctgggcttctctgcctctgccatgtcttctcacattccattaacctatcggcctgctccttgctgaatgctacctcctgcctctccaggaatgacactgtgactgaatgcttgcgtaaatcctacaggcagtgtctccaaaacacattgtcctcaactgctcgatgttgttgtgcattacttttctttgcagccatatgtctggagaaagtttctgctatggcaggcttgtggcttgcacccaggagaggccaggctgaacctctggaactaattgcccttgaccgggccccgggaacagccttttcactgtgggagaggaggcccctcccatgtacacatgcttaccacaccagtctctagattcgcagaggcttttctccttggcgagtggccaggcatgcctgcttccctctctcactgctgacggatgagcaaacagttcctgtctattctcctagaggtagagaaaggcagagactctgtccttggcttgcatcaccactcatatcaggccaccctccacactttgccctcccttttcaagccgcccttttttccagtgaaccagaggatactccaaatgtgcccgacacagacctgtgaggggacttctccacctgggtctcacacgctccacttaaactacctccctctcacttctcctttctttgctcctttatcattgcctatgtcagtcacttcctgtccactacagatttttatactttactccatttttgttttcttctcattcccacattactttacctcacctcaacccgttttgtccttctttcccacctaataggtgggaaaagaggtaacctttctcacatcctcacaaaaaaagtttctgctttgttcattaaaatgatttgttttgcatttctggtgagtataatttttcaggtagcaatattttattcttaccagtgcctccttaaaaagcctttgcaagtgctgaggtgccagttaagcactatatgacagccatcatcctcacattacaggccagtggttttcaatcctttgtgcagcgaatcacctggggactgttttaataacaccgatgcctgggcattaacctgcggccattggtatgtgtataaagtttcccaggtgattctcatgtgcagacggggctgtgaaccacacattcacaccttctgctctacaccagcatcaactctccacattgccacagtgcctggtatttgcaaaatgccacagaatcccttaattgtttatttctcacagtcttattgaggaactctcaggatgagcctcatgtcattgctgagaaagctgaggcttggtgaagggatattatttgccaagccatgccagaaataaaaccaaggtacttcaagggccctctgacctcatctgctcaaagttactttttttttttttttttttccagagtctcgctgtcacccaggctggagtgcagtggtgtgaccttggctcgctgcaacctctgcctcccgggcttacacgattctcctgcctcagcctcccatctagctgggattacaggtgtgtgccaccacacctggctaatttttgtatttttagtagagacagggtttcactatgctggccaggctggtctggaactcttgacctcaaatgatccgcctacctcggcctcccaaagtgctgggattacaggtgtgagtcactgtacccaggctcaaagttacttctttactgtactcactgactctaaactccccctgccaacaacacttgttctcactcatagaggtccctttctcagagccattctaacactcttaccacccagatgagcctctcttccaaagagagtatcatagtgagcttggcagtgcttagtaaggcccgacagtggagaggaaacgcagaaggaagccaaggacttattttcggaattctcaatatttcagtgattcagatggcttcagttcacattcttcaactggacacatcatcacttctttttatccccagagttcgagtgccacaaaatcttgctttgacaaactcagcattagtcttggagtccttgggcagggaaaatgcatgtattttataaactgtctggatggataaattacagcaatttttccctgggaaagagttgttcagacatttaaaccctctatatattgagcatgataacctttctcacatccccacaaaaaaacagtttttgctttgttcattaaaatttgttttgcgtttctggtgagtatagtttttcaggtagcaatgttttattcttaccagagcctccttaaaaatcctctgcaactgggcgtggtggctcacgcctgtaatcccagcactttgggaggctgaggtgggcatatcatgaggtcaggagatcgagaccatcctggctaatacagtgagaccccgtctctactaaaaatacaaaaaattagccaggcgtggtggcacacacctgtagtcctagctgcttgggaggctgaggcaggagaatcgcttgaacccgggagaggttgcaatgagccgagatcacgccattgcactctaccctggtgacagagcgagattccatctcaaaaaaaaaaaaaaaaaaaaaaaaaaagcctctgccagtgctgaggtgccagttaagcactattaatcaaacactaaatgctttttaaacagctctacctttttttctaattgagaaacagagctgtttgggcaagtttatgaggtgaccttgattgaattaaagaggtcagcgatggaacagacttcaaacccatattcaatgatttttttaaaaatgacttccttccaattaagcagaaattagcataaaatattttgtttctgaaaggttaaaagaattcctctgagaaggcagctgtcttgttactagctttttattgaacatgagagggaagggactatgggtagtttcatctaaagtgctttgttaacatgacactgatgatccagcatcaattacaatattccttaggagcctaagtgttacgtagaagggtcaaaaagtccattttaaattttatttcctatttcaaagtccaagaacccaatgactttcaattactaagaaagaaagaaaagaaagaaagaaaaaagaaagagaaaattaaatcaacatatagtttatcatttgcaaaaattgcaacctagttctacagaaaaaagcttcagtcattacctctttaattcaatcaaggtcacctcataaacttgcccaaacagctctgtttctcaattagaaaaaaaggtagagctgtttaaaaagcatttactcatcttcctcttagccccatccttctgcttgccatagtcccccacattttaatgacctgaaagaacatcaccttcttcctaccaaaaagagtaacatacagagtgtctgatatataatgatggaagcagaattccacagaggggagggggcaccacacacaggtgatactttggggactactgggtgtgtctgaggcacagtcaccctgagagacacactcgacataacatagtgctctgcatcccacatatctacccctgccaacctcaaagagtcgagtggacgtggattatatagaggagagaggcacaggagtgctagagaaagagaaggggctctgaagccagataccagctatgaggcttagggcaagaaactaaacctccaagagacctcagggtccttatccaaaaaatgtagtcagtactgtgaggattaaataggtaatagggttttttttttttcttcaaaatgaaaaaaatatcccccaacagattaaaaattagttcttcctagttttaatttcctatccattcatttaacaaaatcttgcccccctaccatgtacaatgtagtgggctgggcattctttatgttcaagtttatgctctcacacttctttatgttagagtttatctactagtttttggctatgacttcggagggcacagtgggcagagactgtgaggacctgtgatctgacactattccaagaaaagccgaactgatgttatgctacgaggatttttcagaggagagaagcaaccctttcagatccaagtcagtgtctcagtctttcaagactttgttagctattctttccccttaatctggcactgtaaagaagacaaaggatatggtcccacacacattgtgagaatttactgaatatttgttgttttaattttatcactgctttgtattatgacattgtttaagacaattcgtggaggcaaaggattaagggtagagaaatggatggctttaggaggctcggtagataaactacactagaaaagtctagtattgcatgtggagacatttcataaacaactgactggtaaatcactacaagaaaaataaaatctctcatggtacttccaaaatatcttctaaatatatgttgtagattaagttgtgcctgaaaacttgtaatcacaaaaaaatcacaagtatcaaatataaacttgtatttattcagcagctcacctgatcattatttgggggtaccaaaattcatttttctcattaatttaggacattgggggaagggagaagacatattacttccaagatcagaatttccctgagtctgtgaatctcaagaagattgatattactgtagatgaggtccctcagactcttattttaaagctatattggaggcacatctcataaagaaaagcctcgggaatagagaaacagggagaggcacttcaataagtcttgaaattagatggtgagtcaataaactggtgatcctcaggtaggctctcccagaccctgggggtgcaaagaaaacatgggatgagatgggaaatcaaagggctgatattgtagctcagatcatttcagatcaaccatcaagcatgtgcctgaggtttgaggaacgtcttcatttttctctttatctttttggggacttatgaaatggaaaacatgggttgtgacagtgtgtatggttaccaaaggaaacacataacacagcagtgaacatccctatgcacttcacctcttcaaagcattttcttttcttctttttcttgtctaaagccatacagcagactctgctttcaggaaataaatgtcactcaattagcaaatgggtggtaccaatttccagaataatttttaagggtggcatttctgttgggatgggcttaaaaagagtttgctgggtgcgttgcctatattgaagcaaatctccttctaggtagtgggaaaatacagaaaatgacgggaagaccaagcagaagccccagtcggctttgtctggattaacattttaaggtaataagcatctccaggctacctttgcctctaaaaggcattatggcaccatgtacactgcaggcactcaaaatccttcgttgattttatttggttactgactcttatggtatcactgaaggcatttgaaagagattctggagtccttttcccataaaattcattggtgccataacagggtcattaacctgaaaaggagaaagctagtattgagctctaggctttccacttacgatcttgggtaaataacataacttctcatcattgccaatctctctgtgggtaagaactcaacatttctgcctggtttagaacttgaattatttcttggatccattatttaatatttataccaatatgattagctcttagaataagaaattataagattatgtggtctgggaaggtaagcatattatggtgagttaaatgtggaaattccctaatttaaagcaaaagaaggcaattcaataaactatcattatctgatactagttactattccttactattcttgactttccagaatgactgaaaatgtctagggagtattcctcaatcaacatggattttttcatagattctcctaggtaatttataaattaatatttattgtagttttaattatttaaataatacatgcatatattgacatttttgaaatgcacagaaaaaaaatcacttgtaattacaccatctggtgataatcagtctgaatattttgacctatatcctcacagattttcccctaacataaattgtgaatataacacatacacacacaattggaattatccatgctggtttgtaactgcttttatcacttcacaacatattgagaactttctttcattccattatatagtctaaaccatggtttctttcaagactgctcatggatatacattaattaatcaataccctagtgttcaatgtttagatgtttctaaattaattctgagaactgataatttaggtaactgctttgagctgcaatgaccagcatgccccaagtagaaagcaagggcctttgggacacagcagctctagaacttaaagggggctcattaaagaccctgcaatgccctgccggaaatgctacaattaatagactctgtcttgtaacttttgctccagaaatgttcttcctacttctctgctagtgatgggagtctaaaataaaattttctttctctagccacttcctagaaggcttcacacattgtgtcctggaactggggagaagagttgctgagctcttgctccctctttgatatcaagagcattcagtcaagtgaaagagaagggtctctaagccatttagatgtgggagagcttactataataataatttcctataaacttcaatttccagggcttctaagtatcatataatggcaagtagaatttccaagaaagggaaggaagtacttactttttaaattagttatgtggctcttaactacctacggttactagaattctacaagacatcatcctgtcttcattttctgtgttcatgcagtatccctagcatcttcaagtcttcgattaacgaagctcatgtgcaacagtgttaggagtcaaggtataatagctttatgtcacctactgtgttttgatgaacaatacagtataaaagcagaggagaattaggacaatgatgttcatcaacagcacatcactgtgctaagaggctggtaacagtgtatgttttaatgtggcctagtactgattcttttggccagtgtcctactttaacaatgttacagtcacacttcaagatttcagatggagaggtagagaagaaaatcaatagatactatttttccactaccaactggcctacatatatatagcttctctgccatactcacattcaagggacctaaaagatgcctttggaaggtctggcccagttaccatgcttttaataacctcaggaatctactctgaccacctcaaagattttagcttcatctctcaaaggtccacaggaaagagcctatgatccaggaagaatacaaacttatttgttctctattttctattccattaatatataaaaagaaaacttttaacaaaggcttgcttgttacacaaggactcttgtctgaaaccaaaatcatgtagaattttattcctgagccttaaaaaatacacggaaaaatacttatgtagttaactgtgcaaaagaaaaaaattagaagccaaaacattcttctgtaatgttataacacaattttgttttcttctttattcattattcttagttgttaggttttcaaaaatgaccaggtattatttttattcaaaaaacaactttcattttttaaaatgttacatgctgctagagcgcaatgaggtgacctactgaaagtgttttctatgagcatctgctagaatcacaggtgagcatttgacaaaattcatcgatgttgtaaagggtaatccgtttttcaaaatcagagattcctgagtattgcttataaatgaaaacggaaaatcaggaataaattctactgaagaattctctcctgtgtttaggaaagaacaacaacaataaaaagcttacaaagttgcccagattctgtcatctaaactccttcaaaaaatatcctgattttttctagaagttgtgcaaaccgcacttaaattccaacaacactgtgttaattttgctcaaacgcaagctgaaaacatattttaacatcctgtcagaatgagatactaagagtgtcgataaaatgacactaaaataaatgtaaatttggattgctgttacaagtggctgcttggctctgctaagacgttaggttgctatagtactttccatagcaactttgcatcttattacataaatattccctcagtgtccttcaagcctgctacagaaacaggattaaatccactctcctatgtaatgatcctgcatcaaaccttaccggaatgaaatgcccagaacacataataaactgtaatgtagataatggtgttcctggcagtcaataagcatcagggcactttgggctgcacacaggcggcggtgcagtgaccctgtactactccctggtcatgcgtcttaacctttcccaggtcaaggcgtcagtggctctccctttgtgaagattggttgctcatgtcctcattctcctcctctccctgccaactgcccatcagctcaagccctccaccaggctcaagggactcatagcactaagcaagaagccagggcctgacaggagctgggaacatgctgggctgtcatgcaggaaactttgtggagaccccacccaggtctaagctaggatcaaacaggtatggattgtttaagaacttcagctaggcctcagctgaatttcaccgaggtgtggcacagttgagtagttaagagtattagggaaagtccttggtcctgtagacaccaatgtcagcaacacagattaatcttacataaaataccagattatggaaagtttgtgcacatatgagagagatgtcaagaatcatggcattgataggtgctacataaaaataggattataaaggggctaagcttaaagacagtttaggctccaagtgtgaatttacaaaacaaacacagtctggttgggcagaaggagtgcttccattgaaatggaatcttctgctacaggatcaatttaaatagcatctgttttcctgcatttaaaaggtgaagcaatttacaaaaaaaaaaaaaattctacacttttcagaagcatatccattacggaaagggaattgtaactgcacatgaaattagggaacttaaaaatccacccaaaataaatatttatttgaattccttgggcaagattagcaagattaaaagaaaaaaaaaaaaaggaaagaaacaggaaagccttggctcctttgcaaatgaaactctgtttagagtttaggaagaaagcaggctactcagcccaccttgcaagatttcttttatcatctttaagccacattagttctgattcatcacatttccttgtttggcccccttgggttcccagaagagaaaatgcttgtctttaattcagtggtcagtgatggacacaccccactggtctatttctctttcaggagatggtgccctcggctgtcattacatgtgaaaacagcttatccttctatgcttccactcaacacagacacccctgcccttggggtctgctggcgcccggagctcagatcctggcatgtggcctcagactgagccatctcactttcagtgtctgaattctcttgtccctctgccaagttctgagccaatctcgggtgagcctgctttcagttacattcagtgcttcctaaaaggaagtttctaccagtgtgaatgacagagccccttgcagttggccccttcagtcagctgctgcaccctggtctggtatttagtaaccctctccttcttctgtgcctggctggtgatggggtaacagtgagcctcttcttaagcttgtgcctgattataatcttcctgatgggcatttttaaggatctttcagaagtactaccacccagaaaatacttaatcagaaaaaataggttgtcctgctattcaaagaaatcaatgggatggtcagagagccctattattattatttttattacttattttttttttaacataaatcttccagctacatatataactattcagataggctgatactgctagttccaaccaaacctaattatgagttcctaatttgatttagtggctgaaagatttggaaagtccttgtttgaattcttagtgaaattaaaaaaaaaaaattccgggccaggcgtggtggctcatgcctgtaatcccaacactttgggaggccgaggtgagcggctcactaagtcaggagatcgagaccatcctggctaacacggtgaaaccccgtctctactaaaaatacaaaaaattagccaggcgtggtggcgggtgcctgtagtcctagctactcgggaggctgaggcaggagaatggcgtgaacccgggaggcagagctcgcagtgagccaagatcatgccactgcactccagcctgggtgacagagcaagactccgtctcaaaaaaaaaaaaaattcctttgtacctatgttatggtgaattttcatgaaaaattgacagctcagaaaaacactcttcataatttagagtgtctgctcctataaggagctcagagtttaaatgaaatgcagttaaaatccaaaaacatttgtttgtgtattatggaaaggcataatgattgtctactgagcaagggactttttagttttactcttctaacatttgtgttcaaagtacactcatcaaatattgggtgaggtacatacactatgtagtgatgttcattttggtttataataaatttaatttaccagctttaggacatccctaatatttttaactgaaaacacttttttcaaatgagtcttacaccctagagaactgggtaccctgtatctaactaactctgtgtgccctgggtccacagcaccttggacatacaaaatgtagataatcaaaacagtgctgggttaaagctctctgggccatggcctgttcgccatgtgacactgaattttgtacgtataaagttctgaacattttgtttgaacatgcctctttaatacttgccatttcaatttaattagagcaaatgttctcagggttatcatcctcctatcaacttctgggacaaaggcatcgaaaacattaagatcagaagaaggggaatatgaattgaagtccacagacttttattgattacgtacttggggaaaggcccagggccacgtgttggaggatgactaagataacaagcagagttaacatttattgagtacttactagatgctcaacactgtaagtaaagtcagaagtgccttgcatgcattgacttattaactctcacaatactaaaacgtatcgggttttgccatctgaggccttacaatctaggacagccttcctctttcctttctcctttttatttcttgcgaacgctatcccgccccacagagtcaacctggagggagagagggaggaagggagtggaaaagggtaagggagaaggagagagggagagagagggagggaggaagagagagagaaagagaaaaaggaagaacagatctggattttaaagtctggcttcatttcagtaggaggcagactaaacaacaataaatttgaatttttatcaaaaattatcttcacaggcttcagagcaggatgccgatcttctagaatgaatgcttcaataaatctgtcattatttttgaatttattaacaaaattgattttcatttttatcagcatcttagttttgctccagtgaactccttttcccctttaagattcaactgatcaagaagagtgaacaccccacccagaattctattgtagatactgcagaattatagccaaagacatattgcaaattattatatatggtaaaaagaaaagtacaatgaaatattcttcataaccaaaaagcagagatatattgaaacattttgattattttttaaaaagtaaacccaaggtatcatataagtccttacacaataaattgtgcctttcctaaaaaccaaacaagtcaattatttccatctcttccctgccccccaaaataaaacccattacagggtactttttgtcttagtatggagatgacaagcaaagctggccctgggggaccacagacagagcgccctgcagtgggtgcagcctcagcacctcctcccggcacaggcaggtgacaactgaaggatattctcttctggaatttccaagaattcctgggtcagctactacccaggaggtctgaagcaaaatcccactgtttaagcagagaggaaattggcaggggattccttacagcatggagaatttcacttccattacagcactggcaattcccctgttagtgaattagagtgctacattttgagaggactgctcctatgtaggtgactggcagatgcaaatgtgtacctaaaaacaagggatgtgtcacccaagaagataccgctggaaggtgtttccctcgggctatggcctccatcctcctgcttcaagcaacagttagcagggatttgtctgaggtttgaacaaaagaccagatgggaattcttgctgtcaggctgtgtccccaaatatgcagggctgaaagaaaaacaactgcctgcctttgggccagatcttcagggccccgtggaataaaaaaggttagttgccttcctttccctttaatcagtcctgtgctttcttcagaaaccacatgccacattctctggtccatctcgttttgaaaagcacgaaaagactttgaactgctcggggcctggcatttgaactccggttctttcatctcttccctcagaacttggcatacaacatgccctgcactttgctcattaattctgctgaccaagtaacaagactggtgaaagttttttttaaaagttcaggctctacttcacgttctcatcagatgcctggggaataaaccgagagaggtgtcgggggatcacatctccgtcgatgcttctgcagcagaggccgggccccgatcctataagcatgtacgtgccgcaagacctcagtgagcatactattcagagtcatcattattctggtcctatcctaagcagactatgaaattatacacaattcttacttgggaaattgacaagttatttaaaaagaaacatcaccaagacaaaacaaaaagccacaggttcaaatgagaatttctgactgatgcagttcttttctcctacacctaccttgtcaggatattaagaatccaagtttcatgtcaacttgcctctcatccagaagcttcacaaaggatgaaagcgcttttgacaaaaaaaaagtttatttctttatttgaagatcttgttgaacttaagaaattcacacaaatccttgcccccttcttttgctatgtgaaggtttgtagaatagaaatcctgtgaggaaggtggtctcctcaaataaacaaacccaagagtaaagcagtcctgaggaatctgatctgggcttagcaggagacatacatcattgacacataagtgctgggttcatttttcagacaagggatatatggcttcagaaaatagtggcatggtgcctacttgtatgttaagcacctgaaagattaaaatgaatgaatttgagggtgaaagggaaagtttctaaggcagtggttctcaaactttggcatgcatcagaatttcctatagggcttaaatcacagattgctggacttcacttccccacaccctgtagccactagacgtttttgattcagcaggtcttgggtggggcctgctaacttacatttctaataagttcctagatgatgctggtgctactggactgagaaccacacttttgagaaccactgctttaaagaaattagagccctttctctatatgcctgtaggcaggagctttttcttatgaccatcactcgcacccctacattctcttctacagccctggagaaacagagcatcctgaccactttgcagtcttggtgacctgatccttttagaatcttgattttggtttcttaataaattagtaaagatcctcgattcctggtcacctgcaatctttctgttaaaaagtctctaacaggtgtatgttttattcacttatacacatgaggagacagatcaaatctataccatctctgtaattttcttttttgggaatgatggcaattatggttcttcctaggtccttcggacaacacccttccaatcagacaagcagtctcccttggtgtctcatgttttgaatgagcttttcccttgcctgtttttacaataccaatggatttatatataattcaatgagagcgttttaaatcagcagctcccattagacagagcacacaaagcaaggttctctctaagtttctcttctttgtacaacctaaggagtgacacccctagcttggtaccaaatggggccagccttttaattacagattaggtgaaagaacatttatgggaaaagaagtctaattctccagcatcttggctcagaagctagaaagcttcttcagggattaaacaattcccatgtaagaagtacactgactaaaaccaaattttatccatatttttagcatcagctgtggctgccgtactctggaaaaggattttcatggaaacaggcaaatatccctgaaaaaagcttaatggccccagatctacgtacggagaaacaactggagcaatttaaatcactctgttcccaagaaggagtttaaagttctattaataaaaagcagagtcactcaaagatgaaagtttagtataattcaaataaaagtgagttatagggccatttacttattccccatctgagatttggaagatcattatgatacctcatgggtctgtggcagttatcggcattacctgattcatcgactctcattttctttgtagggctgtcacagttctcatcatcagacatttccatttcttcttcgcggcggatgcccatgagctgctcactttgagcattccggagctcctgcaagtagaggatacacaaatgtcagagtcacagacacatatggctttccccaatggtctttgggtatatatgactggcatattaacattcagaatccaaagcttttatctcccaaatatagcctcacctaacctaaaggaggttctgaggggtgtggggtacaggggagactgaggtcaggcttagattaatccctgctcacccatgactagggctctttagcaaataatttaatctctcttgagtctcaatttcctcatttgtacaaagcggataataacatccacctaatagggctgcaaagattacatagaaatacctgttacatggctggcacatgtacagtaaggacttagaaattatggttaagaacatgaacagtggaattttaaaatggactgttctaccactgacccacacggtgtgacattaggaaggattcttcatctctattaacctaaattgctcactggaatattatgattaaaaatagttttgaggatgaaatgagttaatgaatgtacagtacttagcatcatgccagacacttggtttgctcagttgataatgctggacattattatttctcatgcaaacatagtgcccctgcatgtgtgtatgtgcccatgtgtgatcacatacacacacaggcacacacacacaccattcagatatccaaaattcaaaattagtaagatgttagggaacaaaacacaaacagatgccctttctttcgtattgcacacggtcatgttggggttactgtttttgttgcaatggttgctttagcatcacataatttagagccacagatcttaagatcacaccttactttctccatttattaggggagtgactacaatcaagttatttatttgagactttgtctagtcactcacaagtgaggaataataatacaaggctgtttacatgtagtagcatatgtgaaaactcattgtaaagattaaagaattacacaggaaatttcttactactgtgcctaaaatctgaacattgtaatacttatgctaagtatttatattattattttgtatcaagctgtatattacatatttgtgaattcttccttattcattctgttctcttacatgtactatcttcagaaatacttaaaacaggggaagcctccattattctttttccctctgtaaagtctctaaataaaaatcaaatagttaaaataatttcatgttatgatcaataaacatatgagtaataataaaactaaattactacaactgatttattaggggcatgacttgtgcccatttgatggacatgcatatatcactccatgttatgggttttctccattcttttctctccttagctcacagattttaactacagcatgatggagaggaaagtatttattgctaacagcatttgaatggtcaactctgtaccctgggaatcacccttgcagaagacagggaagggagaaagcagagagacaaggtccgaggtggggtgcaggggcaccaatcacaggcagccctgagaggccagagggaaggcagacaaggctcctaatttgattatgccacccagaataaacaggtgccaattccatcttaaataacaccatcaggcattggaggtgggtgtcacatgtgattagtgcggaaatttttaggctgtggacagctaatttttctactgacaaagagcccaattcccaaagaggtggcttaacacttgaaacaaggaaaagtcaggtggaaagaataaatgaggctgaaagggactgttgtttagtccctgcgattaatgacaaactgtcatatggtagttgttcttgtgggaaagggtggtggaaaagaaaaaaaaattgaggaaaaagagctgagggtgtttccacagggtgcctctggttcagcattaaatcactagtacactctaataaatctgtagaggtgttgcagataattaacagatgctgtacatgggaatgtgggaaaaaatcaagccaattatcaagcttatacgcaactgagaaatcatccacaatgttaaattaccaactggtatttaatcaattcagcgacatgcaagagaaaatcacagctaatttagaattctgtggcctaatgtatatcaaaagaggtggggaaagtagcaggaaggcaaaaagacccttcgcaggagcacctttgacagctgcactccatctgtccttctggagcatcatttctgtctcctagtaccaaacaaagcaagcaggctccttagacctgcatggaagccttcacacgtcctgctccccaccacacccacgcagaggaggcagggttaagcgaaggtgagaagttgaggcagacatggcaggaagtgtgattcagatcaatatgtgacatttgctgacactcacattctaatgatggcctttttatgctcaggtttattcggcagcaggccaccagcctttctctcaacattccttttaatcatgtttggtttttatgtgaaaaaataaataattcacagactgatcattcccaaatctgaatcatagtttatggactccaatttgtgttttcataaccctcagtttgtctactgcatcacaaacagaggactcttttttttttaatcttgaaaatcagccttgacctcagtcttaagtcagagtcagggagaacatcaggtaagcacccttcatttttctggcccctgaaaaattaaagagaaatcccacctcttccttactcataatcctgaacagaaaaacagaactgtatcagtcaccaaccaccgtaggcattagtgaacaaactaaaaaatgtccttcttaacaataaattgcactagcattttaagtgtcacattattgtgaagtcattcggtattcaccataataacagtgataataaagaattcatttggtattcatgtggatattacatctagtgctattggtattcaactgtaatttagcattagttaatgggcacttaaaatgctacccaaatgattgatatcatagtactttgtgattcctcaaactctatataaaatacttattttacaagtgtaagccaaaatcattaaataaataaaccttaccttccataagtttgggattttgaaagaggggaatgtcatttagagaactttaatattaacatgctagagatggagaggcatccaaatgaaaaacattctttcattaaaaaaaagaagcaaagacagtatacttacttttaaattacaggttcaaagcgtacactactctgtggagttaaaaataacagctggacgaccagtgactaatgacacattttggtccttctaagtggcaaggaggtcaaattctagactgttctcttgggggtagatactcacttcacacatgcatggttgctgatgggtggacccagttggcctagatattcactccccttacaacattggatctggagagaagtgtaataggacttaatggctagcatagggactaagatgttgcttatgataagaaaatatggacggaaaggcgtacttgtccaaagagcaaactgtcatcatcacgtagaacactaaaaaaaaaaaccctctgtatttaaaagccagttttctattgtaagctccatttttcttcaaaataatttgctagggaaagtgtcttggtttatttctgaaatctttactatgaatgggaaaaagtattttctcccattgcaggggagaaaaacactgtgttccctaagtgttaagtcagctgcttttctggacaaggaacaaatctcagctgcatttggagctgacagtgagatcagacaatggcaggcggactgcccactataacagaaaccatcatggctgcagccatgctattctctgccaatccagctgtgtgatggtggttaaaaagtaataataaaatcaccaacctcagaatgctttcgccaaatgtctatgttcttgcgctgggctttcgagaaatggtcccaagctttttgtctggtagaagcgttgaaaacggccacaatctgctcaactttggtgaacaaggaagtcaaacaagacaagtaatttatgttgtgatcactatagggaagcaaagcaaagacactaggagtctatggatgatgtcacaatagaaacaacatcatcaatatccatccaatttgtgcctttcgtacttacattttagcaaggttggggatgtctcccttcaagtctgtctccacaactttaggttaaaacaaattctaagtatgaccgggagaagggcaagggcatctacttccaagcattctttagctgttgtttcaatatgtgatttggtctatctatatacctagatctatagatatatagacactggtgttggcatccagatatacagacaaagtaatgcaagggttgggtgcagagaagtgaagtcagggagaagtggctgaacgaggaagagccaaacatatcattttctcttttggtctttatctcaaggactcaatcacagtcctctcaagacattatcatgtccaagttccaaattgggacaatgaatagccgtgccatgtctcccctcaatctcagggggccatttttcctccttggctcctttttcctccccctgttgcactgactgcagccagccctccagccctctggcagggaacaggaaccatagcctctacctcaagacagaccaaagctcacccaaccagtggcactggcatgcaggtcttatttcaaccaccatatggcaccctccatagctcctcatgatcacattccattatcactttcacaaggctccccgccctctggctcccagaccacttgaagttctaactctattatcttgacttaatttagtacttctgctgctttcaggcctggtgctactggactggtaaatgttgaggggttatgaacaaaactacatagacaaaggcatgggctcttagtagtgggtattatgggtggagccaactaactgtagacttaatcttgcttaaacagttattgatccagtaagcatgagattaaggaaattaaagcactaaattaatcatatgattaaacctgaacttctaaatttttagttaagaaggctcagttaaaattagcttctcaaggattctaacaccccatcaacataaatctttcataagtgattcccaaggctctattataaaaaaggacatcaaagctcttccaaatcttctggtgtccaaagaatgtcaaagagcaatagagtaatccccacagaagaacaacacttggtgccataatttttaaattagcacacaaaataaatgtatgatggagcagaaggaaaaaagcagattccattcacttacaatatcgtgaatacttttctatgctgatgaacaactacttctcaatctatggctgattttcacagagggcttttatctttttgctattaatatttttactattttccacttcaggagaatcccaaccccaaatctccttatttagcaaaacctgtcatcatgtcacatgatgaatttatttgactcaattttaacaggaggatttgccttcaatttgtctcatactctccttgggcacatgtggcttccctcctcgacctcaactggaagaactaaactccagactaaacacctggggctgctctaagtgctggccatcagctgaccactgatccttagtgctctggttggctgtcctgcagcacagctggcagaggagagaacctgttccagtggatcaccggggctttctgcatgttttgtctgtacacaggctgggatcattgggaatttcagctgccttctgtaggggcaacacagaacagtcagccccaaatctaggctggcaggggtggtgatcaagaggttattaaagagtaatgggcttcgttgcttataataacatagctctttggcatcatttagaagaggaagaactatgatgtcctgacaccagtcctaaggggaaaggacaatatgggttgagactgagtgtttggttggtaatagtgaaaattctgacatcaatcagagaaggctgttaataaaaatgaaacactaaagaaaagtatatctgttcataaaaacgtgtaaggggccagagagaatgaaggtaaggaagactagtaatgcacctggaggagtacagaaaagaaagaactaagaagaaggacccaatggcccaatagtgcacaggtttaggggtaaaaggagatcccctaatatctactcaagccatgtgctattagatatttcctgtttgtggctaagtgcctcggttacttagaacatgttattaccatatcccaaggcataagttcagttcattcattcattcaacaaacatctggattcctgttagctaccaggaacttgattaattgctagaaatatatgatcaaggcccagtcttgtctttgatgcaatcatagtctcggaagagaaagaaagacaagcagataattatcctgtgcaagagaggtgcagatgacagctttgaagacacagagaagagaagagagtagctaagtagataggtggcattagaaaacattccacaaatagggcaacatttctgccaagtcttaaatagtgaagcaatgcctgcttggcagagaaggcaggagtggcctgttcaaaggctggtatagagttgtgggaggatgagtgaaagtagctgtggggctggggctggggctagtgttaggtatgaatcaagagagaccatgtatgctaactctgattgggaactttatattgtaggattggcttgggagaaattacaaaggaatgaattaaggcagaggctctggcatggagtgtggcacaggcagtcatttgacagggagacttgataggaggaggcagctgacttgctacatgggaggaggaagaggggtgcgaggtaccacgatgactggagctggtaagtacatcccaaactatgagaacaagcatcggtggagggctgagaaagaagataaggaatttacttttggacgtattgagtttgagatgcctgaagaccatccaaatggagctgaaatatggattaggggttcagaaagaagtcagaattcaaagagatatggccaacattttctgggccattctccatttcttgtattctttttcaatagggtaattaattagatgtaaaactaagtgggatttaattttatacttatgaacttatacactttttttccctataccaatcaaaaagcaaaacaaaaacaaaacaaaataaaatcccacaaaaccccaataactgtgtaactcaggtttggaaaccactctcacagtattcacacggcccagttttacctctctcattgctgcacacactgtccctgaaccagccatttgtcttgcaaatgaaagttcctgggcacacacgaaaaaggactctggaggagtgctttcatcagcattaattcatcatcattagggaaaaagcacctctaagagtatgccctaatgaatgtcattcaaagacagcatacttttaagctcataaatcaggatgactactggtattgatgtaaatacactattcattgcttatagcaggaaacaccagagaggaagtccatgaattagatgaccactgactacctctctggtataattcatactacttactctatctatatacaataaaacctgttaagaagttactatcagaacaggctcttcaaaactttgcttctcagagaaagatataaccagcaaacaagatggcattggcatttgttcaaagcaagtagcttatagaagttgtgctgcaggcagaacaaattgagacctactccctacccaatgccttcaccacctcagtggtccacagagtggtggccagaggccccacacaatcctgtatcagataaaaagcatagattctgtttgattgccacttacttattcaagaaagtatactcaaaagttttgcaggtaaagggaattttttttctttgagggataacattttcccaaatcttctattagcaactgaaagagctctccatcagaaaatttaaatttacccctcacactttgcaaatctttcccccccaattctgtgttttaattgtttgcctaaattaggttatttgaggatcataagaaaattaaaaatgataaattcttcagaagtatgcctgaatgccagttttagatatcacagtagagcccctagtatacccagcagctgtaaatgaccttaagggcaggataaacagagccttgatgaagttgctaatcactccacagagctgcaaaccctcactagtggttattcattagcttacacatatgtatgtgtggagatacatacacgcacctagcatacacacattacacacatatatgtatatattcttccaattttaaacaaacccataagactaatttaacaactttttttgcacttttccccaccccaaaatgtttggacatttgctgagtttagagcacacttcttactgatagagaactttacagactatcatgagaagcgctggtcttcagccttctctgggagggaaagctcagaacagaatatccatttatccaggaacagaccacactgaagcaagctccctgggaaaaagcagccactgggtgcaaaagctcagatttctgggctgcacaagactcctgaatttcaagctctgggcaggaatgcatgggagatgaaagagaaaggttagagtcctctagagaacacgaacacagcccttttcccttcatgtcttgccgactgccttctttctcacaggccctgcacctcttgtattccttgttccagctaaatagcggtgaaagagccttaatccagttagtgtcccaaatatctggagaaactgatttagtccttaaaggcagtaggcttgcctaaataaagcacctcaaacaaatcttccaagcttagtttttgttttttaatgctatctgggctcatgttagagcctcaactctgcagggtacacaggacatttttctttttttaagggataacattttcccaaatcctctatgaatagcccatgagagattttcaaagggatatgacacaaatgaaataggtgacctctcccaccccagcttgtttttgttgttttaaaatactaatagctaggggagaagggacagaagaaaagtgtaaggctttagatgtagtgctggaattggtgagccttggctttagactgaagaattataatggagggaatgcagtaagcgattccagctctcaggatacccagaggagcaagacaaggtccaagggagaagcggtatgtgtcggacagcacataagaggaagctgctgctataaaagagattcccagacagactcctgcacattcactcgggttctgggtcctgagcatgaaggagctggcagtcagcctggcagaaagcccaggaaacagagaatgaatacggtcaaacccatactttaaggagggatggaccggaatttcaaatagaggaagaaaagggcattctggggttttgtcttgagatatgttaaaaaaagcctcacatgacattgtgagtccattacagcccacttaaaactgaggccaagacaccaacagcagacatcatattactgaacttcctggctagatgaggccagatatttgttgcttttagggcagcatccccaacgtttttggcaccaggaaatggttctgtggaagacagtttttccatggacagggggttggggatggtttggggatgaaactgttccatctcagatcatcattagttagattctcatagggagcatgcaacctagatcccttgcatgcacagttcacaatagggttcacgctcctgtaagaatctaatgccgctgctgatctaacaggaggcagagctcaggtggcaatgctcactcacctggtgctcacttcctgctgtgcggcccagttcctaacaggccatggacagtactggcccaggggctggggacctctgttttagggaatggaatttgaatagaataaagagaagcctactgatcacagtatataaaaaaacaggatgttttaagcaaatttcaagcaagcaagaaatgatcaaattgttcaaataaaacagaaagatattaggtatatagtgacttttaaagatttgcatcactccaagtatactccagggaattgtagagccctttattaatgcatatatttaaaaattttggaaagtaaagcaatacatgagattataaatctaatagttcctcaaaatatatagcatttattaagctttttaaatccaataaatctcctgcctagattacccctactgactaaatgaaagtaatgtatatacagaagaaaaaagggacgatataaaaaaaaaagtctaccttcccatcttgacaactctaccaagttctctttttaaaggtaaccagtaaccactattaacagatcctagcacatccatccagaaaataaggttatgcatatagtacaaacagtgtgtatttttctatgagaaaccttttttacttacacaaaggtgctaatattatatacgctattctgtaccttggttttttcacttaatatatcttggaaatctattcatatgtatgttatcaataaggctgctataaacatcttccaacatatcttctgaaatccttacataaatatctttataaaaaattcttagcagtagaaaggctagataaaagagcacctgaatttttaattttgaaaggtactggcaagttgcactctatgtccctgaagtgtttttcagtttgtttctcttaccctttgccaacagtgcataatcaaatttagcttttgccattcctgatagatgacagaaggcatgaattacatggtaaccaattgtctgcaccagtgatatgtatgtttgcagtttccattacaaataacagaaacaagtccagactcattgagcctgccctgtattcagttgttggctcgatgctaagtcatcacatagcagcaggaggagagacctggtttctggggatcttttcttctttgtgaccctcgaaacggcaaccctgatctcctctgagtctctactaactcccttagtggttatgaaaatcatataatggtaataggagatttctttctttttgagacggagtctcactgtcacccagcctgaagtgcagcggcatgatctcggctcactgcaacctcagcctctcgggttcaagtgattcttcagcctcagccttccgagtagctggtattacaggtgcgcaccaccacacccggctaatttttgtatttttagtagagacggggtttcaccccgttggccaggctggtctcgaactcctgacctcaagtgattcacccgcctcggcctcgcaaagtgctgggattacaggcatgagccaccgtgcccagccctgtgataggcaatttctaattacttagcccttactgggctaggcactatgcttgatgatttaaaacagtagttatcaaagtgtggcccctggaccagcatcatcaacatcacttgagaactcactagaaaggcaaacactcagactccagacctaccaaaggtgaaactctagggatggggcccaacagactctgctttaacaagctctctgcatgattccaaggcatgctaaagtttgagaacctctgattatcttacctaagttttgcaacgactgtctgaggtaggtgctagtatgaatgcccatttcattgatgaagaaactgaggttcactgagacgaatatttacttgtccaaggtcatatatttagcagtggtgaagttggcaatggaaattacatctgtccaacttcaaatcatgtatttatacccattatatgatgggccaaagtcttatgagctctgtggtgtgtaatgtgctagactttgtactacacactggggataaaaagggccaaatatgcagctggtccttgagctgctcagagtccctgggggagacaacatatatatgattgaatcgcaagatgagaattgcttaagagagctgcagagggtgccaagggaggccaagaaaggcttaaaggaccccttggctgaaacttgcagctaagttgaattttcaatgcaaacaagccaaacattggaggttatgatggagcaggaagctgcatttacctctctacaaaagtgtattgaggaacatgagccacagtgcagaagaatcaaagtgtctggaaaaaaagtccctactttttttgtgtctaccaggctggaaccaatttctctcagtgtgtgccctcagccttctcattttgtctaaaatccagtctgtcctactttttttgaaataaaagtcattgaataagcctcagcaggggaaacttacagaagtggggccaagggagtgtttttatgaatacaacactgttttgggggttgcatgtagacgggaagagagagttgggaaatctgtgttggtcaagtcttagctccatcgctaactagctgtgtgacctgaagaaagtgtccatctgtttgaatcccaaggcaaagggggctaggctagaccatcctgaatctcctttctggctctgggagcctttagaacagggcttagcaaactttataaggaaaggaacagatagcaattatttttggctttgcaggtcatacatctaccttgctatagaaggtgtctacacacataagtggtttctctccttaaatagaaatcctctcactttgtctgtggctactcttccatgattctccccaggtacaattttctttggttggaaaacaaacactaagttgtacttctctttcagttacgcagagtcaagaacacatcatctctgctttaaagtaactttactgacaccttacttttcctcaatttgaaagtgtcttggctttaaaaaatctttgtaaaaattttttttatgcatggattttgtccagtgtagctcagagactgtttcccagagtaccccaatgctatcaacacacattcccctcgcctgatgtggggcagtggctagagtccagtcctagacctgggctcatatcaaagtgacagagttttcatctttagctcccagaagttatacctttcctgatttgctgaatttcacttaatatgcactccaattctttattgttccagagtgtaagacttgatttctatcttacattttggtattattaaagatttttttaaaaaaacataatgatttgactcagtgtatatattttccacgagactgaaaggaaggataccaaaaaaaaaaaaaaagaaaagaaaaaaaagactcatttcagttctggcaggcatagtgtcctccaccatcacctttggcatcctgtgaaacagaacattctgtgctcatccttgatgctgaagtttttatacatattattttctctggatatttattccctgagaccaaagaggtatttttttaaatggaaataatgtttccagcacttaatgcattggcaaatacagccatcagtacaattttgaggagaaatagaaaacctgtcacattgctaaagcagttatggggaattttttcccatggatgaactacagcaatgactgctacagacatgggcaaacattttaacacttcataaaattcctttttgacagcaggggacatagaagccaaatttcccttggtggaaataaaaaatgtttggctgagatgttcctaagaagtaaatgatttcagaaagagcttttcaggcagaagaaatgtggacgaggacaccaatctgcctaaaagggggatcacagtacacagagatcagaaacccctcacatttcactctagcacttagcacacaacttgacacttgataaatatttgtggaatgaatttaatcattcagacacttgaggcttttacaattttacccaagaagatagatgagggcgtgacagtggagaactgtcagtgccctgcgcagctgtctttgacaataattctgaccaatcttcagcacctgcagaatgcaatgcacataacctcagggttgaaatgtggcttaaaattcacagtgtagcccaggaggagtaaccttcacagcaaggtataggcagaacatttgcacagagtaatatctgattgcctgttctatgatcactttaggagctttgaacctcatggttgggtcctggaagatacctgtatttagatatccagagacgataaaggatccacatggttgacataagaactgtggaatcttaagggtggaaaggaactttaagggattactggttaaacccttttattacagagatgagaaaaaggagactgaagttgcttaaaagactttcccaaagtcacaaggctaattagtggtcaaacttggattagaaccagatctctctgccttgtcaaaagtctttccaccatttgcagcttttaagacctaagatgaggctgatgccattacctatcacaaatgtataaagttgcatgacagttctaacctttccaatctccaggttgaaatgatattgataacggtactctaatactcctactgtaaaattctcaactaaagtatatgccgtatgctccactttaaagagaatggcatattagagctaagatcattgagatcacggtttactaaaaaacacttaggctgtgttctgcaatattaggttctagcccaattttcagcaccacgttcctttccacctgtgattggtcaacaaccaatattttttttcttaggtcttctatgtgcttacaagaattatgccaggtccagaagtggcacagtgaggtagaaaagagaacagtaagtggctcatgtctctatttagcctaaaatcttgctagagggaaaatcaagcaaacaaaccaataaacttgatgcacataaaataattagaaaataagtaagtcctcaagtagatagtattaacaagcgctgcagaaggtaggtgaaagggagatgattatgggttataatggataaacaaggtttcatggaggaaatgtgatagaagtggacttcaattttggcacttggaggaggggaaatagttcaggcaaaggaaacagcacaagcaaatgtgtggaggtaggaaagagggtagtgccagaagcaaatacttcattttttagccagatagcagcatttatactcagtgtgatgacagcacacctcttcaactctacctataagctgtacctttacatttataatattcttaattttcattttacacacacacacatacacacacacacacttagaaagcaaactgtacaaggagccaagagtcttggttctaaactgcccataaactactaaatgaccaaagcctctcacgtctgctctctgagactcagtttcctcctctgtaaaatgacagggtttggcccaaccctttaagatccctcttagctctaacattctataatttctgctttttatccatgctcattatatgtatggcacatattcttaaattaatgttaatcaacccttctgcactgctgctggctttcccatttgccttttctccagtttgttcccttctctcttaccaggaagcatgttgggaaagtagcaaaatggggatatcatggagtgtttaaatttttattagatatgtgtgtgttgtaattgttaaaaggcatgcaaaacttatcatcttggcatgcatattaataactgaatgtggtagtccatgcttcctgaactttataaacagctcctgtacgagctttgaaatgacaagctttgttcataactgagaaactgaaagtgggcaggcctatggggagtttctgtgaagtatgcatttttaaaaagcaaagataaaaactccaacgtctccgagttggaaaacctggggaagtttctggcaaatggacgggttaagaaatgacataaagatgagactaggatgctatcgggataaggtgacatgacaaagatgatttacctgttccgaatttttttttctctttcttctatatctaggaaatgaggtctatccagctggcccagaagggaggagaaagccccaggtgccacagcaggatagacgatgtcctcatctaacatttttcataactggacatccatggtcagaagagaaaaatcgccctacacagaagtgaatggatgccatactccccaaaattcaggttgggtttttttttttttttttttttttttttgagatggagtctcgctctgtcacccaggctggagtgcagtggcgccatctcggctcactgcaagctctgtctcccaggttcacgccattctcctgcctcagcctcccgagtatctgggactacaggcgcccgccactgcccccggctaattttttgtatttttagtagagacggggtttcaccgtgttagccaggatggtctcgatctcctgacctcgtgatccgcccgccttggcctcccaaagtgctgggattacaggcgtgagccaccgtgcccggcctcgggttgggtttaattacagccccctgacactttaagctaagactttgctaaaaacaatgactgtttgatatttaatagctggtcctggggtgaagaccagagatataaaaaaggttagaactttcataaatacgggcagaactaaacaccaacaaagctagagggtaactgatggactttgatggagacctttgaataaatcacaactttttctttatgttattatgaatgacttgtgacgtttttcaaacaacttttgttaagcactgaacttcaggaacggtggctggagagcaatctaggccaaacatttgagcctatggatcctttccaaatgaaagcaagaacaagtacacaagcacagaaaggagataggtgcatctaatccagctcatggatcacatctgaagtttcccttgtcctattcaaccaattggttatttccagccaaatccataaggggacccacatgcttttaccatgctttgaattctgcaatgtacctgatcttccctagaagctgcggagtgagccctccgtgtttggcttgtttgcggcctgctccactagttagccagtttgccaatacacctgcttccaaaccacctcacaacaatttcccaacatgcttggctgtttagtggacaggctaccatggaatgccatgaaggacggcattgacactggggagatctttcggcactgacactaaggagatcctttatgtggagagggagcagttggggctgctatggaataaccaggagatttccagccacctgggagaaggaaagctgaggtgcaattcctgaatactcatgcttaacaattctaatctcattctaagggaagaagccaaaatgtgattcctgtggtatttgccaggaatattaatgcagacaaatggggtgtgactggttctgcttttggaaaatgcagcaagtgtgtcagtcactgaggactttagcagttattgttttacaagcatccccaaagtcctgacatcaaacacatcttaccacactgaacagagctgtggaaagcaagaagtacagttgagacacaaacatagctccactagagagagggaaattcgggacaggaaaggagaggcatttggattaaaggatgaggagatgtgtatgtacctaccatgttagtcaggttactgctaatagtttcacagactgggttcctttttgcagccctttttgtaaaagcacatagaagagaatggaaagttctgaggttgctcaatgagatatgcaatcttctggttctgcctcacaggcttaattctagcccaggctcacatttaaggtatcccccatcttcgagtcatcctgaaagatcttggctgtcaaagactcacaggaaggctcctcagagtctccattgctgggatgtgtacaccgtggccagcactgtaggattttcacaatctcggttgatatctgccaactgctgaaatacttctcagaatcaaattacagggctaagggggactcccaaatagtaacaggcagatggtaaatacagaggttgttggatggttacaattggggatactacaacgtaaatttctgatgattctttcaccccaactctcctaatatttcctagcctctgaccaagaatttggtaaagtgtggcaatttccaataaaaagtacagctattgagctttttctctgatttgcttcattatgcatgcaagttgaaaccttgtttcctgcagatgatgctaatatcaatgccaaactactcaacgaggtcaccagaaatttctgaactcactgtttcagggttccctcctgcctgtcttctgatctactcattcattcactcactcatccaccaaatatttcttgcatatttctatgttataaggcttgatatatattgatgacttgatatatattgatgtctcttcctttgtgatgcctgctataataactaaaagcagacatatcatgaaatcactactcatttggataagtgttacaaaggaccttcataaagattcagtgggctgggcacagtggcttacacctgtaatcccagcactttgggaggccgaggcgggcagatcacgaggtcaggagatcgagaccatcctggctaacatggtgaaaccctgtctctactaaaaatacaaaaaatcagatgggcgtggtggcgggcgcctgtagtcccagctactcgggaggctgaggcaggagaatcatttgaacccggaggcagaggttgcagtgagccgagattgcaccactgtactccagcctgggtgacagagtgagactccatctcaaaaaaaaaaaagagagagatgcagtgatggcaaatctactagaagagggtggaccagaaaaacctctctgaagaggtggctcttgatccaagacctataggataagaagaagtcaagcacacagagtatgggaaagggcaccccaggcagaaggaacagaacgtataaagccgagtggtggaaggtggttttgatgggctcagggggaaaggggccagtggaaatgatgcatggtgagtctgaggataactgaagctaaagaagtgagcacagagagctctgtcagctagggacagtgaatattctctaaatgcaatggggagatactcaaacggtttactggggaagacatgacctgatttgtatcagatggaatgtgaaaataaatcaaactagagtagaagtagaaagggaagcactctgtatggcaaaaactgcaaaattcttcctagtagccattctccactcctgccttattatgagaactccaattttactctggagagcagcaggcccagtcaaaaattatatttctcgcattctttgtagttaggcatggccaggtataataattctgcctaatgaaacctacatggaagttggctggggatggatttttgggcaagtttgctttcttgctataatgacgcaactccttcctgtgtctttccttctcttttcttatgtgatttcagctggaaaaagaagatgtgatggcaggcgaagcagcagcaaccatcgtagacaactatccaggtaaagcgaatagcaccagagagacctcagacctggcagccttgaaccactggaccagtaccaacaaaccccacatctggattttactgtgtccagagagaaacatcttctacttgtttcagataccgtttggcagaattttctgttactcacatgtggatgccgtgtctaactgacacatcaagtaaccaaagcctgacttgggtggtggcggttacaatgaagaagggtgggccgaatcggggtatatttttgaaggaagaaacaatgggacttcttgatgacctagaagtcagttgtggtggtgggagatggcagatatataaaaagtacaagactttggcttgagaatttatgagaatgggaaggaaaaaccagaagaggagcaggtttgaagattaaaagcaaggattccacttttgatatttcaaagttgaggtgcctaagaggcagtctccactcctgtggtttccaggagacaggatcttgctggtcctgccccaccccttcattcactccttctcagggagtgatgagccagcctgcccagggggagtgcctgttctgctcacccactcccttgtttaggcatccaaagtgtagcctccaggtaatgtggctggggccttcagtgctgcctgaggctggatgctcaacacaacgtccaacattcagaagccaattattgctgtaaatctccacgtcattttccaatttggtggtaataccaaaaagtatttgtagtcccacatactacacttttctgtccctctctcagttgcttcaaatatgggccaacttacacctatataatgacaggtagacattttgcgttctttcagccacatcacaggggcattttaataggtgcctctttcaatagttactgccaaagaaaacgaagttctcacctattcatggctgccctcttatctttattgttagagccaagggttgagtcttccttgctcattaggactataaactgcatggaaattagaacttatttaaaattgatgccagtgagcaaaagataaaaacatacagtaatcatttcactgttcaggcatatgacttcttaccataactctgaagaaagtgtattattagaattgttttactatgctctctctcatttttctctaccagttcactcttaccttccctccatccactgatccattctcttcttccctcctttaaaaactgctgtaaatattgctttttaaaaattctatccctaataaccttagagtttctagacatacactcttaagtaaagggccattcctcaaggctggtgaatctaggtaatgtggtctggtatcagtctgtgtgaagacagaagtcttatttttcctattccttttctttaaagacagattggtcttatactggatatttgatcacttatcggaatttacatttgggaatttgttatatcatatgctacgctgctgtaaaacctgtctttgataaagtcatgtaagatacttttacatttaagatctcagttttgccctctcttccatcctatcctgacagatacattattccttgtgtttgcactgatgaaagaggtgataggcattttggcacactatatcacagaaaatagtacttatcttcagaatggaaatatacatcccatatgtcactaccacatagggccctgcacctggtatggaatggagcatggcattgttacagtgtcattcaatggcttttaccaagcaagagaacatcggcagctgtgatgcatgatgccactgtgacattaactacagacacagatagagtgcccataaaaaaaatatacgccctttttttgaatagagccctgggtaattaccctgactattgttctaagagaaagccccacttacaccccttcatcatttagactctggacataaaaaaaaaatcactggcattgagtagttaaggcaatttgctttccaaatgaagaaaggacaaaaaaatctctactcttgagttgcccattttgacagccacagctcccccagataaaagatcctgaggagtttttctgatagtacccttttcctacacagagcccaaggaaaatgtgttcaagtttgctttctactgtcagcactaggaggacataggggtctgtgcggacagcctgcaggtgaacggtggcggccctgcagctatgatatgaaccatggtgggtccagcaggcacagatgcatctagctgccctgccctggtggccaggcttgctgttctgaggaaaagctacagaaacgttgctcaccttgagaagtaaactctcagggcagggtccgtgttcctccaagttgccacagaacatgaaataggttatgaagtttgccattcaatatggagtaaaaatgggaaattattgaactacttacccccaaatgaaaaagtaaaattaataaaaaagaaaaggcaaaatcacaacaaaagagatggcccccaaaattttacttacattgagtgagaatcccagttaaggcatttttaaaattctccttggcttcctccatctcttgctcatgggtggctttttcattcattagccggcggacgtggctgttggccgactgcaccatggaatagaactggtttgcagagcgccgattcacttcccctcgttcaatccaggaaagcagcactgtgatagcctctgaaaacttgctatcatctggaaatggaaaaccaccaagtacaaatcatgccaagatgagaaaatacactttattcttgttcctctcaaaagacagagcatagtccaacctagtggatatattttcagaactcagcaagttagctttcctgagactgactgccatatcatcacttaacttctcttttcccatctaacttcagggcaccacagaaccactcaggaggttcacactctcatctaccaactccatgagctcagctgtaggagatttgttctgggcattcttaggaataaggtacagcctcattcttccaccaaaccttgatttctctttcttaagatggacttgaaaaactgttactaacctacttggcctccacttcatttctttgttcctttatcaaaaatattatacagtgttaccagttttctcatttatagaatcagctgagttagtattaaaatgtggaagaaagattggatttttttaaaagtgtttgtaatgtatggtattgtccctaaggcaggtagtaggaataagtcaattcttgttctactgtagttcaaaactaattccattttagggctaataccatatatttaattaggctgaaaaatagaatatttcctaattttccacaaaagagaacatgtttcctgaagtgttccgtgtttgctttagatggctatggagagcccatctgaacccagtttgagatgtatgtgcatggtgtggcggggggataggaagtgggaaatgaagttccgcctgaaaataagtgataaagtctatttcaaagaaaacagacttgcctatttggggatggttactggaacaaacccgtgttgtatggcttggaggtggagaaaaagaaagtttgtgggtgattaagttaattagaactggaagttgtatgtcagttgttagaacattaaccaatctgactactgctgaaggctcattgcctactttccaggcaaacctgaggggagaagcttttcattgtgttctgcaatccctagaaaatgtgctttagggaaaaataccctacatttttacaagtaaactaggtagactctgaattctaaaaatcaggagcaaaattagattgaaagattcagattctcacccattcatttaaaaaatactgagtgcctactgtgtgccaggtactgtcccctccactggaggggcatcggagacatccttatgttgtttgcatataaacatacatacactccacatgaatagacagggggagatgcatgcttgagaaaaagatttcgtttcactcaccagattttaaaatcaatcattgagttcttattagtattttacacatcatacgaaaccttcccaccgttgagtgctttgtaaatttatagggtgctttacaaacatctttagtatcttttctcccaaagacctcctcccagaccaggagtacagcttccttagcatggctgctgcttgcccaggaggtgtgtgtcctgaatgaaggtggggctgaacctaattcaaggtcctacggctgaactctggaaacctctgccttccccaggaaagaaagcagcttttagggatgtacccatgctcaggcaccattctaagtcctctcctgctgcacagcagccttctagatttggggatcaaaggttttttttctgagcaaacctgcccccctgccctcacactttaaccagaggagataactggcctgggaatgcccacaaaacaccctgtgaatgacagactcaagtttccttgaaaatctcaacccataggcacagaacacacttactgagtatcgtagccacttataccattttgttaactctggaatttcagtctaagttcaaccctcagtgaactccagctgcaatggtttcttatctcatttcatggaccgaagcagcttgtgtaagataaaatctatcacacaacttaacattacgttcagcccatggagaggcccataatttagcatgatgtttgtgagaggcccactgcaaccgttactggcagaataaattgtgcctccctccacactctctacctctcttcccaccaatatatgttaggagaatggacctcagaacagacagcagaaataaacctaatgcttagaagaaatctttttttttttcctctgaaaagataacaacagaaaaagagaacactgacttcatgtactatttttcccctttgctgtgagtttcatgtctacataacacagagaaagaaaaatccttaacatttttgttatgagctttgcagggacagagtgtaatgctgttcacctctttctgtcatatacaggtagtttttccttctcttgcttgtggtcgcttagttcataaatagactaactttactatcaggaaaaaaaacacttcaattttaaaaatgcatgtttgctcaaatgctctgaaagccacattttattgcccttcacacctagacctagagcacaataagttcaccagcagattatagtttcagaaagaggaaacaatattcttaggattaagccactgaaaatacacaatttcaaaagtaagtagccaagagattttctaacatgttaacaagtactaggaagcagaattccattagcctaaaagaggaatatagtttcaaagactcccaatttcatcttcatttctgaactttctgaaactgacaggccgatatatgattgatgtactgacattcaaattaaattaaaaaaacattagttaaggcatgcttgataactccagtcaatatttgttgccatgtaagaagtgactttaatttatattaattaagactaagtcagtaactccctctggatggctacaggaggatattgggagcggtcattttcaatactcaactgtaaattcaattttgtattcagtggaaagatcactgagaaagcagaaaacaatataaactaatttaaacaggatttagattgcagcattattaaagctattcatgtggaaagaaattaacactgcttgtaaaaatcacatcaaacatgcacttataaaaattccaaatactttctgtgaacatgctcaggcataactctgaactggatgcagtttagaagctagaatgtgcagatgtgctttttccactataagaattgagaacgattggtatatgatggagtgaatataaatcatttgctcattagaaattacccaccgttttctaatcaggtcctcacaatgttaatgcacctgagttaatggacaggtccattcacgggtcttgcctttttcccttccatccgtccgtccccgcttcctttgccagagccctctttgttaaacagcacggcgtgcctccctgcatctgctcatgctgtgcacttatccttgggtctctcccactcctggtccccctggtcagctgttattcttccctcaagattcagcgtaagtgccctttaataaagaaatctcttctgcaactctaggatgaattaggtgtctctttgctatgtttccacaattccccgcatatcctgctattaaagcattagtcgcactgtatggtaattgttggtttacagatctgtctccagttttgaggggctaatatgagaataaaatttccaaagacatatttctagacatatttctgtcttctggttactctgagtttttccctttgtattttatattttattgcattctacagtagttcctccttatccacagtttcaccttctgaggtttcagttaccctaggtctcagttaactgtggtcaactgcagaccgaaaatagtaaatgcaaaattgcagatacaagcaattcatacattttaaattgcacactgttctgaatagcataatgaaatgtcacgctgtctcactctgacctgaccgggatatgaatcatccctttgtccagggtatccacgttgtctacactacctccctgtgaatcacttggtagccacctgggttatcagatccactgtaatggtacagcagtgtttgtgttcaagaaacccttatttggcttaataatagccccaaaatgcaagagtagtgatgctggcaatttggaaatgccaaagaaaagccaccaagtgcttcctttacgtgaaaaggtaaaagttcttcacaataaagaaagaaattgtatgctgaggttgctaaaatctaggataagaacaatttatctatgaaattgtgaagaagtaaaaagaagcttgtgcatagtatatatagtgttcagtactatccatggtttcaggcatccactggggatcttggaatgtatcccccaaaggtaaggggagactactgtattcctaatagatttgtagcaattaatactggaaagatacaaatgtaatggttaaaagttaggaaacatcagagttgataataaacatttaaatttcatgtcaaagagtattttcacacatgccattatctacgagagatagatgttctcatgacaattaagctgaatgatcccgttatacttcaggcttcagaagtcattatcactggcaatgaaagttaagagtgatgtcagataatcccacagaagcaaggccctctgcagtgaggcactaaacagtttatcaaataactcaaaaatgtttttgaaagcatttttaattctgggaacgtaattgctctttagctttgtgaggagtaaataatattataatgatactatcagatgtcaccactggaatccacgcccatctcatttcatttctggttatttcagactttgttaacccccttccttctccctctcttccacatttattgagtacttggcacatagtaggcattacaaaactgcatatgggagaactctttgctatattctaagaccaggtgcaggagcagcctttgtgagcttgttaaaaacacagactcagcctttctcacacctccagaattggaatctgcattttactccaggtgatttgtacgcacatggaggtttgagaaacactgaagaaaggactcagtgaaggccaggtaaactggttaggagctgaccaaagtaagagataatgaaatcctgaagtggaaagtagcagctgagatactagagactttcaaaaggaatagatgtgattcttaagagctttgtgagtctctatccctgtccccacgaccaattaaatccctgtccccacagctgtcacttctatccaggaaataaaaagggttcaagacttggaaatgggcatagagattactatagaccctttctatggaatgctgggcatgaattacctaattctacagggggtgggaaactttaattctttggctaatctctgactaggctattttacaactttgtaggagtagaacataaattgtggcaaactgataacaatacaaataattcgtctctgtaacaatgcaaattaatttttgttcagtagaaaatgtaaatctttataaagcgaattctccttcgaaacagttttaacattttcttggtctccttattaattagtgagttaaataaaatcattggcacatgttcattttatatttgtaagacagtcatgatttcaccgccacagtattctttaacaaaagacagggcccatgctacagtcatatctgaaagtccagggcatggcacaaagcgatgggtacctggtgaattttaattaaactgatacatagataatgatggggaaaataaaccaaattggtaagtgttttttgtttttgtttttgagatggagttttgctcttgttgcccaggctggagtgcaatggcatgatctcggctcactgcaacctccacctcctgggttcaagtgattctcctgcctcagcctcctgagtagctgggattacgggcatgcgccaccaggcccggctaattttgtatttttagtagagatggggtttctccatgttggtcaggctggtctcgaactcctgacctcaggtgatccacccatctcggcctcccaaagggctaggattacaggcgtgagccactacgcccggctggtgtttttttcctcccgctttgtgtgcacagggagaagcagccctgaatttcagaacaatagataggataagagccaagccgggagcactgaatacgaaacttaggtgggctatagtatccttatttacagctgggtctataaaggaacaatgaggagacagggattttatgtttgaacggaacgagggaaaacaaggaaggcattctaaaatgcttttctttccaaagaaatggagggacacacacatgtgtacacacatacacacacaaggaaaggtatgtctgtagttatcactgatttctggctccaaagatagctggaaattgctcacagtgtacagtcacagagtcatctaagcagatttggaatttcagtatggtcaaagcattgctgctatcacaatccccaaatttctgtacatgtccctaaagaagtctccttttcctggctgctcaattaaccccgcatcaactaaccagatcacagacagcataaaaggctaaacaaagagttaatgttcccttctacccccaaaacacacatgcaatctccttaactatttagtagctgtaaaaatgagaaaattaagggggcaatatgaaaatgcactgattattcctgctttagggtcgagcaaaatatttctttttattttatttatttattttatttatttatttatttattttttattatactttaagttttagggtacatgtgcacattgtgcaggttagttacatatgtatacatgtgccatgctggtgcgctgcacccactaactcgtcatctagccttaggtatatctcccaatgctatccctcccccctccccccaccccaccacagtccccagagtgtgatattccccttcatgtgtccatgtgatctcattgttcaattcccacctatgagtgagaatatgcggtgtttgcttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccaagcaaaatatttctaaataaaacggcctatcttgcctctatgaaggtcaataacacataaggaaataatttgcaaacaggctcctatgtttcatatttcccttactctatgaaggaagcctggcttttagctaatgggacatccacttggctcataacattattgatttttactttcatggaaccataaatactgacaaccatctcagcaaaatgctggtaccacatctgccccttcctccctctggcaggctgacatgaggctattctatatgcaaataagagtccagttctctggaaattatgaatgttgatcccaggaggatggtattcttgttgacacatcaggaaatcccaaaggccctgcctgcaaggctttgtcaggacgtcacctaattcagagagaaactcttcatttcatcacaaaatgaaagattatgtgaagctttctaagggggtacaaagtacgtaaaaacttttaaatgctcttgccaagagaaatcccggtgaattagaatataatccttcctcactgtctaatcaatctcttcctcccacagtccaaacacagggttcctccaggggtggatggtctgtgttagacacactgaaattcattatctcatctgcctggttgccactgtttccaataaagtgtaattatggtgttattgagctccttcccactttctcaaagccatgctataaactttgggtttctgagcagttacttcccagtcggtcttcattaagttgaattgtctcggaacaatgtctgtttaaccagcaggatgcttactaattttcttttttagaatttgtattaatgtaacaggcactgggtgactccatgtctcaggcactacacaaatacaacacagtgttacctctggtttcagaaggtcaagtagccagtgaatgggataacctggtcccagaagatcctccctctctcactccagcactgcccatccgggctggctatctcccctgtgacagcactgtgcacttcccacatataacaggaggattattatatttattataatagtgcactattataagtggcaaacgcaaggtgatttgttattgcctgtgtcactcaagacacctaaactctttgaggcaggggcttgttcaccgttgtcctttccaccactggctaggacagcgccagtcatatggtaaaatgctgattaacgaatacttcttgagtgattggaaggatggctgagcacacatcacatcatttccatgtacatctggtcatgcccagtagaaccactggacagaaattcaacgtgctcatagatccaaatagcagaagaagagagaaaataattatttttactgagcacctactatgtgcacagttttagcattggacaggacatggagagggccttgtgggtcataagaaagacttggtttgtacagattttgctaaataaagctgattttcaaagagaaaattgtaagaataaacaagtatgatataaaatagaggaaaagtatctgtaataaatctaagtaagatttctcaggggaggaaaaaaatcaaatccaattaggtattttcagattgcatttccatttcctttctgacacagatttctttaccttaggtattgactgtattttatgtccccacatcaatgaaatcatcttcagggaaacagtgtcctcagctcctcctgtctggctttgcaacattataaggagcatggagtggatttcctctctaaggcagccaatttcctaagcaattaaatgctgtttatattccaaactctatgcttgggttgaaattgtcaagcttgatattacctgactcttgcctaagatgtatccccagctagttcattctactgtaacagccatctattaaaatttccaatctgttctttcctcaagggatcacacagtacttggcaaaggtacagcttctgaattctgtaaattatactcatctatataaatatatacttttgaaatggcaaggcttgcaaattactttaccaaattgacatcccaatctgttatcctctaaaaggagcggcaaatgccacatacttcatacgtgcggagacacttctgtactgggttcttaaaaacaacataactagatgatacgcttttatgaaattcctccaggaggtcacagatcaaggtgcagtttttgtcacttctaggtgtggacaaactgaatacagttagtctgtgtagatcataatctgataccacaatacattggatattaaagaaaaattattgttccagtgaatactccttgttgagaacattgctgctgtatctcattttggccactccttatggtttctaggctggagggaaaagtgagatgatatctgtatctgcactgcatatgccctttattaaaggcacagccatggcctatgtatttacatcagtaagacatgttttctcaaagcagcagacacaccacaagagcatcagcaagaagcattccttggttacggtgcgggtatttcagtggcagctgcagttgattaaggattctcaagccctggatgggggatgaagattggaagcacagcacccccgctgccacctttttttttttttttttaaagcatagaatgtcaacttcctatcttcctaaaataggtgttaggcagcttttcatacattttttttagtgaaaacatccaatccactttatacactgccagcaatacaccagctatgttctaaaacacttgaaggatcaatcacatccctcttctcatcagaaatctgttaatggcttctccactgtttatggaataaaacccaaatccagcaatagccttcagggctctgccatctggcccagactgccattccagctttacctcactctagaaaggcagcttctatgctgaattcctttctgcttctgtgggtttttattcttaggtctccagcctctaactagaatgcctttatgcctctttttatcctggggaaaaaaatcttatttattctgcaaatttcaaattatgcctcctctataaagactttcttgacactttcatcaacattatttgcactggcccctgagtccccaaagcatattgcatttaccttggttgacaatcatgccattgacttggtattacagttaattgtttatctgtagacacctacatgtggccaccaactgtgacttacattctctcatcaaatcctgacagtgctcagtgacctcaggagggtctgaccatcatttgcctgtaaaatgcccatatgttgctcagctcacacaactttggtcagtaatagaactgaattcacatgtcatcctaacttcaaaatctggcatcactgtagttcacgggggcaggtaccagagccttcctatgtctttatttcccacagcataaaacaccagggagggcctcagaaaacattagaagaaataaaacatactctcttctcttgctagtcatcctgtaaatgttgcatgtgtcccttcaactgcatctctgaagacagggatcccattctatgtttcttttctatcctcgatggaccctagtaccatgtctgctgttttgcctgaagaaggctttaggagtctggtaaacatgcacactctatagagctggaggaacactaagaacgccccaccaatggcacaaatagttgctggctcattaaacactgggtcagaagataatagcctgctttggggacctttctgtcccctcattcagtgagttttgttgagtgactgtacatacacttttatggagaacatgggtgagcattctggaaaggggcaggggtctgtcccaggcagaagatgaagcccaggtgtctgcagcttccaggagaccccccagctaaccccaccccagctctgtaaagagtctgtgcttacaccagactcttacagccttcttaaggcatagcagacattgtgctgaagggacaatggtggacgcaggagaaacgcacagggttccgtgtctggggatccctgtggaggaagaaaagccagcgtgggtggcccatacctttcagcttttcagccagcagagcggcttcgtgctccgagtagtgcattatggcaggcggggatgggggcctgagccggtcctcctccagcttgcgccggtgccgctcctcccgggcacgcatcctctgcttgcattcccactcatagaagtcatccctggcctgggcaaagtccacatgaaggcggcctgaatcctttttgtcggtgctagaccctaatcgcatcctataacctgaaaccaatggaaactctggtcacaccataatgtaacaatggccacagttttggtccagaccttcaaggcacgcttaggcaaatgctcacttatttcttggctgtcactacggatacatttcccataggaagcgggaaacaattatccttttccccagcaatcttgaagctctgtaaagttaggcctattacaggtttggggataaacacaccttggagagctgtctcagagggctgcttacccatcttccaaaccagtatccccaagagaagatgatctcaggaactagggtcttatcatgatcattccttcttctccctggcttctaggaagctcagaaacaaatttggcatggagcattttttttctctacctttttatggccttggttttattatattttcagcttactataattctactgtataggtgaaatatgagtaaataaagagcatctatgatatttaaaaagatctacaaagtgaattccagacacctcactcacaggttattgctacattcccccagaaaatgctgctgctcaattctctctcagcagctgcaaaagccacaattaccaaggcaattttgcaatgctgttttatttccacttatcctctggggtgcgcaggagaatattttaccttcgatcaagaggcctcgccgctgcctgcctcacagccctgcagcacctcatctggtatgcagcaccacacaaattgttcatgtaatattttaaggccacagcagccccgtgcaagagcccagagctagacaaagaaaaaaatgggcctggaaatctttgggggattcactgtgagctacccaacttagataaagattatgagcagaaatttgatctgagagatcaacactaacagaactgaaaccagtcagccggcctaacttcaaatgaagaagagttgactttgaggttgctcttcagtttggggtactcagattttcagaacataaatccaggtcccagcagagacacagctgctgggggctgccagaggagagagcaacataagcacttttccagtatgggggctttgcaaatgagatacaactgtaaaatgctaggctgcactgtgctgatgttcaagatctcatggtagatttcaatggattattttagcacttggggataaacctcagctgaaaatctctgtagaggctggctcctccccaggatgccacttcacacctttgaaaagttacaaataagatattgacttcacatctggtttctgtgatgccttggaacccttctcactgctagattttcaagtgttatctgaaaatgggaagacataacaataccaatcaaaaacaaaaacatctaatcacagatgtgcagaattaatgcaaaagcaaaatgtatcttggttgtgggccatgggaacttaacaagtcagcaggccacagtgatacacgcataacagctgagcaggcaggactgtttaaactggccagctatcccaactggccaagcacctttcccctgctcatgtccagagaagcagttttcaaacatttctggctccagaaacaccctcactttcacagaaacatcatcattaaggacttaaaagagaccctgatgaggctgagtctaaaattagctaggccttcaaacgtgaatgtggtcctaaaattagacaggccttccagctgggcttgggcttgggcttgctggagcccacaaacaggaggggccgcctgacttccttcctgcctttccagttaattggccttgcagatcttcctgggactgacgctgcagcctctcaagggcagggaggcagagttaggaggctcctctgcacccaggtagggaagctggaggtgaggcctagctgtcttctcctcctacagtaatggggcagaccaaggagcaatcagagacttgctgagagaagcgggaccagcacccaggctggaaaatcataggatcaaggtataatcaaggagcacctttcatatgcctaaatttgggactgttcatctttgtcagtgtcttatgaggcttctgattgggtgtgaacattgtgttgtattagtgttgaaaagggcctctgatttactctaaccttctcatttaatcaagtagggtaaagaatacagttgacctgtgagcatgggtttaatctgtgcaggtccacttataggtggatttttttccaaccaaatgtgtatccaaaacacagcattcgagggatgtgaaacccacatatttggagggctgacttttcatatacatgagggttctgcaggatatacatggggcgggggcggggggtcctggaaccaatcctccaagtgtactgagggatgactgcagttttcttggtacagctgtgattagaagccaggtccccaggatagggttcttgagatagaaaaatccgtccttctttatcatcatcaggatatttgtgttaaaaacaaccatttcctgaatggtttctatgttgcaggtgccctgctaagcacttaatatccattatttgatttattcctcctcacagtcctacgaggtcatgctgttactatctttattttatagatgagaaaatggaggcaggctctaggccgtgaaacccagtgccacaaactcaccagaacccccgttgtctaacagcggattgtgtgttatgaaatgtcttcattctaggctttgtcttccttctccattttgtattgcttttagtttttattttctactttgtaaggttttactgaaataaggggttttaaagttctccatatcactgtctaccttaggaaagtctctgcagtattggaataacctcaagtcttctggagtttgcacagaatttcgtggcaatagaggtggactgcagaaattaagtaaaacctggcaggaatgctcagataggtccccctgcccctccccacccccacccgctactgttttcccacattcccccatcagctttgcctcaggaatagggaggtgaaatgcagagggacagactgaaaaatggaggtggggagtgtgagggaagggcagtgagttcagtctgagaatgtgtccttccaaagccagcccctaattcttgggtttggcaaaggccttgcggacagactccattcacttggcccaatacccacagatgggaaggcagcactaggcctaatctcagtatctgtaaaaatcgcctataaaaattgacaccagaggacaaggcttaatgaaccaccaacgaggcaatgatactgggccttctcctagggcccctaagctactttcctgcaaggaactgaccttgctttggtaccttggtgtccagaaagtgaatccacttccaaaaacctgaaattattctgagagagtactttactcctcctaaggattacatccagtaagaataatggtccttagtactcataatattgcttctcatctaataagcacttgagaacattaattagaaactcgatggaattcctaaagactggatggtgggaaattgctcctgcagtgaagtaccttcacaggcttagcgcagagcttctggcagccaaggaagaaggcagaattcctccttttccagccccaaactatgaagactttattttgcatgaaggccaaagggaataagctcatattaacatcacaaaacataacaaaatgcctagaaaactccttatgtaatgcaaagtaccagaaaggtaaatggctttatcaaccatgaattcctctgcaaagcgaatgtgacaaaaattcttcttgcttttccgaattgctgtaatatcaccgcactgttcaaagacttcttgaataatttcctcagtagcattttctggtaatcctccgacaaacacggtcttacacccaggaggtcgttctcttgtggaaggaggtggaagatctaataatcacaacaaaacagaaagttttatctttcatttatttgctttctctggttctcctggcaaaactaaagcttgcagagtaactttctccagactgagtgacggtaaatttctatgccaacttaacattgatcccaggctgtcttgtttctaagttcctctcccctcctgctcccaacctttactttctgtgttcattgctacacagagtggctatatgcttgtccatgaacaaagataaagcaaatgtttgcataatttcatttctcctttatactacagaagcccagaaaagggagggaaaaaacttcccaaagtacaaaacatgacgaaatgacaacatgatgaaaaacctcagcgtgttatctgctttgtcttgtttccagataaaggagcggcaaaacagaatacgggaagcataacctacaaaagcacgcacaatacttacttggctgtgaaacaccgggcctgaaaaaaaccactttgttattattcacatttaaatgagcaaactattaaattttgggaaggctgtataaaaagatacaatgtacactctcacaatattttacctagtttatatgtagattactaaagcaatctcctgaaaagtccacttaaaaaaggcaacactgattaatatgaatgacaaaaaaaaaaaaaagtcctagctcttttagcccataaacttagtatctgaggcaaaattaaaaaaataaaattctggcccatttacttcatcaaatgtatgtttccttcaagcaaatacaatttggtccagaaactctgagatgcaggcttccctctccccagcccccaaattgctaactgtcaaattaattccattttccatctagcaaaacatatttcagagtttttcacccacatttgtgaagatggatggaaatgctcacatatttcacactgtgttctccggcaaacactaggcttcactgcatgcaaaaagtcttaacgctggatacacatccctaaatcccacatactggctttatagtgtggattcagcttctggacagacacgtggccacatccctgtatatttattgtaacctagagacaaaaggccttctgtagaacggatccccactctgtgcatttacgtgtgagtcacatctgaaaatgactgcaatgccattttaaaatttaaaaagaaaaacatttaaaatgagcaaatatttctcataggcgttacttacttggattttgaggaaaaagagtacagcttttgcagtggattatttctttgacaacagccacttctgttggtggtgggggaggtaccagtccaaggcctggtatcattgggttaatgggggtgattccagtcatcatgttgaggcttggatcaaagcctgggacacagattgagtctgtaaagtatacaagataacattttgactggagattaaatccatttttgttgttgtttttgccattttcctgtggattatttgactttatactttctatttttcaggaatttctcctggcataagatataatattatagaaagctatgccagaagggtaaagagaaaaaaagtaaaagatgaacattaaactacatgaaaaggaaattatattacttaaaatattaacatggcagaaagaacacagcatattaaaatgtaaaagcatgcaccatgaagcttcactattactgtgaatgcaattttctatttcttaacgttggtgtattgtttataccaccttatgacccagaatatgggaagaatatcatttaacattgaagtgctctgtgaatctaattgtcaacgtggtttcatcaaaagagccttcttacccaagtgacctagatttaggaaagttcaatttatatgtgcatactttataatgatgtattcaggtcccacctaacctatttcccctggaataaaaaaaaaaaaaaaagcaaaacaaagagtgattacaattactatggctgggttagatacatgcaggcataaaattagctatatacatttctggcttctattggataattgcactttcttcctataatttagtcaacaaagaattgacccacccttttgaaatctttatgccctgtattacacacacacacacacacacacacacacacacacttgaaaatagaaagtgtgcaaaacaaatgggttttccagctttttttttttttagtgtgataatgaagcaagtgatttcaaaggtggcatacagacactaataagtaagacctttctaacagcaggggctatgaaaatactatactgagtagccacaaggggatcccgttcatgagggtttccctgttggcagaaaagtctcatgggtggcgtgaaaatgttcccagatagacaggccaggatagatcatggtgccctcctctactctgcaaggatgaaacttccttcttgtctcataccatcctatcttcttctccctcctcatcttacatcacttccagtcttccttcctgcccgccacccctgcccccgacaacccctttgtacagttctcctgtacagcctgtgccttaggcctccgcatggcctcactcttcgcttacctgtgctgaaaggctggaggagcccagaagcagatgtaagaataaccacacgctttgtttactaagaagctccagagaatacagaaggtctagcaaaagcgtttcctttctgggaaaaggtttacagattccgccagctactttggacatttccactcctcctctgggctgaacagaataaacaatgtgattctgatctataaccccaagaggactgctgtcccatttattaaaaactccatttaatttcatagtgtatcagtgtgacttcagtaaaaggaggatttttttttaaaagaaaagaaccctaaatataaatgacaaataagcattttctttcaaagtagtcaccctgacattctaggtacttcctctacaattatggctctcagtttcttcatctgtaatatggtactgtttgactggattatctcttggagtgctagaattccaagactccaggattccatgctgatgttgctcagtacaaactgacacacaaaagacttaaagttttataagtgacagagatgactctgtttattctgtcaatcatcagaaagtttcacaagtatgatttccattttacagaaaagaaagtaaggcttaaagtacttaagtaaaacttctaacattccaaatcaaacagatggcagagtcagaatgagggcccaggtctttgcctcagtatttaaacatgtattaaatgtgactatttcaaagtttccatctagaatgacccaacatgattactcatctaatacatgccactacttcttaaaatgtactttacccttaaaaaaatcaagatgggtcctgccgatcaattctaaagaagttccagaacagaatggttttcaacatcatcatcattaaaataacatattggcctccaaggtgaatatattagaaaaagaaatattggcaatgggaatattggcatgcttgtgcttttatttaatctcattccgtacatcggcttcatctgtttttttcctggcctggccctcgctattatttgccaacacaggatgatttaaggctgaaaccactcaggactgcaaaccctgaaatgagagccctgtgaattataatcagcagatgtttcccacaaatgagaagagaagcccagtgcttgcattctctttagttgttaacagacttctgttttctttctgaaggctaagtaaataaatatatgtccagaaatggggacagaagataccactcttgtacaacgtattttaatatacagcaagagttgctttgcttttttctgagacatcagtatgaggagactatgaggtttaatgaaatctgcatggcaagtgcagtagcttgaaaagagcttagaaaggaattaacacgtaaattatgttggacctgaaaggattggagattcagtatttgagaggagaaagtaaggaaggattagactttaagaaaaaaaaagaacccattacttttttaacaatatatgtaaagatggaaattgttttctctaacagcacaggagcatatgatgtactcgctcattaaagcaaacgcacaaactgaaaatcgaggaagacacaaacacaggaagacaaaggggagaaggcagcgcaacccgaagaatcagttccatgccctgttaggaaaagctgcccctgtgagcttcagagataatgagttgtaattctactcagcgcaaagaggaggactgcttaaatcacagcaagaaagaatccaattacgtatacagtagaactttatcacaactgtactgaaatgacaggaaggaagggttattcatcacagaccgtggccctgtctggctcctctctgtgttgccggctccaagcagagactggccacagccaaggctcggcaaaggtttctttttggttgtctgttcccagttggacgagatgaaaacaaacaaaaaaaaatcctgtttactgattcacaggccagtgttttatcaattggatgagcatttttcagaaggcaggttggggctttgtgttcaggattttagaggcatggcagttgaattaattaaagcactcattcatttgaattaaagatccattcagcatttcctgggcacgtatgactgccaggatctggagttacagaggtaacagtagtaagttccccacttgagtttgaggagaggataaaggatgggaaccaaactcagcaaaagagtcgggacacatgagctgaggctcagaggacacagagagagtccaggaagggaattgctgggagagagcctggtaggcctggggaattccaaacaatttttcatggctctttcatggtgtgcatctggcagtgtggccacaatgtctggagagactgcaggaattagatcagatcagagagaccctgctgttcaagctagtgaatttcaactttgctctccctggaactcagagtcagagatgcaccctgccaggccagggctccggtgcctgggccgcccttcctcacttcttctctctttgtctgctgcccgctagccatgccttgctccttttctgccctttctagtcaatgcctcagttaagagtctcatatttgagatgagaactagatttcatttgaaagaaaggcagttgaggcctcttgccaggcaaggctgggcatactaactaggttaggtgtgggcagggaggagggacagagagaagttgtcagtactaggaacaagtctggtctggaaggaagaacatagcgttttaagaaaataataagagaaagaggcagtaatcaggctaaatggctgcattacaggtgtagtcctgggctgagggtgtcctgacaaagtggctgaacacagagattattagcgcagataaaacacaggtccaggtggggcagctgcccagaggactctgtctacaggtcacagggcctgcaccccctggtccagggttcagacccagcccaggggaaataaagtttgcaggaacatcatggagtcataagttgagaaatactaggccaattggcaggttacctaagccaggattcaggcaggagaagcaagacaggattcagacaacaaaatagaagcctggggtttggggaaggagatagacccctcagttatcagatacggagcacaggtcacagcctgaccagcataaagcctgcttggatgctgagtcttagaatgcagggctccagagcccccttcctcccgcctgacgccagatggaccctcaagtccagggacagagtaagtgtgtggggccaggtcccaggacttgtgcagggcacagagacaggctggaagggctctaacaaacatgcaattgtgctgcttctttttccagaattactgggttaaaattactgacctatcatcactctgcagagaagccacgtgatacctgaagacattctgtttaccagaagtttccagtggagaaactttttcagaagtctcctattgcaattgacaagtcttgttgttctataatgtcattgaatttgtaaactattaaagtaatgctctttttcattccatgttttcttttttcaagcattcttaaaaaactgttttgtgaacagcagaggaaaagtgaacattttaaaaaaggtgatcttaaagtcaagggatctggcacagctggatgacctaaggctgaccagctttttttttttgacatgagtgttgcactgtcatccaggctggagtacaatggcacaatctcagctcactgcaagctccgcctcctgggttcatgccattctcctgcctcagcctcctgagtagctgggactacaggcgcccgccaccatgcctggctaattttttttgtatttttagtagagacggggtttcaccgtgttagccaggatggtctcgatctcctgacctcgtgatctgcctgccttggcctcccaaagtgctgggattacaggcataagccactgcacctggccagctgactggctttttaacctctctgggcttcagtgtcttcaccaggggaaggagaacatgaatactagatagacatactggtcttcatggtcatccaagaagaacacctgggtgaaggcagtatatcaaagtgtggagacctcaagtctgcagtcatgcactggctgtatgactttgggaaatttaactaatcattctaagcctcatttataatatctgtaaaatgaagagaataatatttaccttttaatgttcttgtgaggattaaatgggattaataaaacaaaaccaaagtgttcagcataatgtccagcacatggtaaatactcaataaatggtagcaattacatacagcattaataaacattaatattatatagaatatttacataaccttatataaatatgttagtaacatagcagacacacaatcataatgatgattacaaagtctttcatttgacaaacatatgagtgcctactaggtgttgagtgttttgctaggtactctgcattcaaagacattgcaatgttcttccttcacagatgtggaaatctagtgactgaaacaacttagcagaaaataccaatacagtaatgacacttattttgagacatttaaataaaaggtgctatgaaaacactgaaaaggggacatctaaacccgtctggcatagggtttgtaagagttgacttgtgtccccccaaaagatatgttaattattattatacttttaacataagtcctaatcccccatacctatgaatgtgactttatttagaaatactgtgtttgcagatgtaatcaagataagattaggtcatactggattagggtaggcatgatctaatatgactgctgtccttataagatgaggagaaaagacacagacacacagggagaatgcaatatgatgactggagagatgcacctgcaagtcaaggatcacccaggatagccggcaaacaccagaagctaagagaaagacatgaaactgattcttccctggatccttcagtgagaacaaggccctgccaacagcttaatttcagacttttggcccccagaactgcaagacaatatgtttctgttattttaattcacccagtgtgtggtactttgatacagcagccctacctagaaaacaaatggggttgagggtggggggtggggtgggtgccaggggagtgtcagggaaggaatcctggagggggtgacagctgaccaggttcttgaaaaggatgacatctgtatatgcaatgggcatgtaaaaaggtatccccaaaatacacttattgggatcctaaatacaaagatatttctaaatgttctcttaggagaaatgttcaaaaccagtctcctggaagcagaatagctcttaggttttccctttgtgaaataaacaaactctgaagatggttacatatttgttaagaacaaattaaccacacagattatgttaacataacagaatactttacaaggtgagtgaatgcctacaaaccagatctttaagaaagtgaaactgaaaatgcttttgtaatctttccaaagagtttcaaaggcagtgaggtatgtttttcatttaaacctaagatgtgtatccagagtgagttcctggtgcctgccgtgcacactttataaacaaagacttcattccatcaataaaaccctctgtctcctttgaccaggatgcaacgctggcagaactgaggaatgcagctgtcaacagctattctaagtattgttgacttgggtgaggagatttgtgtccatgtttgaaaatatgacatgacacgaagcaaagagaatttcaaaactcctgaccaaagctggtacagagaaaaactgactgctcaaagaactccatcagatctttccagcaatctgtgcatggagcgtgcacttgaaaagcaagtgtgttttgagtgagcaggaggtaagcgctcatcacaggttctgtaaaattcactcacactgtgggccaggaactcaagggcagagcggtttctgtgcagaggactgggctgacacagtcagagcaagctgctccatgttttctggacctgctgaaacacactcttaagacacagtgggcctcacagctgagccatgaaaaccatgctggcatatgacaaccaggtgtggaggggttcattttgacaagcaggcaatggacactggccctaaccaaagattaggaaatttcaaagcagaaagcaacctgggcattacctagtcctaccatcttgatttagagatgagaaagtggatgcccagagaagtgaagtgatttgcccaaagttacacagctagttaagaggagagctggaattagaatcaagagtcctgctgcatcttcactgtgcacctgagttctctgtctctccagcatgccttcctttggatgcctctagtgacactgcactcactagctcctgacattgcccattcttttttttttaacagttttcaaagtgagaaatttatccctaatatgttgacttcggacttgataacctgtagttaaatccattgtctttattcagtactcctgggttcctgtaacaagtctgattctctttcccactgttcctggtcaaatccataaagaaagcacacaacaatacctgaaccttctcccagtcagcctcagcaccctcttccttcagtccttccatgaactaaaatccaccttttctgacatctaaaaattctaaaaacccaccttttctgaggtccagggttatccacagaaagagaccaggaagaagctgatcaacctattaatggtggtctctatctttcttagttctgaacttgtatgtataaattttagtaagttgttacgttacgattaaaaagtaatggtcatgtttactccttgctttgtgacaggcctgtgctgaaagcttcatgtcatctcatgtcatctttttggcagtcccatcacaaagttgacaaatgctaagtgacctcattctactaaaacacacacgtcttgtctgtctgcagaaggatactctcatgcaactttgaagttgacattttgaaactaaatgaaatttgcattttccgttcagttttccaaaatctgtcttcttagttctcctcctgtcttgaatttctcctcccttgtcctcaatagctataatggctagacaaccctctcttaaagttcctgttccttctaattcaccagcaaatttcttcttgcaggacagattcagccacagagggcaaggagatcctcctgttgccacatttggaaggtgaaccattagctgccttcctggcagatgcctactgggggtctggagcttggaggtgacacatggagcatgtcctcctccacttcctccctctgtccaggtagttgttgttttgctctcaccacagcattatttctgttctttcccctctctaccttcaccccttggtgtgcaccaggttccctgcaccctcaggtttgtgaactgtagcacgtgcttacagaaatatcttcttgggccgggcgcggtggctcatgcctgtaatcccagcactttgggaggctgaggcaggtggatcacgaagtccagagatcgagaccaacctggctaacacggtgaaaccccatctctgctaaaagtacaaaaaattagctgggagtggtggcgggcacctgtagtcccagctactcgggaggctgaggcaggagaatggcatgaacctgggaggcggagcttgtagtgagccgagatcgcgccactgcagtccagcctgggcaacacagcgagactccatctcaagaaaaaaaaaaaatcttcttaagcaaatcttcttagactccctccccaacactgatttcttctgaatcctctgttgtaaatttccagttttacgggccattgccaggtctcagggatgtacacagggttaccgtcaattccttaggctggaagctcatgtgtactaagttattttccctgctccctctcactcatttctccatcttgtctgaatgtactccacagcaaactgcttacaggattctgggcatctggcctactctactcctgttagacacttttgggttaagtaactttagggcttggttgtttcttttaatggcaccactcctctcagtcctggtttaaaacctctataggtaaccacatctagtgacctgccaaaccctttcagatggagccactttagaaaggatttctatatcattgtcttttttgttcccattgctaatttaggtcctcattcgctctcatctggagtactgcaaaggactctttttgtccccacaaactgtagcttctatatcccccctgtccccaccccctcctgcccttcctccctccgcctcctccctgcatgcccttctcacacccctggaactgggatcagccagcgatgcacacgggggaaccatgagaacaggccctaattggggcctctaaattacttctttcagacttcttttcacatccctatctcattagccgatgattaattttctttctgtacgatgttatgtgactttgtacagcaggactgttatataatgatagggagggagaaaaggactgaattggctcttggtgttctctgctttgtcctagctgacaagcttatggtgcgggagcagacagtaggggcaaaaaattattaaatattgagaaatatttttgaacattcagtcaagcccctaagaagtcgctaatttttatacatctacttctatctttctgaggagtggggacactccaaatatatgttgaaagactaaataaattataatttctttctggcattcaatgcctccttgctctatagaacttcctctttatttgaagtcaggtaatagcctggtgacaccatatagatataaagcccactatagtcagtatttataacagcagagatggtaattcacagcatgtaaatgtctttataggaaacttccctttgaaacctgcatctttctgaggcaatatgcaagtgttaaccttttgattttatttatcaaccttcatttctgtttacaaaggcatgtgagagataggtaacgtctcataaattttaaaaagaacaaagaaaaacattcaatatttagtttcaaagaaaacattcacatcatattaaacaatttatgtaggtttcaatttaaacttactgcttgaagggactgaaacaacacagaactggtctgtttaaataatatcagtatatagctgtagactgggagagacaaaaatagagcctgttttaaaggtaaacacatcatgaatattcctaaagagaactgcaaattgtgtgtggtctgtaaatcatagactgatctaatattaatttaatttttctactagactgtgtgggcaaggagaacgggtaacataactatcacttatctcagggtccaacatggctcttggcatatagtatcctcttcaacaagtatcagttaaatgaaagaaagaaattataaaatttacagaatttacagagttcatcctaaagagacaagacaaagtagtatttggttgttgagtccacaatgtcacaacataaattcatatatgattctaagcaaatgacatgtggtattctttctatttgtcttattaagtgaatagtaagagccatgagggttcttgttagttattcctttattatagttggaaaattatggtgatgatgacttacatttcacagataatgaggctaagaggcacaaggaatgaaggtgtgttcacagaataaatggacagaattggtctttgaatgcttgttaatatggcatctggaaggcagacctcatgcttcccttcctttctagctacaagaaaccagacctgaaatcaaaggataacacagaggggcagtagggtaagtatggtctcatctaaatccacacaaggtcatctcataccacttagcttgggagtgcttgaaaaattcaggacaggaacagggacaggagaggacatcataatcccatgcctcaggggaatactacaacctaacaggaacataactgaaaggcaagctaaccaaaacaagtttacaaaagaggcaaaaataaaatttcactcatctgctattaaaattttaaataggaagcataaaccatatgaaataaactcaatcttcacttctatattatggtgaattagtgaattaagggaaaaaggaaatacaggaactgtagattctgagtagagattagaaataaaaggaagaaataaagttgaagatgaaaagaaaggaagtaagtcagagggagagacagcagcagacagatggagggaccgtccgagttctagttcaagggtagactaacagaaactgtgcctcggttcttcatctgcaaaaaaaaaaggactaaaaagagtatttaccctgacagcattgttctgaggattagtgttacgaattaaaatatgtacaaggcttcaaagactacctggtacagagtaagcactcaacacatattactatcactttgataaacattatatcatttgtgtgtgtgagtgtatgcatgtgtatattagagtgtacatgtgctacaagactgctttcatgtccttcctttaaaaaaaaaaagcatatcctacttctcggtggctttttaagttcatgttttattatctgtcctaacttctttgggtggaaaccagaaggccttctaggaaaacaactgaggagacagtgccatacagtttctctacaaaagaaacttctccaagggaaatcagaaacctcctctttcttctcccccaggacctaagatatttttcatgcctggaaatgagagttgcagcattgggacctgtttcctctctgctttttctgccaggaagattaggtgttgtacccgacacaccaactgcacttgttcctatgtttggcatacccactttccccttaaactgagttttccctttgtaattctattttattcatccaaatgattatgtctattttgagcttttttacccacacacatacacatacacacacgtgtgcataaacacacacacacgtgtctttttaataaattaaaactgagcagcaccagacttttaaaaatacttcattacatccgaggccctggccagatttacttatttacatgttgttttgcattttaatttagaaagcaccaatgccaacccatactcccccatagcttgtcatttctgacaacatcctgagtaattccaggggcgaatttttcagagggaataatttaactaacaaattgccatttaaaactaatttatccttttgagctgagtgcaatatacttggaggagcattccttaatgacttgtttggataatgtttttctccacagtgttgatccctcaacattagaaactcagagagttaattcctcacatgaaaaacataccccaaacttttcttctggaaaggtcaagatcaaaagcagagactatcccccagatttttcattttctcccttcccttcccctcccttgccttcccttcccttctctcccctcccttcccctcccttcccctcctttcctttcctttctttcgcagagactatcccccagatttttcattttctttccttccttcctccctccctccctttctttccttccttccttccttcttaatctttcttttatcttttcttttctttttttttttttggaaacagggtctcattctgtcacccaggctggagtgcagcagctccatcacagctcattgcagcctcaacctcctgggctggagtgattttcctgcctcagcctcccaaatagctgggactacaggtgtgtgccaccacacctggctaatctgtatattttttgtagagatggggtttcaccatgttgcccaggttggtctcaaactcctgggctcaagtgatcctcccgcctcagcctcccaaatgttgggattacaggcatgagccactgtgcccagaaaggatttttcattttcaattaagtattttctgcccagttataacttcaaagaacgttaggtacttcattcaggggtctatatttcattcttattcacagaagcatctagttttgaattgttactatgcttttatgcagtgctatgttttcaaaatccttttttagtcatttaaaaagctggtcctcattatatctccaccagattcttcctcctccacagatgaaaaaggaagttgaggtttggcagactgaagacatctgcccacagtgtcactggaatcacagggaaataggctgtggtttacactatcctgctggggatgaaaatctacttgtttgtagtctccagggtggtaaagagcagagggggaaaagcaggatgcacagtattcagggtttagctgaatgtcaagttcagcttcctcatctcagatgtgaggctgcaacctgcctatttacttcacgttgttattatgagtgccaaactgtatgatggacgtttatgtgccagcaatttacaaacaagcaatcaatacacaaatgtaaattatagtcagcattttttcctattttggtggcttctgagactctacaatggtgctaagtgcccaccttgtccagaaagagaattcaatatattcagtgtattactgtgttttaacaagtatacagaagtgtgacaggtgagagggacagagggagaaaaagaacggggcggggggtgagtgagagagagagagatagtgtctatgtatgtgtctatcctcgatgcttgcaatccatggttctcagcagaactatgccattctccatgttagggtcagccagtttttatagttggaaaaactgagaagcagagtggcatactgccctaggtccttctgagatatttgctcattcaacatgtattaattacgtacaagtttgctaggcaagacgctgggggcatagaggtaagtcaggatccctggccctaaggtgcccccagtccgtggtgatgcagatacctgggcacatagctgtgttagaaagtggcagtgttattagcaaggcacacaaagtacctatatcatcatcctgaaaaaagcctgaccatactctgaatagtatgtggacttcctcagtgaaagtatctatctagctaagccactgtatccccaaagccaagcacagagcattttgtaaatacatacccaggtcagagagtggctaccccatgggccccagccacactttcaatagcagtcatttttcctgcatttatcaaaagacattttggaggcagaggattgtttggtgttgtattatttatctttatctatattattatttacctttctcctcttcctaacacaggaacattccagatcggtaggcctcttgcaagctgagtctataccaaaagtgcacacgttgtggaagactgaggttataaaggataaatctgtcacagagacagagtacaagggctggctaatctatatttgcttgttgtaactgaacagggaatttacatttgccagaatagcagaaaagaaatattagcttggacattcatgcccttattcaattatttttttttactataaccaaaacagatcttcatgttttttcaaatacatttggtcagtcagtcaaaagaatttgaaaagcatatcacaagtatttaacttccttctatcagagagtgatgggacagagacatgagggaagtgaatcatttcagcataaagcttttgttaaacagagctaagttaaactgaactaaaatagaataaattggatgtatgaagtgtgtattatgggaacttatcctgagacctcttctgttcagtgtcttttcttgatgtcttgaacaaagattgctataatacactcactaaatactcaccatcatcaagttacttgtgttgaaggcatgtcaggtgctaagaacacagaaaggttgaagacaagtgtttaggcttcacgcttcaagagggacaggaactttcagagtaaattaaagtgacaaaaaagtactttaagttattgaaaaccttgctaaaatgaaattaaagagctgaaactctacccagagttatatgactgacacagtcacagcagattataacagaaagtcatacatgtaagaggtaaatcctaattccacaggataatgtcagagaaatcaggtcctatgaagcatccctcacactgttccccttggccaccatctgtcaagaagtggtaccaggccagctcttgttattaccataagaagcagagagatatgagttgggaggatccaggtcagatggactcctaccaacctcttccaattgaaatccgggcacttctaccctggcctcacccctccacaccttgcttggctggcctgccttgcactggcctcacctgtgaccatgcactccagctacctcttggacagactttataccagcctgaccagaaggttttcttagctatgatgttcactgcccaatttttccttttgtccctgctatagtctgtattataaatttcatggttagaaatttaatgttgccaagcattaagaggtgaggcttttcaaaggtgactaggctatgagggaggttatgccctcatgaagggattaatgcttttaccatgggagtggattagttattgtaggattgggttagttattgtgagagcgggctcctgataaaaagataaggtcagtccccactctctctctgtctcacatgcttacttgcttttctgctttctaccatggaatgatgcaacaagaaggccctcaccagatggctgagcagatgctggcaccatgcccttggacttcccaatctctagaaccatgagccaaataaatctcttttctttataaattacccagtctgtggtactctgttatagcagcataaatgaactaagatactccccacctcacatttgtgattgttttggatcgttttcccacgaacaaaactcctagatatgatccttttttttcttgagtgaattaccctctgagtaaaaatctagcctttgggactccagatgaattgtggaagaaggtatgggaaaaggtagagtaattattttaaccaagtattataggcgccaggcaaggtgctaggcatttttgcataccttatttaattttatcttcagtacaacaaagcaagggaagttaagatatggagaaagtcaagtgtcagctagaagcagaagagtaggaactcacactcaggtcagttctattgcaaagctttttttgtctcaccagagctgtcaatgataaaaccctaaattggatggattatagggtctggccagaacacaggacaagatggatctttagctggtaaacaccagtatggccatatcactgttttaggccagcatctgttctgcttggtcagtgcccaagacctatcatttgttaaatatttaggcatcattgttgcccatctcaaaatgaaatgtttgccaaataccaaatgtttgacttttactctggcaaggagagagtaacagtgactggatatggtctcccacctgaaacaactaaaaagccagataaagtatatgaaacatggttttcagatactgggcatgaggtaatgcaagacaatgattcatgaaagaagtaaaacaaagtgagccatatgattgccccagcttattgccaggagagtttccgggctacagcacagggaagaggaactctggaaaagtctgacagtctctctgagtaaagaaatagttggtagtttaggatggcagcttagagttcatagggtaaagtaccagagagaagagaatagcacacatgtgtgcacacaaacacatctctccctggagatataaagcaagtcttgagttgagaactaatcagtgtatgtgtgtgataaaactacactaagctaaagaaagaaacacccaaaaggtttagaaggaataatccataaagattacaaaagactattctcatcagttagagtagaaaagcctcataattcatgatgttattgggtagaatactcagaatggtatcacctttgtagtaggacaaaactagccctagacaaaaagctgctgtgatctctcataacaaaacttaaaagcaagcctcaaaaggttcaactgcttcccagtaacttaaatgggtcctaaaataaacttcacggatatgagaatacaaaaatacccagcacctagcaaggtaaaattcacaatgtctggtaaccaattaaaaattaccaggtatgacaggataattccaaaacctctgaatatattattttacatgtcaaaggaattaaggatacagatgacattaagattgctaatcagctaactttatgacagattattctggattattgatgggggcacaatataatcacaagagtcctaaaaaggggaagagggaggcagaagagaaggttggagtaatttgatgtatgaagaattcaaccctccattaccagttttgaagatggaagacagcaatgagccaaaaaacataggcaacatctagaggatggaaaaggcaaaaaaacagattctcctctggagcctccagaaagaaatgcagccccgatgacatattgattttagcccagtgagatttgcatgagatttccaaccacagtactacaagataataaatttgtgttgtttttaagccactaagtttgtggctacctgttatagcaatagtaaaaaatgaataaaaagagaaattacataccaggcatacaaagaagcaggaaaatgtgaccaataataatgagaaaaataaaacagtagaacaaaaaaataaataacacatagatgacagaattcgtagacaaaaatattaaatattcataactgtgttccatgtgttcaagaaggcagaagggagatttaacatattaaatagagagatggaagattaaaaacagactcagaatgtacttgtagggatgagaagtacaatgtatgagataaaaaatatactgtatgaaattaacagcagatttgatgatttatttaaaaagttagtaaactcaaagaaaagcaatagaaactattcaaatgaaacgtggagaaaaaagacaacaacaaaatgaacagaacataaaagggctgtgggacaactgcaaggagtctaagatatttgtaattaaattacttgatgagggtggggcaagaacaaatatttgaacaaataatggctgaagattatccaaatttgatagaaactataagctcacagatctaagaaactcgagaatagaaggcacaagaaacatgataaaagtatatgagggaacatcataatgaagttacttaaaatcaatgataaagacaaactcttaagagcatccaggaaaaaaagacatattacatacagaggaactaagataaaaataagagtatatttcttgttggaaacaatgtaagccagaagacactagaatagcacctttaaagaactgaaattaaaaaaaaatcttttctttaactttttctttacccagtaaaaatacctttcaaaatgaaagtgacagaaaaactttttctgacataataagctgaaacaatccatcaccagcagatctatactataagaaatattaaaaaggaattcctctaggcagagaaaaatgatgagctgtaaatcttgatctacacaatggaataaagaatatcggaaatggcaaatatatggttgaatagaaaaaaaaaatttttacttatttttgaactctttaaaaaataattgcctgaaaagagcaaaaatactcacaatgtattctgggtttatgatatatatagaagtaaaatataagacagcaaacataatacaaaagtatatagttcttacaatatatatgaagagataagccaacaaaggagataaaattgaaatcataaagatactaagtccaaaaggtggcagacaaatagaaaattggaataaaaaacagaataaataaaatcaattattaagattgattttaacccaatcacactgataatcatattaaatataaacagtctaaataaatatccaaaggcagagatcaatccaatatatcagattggatataaaaactatatgctacttataagaaactcacttttaatacgaagtcataaataagttaaaaataaaaggactgaaaaaaatacaccatgctaacattaatgaaaagaaagctggaaagggggcatgctaatattaggaaaagtgaatttcagataaaaaatataattatggataaatgagtcatttcataatgataaagaggtcaatttaacaagaaaatataacaatcccaaatatttattcactgaataacagaacttcaacatatatgaaataaaaactaataaaatggaaagctgaagtagatgaatccacaattaacagtcagaaatttcaacaaccctctcttaataattgctagaacaagtacatagaaaatcagtaaggatataaaaatctaaataatatcaaccaatttgacctaactgacatctatggagtacttcacccaacaaaaccagaaaacacattcttctcaagattacatgggtatatttatcaagattggccatattctgggcataaaccaaaccttaataaaattacaaaaacacaaatcatataaagtgtattctgagaccacaatagtattaaattataaaatagtgatgaaaaatatctagagagtcaccaaataattagaaaataaataacacatttctgaatagcctgtaggtcaaacaagaaaccaaaagggaaatttagaagtactgtgaattaaaataaaatttcatgatatgcagctaaaacagtactttaaaaatgtttaaggcactaaatgcttatattagaaaagaagaaaggtcttacatcaatgaccatggcttctatcttataaaaaaaaaaaaccttaaaaaaaaaagagcaaattgagcctgaaataagcagaaaaaaaaattaagaacaggaattagtgacatagaaaaactatagagaaaatcaatgaaaccaaatgctagttctttgtgaagatcaatgaaattgataaaactccagccagccttaggcaggaaagcagagaagatacaaactgctaatattagacataaggaatgtaacataactacagttcccatacataaatatcaaggcatattacaaaaattgtatgtcaataaatttaacaacttggaatagatttcttgaaaaacacaaattaccaaagctcattgaaagaaaaacaaataatctatatagctctgtatctattaaagaagtagactttgtagttacaattattcccacaaggaaacttcatgcctagatgactttgctagagaatcctactctagtagaggttaaatcttaaggaaaaaataatactaattctacacaaactcttccagaaaattaaagggtataccttccaatttgctttatgattccagcattacttttgttacttaaatcagataaaaacattagaagaaagaaaaactatagacaatattcagcatgaactttgatgcaaattctaaacaaaattttagcaaattgaatatagtataatgaataatacatcatgactgagtagtttatcccagagatacaaggttggtttaacattaaaaagtaattcacgtaatttaccaaagtagtagactaaaaaagagaaacacacacacacgatcatctcaatagatgcagaaaaagcgtctgatgaaaatctgacatccattctctcagtaaactaaaaatcaaaggaaatttcctcagtaaaggttatgtactttaaaactacacatatgatcatacttaaaatggtatttcttcataaggtcagaaacaaggcaaggatatccactctatttctattcagccatcaggatatatgacaacatgcgtgactttcagaataactatattgagtgaaagaaaccagaaactgagtacattctataggtttcatttacataaaattctggaaaatgcaaaataatttgtagagacagaagatcagtggttgtctcaggatggggatgagtaagaaagggggtctgagtaggtaggaggaagagataacaaagggaacaggaaatgttttggtgtggctgatatgtccattattttgattgtgatgatttcacaagtatatacatatgtcaaaacttatgaaattgtagaatttaaatatgtacaatttattgtatgtcaattcattaaagctataaaatataacagatactttaggtcataggtaaaaacgaaaacactgccacagtgaaccaagctatatccagccaaggtcttggtttcaactagggaatgcatgataggagggcatggttgtcctccctggcagcaacttaaaagcatcagatatgcatatataaagctttttagtttcctaacaagagatacttaatagatctcaaattaaacaaacacagccagttatatgccaattctatagttttagaagtcagcaagcagcatattggggattatggatgaactgaacaaaatctagcataaaacatggtaccagacctcaaagggttttgaagactgtcgatgatttggtagagtgatgctaattctcactctcaacacaatccaagcgaggaaatttctccaaaataagataaaaacttgcagggttttaggtgtcattgtatatctgaatttactccacagaaattcttctcccaacttgttaaatttcaagacttctccttggagccatgagcagaataagaaaaacacagatggctcaacttcacggtaataatgattcaaggcaagcaaaccttcagctgtttatatttcagattaaaatagaattgaggagagaaacatcattctgggtgctaaaatgaatattaagataaagctagtgtaagtattattaatattgcactattattattttgggtttgcaatccataggaaatccatgtatgcttctgtttgcttcccttacaactggtattttaaataaattctgcatgctcaataaatagggtctatttactcaaaggcgacagaccccatggtactctccacaaagacttccctcatggcctcctgctgctgttgtttatagggctgcaattacagaaaggattctcagcagaacgagcaatgacaccattaccatcaacaggaattctcctggcactgtggagattctttattgaaagaaatacaaagccagtatgttgctagtagaatgcatgaatttgttgggcaatggctttctccttctggacaccaccctgcaggttaatgactctcaattctgagcatccttcttctctccttccagcaggtgttttcacacctttctaagttaagtgtcccagaatgtaaaggctgccactacagggaggcagcaggacacaatgcatgagactgatcggcagtgaagccggactgcctgtgttcacatcccggctgcaccactcactaacagtgtgacttcaaacagattacttagcttctctgtgccctggtgtgcttattcctaaaaatgaagtaataacagcactgatttcactgggtgaggattagataaggactgagatgcttagaaaaatgcctggcacatacacaataaatgcaagcaattattattattaacacagctttgttgacacaataacatttgtagagaatgaatgacagcagctactctaagctgcctccttatggcaagcacagtaggaacaagaaatagaaatacttcctctaacaatgcagcaaaatcttctgggagagagaaccatacaagaccagcctattaaataacaataattatattaataccacccattactgagtaccttctacacactgcagtgtgtaaaatgcatctatatattatcttattcattcccataaccccatgaattagatgatataacttccattttccagataacaaaactgggactcagagaaattaaataatttccctcagttcacgtggctgagacaaacatttctgaatagaactacctggctcttagccaggtttttccgctatgccatgcaccttttcaacccaaaaggtagtggtgtgttctgagcaaaggcattcaggagaaaacaaacctgtcaggaggcagagtttccaacagcacactgtctttgaaactattaaaagaatagtcttaagtgctgctgggtgaaacaattaaaaggatagtcttaagtactgctgggtgaaacttgtcacacctgaacacagagatagcaatcctcattgctgggtcatctctcagtggcaggataatatacttgaaaggatgatcagttgtttcctggttttttccttggcccctactaggtaccctgattcaaacaaggctgttcattggttagtttctcagagaaggatattgtgtagaaagctcagggaaaaaaaagtgtgtggtatgttggcatcatggcactactggaactggaaggactgtggcactgggatctagtggtgggtgccccgctttctggatggcagggaaaggttctctgatgcttaaatgagtccttttttctgtacatttgggatatttcataattaaaaattaaaaagtaattatctataagcaggagaaaattttatcttataatatcaataaataactcttagaatactctcaagattaattttgagaggaaacttataatcattaacttttatattgagcaacaattctataaaaacacaacagcctaaatcaattcaaaccttaaagtaaaaatgtttgcaacatatatgacctattttgtaaaggggcagaatccacaacaaagaaccctagtaaatcaacaagaaaaaaaaatgtttcaacagataataagtaaaaaacaaaagggaaatttaaaagagaagaaatagatatggtaaattaagatttggaaaagttcaaataaaaacaagatatttttcacacattagcaaacatttaaagaaacaataatagtagttttggtgagaatttgagggctgggctaacaatatgtgtagctagcattcaaaaggtatttatttacatgagaaaattttgccattttttcttcactggtaagaaaaaatgataaacaaccatatatttggaatgatatcaactttttaggattaaacacattcgtttatacatttgtagaaaaagaaattggaaggaaatacatcaagacacatgtagtggttatttctgcatcttcaaatgacaatttttgctcatttatacctttgtgtattcaaatttttataataaaattacattattaaaactttccttggggccgggcaccgtggcccatacctgtaatcccagcactttgggaggccgaggcaggcagatcacttgaggtcaggagtttgagacgagcctggccaacatggtgaaaccccatctctactaaaaatacaaaaattagctgagtgtgggagccggtgcctgtaatcccagctactctggagcctgaggcaggagaatcaattgagccttggagatggaggatgcagtgagctgagactgttccactgcattccagcctgggcgacagaacaagattctgtctcaaaaacaaaacaaacaaacaaaactttccttggtacattctaggttctttaaacaacaacaacaaaaactctttgatggcaaatggaagagacaggattcatgttacacatccctctgtgtccttacagggatgtgctgaggatgtatgaaatttctttgtaataatgtcgttgttttcccaagagcattatttaaggagaatggacaggtctatgggaaaatttaactttgtatagaatgatttttaggtctaaaaagtctagttcagcctgggaacactcttctatgataaaggaatgaaaacaacacaaatcacaatatcatattaaggtgattttcctaaggaaataatgtgtttgacagctgctccccattcagtgtatctgtaagtgaagagagtcaattgaaactaatgttcaccaaagaccacttttagccacccattgttgacttggatgtaaaatggtaagcattgtgtttgaacgattaaaaaatcagaaataaaattactttttgatattagaatctaaatggtccaagaatatgattgtcttggggattctttttgagaaattaattttgacacttcactcactttataaatagaaatttctccttggttgttttcttaacatgtttagaattgatgctaacacactttagtttattcattgcagccaacttttgacaacaagctttcaaattctggagtttaaatatcaaaacttgacgtggtaacattatagaaaaaagctagtggaacacctttaaaaaaatggaatgttgaaaaacaactccaatgaatttagaaatggcagaggaaaattatatgagaagatttagagtcctctaaagcaaatgatttattgaaatattttttcccccagcaagtattaataagtaccttccatatgccaggcattgttttaggaactggagacgcaactttgaacaggacagacttgcttcttactttctggaagcttacctcccagtgaggattgatagacataatcaaaaggtaaagaaagaagttactttcagattgtgctaagtgccatttacagggatgtaggagagttacctggggtgagagaggagggaggaagccgtttgattggttaagatggtctgtctggaaaagaacttttgagttcagttcctaaaaacaaggagctggcctgtggtgggaagatatggaggacgagattataggcagagggaagagagggagcaaaggcctgaaggcaagagcaaacctagcatgtttcagaagtaaaaggaggccagtgtggacagagcctggtgggtaaggggtacagtgacagatatgagattcaacaggggattcccaagggcctcctcatccccactactcaactggataactactgtcttttatgcctattgactttctgcttgaacagtcatttaaaagtgttgaaaggtgaaaaagaaaggtttaaaaatctctgtagttttaattttattctgattgctagaggagatatataaacatacacatgcacacacacacatatataaacatatatacacatatatgcataaacatataaatatgtaaatgcacacatatatacatatgtaaatacatatatatacatatataaacatttatagatacatatgcaaaaacatagacagacatatacataactggtgttttcgaacatttgacaaggattcatactagagaatcagtggcatagaaattgcagtataggaggtaaaattggatattaatgtttggaagtacttcagactgctcaggaaaagttaaccataggtgggtggaagcttttccccagctggagaagctcagtatgtcaatgaaaccggaggttactaataaaaacacatgaatgacatgaacaggtctattctgaaaatagcagagttggaaaatgctaacgttagagacagagtcagtaacaacaatgaagcctgccagattggtgtcacttaagagacatgatctaaatagaaagaaactcaacccattgcatgaggatgcttaagttattttgtttgaagagaaatttatcttgctcagtggaataagccagaagactaaacaggaaaagaccattagggaaagatacccaacgagcaaatcagaacaatatgaaaaaagtaatatcttaaagccacctatattaataaatttggtttgcctgttcagagttctaaaaatgacttgtgaggggagagtacagtgtttctttgtactccattactctttggggtaaaacctgtttgacaactcagttcaacatgactgacagtattaatcatgcacctatatgtggctagcactgcactaggaagtgtctctgctcataaacagtgaaacctactaaagagaaaaggcatgatgttaacaccacctgggatgtggagtgtatccatttcacaaaatcctatcagcagagcaaataatgggaacaaattgactacaggccagggtcaaatcctaaggtaaaagcagtaactgccctcgggtgggtaggagagagcatctctgaaattggccagagctaccagggaaggctattagaatgaagtgggacttgaggctgcccttggaggagctggtaaaattttgataggtggagaggcagaggaaggtgtctctgaatcattaacagctgaacaagagctgttcaatcttatccaactgtgagtctggaaacactgcctaattattaactagcaggtgaaaagaacagaaaaaaaaccactggtgccactgccaggcttccatctggctgtggtatcatcaggaggcccttaaagttatagttcttgggcaataagaaggcagcatcttttactaaattaacaaaattaacttactaaataacaaaagtaattttaattacacccagatttagcagggaaactaaatagcaaacattcaagtaagtgtctctgttgataagcatataactagaaacactcttttggaagtaattttgtgatgtctcaacagtaactaaacgaccatgtcatctgttgacctggcaattgaccttaaagaaatagtccaaatgggaaataagaagtcaaagatactaactgcagagttattgatactattgaaaaactggaaacagctcaaagactaccaacagagtagtcaaagtaatggaagcagatgtgtgatatcattcacccatggagttagtaaaagttaaaattattttaaatagcccctgttggtgtgagtgtaaaatgggtttaaattttatacagggcaattttggaaatatcaaaatttaaaatatgcattcctctgaatcagctccagaaacgctgagaagggatcaacagttaaaatacttaatccacgtagagggctttactgactccaaaacatctccttatttccttttttaaaaatgacattatccacaatacatatgatctttgaaagaaaaggaagaaagaaagatagatattattgatagtcccattttctaatgaggaaactgaaggtcaaagaggtaaaggaatttaactttctctagccctaagttcatatgcctgaaaaatcatgatgcaactggttggaatttcacaaggctaaatacagtcatcttgtttaagtgaaaatatctcttgatttagatatagaaccccatttcatggagccaagacagtagggtctacggaaacaatggctgtcctattcttccctggagatgataacactgcttctactacacttgacagagggggagaaggggagaacaaaaaaaattttttggtcttctgacctagcctgtatgaaagaacaaataacttatgtgcaaatataagatacagtgtgagtgctgaaaacgaggtaaggattatgagaggtctattatctacatgtgttgtatatacttggagaacacgtttgaatgggggaggtgcggcattatttcacagcaggagaaataatcattctcatcatttctaaaagccaagcagccttcagtcagtttcacaataatcaattaattagctaaagtaaatatttagaatgagttacggcacaaagatatgaaatcatggcatataaatgagctttagacatgtaaactgactctttaggaggagaaattactcaagagggagaagtggtattgcaccagatggctgtgtctaataataacttcaatggacacatatgatacttgtttaattatttatcaaggagaatgcctgcaaaaatttagtaagtttataaaatttttggcaagtacaagactgtgtcagccaataatgcattttgagtttaaaatgctccctcttggtggcttatgataatacttaatcctagaccaaggattcaccatttttctgtctcagtttcaccatctgtattaagaactgaaaaacctttacccaaatcagggagtttgggactctttaggactttactttttatattatcccctgaatcaaatacttcttcctacttaaaccatttccaaaagtgtactgtcatatcctaattgtcttaattctgtctcattgccatttcccccttaagttgcctcacaatctatctgcctgacttctagacaaataacttcaaagagttgtctatagaaggtttctagttttctttttcatttctcattattctctttcatttctttctccctgcctcccttccctttttcggttttgtttttgcttttcgaaggagggccaatttaaaaacaaaatgaaaaaagcacatccattactatctgaaggcactggctactacgaatcccttttctttgtgcagcccttttggctttttgcaagacctccctatgtaccatctcacccgtttcttatgatattgttcaacctttaacccactgacctgacttctatccccacagctcccccagaacggcccttgtgaaggtcaccaatgaacccggcccccattgcagtcttttaactttgcccctcagaagaaatcaatcatgccggctactacttggctgaatatgtgacttggatcccgtaacgttgcacacttctctttttcttctaattttctgactactcatttcctctcaaccccctttgctggcttatcaccttcttcctaaactataactgctggaagttttcaaagcctactgctgttccctctattctctttatgccatttccctcatgcccatggtgccagtcatgctgatgaacacagatctctctggatgtgattatcactggcccacccatctcttactccagacccatatatccctgtgtctactcaatatcaccacttaagatatcccacaggagctccaacccgggaagtaccaatctgagtgcatgatttctccctctatttgttcctcctgtgtttctcacttcataaacccatttacccagttgcttaagctagaaacttggcattcatcttgattctctctctctcactcccctgtcatctaatccatcacaaaatcctaaggcttctaccacaaaagcttattccaatttgtccttatctctccaacttcactatcatgccccaagtcaaagccctactcacctgggacctggacatgtgtggcctcttaactgattctcttgcttctattcctaccccacttcccaaatccattctcttttaacattaaattcaatcatagaatccctctgtttcagggaatgaataaataaatcaccttcaatcaattaattttagaattaagatcaaaccctttcccaggacctgcagggcctctaacaaccactttgagctcttcacataaccagttccacctcaaccaccaagctggttgtccaggacttctccaagcgagtcaagctccttctgcctctggggtcctcttctatgctcttccttctccactttccagagctggctccttctcatacctcagaatctcagtttaaatttagtctccacaaagacactgttcgtggttacctgaagattcatggtaagttcccccttatggtctattattgcagcattgtattatttcctttatagtaatcattaccatttctaatgatacgttcatcaatcagtttacttgtttactacctgtctccacaatcagaatatgagctccatgacagcaggaataactttaggtattcacaataaaacatggttaataaatatgggagtgaaggagggatactactaaactatgacattaaaactagtatgaggccgggtgcactggctcacgcctgtaatcccagcactttgggagggcgaggcgggtggatcccctgaggtcaggagttcaagaccagcctggccaatgtggtgaaacactgtctctactaaaaatacaaaaaatataaataaaaaaaattagccaggcgcagtggcaggtgcctgtagtcccagctactcaggaggctgaggcaggagaatcatttgaacccaggaggtggaggttgcagtgagccaagatcacgccattgcactccagcctgggcaacaagagctaaactctggagggggaatgtaatattaattcaaacacccattttttttcttgagaataaaattttagtttcaatattttctatatattttggtttcatgtttacaaacacatttaaaatcattaatatgtttttctttaaaagctactgatttccttatgaatttgtttttttcattcaaagtgtaaaatgaatgactctcattagatgtgttttgaagaaatatctttgctgtgttcttttctctgtgttcagccacgagaaattggtgtgaggctgctggagtgggatgggtccctatcctgacaattataagtcagtataaaaaagtctgaggcaaaagcaggcatagctctgtgggcatttctgatattttacgttagtcattagaaataattcatataaaaaaggaagatgaccaataataagagaaaataatgtgaagcattgtattttttaattgctgcttgaagagagttcattttcagccaaaacacaatagtactttgctcctttggctagaagtacaagtgattccaagaaacttaagtattctcagagctacctgctatgggtatttaggcctaagtcctgataaaaggtaatcacaagcttttaagaaaggtattttttaatttcttcttttcaaattggaaagaaagtgggcaaatggtttgtagtgttctaataaaatagattagataaaaggggcaagaaatcacaggctgaagtttttttattcaatacatatttattgaatatcaatgcataacaagaatggttccaggaggcataagaaacacaaagatgaataaaatatagttcttcccattaagaggctcatcattaggcagaacatacagattagatagatggatggatggatggactaacgacaggtgggtggatggatggatggatggatgggtgaaaggacaaatagatacagcataaagagaggatgaatgattaagcatggtcttctagcacaaagaaagttacaagaattatacatgaaacaaggaataattgagactctatgaatgtaaagaaatgaatgtagttcattaatttgatccatatctcagttgccttactgatatggtttggatgtgtgtcccctccaaatctcatgtcgaaatatgatctccagtgttggaggtggggcctggtgggaggtgtttgggtcatgggagttgatccctcatggatagccccttcctgtggtaatgaatgagttctcactgttattcacaggagagttggttgtttaaaagatcttggcaccacctcctctctctcttgttccctctcttgctatgtgggcatacctactgctttctaccatgattgtaagcttcctgagacctcatcacaagcctagaagatgcaggtgctgtgcttgtatagcctgaagaactgagacaaatgaacatcttttctttataaactgcctagtctcagggattcttttacagcaatacataatgaactaatacacttgtgcaatatcaataggcttttcctttaatatctacaaaattcttacagagaatgaatgaaaaatgaagtctcctcttgaacagcccaaggttaggctgctcctgtatgactagccaatttcattgagtgaaaattcaatggcatcccgaacttggcatgttcttcattaggcaaggaaaggaataagcaagagtgcctggagtatttctctcaaatctatcaaaagcagagaaaccagtcaagacacactgttctgtagaactaaacaagataatctccagacctctgtctccttgtccataatatgaaagtgctgtggcagccaatgatgagcagcagccatggctctgcattactccggggccctgggcctcaaacaagggccacgaggtgaccaagaacacaagcaagccgaggcatagccgctggcacgaacatcccaccaagcacaccaagttcatgggagatgtgatctgagaggtatgtggctttgccccacgcaacatgccatggagctgccacaggtctccaaagacaaacaggccctcaaattcatcaagaaaaggccaaggaggaggaagagagaggagctgagcaacattctggtcatggcttccatgaggaaagtggctgccaagaaggacgaattcctcccctccccacataataaaacctttacaggaaaaaaaaaaaaatgcaagggctggaccagatcagtgttagcagaaagattagcagatagatttcttcacatatgaattggtgttggctccttggagtgctatgttgcaatggaagcacacattctacctcagtagcaagaaggccctctgatggactagcaacatctgccatgagcatgggaatagcgtgacacattcactactgtggggcagatcactaaggtttaacatttaaaccttaatctacctcagtagcaagaaggccctctgatggactagcaacatctgccatgagcatgggaatagcgtgacacattcactactgtggggcagatcactaacatttaaatgaaatgttatctccagggccgggtgcagtggctcacacctataatcctggaactttgggaggccaaggcgggcagaccacttaagctcaggagttcaagaccagcctggcaacatggtggaaccccatctctactaaaaatataaaaattagtcaagtgtggtcgtgtgtgtttgtagtcccagttactcaggagactgaggtaggaggatcacttggatagcttgagcctgggaggtcaagactgcagtgagccgagattgcaccactgcactccagcctgggcaccagagtaagactttgcctccaaacaaaacaaaaccagcgtgagatattattatctaaagtcctttcaaactctcaaatcttatgatttccactaacattgagttggtgtgattatcttcctatatagtggacaacatatcacaataaattcttaattatccatactttcgttatttttgccccaatgttgctttcattctcatgaatgtgatccgaagaaacacagccttatccacaagcatggagcccagcaggaagctgtttaaagcagaatacttcgtttactcattcaaagaagcccatgccacgtaggctgcgatgggctcaggaatagcaagaggtttgccaaggtgatgcaggtgagaaaatacgcatttcttgttctttcctgctcatatttccacaaagtttctttacagaactgtaaattcagaaatcagatagagccatgatgaaaacaattacaaataaaaacaaacgatggccacttatttgagatttcagatagcatgtaccccggttacctcttactgataagaaaatctctacttgtgctgctcttttccaaagattgcttgaactgagaccatctaatcgctagcatctaaattactattcattttcgtgtttatcctctggtactggttactcagcagatgccactgctacgtcaaaagcccggaaactggcaggagaatgtccttccttttcttgctccttgtttcttcaaagtctagcaagatttgagttccttacaatgattctcctgcatcactcacatggctgtatgtgtgactgactcggtaggagctctctgcatccattaaagaccagatatacaaacaaacaacatcatctccaccaaaaagattaccttaatttttttcttttttgagacagttttgctcttgtagcccaggctggagggcagtggcaccatctcggctcactgcaacctccgccttccgggttcaagtgattctcctgtgtcagcctcctgagtagctgggattacagacacgcaccaccatgcctggctaattttttgtatttttagtagagacacggtttcaccatgttggccaggctggtctcgaactcctgacctcaggggatctgcccacctcagcctcccaaagtgctgggattacaggcatgagccaccagtcccggccaagattaccttaaccacaggagatactcttcctgtggttcctgtcaaaagttaccatgttgctttattccttccagatattaaccagatgttagtcattttagcattgtgcatattaatgtcttatgttcttgatttttaagattttccctctaagtcttagaaagtcagagctttaagggagcctgaatacctgcctttgacagctaggcaccacaagggcctcgaaatctgtgcaacttgcccatggccactttgccaccgtgtgatagagcagggtaggagcaataccacctctccagggcccatggccctgtgctttcctcttgccatactgagtggcttttcctgcactttcatgcccttcccagtcttctccggtgggtgaggcctgcggcacactgggctcttctggtgcccctgcagaatctctggcatgcccctctcttggcgaagccccagcaaggatgacatagaaaattcagacaaggatgaaatcatcgttttcctctattatttttctaaattgcctttttcctacccatgactaggcagtatttcctcacagctggggatgaacaaattcaaaaagatgttctcaaatacatggtttccaagagaggccactaagtgttgaaagtataaaatgaacatttttgagtgattgcacagttcatgaaaatgtctctggttagaacctcatcagcagtgattcactctgtgcatagggtccccatggagactggagtcacctcacattagggtattgaggctcatttttcctgctgagatggaataaatggctaggatgcattaactgatggcggtcacaatggtcccatccagtgaagtgaggaatatttctttaaagatgcccttgtggtcagaaagacttactgaactttaagactaccatatttctccttccctttaaagaaaaagagtacttttgccctataggcataaacattcagaagtaaagcctcaaggtcaaaattatatcttctatgatagatagcaagataatgtccctgttaaagaggaaaatatagtttattacagttcaatcatgtttttcttgatgcccaaaacatctttttcaagataataaccaattaaatgagattatatactgtgtgtcttagtctatggggagcttctgtaacaaatactacagactaggtagcttataaacaacagaagcttatgttttggaggctaagaagtccaagaccaaggcacttggaagatgtgccatctggtgaggacccactttctggttcaaagacagcctcttctcatttcgtctttacatggtggaagcagtgagggggctctcttgggtctcatttaaaagggcactgatctcactcatgaaggctctgcctttatgacttaattaccacccaaagtccccatgtcctaatatcatcaccttgggggttaggatttcaacatatgaatttgggggtatgcaaacattcagaccacagcacagtgctggagcatagcagatactcaatacacgagttttaatttgtatatgcaactatgttttaggtactttacagctcagctacttttatttaaaaatttttcagttttaaaactgcatcgtaagtaagaccacagaaatgtagcatcagacaagcttccctacccattccaaggccaaatgaggatttttttgtttgtttctccaccagccaagaacctggggtgcttcagggactcaaactttagttgcagtttccaggcctcatggtttagaaggtctaaaataggcccagaaatctactttccagaggatgctgaaacagatgacctgcagcaaatactctaatgtaattgactcttgaagaacatgtgtttgaattttgaaggtccacttatcaccaattttcttcaataaaagttatactaagtatgcctgcctctcctgcctccccttccatctccttcatttcttccacctctgacacccctgagacagcaagatcaactttgccttttcctcctcctcccagcctacccaacgtgaagacgaggagcatggagacctttatgatgatccacttctgcttgatgaatagtaaatgtattttcccttatcatttcttcttcttttttttttttttgagacagggtctctgtcacccaggctggagtacactagcacgatcatggttcactgtagcctcaatctcccaggctcaagtgattcacctgcctcagcctcctgagtagctgggactacaggtgcatgccaccatgcccccactaattttttttttcagaggtaggttttaccaccatgttggttagactgatttcaaactcctggactcaagcaatccacctgtctcggcctcccaaagtgctgggattgtaggcactgggcccagccccttccttatcatttcttaataacatttatttttcttctagcttactttactgtgagaatatagcatataatacacataaatataaaatatatgttaatcaactgtttacgctattataaggcttttggataacatcaggctactggtagttaagtcttgggggagtcaaaacttatatgtaagttttttactgtgtgggggtgagcagctctaatcctggctttgtccaagggtcagctatagtgtcacagagctatgatttgtgggtgtgcattgggtacatgtgggtgcttccacgtggcttgcagagaatggttgtcacttctcctccaataggagatgtcaggacaaggggatcattttctacaggggccaagtcttctcttttcattcccttaaaatagaaagtcatccaaggtcactcttctccccttccccgtgccttcctaaactgctctccaatgagggtaacacaaactaacacatttgatccctataatatgtaccacacttcaccgattctagaaaaggtaacaattctctgatgatgattattccctccttctttacagacaaactcagagaagttaactaacttgcccaagtttacgcagctaagggaacaagcctggattcaaacctaagacctcaggctctaaagccaccatctgtctcttgcagagacagttcctcaatgttgaaggaaaaattttttctcctgaaagaccacagaaaggatccccacatactgctgtaataggctaacgcccctctgtccttgcactttcccatctttccaaccctctgcttgccatcctcagctctgcccatccagccacccctccactttcttgcctcatcagcccaccccttttttcatggctccactgccactcttgtaggagtgtgtagtccagctctgaaattactctcctgaaaatgctcatgccttctttgtgcccttgtcctttcattctcaccacctgttaaaatccaaccttggataaacccacagagaacttccttctctgtgcctgcctactgggaggacacaacagtgctggagaaaaccacgcagggctctcaaagagtgtccagacattttaccatatttttctggtcagcttcctgtctctcccccagtgaaaccttcaagggttctcccttctcttccaaccttccattcctcatcagcccacttatcctcagcagatgcctgtccttttctgagaaatggaatccattagccaggaactccctccacctgagttaccaaatcagcaatcccacctgctctgcattctggacttcccatgcaggatgtacataggttgactcaagtccatctcatttgtgttaaactttaaaaattccaagtttctgttttctttgagagagtgttacttgctttcagactgcaatgtatatattctctcccatactgatgatcactttttggttattgtcataaacctgagtgcatgaccaccatagtgttattcatagaagtctacttgatgttactaagttgttcctggttcaactttagtacaatatctagatcacaggacccaggttcgaaaatggaaatctgcagcattcaaggacaacaaaaagtgatgtgcataataattacataattgaaatctttaaatttcaatgtaatacaaataaatctctatgattctcccctacccccaccacgaatgatgtctttccacccaaggtatttatttttaaaaacaaaagtgtaaagatagagctggccttaggcaaaaaacgtaggagactttgctttaatcatttgcccccaaatcctaatacagtagaaacactttaggcagatagacctggttatcaattccagcactgtttccttccagctgagtaaccttgggtgagttaactcacatcacctaaactcagttccctcatctataaaatggggttaataatatttagctagcagaggattcaatgatgcaagatattagagtatttggcacatattaggtgccaaataattataggttttattattattctttttagtgttcctagtaaagtcactcatatcatagccccagatctttaacttcttatatccctaggcaatacatacattcactttaaaaagactttgtctgtaaacttctgcttccagccaccagaaagtaacaaggatagaatttattctcctactttaaacaactcaaaaatcaaacaaaatatatgaaatgacggttttcagatactgtacaacaaaaagtacaggatagtgatcattgagagacgggaaataaatgaagtgaaacttatgatagtcccagccactgtctagaaggtttccagggcttaatgcaaggaagagaaaccagaacagagcctgaggtctgtctgaattagacatctggggaaaccaatgcccctggaaatttcagggcagagtacaagagaggaaggagccaatcagagagagagagctttggagatcttcagaggtcccctcagagtctgtggctgcatgttgattaggagagacggagagggaagtgcaaaggctggggcaaaagccacagatggaacctttctgaagctcacaaaggacagggagtagctcaagttctcgagatccagagagaagcaacctcgcaatatgccaggaaagagttcccagaagtgttttgcctcagaaaccggatgaaattatctccagtctaaaggctgcttagatccattaacccaagtataaaatcaaagccttgagagaatcaaactgtttccaaggaacttgactgcatctcaaaacaaacaaacaaacaaacaaaaacttaaaaatattttaaagaagacaaaaaaggaaagaaaaaaaaatccagcacctgacaacataaaattcacaacgtctggcaaccaataataaattagtaggcatgcaaagaaacagaaaaataagacctatcataaagataaaaatcaatcaagacagagattcagaaatgtcacagataatagaatcagtagataagcacactaaaacagctattataaatatactccatctgtgcaagaaggtagatgaaagcataaccatgataaagaaagacagggaagatacatttttaaaaaagaaggaatctgaaaatataatgctcaattatgagaaaaataaatcatggatgtcaaataagggggctggaggtcatagttactcttcatatctaactgattgaagacagaaaatctatagtttagacagtctaaggaccaagtataaaagtgacttttccaggtattatgcattttatgtaattatttatataaatgaaccaaattacatattcattcaactatatagttaccaagcacccagctttaatgatagaggaaatacaaagatgattagctacagttctttcccatagaagaagtccagcacagtctgttagacagatgatagaataattatattagcacataaatgacatgtgcttacaattcaagaatgcagtatgtaacacactgtaaactagaaggcaggctgcagaataataaaaggaaataaaagcaaacagtggatctggagcagaagtcccctacgcaattaatccatagttacaaataaaagactttgacattaacccaatgcaaaaatccaatatacaataattcacatgcatgcacacacatatatacacacacttatatcagtatagaaacactcaaactcattctaatatgggaatttaattgtctggcttttctttctactctctgctgaattagaatgtccactctgagcagaggatgcatttcctagtgtggaatgcaaatattttccctcagcttattgggctgttaaagatactgaagcttctctactccagaggaaatcaagaaaattagggaatgtatgtatttgtgatatatacacatacaaaaattatatattatagattatatatttaatacatgtacatatgtcaatatgcatgcaattatttaaaaatatttctctagttttagtctagtgagtaagaatgtggccaccatagttctaaaggctaatgagtggtacatataccagagtacaacagagcaaataaagattaagctaatcaagaggtgcaaactggaataaaatttaaatatatatgtatttgttgtagtatacataggatgaaaaaatttttatattaataattcagaagaggtcgatctaatgctaagcaagtaaatttatcttattcattccatggaatagaaaagtgactatattatattaagcatttaacaaaagtttgtaacatctctagctaacaaggatataggcttttgtcatttgtggagaacaatctttgatttgctttaagtgatgtcagttaccttatatagtacatgggataggccaaagcaaatcttttttggaaacagattttacacattctcttatctctagaaatactgtagacaggctgggtgcagtggctcacacctgtaatcctaccactttgggaggctgaggcgggcagattgcttgatcaagcccaggagttagagcccagcctgggcaacatggtgtgaattcccatctttcctaaacatacaaaaaattagctggcacacatctgtggtcccagctactcgagaagctgaggtggagaatcacctgagcccgggaagttgaagctgtagtgagctgtgatcaggccattgcactctggcctggatgacagagtaaaatcttgtctcaaaaaaaaaaataaataaataaaaagaaagaaaaagaaacaaaagaaatattgtagacacacacacatcagcttagcactaggatgcaagttgcaggacagcatgtgtagcgtctatggcagtgcctgcacatggcaggtgctccatattccagtcccattggatgtatctaggccatctacctctgccccatctacctctgccatccctttttggacagcagccttctagatacaaacccagcctccctcccctcttgccattcttcaatgcagtctctataaaacaagtcagatgcttttttgttagcagaaataaagaaacaaaacacacgagtcacaggtcacttatctccttaaaacttcagtagtttgcacttcaaataaagtctgtactccaagctttggaaggcatggtctggccccagcctatcctaccagacttgagttaagcaccaacctgccaatcccactccatcccaaccaccacctctggcccacatacacccacttttctcttctttgaagaggataagctcctttcatctcaggtctttgaacaggacattttctgcttttagaactttctcatcttttcaaattctccatttctttctgctcttccttcctgctaactagataagtctaatttatcctttaggtcttagtttgaatattactactttaggggaaccttttctgaagcttctccaatacctccaaacaaagttagcctcccaattcctctttgtaacatcccacaattataattagtcatttgtataattatttgataacatcttctttagagatacgtgttctccataagagcatcactggtcggtcaggccaattgctgttcctctagtgccttgtaaaaaatgctgtaatactgtggtgagtaaataaatataccaatgtaatgtcctaatgtcctggggaagaaagggtaagtaaatgcatagagtgtaacagaactgtcacaagtacatgaaatcaggtacataaattgtgaaacataagtcaagggcctatttgttttctgacacttgatagtgagaaatctttcaacaagatggaaaataaaaacaaaagagaactctgagcatcatcctttagagacccccactggtacccgccaggctgtctgtatccccttcatcatggctgtgtcagagaatgccaccattaatatctgaagggactaaagaaagaaactttgctggtataagtatgattttcattttaaaaacaagcatgtggggtggtttatcaacagacagtcctgagtgtatttgtaagctgaagagacagtttcaggcaggatttccagattctatttttttatctctgaccacttctctcatttcaaatcttggagccctgaaatagtaggaatgtagtgggacacaagagagggatctggagacctggctgcagggtaggctgaaacttgaaggagcatctgagagcttcttcctaatttcacagcagaggtgcgtctgggcgttacggtccccagggcgtcaacaaccatccctatgttgtggccaccaaagccatacctccatcaggccttccttcctgcttgccaggcccataaatctccctgctcaacacaggttttctttcaacaggttcctcaaactcaacatatccaaaaggaaatgagccatcttacccatccttctctttcagccttccccaccttctaagcaaatggctctatggttaaccccacttgcaagtctagaagcctaggagtcactgttgattcttcactctccttatgttccatgtggtcttagtcatccattcctgtggtttctacaatgaaatgtctcatgaatcccttcaggttactccatctgtactgctcaggataatcgctggcattactgccatcactgtctcttatctgggtaactcctgtctggttgccaacctttccacacccccatcagtcctctataggggttacaaacatgctctgtaaaaatataattctgatcctgctactcccctgcttaactttcttcagtgacatcctatagcaccctttatctattagtagcataaccacttatcatgttaatttgtttttgtgtatttactcttttctgtttctcccgccactctaaagcatgacagtaaggtctatgtcctgtattcccagtatttagcataacatctggctcaataaatctcagttaaaagagtgatgcttgaggagatgaaaggatttaacaaatccctcttcatatctgggcatattaaagaggataaaggtgttcctgtgaggattaaacaacccaagaaggaaattagaaaaaagtactctgaggaagcagagaagaatgaaaataagtggaaacaccagtgaatgggagagggtagtgaaggggacggagaaggacttgcaacctatcttggcgttccatgagatagaaagctaagttcttctcagaatggcaggaaacagaagcagtgacagtgaacccagagcttctgaaaaagaaacagcaaggtatgagccaaggaacacttaagggtgctgatagacccttacaagtgtgaagaagtcttttgttggctccaaattagtcactgataaaggatgtggctctatgtagttaattgggaagtatgttgtcttttttttttttttttttgagacagagtctcactctgtcacccaggctggagtgcagtggcgccatctcggctcactgcaagctccgcctcccgggttcacgccattctcctgcctcagcctcccgagtagctgggactacaggtgcccgccaccatgccctgctaatttttttgtatttttagtagagatggggtttcaccgtgttagccaggatagtctcaatctcctgacctcttgatccgcctgcctcagcctcccaaagtgctgggattacaggagtgagccaccgcgcccggccaagtatgatgtctttttggaacatgtgtttaaaatagcacaaatggcatgctaagaagcttggagtaaaagatgtgcatcaccccagagtcaataatggctaaagaaatattgttgacaataggaaaggagatttcaaaaagtttatagaaaagcaaggtattatctcacggccagagaatatccagaaagcactattagttcccatgcaggcctgggcaagaaacttaaaacctgggtactcagctcctgcttttcagctctccttccagttgatgattataactttggaaaagaaattaagttatacaggaagagagcagctggtcacacaagaggtgccaaagcttgggatttgatattctagatttcaacttgtgacaccagaggtggggccttctgaaaagggacaacgtgtgccacagaaaactgagaagaaggtttcaggcaacacctgacccaaattttgaaatttgagattagggagtgacactgttcagcacaaacataaacaaaattgtgaactagatcatgcagaggatatcatatgaggcatagaaggatggatggtagtggagaaggatctccacagtgaatattctagcgtctcacgagaggctcacaggtttgttttttaattaatttttaaattttactttaagttctgggatacagaatgtacaggtttgttacataggtatacatgtgcgatggtggtttgctgtacctatcaacccatcatctaggttttaagccccgcatgcattaggtatttgtcctaatgcaggcattttttaaaggctaaattaagttaggaattgtacgtagtagatcccactctttgagaactacttattgcacattagcatagtaaaggccttgggaaaacctacaaagaaagcaatttatctacgtttaacccagagtttgccaccattgttaggccacctaagtataatacttatgtgacctccactctaccttacaacagtggaacacgaatgttccaacagattggtttaaaaaacctagatctacaccaatgcacaaagtattgacaacaaacacaaatcaaaggcaacaaaaaaacttcacaaaaccaaaacaaagtatggggaataaaacaaacaagaaacaataatggaggtaagtatcatctcacagaacagccaggactttggagtatgggatttaggattggggtataactgtgtaatggtatatttgggataaaaggaacaaattcaatgtaatgatctcaagtagcacttcctgtgaagaaggtaaacagagaagttcataaaggtgggagcagaatcacggtgagaggaacatttggtgatgatgaaaggggagggaagtggaagaggcgtcactgtggaagtgcacgacagcacatctgaaaggtgtgctaccacagtaatgagggatttgatttcctgggaaatccttttgataaaatcagaggatataaaaatcttacgccttgctttactgataattttaatctctcaataaattgaagaagcagtgaggaaagggatttagtgtcagtttaatttcaacaaatatgggaagagtggttggtcatttagaaatatcagaaactttgggagaaagccaagtactcataaaatccagcctctccataatcctgtcagaaatgttttaaagaggatttcttggaaggaaggttacactaaataatctttaagtcccttctgaaacattaaaggctgcctctaacattctgcattcacagttgaagaactccagaggtggccagcatgacacctgagcaagcagtggcatccgtggctctatggctacgtggaaaagaaacatagtgctgcacaccaggtacagtaaaaagggcatcagatatgtcatgtaaacataccatagaaccataagaactgaaacaatgtggtcttggaataaaaatagataaatcagtagtaaagaatagatatttcagaaatagacaaaaatatgcataagaatttaatttccaataaaaggcagaattaagtcactgggggcatggaaaatagggaatataacaacttccagagtgggcaaacctttctgcatttagaaatggaataaagaactcataaatgaaaaattaaatataaaaaccataaaaaagaaccaacattaagaggcaaaacatggagtagataaatatttttaggaaatatgaagtccaaggattaaaatgtttaacaaatgcccaaatataaaccaaaaaaaaaaaaaaaaaattaccaggaaccctatttgataaatggatacagtgtgagaataattatttacaaaagagaaaatgtgaatagaaaatgaaggagaataaggaaataaacaagggtagttatagaataatttaagataaaataataggatgccatttttgcatatcaaattagtaaatattaagtccatatgtatagtttgggaattaattgaccagtacttaacaagaaacttgaaaatgctcatttcttttgatgtactagttccacatgtaggagtctatccaatggaaataattctaacagctaaaaagccccatgcataaaaatgtccactgcaatgttttaaagcaaaatattatttgctttaaaaaaagcagaaaggagaaagaaagaaataagaacaaaggagtaagaagaatatttaatgtatgcttaccatatggaggttatataaattatcccatttaaatctcacagcagttccatgaagtagatatgatcaccattttatagaaaaggtaagatgtttttgcatgctcagggagactaagttctttaaagaaacttggctagtaacagtgaaaaaatggaaacagcctaaatgtaaatagtagaatggttaagtaatctagagatttgatgaattatttttaaatttttaatataaaagaatacaatggaaaaatagtttaggataagatgttaaaaatgcataatagaaaatgttatattcagtatgattgaaatacacagaaaaaagactggaataaaataaataagcactaaccaaacacaacagaacctgaccctgagattgtatcaaggaatgtagtcggctggtggccctgagaacaaagcaaagtgcagttaaattatcaggccgtgtaaatgatgaagggaagcccagaaagaccctgaaaggctcaaaaacagtttaagcaatttggctaacacaggagatagaaaaagtaatttggggcagatacggtaaatcttctataacgcgtagggctgtaattcttttcatggcaagttgctgggaaaatcataaattggtcatggttaaaacgtcagaagactcaaaattacaagaaaaaataatgaattatgaaggttttggcttactctagaagtcgtactacattttctgagagaagtaggaggtgagacgagagtaagtaacttctgctctctgaatatttcaattaggcagctggggaaatgtgggtggaaaaatagaaatctttactttcaagttattagaagaaagtatctgtctatgtaagctttagggaaaaggggcctgggataaacacatgttcaagccatagaaaatgtcatttatgtacacctacctccctagagcagactaatcttcaattgtatgaatttgatagcattttgaagaacttaataaatatcctaaatataatgttttaaaactcagcctttgtatttcctttgtctcctactttccctggtctcttatccattttcatattctttcttattatattaaaaaagaaaccatatatattatatatatgtgtatacacatatacacatacacacatgtacacacacacacacacacacacacacatattactacagttaatttggaatttttcatttatggccactattgaccaaaaagaaacacaacaaaaaacaaatgcttggtcaactcagcatgaagtgcacaggtatgtgggagtagaacttagcacattccaaatgcgattggtttctatttaatgaacaccatctaccctcacctactttgatggccaaaaagtgaatttttcttctgccactgtaacaatgactactgcataatacctggttgtcacctctccactataaattctgagagggcagaccatacttgtcttgtttactgcgggagcccctgcaccagacagcggctcaatgagtatttgttgaatgaatgaatgagtgagtgaatatacaaatcctactcatctctccagacttagctcaagccccaccttcctgataacatctttcctcaaagccccagtgaccgatctgattattatattaccagtgtgcaccactacttaacacacctgactctacacatcatttttatcattgtttttcaggtgttggtgttttgttttgtttttttcaatttagagagaaaggctcttcaaagacacttatatacatatatatttattctatttctcaaagcactttttacaggacacatgtaaaatcctcagcaaacacctgttaaattcaatggttaaatcttttagatgacttttgactttgtggtatttctaaacattttctctgctgaatgcatgcattgtattaggatttcaccacgtggtggacagaaaacagggaatttagtgtcagctgagctgagtttatagctctgccatttcaatgctggaaaagtcaccgaaactctgctcttctgtttctctatttgtaaaatggaaacattaacaagagcaataacaaaaagaaatatctacctatcataaagggaagacagtgcaatcaaatgggataatgtaggtgaatgagttttgcaaattggaaagcaaatattagccattctatttaccaattttaaaaaacgcaattgatgttgcaagactgtgtatagcaataacagttagtgtggctttttctgagaacaaggctattaggcagaagagaaaggtgatgaggaaaagaatctcaagtacaacttgccaaacatgccccagtcataaataaaagactgtgtccaacactcgcggtacagagagattaccaggcacctgtcacctacacccttcggcactgctgcaagcatctctgaaaccaggagaaagcttaccagacacgagctgctgtccaggcaaccctacgggaaccatgcccaggttattcatggctgtagcccaggctgtgggatctgtcacggacatgttgagctgggtcgtgtctatcgctatactccccaaaccatcggctgctgtggggaaaaacaaaccatgatttagagtccataggcaagggtgtttgttttaaagaaaatcacatttctagatatgtgaggcttcatttagcacattcccaaactacaaaaaaaaaataaagaactataatctgcagcaatgttttctctagacataaacacaaagtgtttccaaatactttctgggagaaaacttaatgacatgtagtttatattatacacagcatgctattaaggaggtacccctggaaaaaaatcgaagaattgtttccttctcccagtgaaacaacgttagttaagtcacaaggctgagaggcaaagcagtaatactctcttggtaaaacaagttaattggcttactgtttctaggtgtaattcttgagcaggcaggccttctatctaataagaaaatagttgtcaagcagtagaactggtcctgactgaatttattaagtgttacctcgtaatctattccttcctttacaaacttttacattattacactaagaaaatacaggtgtctacctaacgtgacttttctgaaggatttctaaataaataaatcaaatttaaaaacaggtagcacaaagcttaagaaaacacaaaacaaaacagaagaatgtgtcaaatttgacttagtgctctttcattttcactagttctacagactgatttctttatgggcccaggctcctggttcaatgcatatttttcaaggtggggcaagcttttccactaagaactcaaaaaatccttgtttgtgtcctgtgctggccactggcatttacctgcagccatcatctgaggaagctcctggggaagctgggtgatgttctcaactccacctgcatctaccattgaattatgagtgtccagaggggcaggaacactttgatggctgagtgcagggtcccctcggaggtcatcagattctgcaaaacgggacagaagtgtggtgagaaaccttaatagttaactgagataaaacgtcaaggaacaaactgttatctattcaaaatcaaaaacaaagaccgatttccagtctcaggcacagaagaaatgctgcttcccatcgctcagcggctgtcttgtggctcagttaaaaccttagagccctgtgagatgtgtgggtcaactcatcgactcaccaggagcctgggctggctgaataaacagccccatttgtgagtacctcaaaggccttgcttcctactgaagcaccttcacaaatgggggcttatcagtccctgcacagccttttccacacacactacacatcaatggagagggcagagtcagggctaaagaagatttttttaagttaaaaaattaattgatgctgttactttggaagatggtcgtctgtggaatgtattcagagagggaaaaaagttgggaggaggaaggaaaaaggaagaacccattcaccatgcagctggaaaaggagggtacctaaattacaatagtcaggaaaggcagaagagaagaatggcatgctgtccataaaggaagatctagagggtgttagggaggcaaaggaagagcatttggttttttcagctcattggaaagataatttaactggccacaactttttggtttgaattttccttagaattgcccagcttatatatatatatatttttatatatttatatatatttatatatatatatttatatatagtcttttaatgcacttatctaataaatataacaattaaacattaaagttacaaagttcttctcaatctcacactatttataaaatgctatgccttctctccacccttagaaatgcaaaaacagagctttcacatgtattttaagtgcactttcaccatttcaaaactcagatgagtggcatgacaagtttgatcttaagtagattagatataacaactaagtctaaatatttatttttattttagtataaatttagaagtttttctaaaccatgttcctgttaatgatgattttagaattagatcttatggtttgacagtgtatctaatgtgaagttcgaaccttttatggcatgtctttttgtttctttcattcttaggtataagaatcagtaattccttgagcactgcactgtcaaaaagaacttctgatcagttgagcagaagtttaattcaaatggaagctaagggttcaattctcaacaacaggtgaataatgagcaaatagtttttatggtctcaacaaatccctagccctcaactagaggggtatgtaagatagtgtggaatttttttccaattgtctgtcaggaagatgaatcatcatcatcatccaacagtgaatgattctaactttggaagcaaattgtactgagaataaatattttattccttcccactatactatccaaatgaactcagaacctgcatgtgtattgtgcatcaattatcttaggctatgggtgccatcagacaaagagattctcaccatagaaaataaattcaacagcataagaaatgcatagctaacctaaatgtctggtctattcaccaacgatctttctacgatgaaatctcaaagcacttctctctccacttccaaccatttcagagtagcaaggcagagtcaggctagaatgtgttcattcttttgttcaaatggccctgtagcagagctgtttcagatctttgcaacgtcactatttgtcttacttatctccccaaatgaagtttagtggctagcctccttctacctcagattcttcccaaatgggcattaatcacacatttttttctcgagtctgcagttctggaacactatatcagagaacatccctctactttgtaggctcatgacttgtgcctgacccaccacatttcaccttgactttttgctacactgttttagggatggctttagttttccttggctctgtaacagtctgctccaatggcagttctcactttagtggttacagtcgtataaaggggcatcaagtgtcctggagacccatcgtttctacctaatactttcatggccatcttaacagactgcaagtgtttcattgaaaacagtaagcaactgctactgttccactgaaaaaaagcattgttctgttggcaagatgtggtgtataaacctagatttatcccccaatgaaactcttgtgacattcaatgtattacatctcttcagtctcccaatccaatgtttttttttttttttttttttttttttagtatttattgatcattcttgggtgtttctcggagagggggatgtggcagggtcacaggataatagtggagagaaggtcagcagataaacacatgaacaaaggtctctggttttcctaggcagaggtccctgcggccttccgcagtgtttgtgtccctgggtacttgagattagggagtggtgatgactcttaacgaacatgctgccttcaagcatctgtttaacaaagcacatcttgcaccacccttaatccatttaaccctgagttgacacagcacatgtttcagagagcacagggttgggggtaaggttatagattaacagcatcccaaggcagaagaatttttcttagttcagaacaaaatggagcctcctatgtctaattctttctacacagacatagtaacaatctgatctctctttcttttcctcacatttcccccttttctttttgacaaaaccgccattgtcatcatggcccattctcgatggtcgctatctcttcggagctgttgggtacacctcccagatggggcggccgggcagaagcgctcctcacttcccagacggggtggccgggcagagacgctccccacttcccagacggggcggccgggcagagatgctccccacttcccagacggggcggccgggcagaggcgctcctcagttcccagatggggtggccggacagaagcgctcctcacaccccagacagggcggccaggcagaggcgctccccatctcccagacggggcagccgggcagaggcgctcctcacttcccagatgatgggtggccgggcagaggcgctccccatctcccagacggggcggatgggcagagatgctccccacttcccagacggggtggccaggcagaggcgctcctcagttcccagatggggcagccggacagaagcgctcctcacatcccagacggggcggctgggcagaggcgctcctcacttcccagatgatgggtggccgggcagaggtgctccccatctcccagacggggcggccgggcagagatgctccccacttcccagacggggcggccgggcagaggcgctcctcagttcccagatggggcggccggacagaagcgctcctcacatcccagacggggcggccggacagaagcgctcctcacatcccagacggggcggccgggcagaggcgctcctcacatcccagatggggtggccgggcagaggcgctcctcacttcccagatgatgggtggccgggcagaggcgctcctcacttcccagacagggcggccaggtagcagcgatcctcacttcccagacagggcagccgggcagaggcgctcctcacttcctagacggggtggccaggcagagacgctcctcacatcccagaccgggtggtggcggggcagaggcactcctcacttcccagatggggtggcggccaggcagaggcgctcctcacttcccagacagggcggccgggcagaggggctcctcacatcccagacaatgggcagccaggcagagacgctccccacttcctagatggggtggcggccgggcagaggctgtaatcttagcacttttggaggccaaggcaggccgctgggaggtggaggttgtagcaagccgagatcacgccactgcactccagcctgggcaacattgagcattgagtgagtgagactccgtcttcaatcccagcacctcgggaggccggggcgggcagatcactcgaggtcaagagctggagaccagcccggtcaacagggtgaaaccctgtctccaccaaaaatacaaaaaccagtcaggcgtggtggcgtgcgcctgcaatcccaggcactcggcaggccgaggcaggagaatcaggggagcccgaggcagggaggttgcagcgagctgagatcacagcagtacagtccagcctcagcaacagagggagacgggagacgggagacgggagacgggagacgggagacgggagacgggagagggagagggagagggagagggccaatctaatggttttaatgacatacaacttactgtggctaccatgtgcctgggatggtgattctaaagtaagctctgtcacatcttaggaatttccaatagtctcaaggctgccgtgacattgttcacaaaatttaagttgattcggtcactcattttggaagaaaggtaatacttttaattaattaccaactagtaatttatgaatagttgcaagaatgattttggtactttgttagcatctattgttcctattgaatacctgcctctttaaatgattcaagaccataatgcctaatttatcattcacatcaatttctctgccttagttttattatttctaaactatagaaaagattaatcttcttagcgatgtttatttacacacagagatgtggggagttaaaaattatagctaataaagcactctgaatacagtaggtgataattattactattttatttggaaatgtagtgtttccattaagataccctgggatctttgtgttctggtagataattatgtaattaattctaaaacagtgagtaacacttgatatttctaaaagtaagtgttgccctagttttctgtgccacacctcagttggagcacaatatttcattttccaccattcctttataaaattatatgaggtaggccaggtgcggtgactcacacctgtaatcccagcactttgggaggccgaggcgggtggatcatctgaggtcaggaatttgagaccagcctgaccaaaatggtgaaaccctgtctctactaaaaatacaaaaattagccagcaatggtggcgcatgcctgtagtcccagctactcaggaggctacgacaggagaattgcttgaacccgggaggcagaggttgtagagccgagatcacaccactgcactccagcctagttgccagagtgagactccatctctaaaaaagtaaatacataaaataatataatgtaatttaaggctgggcgcagtggctcaagcctgtaatcccagcactttgggaggtggaggcgggccaatcacctgaggtcaggtgttcgagactggcctggccaacgtggtgaaaccctatctctactaaaaatataaaaattagctgggtgtggtggtgcatgcttgtaatcccagctacttgggaagctgaggcaggagaatcgcttgaacccagaaggcagaggttgcagtgagctgagattgtgccactgcactccagcctgggcaacagcaagactctgtctcaaaaaaataaaaataaataaaaataaataatacgatgtaacttaaaagatgtataaatattttctctctaggttttttctgcctatgcaactacaaaaactttcaagagattcatgaccaattatgaaattggcagtttctacttacagctttaatgaagtatgagcaccacaaaacaatctgatacacaaaatgccaaggataaaagtacagctttgtttggccttaacagatatctaacttgtttcctgttaagatatattcaagtataaaatctcataccaatttcataactgttcaacaaaatatatttatgttcagtatttcattgggctagataatggggcaaatattttttgaaacttatcaagtctatgaaaatactatttggcttaaaaaatggcacaggtttgggaggctgaggtggcaggatcacaagatcaggaatttgagaccagcctggccaatatagtgaaaccccgtctctactaaaaatacaaaacttagctgggtatggtggcgggtgcctgtagtcccagctacacgggaggctgaggcaggagaatcgcttgaacaatttctataggtatcagcgatgcacacatcatgaataataaaacctacctgtaattgtccacaaaacacagattcctgttaaaggagggtagagatcagctaggtattgaaaaatccttcttattgaaaaaaagaaaaaggctgggtgtggtggctcatatctacaaccccagataggagctaatatctataatccactttgggagaccaaggtgggaggattggttgaacccaggagtttgagaccaggctgggcaacatagggcgatttcatctctacaataaccttaaacagttagtcaagcatggtagtgccctcctgtcgtcccagctgctcaggacgctggggtgggaggattgcttgagctggggagtgaggggtgcagaggttccagtgagctgagattgtgccactgcactctagcctgggcaacagattgagtccctgtcttaaaaaaagacaaaacaaaaccaaaaaaaagcatgattttgtttggtctaagtccttaggtttatacctacttcaataacaaaataattgtggtgaaagaatcagatttcttaatgtcttgtaaacagttgataccaggccaggcacggtggctcatgcctgtaatgccagcactttgggaggccgaggtgggtggatcacttgaggccaggatttgagaccaacctggccaacatggtaaaacctcatctctactgaaaatacaagaattagccgggcgtggtgacgtgcacctgtagtcccagctacctgggaggctgaggcaggagaatggcttgaacctgggaggcaaaggttgcagtgagccaagaccaagccactgcactacagcctaggcaacagagtgaaactccatctcaaaaagaaaagagctgataccaaaggaagcttatttcatatggtatcagcaaatttcttattttataagaactctccattagcattatcatggtatatatttacagtaaaaagaaagatacatttccttccaaagttcactctccttttccatcactaaggaaatacctaacttcgatcttcacatagtcagtgccatactctcgaggttatggaaatgttccacggtttaaaacaatatagataattgtgaagtaggtatgcttatgtattaactctttgattctttaagcaattatgaatagtaggggagatacttctgcttcctgtaatgataaactatgtaactgtagatcaatcttcccactgaggaacaactaaaaatcttaatatcttccatcagttttgtaaaattctcactatcatcttttcatatacaaaagcagttcaaaggacattctctgattattgtagtgggttactaatctggcttctaaggagaatgggtcctgttaactactgggtgtttcatcttattgttaagggaggtgagtggaatctgcaagtttaggggcagagtaggaattgctctgtaaagtgtggtaaaagaaaacataaaagctgaatgttctgaggggaaagaaaggagggatctttggtgcccacccatgaagaaaagatgactacagagaagatcaatgacttaagcagaatttcaggtggtttcactgggaagcatacagtgtaaatctctcctcagcccctccccagaaatgtcagctaaatctgttactccttatttcttagataggagtaagttttggggtattggggagcacttagaggagagtttcaagaaaagaatgaaaaggtagctaatgggattatataacatcctacatgataacgcatgataaagactcaaatctgttaaatatagaggatggtgattatttgttaatgatcaatgtcagctgattaatgggaaataataggattaaggttttgaggaatagatttagattaggcatatcatggggaatttctgatgagatgactgtaaagtaggagtattatatcaaataacacttaaaagctctttctcagtgatggagagaaaagccatttcttggaaacagtatgggcagaaaatggagttggacaaagatcaattcagataggggagaaccctatagcacttagtgtcaaacccatgaaatcaaaaggtcttctttagtatctaactagttattcatatacagatgctcctcaatttatgataaggttacattctgataaatccattaagttgaaaaaatagtaagatgaaaatgtatttaatgctggcaatacaacagacagtcctcaaatgacgatggtttaatttacaattttttaactttacgatggtgagaaagcactgtgcattcagtagaaaccataaccccatcacaagttgtaaggagcttcttgacttggagttacatcccaatggagttatgtcccaaaagcataagttgaaccatcctaaatcagggaccatctgtgtttataaaatcactgaactttttcctgaagtgtcacatcacactacattgcacctaaggagagatgccactcctactctttttccagttttctgttaaggcagaaagataaaggagatatatactctttctcccatgctctcatagcactctgtaccttgctctatcccagcactttcactcatattctagttagtttatctctatcatgtctctaataaactataagcttaggatgatcaaggaaactagtcatctgtgcataccctgcagctagcaagcaaagtacctgaaatgtggtaggtgttaaatatatatataatatagttataaatttataaaatatattttacgttttatataaaatataaatattttacatgtaatttcaaatgaattcatgcaaggaggaaagaagagaggaaagtaaaaaatgaagaaaaaaaaggaaaagaaggaaataataaaggaaccaagaaaaaaaaaaatctcagttccagaatttagtcccaaagcttggaagtttaaagctaaagaacacaatgagggtggagggatttttcttgtatactagaatacagatgaattcaaagtgtcaaagaatgacaattaaaaaaaaatctgtcagatctttcaagataagctttagatgcacttaacaagtcaccctctaagctttaagattccacacctccctggcaaccaatgtaggatcacaagcaggttacagtgatgttctccttttgtgagacttcttgcagctgctctttgaatgagctgaaatctataaataactgcatctccagacccattaagcagtacattagtgtaacaaaggcatatatgtacagtactaaagaagtgaaattgttggaagaaaggaaaagtttccatttggcatgcaccacagaggatgaaaagcagacccaaccatttctcaaacatgaaattccattattggtttgtgattacatcctccacttttctactttgtatagcagccaattttaaactacaaatcatcatctttccatcttagagaggacatggtttctaaatgggtaaggttttacccacagcatgtctatctttgaagaactctatattgagagaaagagacagaaagagagatgacctgaaggcccccctctaaaaacatgcaatcaaacaaaatgaccaaatttgccaaggagacaactcaactagcatgtgcaggacagcagagaagaacaattttcttttggcacaaagaaaaatatcactcggcattacaaatataagtgtagagacatgacaagtaaaattatttttctcaggaaaactttgcttttggaaaaaaatatgctttatatatctaaattgaacaaataacaaaaaaaatcttgagaccttatgtataaagtgcccctctttccattaaaaacagaaaagaaaagaaaacaggccttgatgctactatggtaatatgtagggattggtaccatcggaggtttccagaagccactggagatcttgccacatatcctctgtggggaagggaggctactgtatgcagttttaaagtctttgtataggcaggttttaaagtgtaggacctttcacatttagacttctagagattttctgaaaagggcaacattagacttgaagacagtttatgaaatacgtaatggctcaactccttcccctcattcatggatatcaatcaaccacatacacaacctgctgtcatatgttgttgttttctactttccaaaatacacagaccataaaaaaaaaagtgatcaccgctagactttgctggtgagtaaattattcaagaaagcaatattatcagtaaacataagcctggatccattaaagctagaagagtcccattttacgcaaagcttttctaagcccctgggattcagggcaaacacatacaggttcatagagtaattcatcaaggtttgaagaatcaggtaaaacctgagtttatcaattcctacttctcccagataaacatgtctccaaaatgtttctgacaggcaactatccagcctcagctagtgatgggtgtggcagctcactgtgccagatagtcctaagagttcaccgttctctctcctgagcacctatctgaagaacaggagatctaaatctaaattctgtcctcaaaccctacctctgcagtgatatgtggtcttggaaagtgactcttctatccctggaatagggatactgaggcttaactaccatcttacctagccacagataaatttatgaaagtaactaaggacatatcagataattcttgcctccccctggtcaaattttttctgtgtttgcactcttgtgttcttttcacattcacattctaaaagttctaaagagtagacaatgtaaacagaatgttgtaactaaataaaagcctcaattaaaatggcaaagctatggactcctgagacagagcaagagagacaggaaagagtcgtcttgaggaagggataaggcctctgggacaagatttcaggtggatgtcaggcttcaaagatatagccatcaaaagaggtgaattctataaaccatacacatggcaacaaatcaaagcataattttgtatgcatacacagtacagaaaggcaatgttggtcacatcccggcctcttcagctgcactgatacacagaaagcaatttctgtaaacattattgtcttcttacataaaggaaatcagacaatatataattctataatttgtgctgttttgtgctcagctttttcattatgtactcattttacaccttgacccaaccgtggaaaacatattaagctagaaagtggaacattttaattgtagtggataaataactgacccttaaatggtggcaaactggcaaattagttatctattttccaaaaagccctggttagagccctttaatttatggaaatctacctgcaataaaacccagatcagaccaagaccagcctgagccagttgctcatcctgtttaacatttctcccagtagggtgacaaataacatattagttactctttaaacaaatgtgctcttaatgatgccactgccgcatgatgaataaagcattagccctgcagtcatgatcgccctgggacagggagcgttagcagaacacacccaccttgcatggattgccctgggtgagagactttgctttatctttctctaaatgaccacccatagcccttgctcatgctctgtaaccagtgagcaagaacagtggagccttgggtcccctgtgatggtcctttttgcttctcagggcctcataaatggtatggctatatcactgggagtaacccagaaggcatgatggggtagttaggggagggctatgggggcacaggagcctgatgcaaatgactgcacagcagcacatccagttggaaagttccagttcagcagtgagcattctgaggaaatgggtcaaacctttagtgctgctggttatatccagcaagatttaaatgaaggtgctcagaagagaaaaaggcctgagtgtccaaaaggtattcaggctcctgaggctagaggcagattagggggcacagaaaggtggttccaacctccaggaacatacatgattcagaagctgaatcctggttatttcttggtaaaaggtctttatgttctagctgcttttggaggtcaggcatcatcaaaagcaggaattggctacacctggttatctcagcaggccctcataacccagaaaacctccatggaggctcccacccccatcaaaagagatgagagaataaatgctgatggaaaggctccagctctgaaggcaaagttgaagggcactacaaaacactgttgctacagacccaaggcctttaccctctgtctgtcttggtcacagatttgcattaaaatgtcctccacccctaccgtcccccattaacacattctccttttcaataggaggagatatttgcctcttaagaatgccacataaaaatccttccttacaaggagatggcatttggaggactatgttcctcaaatagtctctttttctactacagtcttacagaccaaaggacccatctgcctctgagcaactagtctatttttttaactagggctgtgttctcaactaggcactagaggcataaggtctacaataatgatgaagacctgaaaatattttgtgtcaacatgcaatgaaaagcacactatctaaaacaaatatttaactaaatgtttataaattccatattatgacaattctaattatcaaatttagtattcacatgaaagtcattatagttgaaaaccatttgtaactgggctatctcactttgcagaaattactgagtgtgcaccattatggagaaattagagctggttttaaatgaaagaaataacttgcaggcaaataatttcaaaagcaaaatgatttaaaaaatcatctccaaagttcctataaacaaacttatactaaacatcagatgtgaacacacttgttatgtttgatctgatatggagtaagtaaatctgctgctgcctagaaaggttttaaatggttgtgttctgaggcactgtctccttcctgcctactgtgtgtaagataaagctatacttcctctcaaatttgccaaactcagttcaggatcgaatgccattccgttatttattcatggattacataaataattgtggaaaagaagaaggaggcatgagcaaaaattgaccttaaagaatacagatgagagagaaaaatatctggctcatggtaccgaatgcaatttcatgttagcttagagtcatcgtatgtatttaggttttattatttataaaaaagaaatcgtgctgaatgttctttgtgggaactgcaatatattgctattgctacgatggtttactattttcacagctagatggcttaaacccaaactaaacaaatattttaaaagaattcccaccagcattattacttttttttcgtttctagtgttaatgaaaaagatcttctgcttttcaagtcctctgatatctttactcttgagcaattctcaattttatggcttatgatgagataatgtttattgaaaaataacaacttaagaaaataaccagcaactagtggtggttaagcagtgcagtgtctgaagtgagggcatttgagaactgcagtggctgtcaactccaaatattcaccaggtcttgactattacggcaattaggatgatgattttattacttgcacactgaagtagacatatttttgtgtactcatccaagatatcaacttgacagtgtctactacacacagaattttgctaataagataaaaataaggtagatgtgacagtgagacacataatcaacataaaacaaaatgcaccatcatgtccagacttctcactgtatgaccaaacccttactttaataggggtcaccaccttcattcaaatgcactccccaaactcttgctatcattcttaactactggctaattcaccatccttttctctagggataaaatttgcacagaaatgcaatgacacagttctcttcaatctgagagtaaatatcaatatacactagagaggtggggatttttttgttttaaaaatattattgctgatacatgtaatgagttcaaacaaagctaaagtctataaagtaaaaggggaatgccattccgttactccttatctgccagccaacacactccccagatggaaccgctgggaaaatagctccctatacagcagtcactgtggcaagaaactcacatcctcgatctcatgaaaaagactcacaacaacctatgagatagatgttattccaactttttacaaaagaaaataaactaaggtccagaaggctattcctttggatttttacccaaggtcagaaagccaatgaatggcagagcccaggactcaatgtaccctagcctggatgtctgttgttacagatttggggaactccaactttctcccacaaagagtcagactagaaggttcctctgggtttaactggctctaaagagagaaagaagtctagggtaaaggttagttccatccctgggggtagatttatttatgcaacatatctttataagatgttgactgtatgtagcactgtgcttgataccaagaacgtaatagtgaacaagacatagaccctgtcttcaaaaagtttgcaataatacagtcaggtaactaaacaaactaaaaagtaccagcagacatgaacttgctatagcatggcaaattagatattcttaggaacatgcctcttataagaaaacaacaactagattctggataagaccacttatttatgtattactaggctttctactaggcttggtaaaggaaaccctgctagacatctgcttctaaaaagaaagaaaacaaaaaaagttggctgaaaccagaaggatgagccaggagtagtaagttgcttggagggaaagtgccaacatcagcaatgcaccaggagatagcctgtcatggcaaggtcaagccctggtctgaggtttccatggcaatcaggacctgaagatttgttgcacctttacatggcccttaccccagtcagccttctcaaactctcgacttcagttttagaagtaggcaagtgaaagaatctgggcaaaccagcagaaatcactgctgaaagacaactcaagacccatgctttattgagaggcacatttttcttaaataagtcagaataataattgtgtacttagagaaagagagagagagaacaaacatataaagtttctacctagggttgatctgtaatccaaattgggcttaactcagtccaaatatatatattgagggcaaactgatggtttaagctgagagcttgggataaagaaggtataaacatcatcattatcaaggactgtccaggtccattctccccatgtcaacagcttctatttgcaatctctaaatcatccacaccctcaccacaactgtactgcctgatagaatgcactagtgagtgaggcggatggcaaagtagaaaggctggtcccagctttatatatagaaaggctgggaggtggagtcaggttactattactttttcttacctcatcccctttctgccagaaccttcttctgttctacttctcttacttgtaccaaatacactctctctaacacgagctatctcatcatgttggcagctagctacaaggaagaggcctggaatgcagttctcctttctacctgtcattgggaataggagctacagaaactagggttggtgaggcgggtggggggtactgtggaggtgggtaaagccacaagctggataaaccagaaaacccaacttctaactcctattccaagggatagctgacattctagaggtgctgaaagagtgaggatctatgtcagttatcatgtgggacactgaaatcaaagtccctctgcatgctgattagaatcatcacccattgtggcggctattttttcattctcagtagagacaaactgaaaccctgagaactgatctgggcaagtcgctttctctgactctcctaagaaacgtgcacagcagtttggcagcacaatttgcataccagaggagagctcctgtcacaagtaccctgtgggccagtttcctgagcttttccacttgatgctttcaagcctcatctcacgagtcattggagaggctaacgtataatgccttttggaggagctgaaaggaataaaacattactagcaaaacggtcatatattttgagagttaaaatctagatccctttagataggccctctgaaagaaatgctttcgactacgatggcagcagcaaaaactctgttaaggacagcttcatgagcacaacttcccagccactattcccacctgaaaagtacatattctggtctgcatttttttttctacaagtattttgctttgattcattgttgatacacatgacagcagaataataaactaggtagtttgagcctgtgtgtgactgggattcggcataagcatcacaattttggtttgtaaattcctttggttcagtagatcaaatggggaaagacttgtgtaatgtgaaattcaatgaccagcaatggcagggatcttttggatatgtaatctgctgttggagccatgcttggggaccaaatagatgagcaggccatgttaggaagggcagcaaggaaaagagaaaacatgaattaatattaaaaatgtgatgcaaaataaaatggaggttatagtcatatccttccaattgtattgagctgaaattgtttctggatttggaagctccttgctaagctaaattgcaaaaataagattatatgaggagaaaaggtaatttccaaaatataataaacataatacaattactgcacacttatatatgaaatccagaaaggtatatttctttcacgccatgtgatcacagttttgttacagttttatgttcttattttatgctttccactagttttcttgactttgcatattcttgatgcaaatcagtgaatgcatataaagtgtaaacaataggctctcaacatggagcctacccaaatgatttaactgtgtagcattgattatcttgtccactgtgtgagcaacgtgcacaaaatatgcattttgtatgttacggaggtcttgctgatgtggatgaagaagtgtgagaactaggatggagaagaagctaacttcaacagtctactctttagtgtcctccctttacataaaacaaaacaaacaactgatcagctactagtaatcaacaaacttaaatttgctgagaggaagtagttaaatagcaataccaagatgtagaggttagggaaggttgttttgcccctgcctattgacctacatatactgaagcaaaattggaaaactgcagcatatttggtcacaaggtctttctatttccattcataatttcttttctttattccctctttttttttgttcttcagagaacacctttcttgatatgggtgttttaaaattctgatcagaactggcagtgggaaaagagctgaggaaataacggagactcatacttatgtgacacattcacaaaccctatgaatttttaatgaaggcacaatgtccacaattagatttgaaatgaggttttctttgtaggcgctcttacagtaagtggagtgcaagcgaattttactttatattcagtaaatgataccaagtgcaaaaaacactacaatttaatagaaaataaaaacaaattgttgattgttcatagctcctttttcatctcttagatttacaaaagtgtagcagttaaaaaaattgcatttcgttttatttaaataccacatggatgccaaggcaactcaaaggtatagaaagtcattttcagtcatgacctgaagctgtccttttgcattgtgtggagaagtttttgtttgttttaaactgtaaaaatgacttctaaatgtagatctttggggagaaagatattaagcttccctatttgcaaactaagccatttcaaatgaacataaaaaaaaaatctaatagtgtagaaaataaggaaatagagtgggctgatggctacttcgtttgcattttgattttaaagcttaactcttgtcttcatagggcttaggttttcagcttcgcagaaacagacacagtttcccatccttcttaggtggtttccaaagtccttcagtttctggctcctggtcaccttggcaacatcatttcctaaagctgcttcttctcttggagctcccgcaacacagatgcttttactcttccttgagcctagcaagtgtgatcttctcttagtgactctgcacttgtggttcctccaggtaactgcgcaaccaccctgctccctcacctgggcccttctctgacgaaatgtcatccctgacctctacctaaaatagcaactgcgtcaccttctgtccttctactagccttattttctttctctctaggatttcttggcatctgaggttatattacatagttatttctttgataaattagtcatccatgagggcacacttatttttaaccttttaaaaatgtttttcttggtaaattgccatcagccaaaacagtgcctagtacttagtagacacacacccttccctcccacatacgcaaattcattgattaaatattatgagtgggtgtatatatacatacacacataaatatgtataaacacaccgtattaatcattactgtttgattttctatattcctgatgctttgacatatgggtccttgctgacattggagggatctcccctcccagggctagccaatccaagagagcaaacgcctcacctgggagcacacacgtcataggcaaaccaaccaatccagatcccagaccctcgaacacctcctttactggctctcagatgctgaaccactattcctctggcctaatcaccccggagccaagtataggccttataccccagagcttaaattattcaaactagcccatcctacgcctgtttattccaccttgccttgcctcctgttttgcagaaatcacaataaaggcgctctcacttcctctcccttctgactgaccctggcgcctccctgtgtggctcctcgttgtgtggtgtggcaagcttccttctctttggaactgtgaataacaaactatcttttctatggcagtcgtctcctgatctgttggccttaccacaccctataataataaaaactgcattttcaaatgcaaacaaataaacactcaaataaaattcactgtattttcaaggacaatgaaatatagtaatcgccagaagttatgatttttctggactcataagaaataaaatcaggcagggtacagtggctaacacctgtaatcccagcactttgggaggccgaggcaggtggatcaatttgacgccagttcgagaccagcctggccaacatggtgaaaccccatctctactaaaaatagaaaaaaaaatgaggtgggcgtggtggcgcatgtttgtaatcccagctccttgggaggctgaggcacgagaattgcttgagcctgggaggcagaggttgcagtgagctgagattgtaccactgcactccagcctgggcaacagagtgagactctgtctcaaaaaatgaataaatacataaataaaaatagaaagaaagaaaatgactttgacattttaaagatctgtgtacagtttcaactccgtctcagccctgagattcatttatgaattgcttttgtggttattattgttgctttctactttcgccctttaagtttttttgtttatttatttcttttttttaagggggattcagacactattacctcaaaggagcagcgctgccttattctttttgctagatacaaatcgttaaccctattcaccaaacagcaattaattgtcaataaaacacatccacactgtgaactctggtgtcaacgtaggcttatcaattgtaacaactctgagggggatgttgatatgggggagaccatgcatgtctgaggtctggggctatctcttagtctgtttagggttgctataacagaatacccgaggccaagtactttataaagatttagctcatggttctgcaggctgtacaaaaggcatggtgccaacatctgcttggcttctggtgaggccgtttcatgctgcatcatagcatggcagagaaaatcaagggggaagtgaacatgtgtgaagaggcaaaacctcaggggcatcctttttataataacccactctcatgagaacattcctcagtgaactaatccagtcttccttgagcgagaactcactcgctacttcaagaacaacaccaagccattcatgagggatctaatcccatgacccaaacacctcctattagacccacctcccaacactgtcacactggggatcaagtttcaacatgagtgttggtggggacaaactcaaaccatagcagatatatgggaaatttctgtaccttctgctcaaaattgctgtgaatctaatagtgctctaaaagaattgtcttaaaaaaatacatacacatatatgtttattctctttaaatataagaaaataataaatcctatccataatttcctaaattatagttagctctaaatgtaataagaacacatttctatgacgtgatgcactctgagttttttcaacacatttgttccttttttattccaaaaactatggttcatgttgttccatggccaatttgccagatgcttcaacattccctgctggaacgcacctcagacagggctaagtcagggccttccaggggcatggcaaccatgaaaactgatcctgggaaactgacctttaatatattttcatagtaagctcagaggaatgtgctgggtgattacccattacttgtacctggtaaggacacaggcctgaagctagagtctttgcacagtagagatgggccagcaagatataaagatgtccacagaagtggccaaggaaaccactagaatgcactggagggagcctcaatccagtcagttgctaacactggcagtagggccttccctgggatttgatagcctatgcagctgtcttcatgcagttcagattcatgcctcctttacttaccttacagagctcttgccaacatggtcaccctggtgacaaccatgtgctctctaacagaaatacctgaccctgctcaaggtattagaaacaataagagaataatttttaggagacttgagagaggtcttaaaactgtgctcatatgctttttttgaaaacatggttttcaaataaaagcaagggttgagacatccaaggagctagtcgctctccctctagtccttcggccttcctttctgcctggtgttgcacattgcctcccacacgccagtgctcacagctgctccactgtgggtgtggctgttccttctcttctctatgcttctctctttttaggctcatataaaggcccacctcctccaagacaccatgtaagatcaattttctacaaccacttgctcctctgaaccccagagttccccaagggtggtatgtcagaggatttaatgtgggacccaacaccattattttaatttttaatagctatatttgctttgagtcatgtgaaattgatgtttctgtggatttaaaaaatggtcaaatattggcagtttcatgtagttcaacctaatatgtgtcagggaaaaaatattaaaagaaaaccagacatcattgtttaggatgaggctaaaatgagtactttattgaactgtgtaaaaatgaataagtaaataaacgttttgatggtacagatacagcaaaaattattaagcttgtatccactactgaaccactgaccaaatgtattttgacaatcactgttctacgtgtccttttaacgtgtcttattattgtgtgtgtgtggtttttttttttttttttttttttttgtatatctatgtatttgtgttttctcttccattagtttcctggatatttgtacacaagaggcaaggagagattacaaacctcttagcataatacccggcacgcagaagacggacttgacatagggatttgtctggtcacttatgatgagatcttaccaggaaacaccatttgttttccttatggtcattctaaaactggaaactgatgggccacgcaatggagtatgccattccagccaggaaacctacaacctggagcaaatgaaaacacaggactcctatggagcactccacgctgggagctaacctcaccactgggaagcattaaggggtagtgtggcctgttggtcagaacatgaccatctggactcattctcagcagtgtgattgtacattacatcctccacttctccattccaactgacaatgccaccaatagctgagaaagtggaggccatgggaagctggtacctactaggatatcctattggctcctgtcctctctgcccagttactgaccacggcaccaagcttcagattctgtttaatactgtcctttacacaatggtgcctgggtcttttgaaatggatagggataattatgattcatatgcttcaagaaataaaccacggtactcacacaacctacatatttcatttctattttaaaaacacaaaatacttacatgctgttggtgttttgaaagcttttgccacttatgcttttttaaatataatggttcagaaacaaaattctgcctgctaatcagtctttatttccattcataaaaaattatgtctccataatacctaagaggtcaataactagatgttgaaacaaataatattaaagaaaaatatttattgtagaagtctgtggttgaggcagaagaaaggtgttattttcatctggggtatcaagaaaacaccatgaatggagaagaatatggtctgagtctcaaaggattaaaaaaaaaaaaaaaccaacctatgtgggaagagagacagagagaaagtgcgcaggcagctcaggcaggaaatggtaaactcaaatgtgtgaaatcgggagcgttggaggctgctgaaaggacatagctgcctctttactattttacatttaagtcaagttattcagattatattggtctctgtatgtatataatgacaatagtagttttattctctaaaaagttgctttgagaaaaatgtcaagggatttaaatgcatgcttccaaagtacaatgttttcctacataaagatgctggtttatcaactagaaaactaaagtgggcttctttataaaagatagactgaaaagattaggaaagtcttgacaatataaacatacatttactcaccaactcatgaaatactaaaactaggttttactgctcaaagaaagcataaaatagatcatttcagtagaaagaaaataaagcacattttttacaacatagaaagtaatctcagaattcattaaccaagagaccaaaaacaatacctaaaatattatatatgttaagggagctttaaataaagtcatggagagcagatttacaatgctttaattgaaccaggataggaatggcaggagtctgttcacaacctttcatggcagagaagagttatataacagccttgatattggccagctgcaaaaaaagtcaataacaatatgaagatgacaggacttttggaagaaagttactatacagcttggagttcataatattatgtgaggatagagaacattaattctaatcagatccacatcattatttacagaaaacttttttttttaaggttcagagaaaatacaagtgtgatataaacacacaggtatcagggctaataagtgtaagagagatttagaaaaataaaattttgattctataactggatagtcataatcctagtgaaacaaaaagagatgccactgtagaaatcactatggcttacaataatttctctgatgaattttgattctaaaatgacaagtaataaatggaaccaaggacacgagggtaaagacaaacaccagtgtgtgggaataattcctagaagaatgctgaagaggcctaaatacaggactgggatcgaacattttgaaaaaacataccaaagggatgtttatagaacatattttttaaagtcttcaaaagaagaacaaggaaaaatagcaatacttttggggaaggccattaacaataaatagcaaagatgacagaactgttcaactcccattttgtgaatccacccctgcaagcaaaataatccgcacattgggaagggtagaataaacaaaatacgcatggaatttcagcctgacgtggtgatggggggatttactcaccaacccagagctagcatcagacattcacagaacaagccagtaagacccaatcctgcaaccaacataatatgacactaggttaaatgcttccactttcctttcccgaaaatctgagcttgtggcaactttatcgggattcaatcatttgaccttgagaacttagtgcaactatggaaatgacccataatgactaccggaattccaaagagttggtgccagttttagaatgacaacttactaggtttgtgacctggggcaaaagatacaggatgagactgattttcacatattagaagtaaagcggatatagaaggtgaactagattagttaagcaatacgccaaagaatggacttagtgccaatggttagggtttatggcggaccgatttcagggtcatccattctttttcccattcattcagtgaatatttagtaacttccactgtgtgcagcaccattttaaattctaggtgaacaagaaactcactccaaagaagggagacctggaaaaataggtcagtataaagcagataaatgggtaaatgcattaaaacgcaggttaacagaaacaacacagaagaaaaaacaattaactttgaaggtaattttagattttctccaaggttaaatagaggaaaaaattggtggggagggataataaaacaccttaaaatgtgtttcaggcatgacaacactatgatcaaaaatacttctgtgtgaaaagtatgtggcatgatacagaaaatgagtatttttgtttggctgtagtttaaagggaacatggtgaaaaagtggagaacgatgctaacaatgtaggcaggggtcatgctaaggagtttaattcctacaggcaatggagaccaaatggaatattttaaatggggagtgacagggtcaaatttgtaatttagagcaataattcttagagaagtacagagtaagctctacaggaagacaagcctgaggagggtaaatctatttggaggtaattatgggagaccagacaagatgaggcagtggcagcggagatgaagagagggaacagatttaagaggtacttctggagacagaagagatagcaattggaatgtggaagtgagagggagtgagtgacatgtgtgagggcccaagaaggtaacattcaaaaatgaatcccaggtttccacctcaaaggaattgttggataaaaatagggatttccatggcacaagaacacttaaaggattagtttagttcaggaggaaaatgtaagttttccacagagcaatcaaatgcttcaatattaaacttacaaaccatacaaaaatgtatctgtcccctggatggctatttgcttccctcagtagccacaaagctatgttgtatgcctggcacacagtggctctcaacctctgatgggcattggacttgaatcaaattgcctgaggagacttttccaaatgcatatgcttggtcttcacccccaggagattctgatttagtggatctgatgtgaggtgcaggcattttttaaaacagctccaaaggagattctgatatgcatccaaatctgacagccactgtagtatacagtcgatccatagctctttgagtgattagttaaaaggaggaagggaaggagagggcttcttgaaatttttgaagaagcagctggttgactttctatgctcaacagtgtattattgtgtgagaaatttactaaatgaactttcctgtcttttaatctttttttttttttttttttgagcggagtttcatgcttattgcccaagctggagtgcagtggtgcaatctcggctcattgcaacctctgcctcccacctcccgggttcaagcaattctcctgcctcagcctcccgagtagctgggattacaggcacccgtgggtcacacctggctaatttttttgtattttttttttcacttttttttttgagacggagtctcactctgtcacccaggctggagtgcaatggtgagatcttggctcactgcaacctctgcctcccaggttcaagtgattctctgacctcagccaccacgcctggctaatttttgtatttttaatagagacagggtttcaccatgctcgtcaggctggtctcgagctcctgacctcgtgatctgcccacctcagcctcgcaaagtgctgggattacaggcgtgagccaccgtccctggccttcctatcttctaatcttaagggtccacaaatgtgatgttatagtgttcctggcttcaacttgcagacagaacactggctgagagattactggactcactcaaattcaatcttttcttatatttttttacattattgatgaacatcccttcttatagcaactcgttctttaacattttttgtgtgcttttacatatttttcatttacttttttctcaatgtctattcctcctactagactgatgttctatgaaagcaagcattctgtttcttttgttcactatcgtgtatgtaagcactgacctagcaaaacacacacgttcagtcaataaatgagcaacgagccagatttttctggtgaaacatttgaagccacaatgcattattttcaatatgcctataggtacatccatgagtgtattatagattcagaaaatggtttcagaaataatcaaaagcatacagctataggcaaaacatgtttatatatatgtatattttttacctcgaggaaacctttgactcccaaaatttttatgttatgtaagacagccccttacatcagcaaataaaattaaaaatagggaataaatatctaaaagggtgaattaggcacagaggtgtagcctgagaaatagaagctaaacctcgttcctgttccttatctattaatagatctcagaagcctgaaccttgaagtctgataaatctagagctttcctgtcatttatatctaatgatcaattctaacagttagacaaaaaaccactaaatgaatgaaaagatgaattattgagaaacttagagggtcttttagcatggcaattaaagaagtagaaacaagtggctaacttgaagagccagaaatgttaaaaatctctgtattaatagtgattactgaagtgtttttaggttccaagttaaacatttgctgacactgcttactacaatatgtaggtaactcacgacatttttaaagacattttactgccctgagattgaatgtgagtttttttaacaaaaaaattatcaaaatcagaattctactttacctaaaatttgccaagcaactactatctgctactactttcgcatgtatcatctcatgtagtttccataaaaactgtactttaccaatcagaaaactaaaaataagagcaaccttagatgaatgcctaaaactagaatgctataaaaagtgttaattataatacaaatcactgaagtatcattttatccaggtaaatttatacatatgtataaaagtgtatttttaaaaatactaaatatgaacctcaatcataagaatgatacaagaatactatgttttgattaatgataaatttggctaactggagaaaacattgtttcaactgatgttatcaaacaggttttgaaagcagtaataagacacattgacatgatatgcttgatacacttgagaaggttacaccacctctgtggtattcttgccaaaattttataacctcaatttaatcatgaaagaacatcacacaaacccaaatcaaggatattctataagataaccagtacgcttcaaaaatttcacagccatgaaagacaaaaaaagactgaagatctgtcctactgatttctgatatttctaatgtaagatcagtagtcattacatactattggttgtataaatataggcctaagaaattggaatgattccatgttgcatccagcgtattaactaagtgttatgatgcaaagttgtttgtatattagctgcaatttcccccatgacttataagaaaaaaaattccttattaactaatgactccagttaactgattgaaattacattctactaagctaaatatacatgtcatttcttacaagggctgtatgtttttataaatcagtatctcagctcgaattgttggaattatcatggttacttccattgttcagacaggaaaaaagacaggagtagtaaaacaaagggagaggggccatttgcagcaaggagaaaggaaacacgattctaaaacacattcattaacccagggctactactagatgctctaggctagaaatgaccaggctgcttctaaacagattttaatttttaattcagtagaataggtcagatacagctctcccacctggaggtcctgccctagaacctacctgcccgaaggcggcactgcgggtctgctggtaatcatcatctttgggcaaatgaaatctccagtcagctacacccgctctgtatgttgtgatcccaagaaccagtaataaaagttggacaagatctcacaatgaagtggaggttttctccttcgattttttttttttaggagcaagaaagaacacttttttttttaagccattagaaatgtttttaaaggtagaggtagaaggagggatgttggtgtttgaaataaaattctaataaataaagatcagttttactacttaattaaaattgggtagaggcatatatgtgggtccaaatttgatgctcaccatacaaatgcccagacacgagagagatctcctgggaaattaaaacgcctacacgtagggagaattgaacagaccagggccccagagcctccgcacatggagctaaaacaagcatagaggagccgagtcggactgattccccagctcttcacagcccccagattagctgggtattagtgcaggctggtctcagctgcccatgaaaatgagaacacattttaaaacctgcatttgaattttaaaggtactcaacatttctagtattgtttactgaaaaaggtcaacactcaagtgttttatttatgcacggcagaacctcagtctaaaagcactaggctttccatatggcatagcctgagaatgtgttaaatatgtagttccagagccaagaatattatttttcaacttagcgaatgcattattaaaagacctctgctgtgcccaccactgggagatagggcaagaggcagcagtgaccctgcattctgaatgcacagagacactgacagtcactcactctaaataccaatgacaatatccccaaacccacaccaccctaacccatgccttgctctgaatttgggcagtctggaaaaaatgaaaatggaaacctttaaataaaactcataaaacttcagttccaagcacaatatttttggttctttggacaataagtgtttcactgagatttatgcctagggtccttttccatatcccggctctgtgtcagcgttcacatcagccctcagttcttcttgcaaatcaagggtataatatactgattccttcaaataatatttgtgttaaaatcattaaatgcccatgcaagtaattttttattaatgggatgagaaataatacataatacataccaattttatgacagcgagaggagttattaactttagaatatctgttgtataaattaaaaatcttaagaataagtccagtgttttaaatatactatggaaaaacaaaattaatgccaggagaattttgactggaatatagaaatgcctttatcattctgggaaaaatactaccctataaaagccacatcctctgataagttcagaaattatcctttttatataaatattattcacttggaaaaatgttttctataaacagctcccttagtgcattttaacacatacttttatttacagacattagatttacacatgtttccagtataaatctttcgtatatagcaaagagaatctgtgaccaaaaattctgttcaattcggatgtggggagcaaataaatgaccaatgttcccatatacatagtaatatatggctaattttatataacatgttcacattaaaaataagaacataaaaatttttaaatcttcaggaactgtcttcaggaaatttcagaagactatgacttttaaattacgcttttacttgatccaccttccaaaagctcagaatccttatattaaaagagctggcactgacataatttgatttaatcctgtaaatatgcatggaagtcccgatgtacatcatctactatgctctgcctgcgtgatgcaaggtgaatcaggcaccatccactgtccctcttgttaaggagtccacaactgtgctggcaggacagacacgtatataactgattataatgtacttgagataactggtatatcccggtggtgggaataagaggctttggcagcacacggagtaaagagcgaggatcctggaaggcaacctgcatgtagggagagtggaagctcacccgaggaggtgacatttgagctggttgtaaaggaagaataggatcagaccaggcgaaggagaggcattccaagtgaagaaaaaacaattatccacacatgccaagtttttcagatttgacttttagaagcgttttacttcaaaaaggtttaagtgtgcaatgtctaacaagaagcaaaaattacaatctagattgtttctttatgactagcctgctcttctcccacggatcctagctgtttaggaagtacaggtagtaagaagaggatgtgaagtactttggtagccacagagaaagtgagaacgctgcagtaactgaactaaagattagaattagcactgtaggcctgtgagtggggtcgggggagctaccagtgaattgaggaaaagcaaaagtgttttaagcagactgcaatagcaccccttttcagtctgcttaaaacataagccttaaccttcttaagaaagagtctgctaaaacacagtctgccaggcctatcaactacagggtctgcgaggaatttgctctgagctgggacctgttagtcatcagcaaggagagcaaggagagcggatcattttctttcaataatttaatcacactggtgtgagtggaggtgaaggctgagctgcaggcttcatattctacttctttcacagacggcaaaggaagagtagaaaagcaaggtcccctgggtggacctggagagagaaaaaagttctgggacatcccttgtcttcagctgggttctaggaaaaggccaggggtgacaatagctcaaatgaagatggccggtaaatggctgagaagaccaagaagacagactgtgacccgtttcacagtgcctaactaaaccagaatttcaaattcttaagttagctagaaacatatttcatttattcacattttaaaaaaatcaagttaattcattcatattggcatttaaaaaacgtgtataagagaggtacaaaaactgaattgtgttcattgttcacctttctttgagttctacatacagagtcaagttgtaggagggatgtattcaggaggacaagccttggggatttcactcttttattattctctgtataaaagaagatggtttgttggatccacgtgccacccgtacctcttccctgggcatgtggccacgaggcagggggcagaagctgccctgggctagggagacctgggttctggcttccagttctgggtctgccactgacccactatgtgaactcgggctggtcacagttttctcaagtaagaatgagaagcaaggactggactggactcttttcctggctgttttctgctccagtgctttctgattctatagaacaatactatgttctagagaaatgtttccttctttctgggttttttttttttttttgatacggagtcttgctttgttgcccaggctggggcacagtggcacgatctcggctcactgcaagctccacctcctgggttcacaccattctcctgcctcagcctcccaagtagctgggactacaggcacccaccaccacgcctggctaattttttgtatttttagtagagatggggtttcaccgtgttagccaggatggtcttgatctcctgacctcgtgatctgcccgccttggcctcccaaagtgctgggattacaggtgtgagccactgcccccggcccactttctgggtcttatacatttcttttttttaaaaaagccactgcaataacaacaatgtcccatctagtgttaaaacagggaacatggtccaggactgcagaatgaggaatggcgctcaggtctttcctggcttgggggttctgaatggcgattgaagggcatggatcctgctcaggtggtttttgttggatctcaatgacccaactttttcaaagagggcattttttaaaagactgtgttttacaacttttatgtgtgatgtacaacaccagcataataggaccattaccaagggcacatggaacaatctttcctattatttttactggcagctatcaccaaaagcaaaagagcctcctgggatgcaggtcatcaggcagccccttcctgggagataagaagagattctgggtgtgacgcaagcaattcagctaagctctggctcctcactgaaatcttcacagacataaacctgggagttctgcagggtttaatcagttcagccttcccttttcattgctttctttctgaaagctcccacgaggaaaacatctccaatctgggtaatagctaaccacacactcagaactttccaggttccacagtagtctgtctcccttcttcctaaatgccaacccacaagaaaagaaatcaagggagggaacaaatgtaaatactgagacaatgcaggtatctttgaaacaaatgatcatcttccttcttgtgggtttgtcctgtgccttgttttttttttttcattaagtgccaagacaatttaatttgtaaactgccatataaaaatggcctcattttggaatctgcctcccttttggaacccaggtcagttccgtggaatatttgtggagtgactacagcatgccagacactgtcttaatgatgtctgggctgagagaacaaaatgagcctggactcagaaattctccatctcactgcctattgctcagagctttgtggcccagattaccagaattttcagtggcaaggatttcctttttttttttcttcttaaacctgagtttcttgatggttgaatacatcccagtggctccttatcttctagaatgcttaaatgcctactgggctgatggctctaactcacccgcttgttaacctgcgttgatctctcctaactggctacctctctatgccctccatggctattctgccttctgggcttaccttctagtcaaatacttggaattctcctgtttataagccccatctaacttctgcccaaccttcagccttggcttgccagtttaatctgtctctactgtgatccacatccccaaatcagcttggttctcatgtgccccaaattgtccttaactccctcatccaacaatcccatattcctattccacagtctccatgcccatcctgggggcacagtactctttgactaaagtttagaatgatagtctctggtcagtcctgtcctaccagtcaaaccctaatctcaatccaggtctggaagctgcgataatcttgagtacaatacgaactggtaatcagcaagtggggtagctcaaacagaatactggcaaatgaaatttgccttagagggccatgagaacatagtggcctctgattaataccaaagaaagaaaacatctagaatatttcttgaacacctagagtaatgcctggtacaaaataggagctcaaaaaattggcaaattatagaaagatgtcttttaaataacacattgcaaatgttgaggatatgactgtctattgtaagattcttctggataaactgtctgattcgtgtgtatatcccaagggcccagcacagtgcctgacatatagtaggcttgataaatatttgctgaactgaaatgactttgttgagaaaagtatgtcgatgtcacttggtggaggatatctacttttccagcagtgtggatgagcaggacatcttaggatgtctaaactaaaggatcagcttggttgggcccctaaatttacatgccaaggtgttcttaaggcactagagtatggaagtctatcagatggacagggaccacaataggagaggggtaggaaccctgcaagatagtctgtgccctgacttacattccctgtctactggaattctctggacctttgggttttatccagaatgcaggagatctttttgacacctttttcactcattcatatgcaaaagcagaaatctgggtctggccaagcatctctgatgcatacatgaaatgtacatgagcataaaacagccagctatagcccttctaatggagaccttcatagctgccataacagctgatggattggtgtaaggctagtagttttgaagttatattttgtatttattgttgaagctatcagaaatgtagagaacactgaggtcaatcaagagtatatgattttccaagtatattaaaatgtgtttgtgttcctttcatacaaaacataaagcatccatctttaaaatgttcacagcaatcaatgcctttaattgagcagaaaagcatatacagatatagaaatgtttagtcctagccgtggttcctgacaatcatcttcagagataaatttccacaatggatgtttcaattaagacagtaatatttattgaaaggtaaaccataaatgtatagccactggaaacattattgaacagaagtaatttatgctgcagctggtgcactgcatttttgcactgctttgattttatcagcatttgtcaattaatcaacatgaaccttgtaaaacatgttctcttattagttggaacaggcaattgcttgcaaactttgcaggagaggtcatttaataatttgctaattgtgcaaagacagatttaaaataaaaataaaaaaggttaactctcattaccattgtacctaaataggactttgtttaagcttaggcttgccaatttaaatattgtcaatggtttaatttttaaaaaaacttcaaacggcaaataaagattaagatgaagatcaacttagctctaggtttttaaaatttaagagcattttttgtttgcatctttgccatttcaaagagttactagccttgaggctatagttataagacaaattgactatattttattgggagaaaagtgaagagaaaaaagaaaaagcaaaagaaacaggaaatgcagcagcacaaagagcaatccagtagtacagttcttttttttctcccccttttttgcctcaactcattcttcattgatctagatgagatgtcacctccctacttttgactgctggttcattttcagttcagtaagtgagaaagaagctgagtcaagccctctctttgggtaattcatgcatcagcacactcgccaactctcctggcaaccaagaaagcactttaactcagagcggcatcgccaccaacaagcattctgcagccatctaaaaggacgcaactgagtttaaaacgggtaacataccttggagagcaatttctacactggggtctgcagggctgaatcgagaaatccgcaccatcttagaagtgtaagtgaaacttaaaatgaaatggcatgccttaaggcatttataagagtaagaattttgcacagagttcacagagacaatgtttgttgaatgaagatgggccttgccagatacagtctaggcaaagtgctttgctgcagagctccttttataagagtttagaggcccaagttgctctctgcctgttcaaactggcttatcaatccattccattccattctgttctcagttctaaataagtcattatttcacgcacatttccctaagcagacgcaaacactgttttccagtgtgagactcccttgggcaaattaggtttcttggaaaagggtcaaggagcgatcaaacaaaatacctcctagaaacaagtggtttcaggggacattgtgatttatgcaggctacaagtcaaattttagacactggttgggcagtaatgttgaatctgatagggctagttatggggagcaaaatcctgctacctgcagtttctttttaaggtaataataaatgggcgtatttcttatggaaacaaaactgatgatcataaaacaatcaatagaaagtttccttttctaatattttgaattaaaaggtgttaaacaaattttaatttcttaataaaattgtagtaaagtaactttcataaggcaaaagttcatatcttctattctcacagtcttacctaacaaacatgaaatacttctaaaatagatacttcttattgttttttttttgtttgtttgagtcacagggagaaaagtcccttttatgttcttttaatacttgcttttattaacctcagcttcagttagctcacttccatatatcaagattctttctacaaccgaagagacaagaggtaaatgcaaatgtgggaagggaagctgcttggtaacacactagctgctccctggcagcagttatttctatctaaagcatatataccatattaagaggccatagtgaaaaatgaaaggatggaacggcaggttttcatttgtttttaacattttagaatgctgtaaataagtttgtgtgtttcaattcaaatggttccattacctcggaggccttaatcatttgtaatagcaatttcggaagcgtccaaagcttgtgcttaaggagtattattggcattcaatatagtcatatgatattaagcagatttacaacgttctatgtggttatccctgatcatctttatttaaaagtaagttctggctgatgaggtggcttagtatcctcatggattttggcttgttagccgtcccctgccagaaaatctggctctgctggacaccctcacacctctccaaataaaccttaaatttgcaaggtgaagtggggggcagcagatggcaggaagagttcaactaagaaagaagtttacaaaggcagctttttaagaaaatgtacctggggttttggttttattcaagtacgacgaggccaacagatcaggaggtgactgtcattgagaggatagtttgtcacagttccaagaagagcaggcatgccagaccacactgggctacctggggaggcaccagggtcagtaggaggcagaggaaatacggggaaaatgtggggaagggcctttattatggtttccatggaaagaacaggcaagacagagtaagcagctttaggatagctaatttaaataatttcagcaggctctgtggtatagggacggttcctagttatgcagtacctggccctggagtgattcagggcaggtaaatagtgttctggattgcaggagcctgataaaaggaagcaggtagtggcgtggactcaggattggttggtttgaatatcaaaggcgagctcatgggcaagatgtttgctatctctaggtatcagctgacccaggaaggtttagcatcccaagtccacaaggccccaagatgtcaaagcactgtaaaatacagaaaatttttaaaaacaacaacataattaatagaagcctgtctgaaacactgctataagaaacatgaaaacagagcttctgaaacttcactgtccacagggatcacccgggtattttgttaaactgcagattttgattcattaaatcaggtaaacgttgagaccttgcatttctcataaacttcttggtgatgttgggaccacattttgagtagttagaagtaaaaatatcatgaagggtcttctctctggctcatcttcggtcaggaaaggggaaggaccttacataccgagtcttaccttggaccagacgctgcaaggcactgaatatatatacttggtcttattttgctttaagagcaaactttgctagtgggaaaattatcccaattttataggtaagggaactcaggctggttaagtaacctgctctaggtcatttagttaaaaggtagtagatataaatgtatctggcctaaaaatccatttttctcccaccacaatgtaagtacacagggcactcctctgatggaaaatgaaaagtctgttggtaaaggcttcataaaatataaagcccatgaacttcaatagtggcccatttacaacttgacttatggaaagaagagaaatcagaatggtacttattgtctcacaattagaaataaatggtgtttattaataagtgattattttatcatagccttcacaaaacactttaaatgggagtccctataaaactagtgtttttattaaaaaagatacgtacatgtacatggtaagatatatacaataaaaagttagtcttgctcctagtctcctacttctactgctcacaggtaactactgtgaagtttgtatagccttgcagtactgtttctatgcaaataataaacctttctcatataaattcattcatttggttattctaggtacttggggaaaagcagtaaataaaacagacaaaatcccttatgtaggttatattccagtatgaagatagatcacaaataaacaaataagttatagattatatcagatggggataaatgctaacagagaaaaaggggagagcagacaaaacgttttcaagtacgaattcagtggttaaggaaggcctcattggaaaggtgacagttgagtagagacctgaaggaggtaatcttattccacacttactttttcctttaacagtacgtattaaatgcttcaccacagcagggcttacagatctacctctttctttcttttttttattatactttaagttctggggtacatgtgcagaatgtgcaggtttgttacacaggtatacacgtgccacggtggtttgctgcatccatcatcccatcatctacattaggtatttctcctaatgctatccctcctcctgccccacaccccttgacgggccctggtgtgtgatattcccctccctgtgtccatgtgttctcattgttcaactcccacttatgagtaaaaacatgcagtgtttggttttctgttcttgtgttagttcactgagaatgatactttccagcttcatccatgtccctgcaaagaacatgaactcatcctttttatggctgcattgtattccatggtgtatatgtgccacattttctttatcctgtccatcattgtatctaactatttattttgagacggagtctctctctgtcacccaggatggtgtgcagtggcatgatctcagctcactgcaacctctgtctcctgggttcaagccatttttctgcctcagcctcccaagtagctgggattacaggtgcccgccaccacacctggctaatttttgtattcttagtagagattgggtttccctatgttgaccaggctggtctcaaactcctgacctcaagtgatccgcctgcctaattctcccaaagtgctgggattacaggcatgagccaccaacctggcctaccttattctttttaaagactccattgtaccccattgtttgcatgtatcataatattgctgggcttttgttattgccacaggtggatgttttagattaatcctgttatagtctgttagatgatcatttgaatggttataaaagagacttggggcttgtggtataaagcctgattaaatagaaagaaacctgaactaagcatgggaagctatgaatgcaagtccaagctgtgctatgcttgctatatcattatttgtggacttccttttttattttcctgttctggcctcatgacagggtttccattttcctggcatgtcttgggctgttcaccagccccagggtcatgtctaggtgattcttcagttggagacctaactgacatccttcccacagcaacatcagtgccaggctacctgtaaccctgcagagtcaaattaaaacttacaagctttccacattccccacgaaggaagtactagcaaacttttagggagcagtacctctgggctctgtgcacactctccgtgcttaggaggaaagcacatgagcttccttaaaacaaaaacaaaaacaaaaagccatacattctagtgatgtttatttttgcagatagagatgtttagcactgggtcatgacagagtggatttcacctttaatggaagattaatttgcccatttgattaatatctgcggcaatccctggaatatgccagcactctgcctggcactataggaggaacaaataccagtgtaatatggttcctgtcctctggtgttaaaggcaatacagcaggaatgaaaagaaaggggagaacactattatccggggtccctcaaagatccctcagagagctttttgagctaatatgtaaacaggtagggaagtgttcaagggatggaggtgctgcaaggggaccttggtaagggataagtgtatgtgagtgtgtgtgttaggaatatgtgtgaatggaaggtgaacaataattgcactacaagcaaaggaacagataaaggaaaatataggtgttgtacaggaaacatgaagtagctctgtttagtttaaagaaagaatgtggggagtaggtgtagatgatgggaaatgttggttagagtaagactggcagagggtcctgagttctactttgctattagacatgagatagataaatgagttttgaaagattaaaaaatcaccatcagcttcttcctctcttgtttttgctttatttggggtgtgggagcattgtccatgttggttttataatttctacttcttattccagtaatttttaaaaatcagcttagtatttattaaagtaatatatgcctatagtttaaaaaggtgaatagtattataaggcctataattaaaaagagtactcccttcccccactttgcctaccactcctccttcctgcttctcaggggaaactattttttttttttgcttttattatgaaagatgtttattttccagagtgtgtaacctcatatataggtaagacttttgctgcaatcaattgttcttggtttggttaatctatagtcttgtccagcgcaggaaaactagcactgtccagcaactgtaaccagggagattgaatttcaccatgggagaggaaaccacttttaactatgctatttacatccctatacttaagtactgtgtatatactgatatttattaacttattcttagagattatctgccttactactatgcaaaataaggaaaatttagcactctgatactatcacacgctcccaagttttctttcctgatctttccagtgggttaaatggcaacttggggttaaattgatattccagtttaccttactatgaccatgtaatattgtttactaccaagacaagtagtaaaagagtatgcgttcgatgttgttcaacatcttatttttcctggtgttgtcttttattttgctcacctcttttgtgtatctatcattaaccattcatgaactacccaaaagaactatagaacttatattgaaaccatttttttttttttttttacacaattagcccactggttagtctactggatctctttttccctggaggagcctcccgtccagcccctctggtctaggggttttccaggccagctgcccacctgttgtcctggggcttctttttaacaccattttgtgaaatccctatgcctctttcctgtgttggagcccccatttcctggatcccatgatttcctctttgttggtttacatcctcatttttgtagagcacattctctagtagcttcctgagaaaaggtacatgggaggtgaatttgttgagacctcatgtgtctgaaaatgtcttaattctactctcatactgagttaaacttgtaattgaattttaagtaaaatgtaattttccctcataatgtttaggctgtacttcattgtcttctagcttccagtattgcagtctcaggccactactattccttttaccaggtatgatcttttacatgtgacctgtgttactcctctggaaggttttggaatcttctttttaatcctggtattctgaagtcttagagtaaagaaccctaatgagctaatgagaatcttttcttacccatcattttgggcactttatggtctctgaaaatctggaaaatagcattgttccattttgacaattcttcttctattattctttagtacttgtctctgaatcatttttttcttgttttctccttctggcatgcttatggtaaaatatggaacctcatggattaatccactatatttctcacctccacctcaccccacgtccgtctgatatggttggctgtgttcccatccaaaactcatcttaaattgtagctcccataattcccattgttgtgggagggacccagtgggagacacttgaatcatggggggtggtttcctccatactgttctcatgggaatggataagtctcatgagatctgacggttttataaggggaaaccccgtttgcttgcttctcattctgtctttgcctgccaccctgtaagatgtgactttgttctttccttgccttctgccatgattgtgaggtctccccagccatgtgaaactgtgagtccattaaacttctttttttaagtaaattactcaatcttgggtgtgtctttatcagcagtgtgaaaacgtttggactatctactttctagaaagtttgacttctatacctctgaatcattttatattcttctataagtttaatttccaatacctccttcttattttctaattgttcctgttctatagaatgctttttattttatagatataacagtatctctcatctttctgaagttactataggtttttaaaggctttcatttgcttcctgaaatatctatatcttctctgagctcctttagcccctttctctgttttgatctctatattttattctatattttatgtcagtggatatcctcaaatatctgatggcccttcattactcatttatatttaagaaatatatatgtttatttcatatatatacattatatatgaaacaaacgattcatttatatttaaaaacagtgggtctagtttccaagggaaaccctgagtgtagacagggtgtgctttttccttgactggcatccctccgaggtaacagagtggggaatctaaccatttcaacagggactctgccaatcagtcattttttggactgagtttctgcagataagaatctccaaacccctgcctaaggagccagtccctagctgtaggttccctgggagctatgtcagggaatagtccaggagggtttcacctgttctctctgtggagtttcatcctctctcctgggcccaatccctgagtctagagtatctctgattcaatgtagcctaagactatccctgatacctcacatagggttggggaattggtagagtcagtgtgagctagggagggcagggcctaactactccatatactctgttggtctgaagctcctggcaatcaattctcctttttccagtctcatgactcctaagcctccacagcatcccgtgcatgaatctgaaggctttgctcagtgcacctcagctattcctcctccatcactctgctgtcttccacaaattgcctgatatctcacattcagtagcctctcctctgttctctcatttgctttgtgtccctgctttgtggtttttaaaattctttactaatttcagtgagatttattttttgttctttactaattttaatgagatttattttttattctttactaattttagtgagatttctggaacaggaagatatgaaagcatgtgttcaatctaataaaaccagaagtttctagtgttatacattttactttgtagttatatgtacttatgtattttgttttggtctagtttgtttgtccagagaactttatgagttacttggacaaactagtaaccacctcacaactactgttaaggagggtattgacaaaatcattttacttctttgttattttttagggattatcaggcaaggtcaagttgactttccataaatgttatctttatccagataacagcattttgttatcttggctccagaagtttggacaaataatcaatttgaggtagacgcatatcaatttatcaataagaaggaaggaagactataaggaggagggaagaaagaaagcagaaagggagggagggggaaggagaaaaaggaaacagacataaaagattttaaaacagaacagcaggaagactggcccaactaaataactatactaagaaaagctatgtatgttcactaaataagaagataaatttcggaaaatcatctggctttaagataattccaaacaatgatcactgacttggaaggcagttaagcaatttatgtcactgaatgttaatggtcaaactacgttttatcagtcaacaaaatgtacccaaaatgcatatgaaaagcagtatagcctgcaacagaacctatcacataatgatttttcacaattacatgtccagaccaacttctaactatatactgactcttaccactctgaaatatatctattttttggctcaagaatatatgtgtatatgtatgtaccaaggtatatatgtgtgtattcctcccctcatctcccaaagaaatttatgttagcttgcaggtaatccttttacttgaatatatgtttattttcctgcttatatttcttataaatttgtctagctcaaattatgtagtcctctatcctctgtcatactcaattatggaccaataacttttttaaaaaagttaactatgttgtcaacaacatcacttccaatgtagccatcatcatatctttgagcttaacaaaaagcttgactttacagtcagattgaccttattttaaatcccctgtcttccatttactaaataaactccccgataggaaaatggacatattctctattttgcaggattttatgagaattaaatcatacaatgcatataaagcacctggcatactgtaggtacccaattaaaaaaagctattcaagtcagaatatgagatgatattgaaaccttaagctgtctaaaagtacatcttttccaactgactaatttttcatttccattttttaggcatcgcatcactggtaagctggtcacctggaagcaacgcatcagttagccactgaaaaggggtgtgcagagctcttacagaaaattgagaaaatcattatattgatatattgattatattaagaaaatcattatattgctatctacttttatataagtaggggaaagggaggactggacaaaaacaataaaggaaaatatttggcccagcatcagtttcttgacccctttagaattctatttaactacaaaattaggaggttatatgaagtccctccaagtgttcaggacaaagagttctgtggttagatgattttgaaacacacctcgatcgtctcacacctccccctccccattcttgaagctttgaaacacatatgagtttattcaaggtatctgtcccattttgttttaccttccgttatacaaacttacttgactacagactctcccccttttttcttttctttcaggtaatatttattgacatactttggaaaagactggatgagttgctctgcgacttcccactctaacatatgtttctctgagtttctacaacttcagctaaatgttttaaggaagaaaagaacaacagaatatgtgctaattttgattgattgatgctccctcctatagcagcatacaaattttagagtgggagaaaaatctattacgatttcaatgaaatgagctattttatcttgtccctatgtggtaccatcaacattttagacagatgaacaccaaaccattgactgaattgctgcatagtggatttgccttgattataaagacagttgaatgaccagggtacctctggcaattttggcaatcaataagtaacatgaatcaactatgtagtggtcagactggctacccagtgctcaatcaaaacagaaaataacagagataagttaatccttaggttgcaggactataccatgataccagcataaaactcaaatggacattcatgatgaaaaaatgttaatgctatcattatacaataaactgctaaaagtatttttattagtaaaatactttcatttttctatcaatctaacaacacttatttttatctgaaaggagggtactatgctaaacgtcactgggactaaaaggatgtagagtaggaaaagggccaaagatcctaccagaaaatgatctaggagccatatgttagttctgtcagtaattttctatgtagctgtcaataatcctttgttttctctttgtaaaaataactatcctctgctgggtgcggtggctcccacctgtaatcccagcactttgggaggctgagacgggtggatcacgaggtcaggagtctgaggccagcctgaccaacatcgtgaaaccccatctctactaacactacaaaaaaattagctgggtgtggtggcacgcgcctgtagtcccagctactcaggatgctgaggcaggagaattgcttgaatctgggaggcagaggttgcagtgagccgagattgcaccatcgcactccagcctgggtgacaaagcgagactctgtctcaaaaaacaaacaacgacaacaacaacaaaaaaccaaaaccaaaaaataacaacaagaaaaaactatcctcaaggggcttattgtttagttaattatatttacaagtttgggatttttgctccatgccttcttttgttacaaaattatccttaatttacctacataacagagacaaaagtgagtgaatattttgatgttctttaattaattacatgccataatacccctccttcatcttaactgcagaaattctgtgagaacctattgcaatgttttccctttttctcttgatatgtctctttcccctcaaggctgctaaggttttaaagtgttctgtttctatttttttcattaaaaattctatcagaaaccccacttcctctcaagaggaaatttatccaaaaccacctctgtggtatccaagtcataagtgtgttggtagtaggatggccaactgtcctggtttgcccagtaataaggagtttcctactatgtggaactttctgtgttaaaaagtgggatagctgccgggctcagtggctcacgcctgtaatcctagcactttgggaggctgagggatcacgaggtcaggagatcgacaccatcccggctaacacggtaaaaccctgtctctactaaaaatacaaaaaattagctgggcatggtggcgggcacctgtagttccagctactcgggaggctgaggcaggagaatggcgtgaacccgggaagcggagcttgcagtgggcagagatcgcaccactgcactccagcccgggcgacagagcgagactccatctcaaaaaaaaaaaaaaaaaaaaaaaaaaaaaaaaaaaaatagggatagctctctacaaaccaagggagtaggtcgccttgggtgttagcttgagagaaggattggatatggcacggaaacctgcaccagagagctgcaattttgatcctattagaaacactcttctttcactgctaagcagctatgtacaacaatcaaacaccagatggatatatgaatttaatgacctttaagtttcctttacactggtggttctcaattctggtttcttactaaaatcatctggttagctttttaaaaagtgctccctgatttaactgatttgaaggtgagtctttgccatgggcatacatgtttgaagttccccagccaattctcatgtaagtcagagttaagaaacactactttatacacattctgagattcaaactataggcctagcaagagctgtttaaagcaaggagaaatctactttgtgatctctgacttgttaattattacatgcaagtttctacttcaactttaaaacaaatgagaacctgcaaactgactttatgtattcatctacattcatttattcacctagggttcatgatctataagcatctcccttgtcatgtttgtattctgaacatcaatcaccaccatctattgatatatatatttttttcttacaagaaactgtattaggcaccgtggggtataatgatttaaattgcaaggtctctgtcctcacggactctataagtagaatatatgaaaggtgactacatgatcaaggcaaatgaccccaccgccaaccaaggaggacgtggtcatggcctgggatggttaggaaatcttcatagagcaggtatgatttttaaggggctttgaggactgggtggaattttaattagagagccataaataaaaactacaaaaagggagaaaagcagtttgagaatgagtagggaggaatcagtttaccaaagttaagtatgtatacaaataatacagttcaccttttgagccatgcaaactgtatctaaggaggcacagaaccttgtatgagaccaactgctgagcaaggaaatgtaattagcgcaatcacttttttggtgctaattacttaagacattgaaaaagaggattagactgaccaatgaaacaattggttctggataaacatacaaagcttggtctgtaatgtggagaacaagccactgaatagcaatagccaagccccttccctctggtgctgggcccactcaagagacctgatcacacagacagtgaggcaggtgctgcatagatcactgcaagaaccccgagggacccactctatctgatccagtgagatgatttagggttgaagaaataaatttagaacacaagtcatgtaaaaagtacatgttactttatatgtgatgttatgtgattatcagtcattgattttcaattacttttataatgcaagagcttttcttctggatttcagaatttaagaatttctgcgccatttgtctttgcctacgaaaatagttaattctcatatttattccaatagctggtcttcatgtaagatattaactaaatgcccattaatagtctgggtatgcaactcaggaagtcagttggcaaaattaacatttagaagtaggcaccactggttatttcacacattattaacttatattacaattcaaataagcttacagctggcaaaaaaatctcttctgtaaagcgatctcaaacataataggcttaatcagagataaattaaattaggcagccatgcatactacagcatattaattctgagtagttattactacattttctgttatcactggtgtgaacaacattatgtgcaaacaaattcttcgagagggtagcaaataaagtttatgtttgggatgccatgtgcctagcattttcccatgttttcttaaaatgttaaataatcttttctgctaataatggcactaggttaagtccccataaacgagtcaacctcactcccaggaaattaaacaaatgaacatcagacgaaactgctaagtgtggtttggatttttccaaagggaacttctcaactttctctggcaattaaaaaaaaatttgttaatgagtcatagctagagcaaaattgtccaaaatgtaaggtagtgcatagtcgttacgttaaaaatcggtgcctctcattctctgttttggatgaactatgttgccttagaatactcaaagaagaaaattattcaggtagaatgctattttctaaataagatcctgccattatctctctctttctttaaacggtagtaatctaagccagcaaactagcactcagatcccacacgctagcaaatgatgcttttgtgaaagaaaatgaaaagatgcatctaacctttatacacacacacactcatgttgccttttttgatgcacttttgtcagattatctgattctttgttaatgaaccaggccctttaatttctgtatccaggagtaattcaagttactaggcatgacagccactaccgcccccaagtctgagaaacatgtttcacattctttgcgctttgcacatttaaaactcaatgtaaggtgacaagaacattaagctgcccagtgagtaaaatgtgaaactaatcactatctgttctacagatagtgggtacaataattggcaaattaaagtgcctgggaagagctgggccacctgcatcaaaaagcatcaccttggaatggctaatgaagataaatgtatgcagctagctttactgacaactacttcaaacaccagcagactgaaaaagcaacactacagtacttatttcatttactgtaaagtacgcaccatgtgaaatttttgttatttaaaggaaaaaatacccaacccctctcaatatgttgtacacatgccggctgaatcgaggctagtacttactcctaaaaagccaatgcttttcttttaaactggcaaactgggatcaatttgcttattaaaacgttgaatttgtattttcatgacaactagattcaaataaattagaagactacaaaaaagaaaataatccaatttcaataaaattgctactcttattcatccattcatttatttgacagttattgaatacctactatgtgcaggtactgtgcttgacatttggcagagagagacgaatgacatctccttaaggaggttgtggactatttgcaggcaagaggcatgcttacaggcacacacacaggcaactagaaccatgtgctattgtagaaacatttcagaaaggtgtccctttcccttagagtctttcaagagaaggctcactcttaagctgaattctaagatgatttctgaagagtttttgagggtgagtaagcttgagaatggtcttccaagctgaaaaaagtagcatgttcaaaatcaacaagaaggtcaggatctgcttgaggaaaaaaagtgccttcaaaatatatgaaggaaataaatacagaaataaatataggaggcaagaggtcaacagatgatgaagatgaaagctagacaagggtaagaatatgaagggccccagaagatatgttgaggagcttgcatttagttctgcagggcagtacttttcagaatatgtgacagagaaccctggggacctggggaaggagggaggcagcctggaagggagtgaggagtgagaagaggctgagcagtcaggactcaggccctgtacctctactcataccacaagagctttgccaatatctgtttcaccttttgggccttcttattattagtgtttttgacaattttttatactggaataatcttaaatttgcagaaaaaattgcaaagataatagaaagagttcctacatactcctcccccactttcccccactgttaacatctcacattaccatggcctggtacgtttgtgacaactaagaagccaacattggtgcatcactactaactcaactccagacttcatttggattttaccagtctttctattaatgtcctttctctgttccaggatccagtccagtctaggatatcacattgcattgtgtcatcatgtctcttcagtcttttttggtctgtgacagtttctcagttttttcttgcttcccatgacattgacggtcttgatgtgtattagccaagtatttttaaagcatgccctcacttttggctgattagggttattgggaagaatatcaccgaggtaaggtaaacttctcatcacatcacatcagggggcaggcaaatgacatcagcctgatttatcatggtgatgttaaccttgatcacctggttaagataatgtttaccaggctttttcactgtgaagttactatttcccctctttggaagccagtcataaatccagcccacatttaagggggagggtaagcttcactatctgaaggtggatatatctacctgtactatttggaattcttttagaagaaagactctatttatttatttgttcgattgtttatttatattaggatgaactcagacatttattttatactttcggttataatcaaataccatgttatttattttgtggctcaaattgttccagctttggtctctgggagctctattaaattggttcctgtatgcctttcacatgcctacatctttttgttttttgagcacttatttttttagggcataccatgtgctccaagatcttgtatttttactgtcccagccacaaactcagtcatttctctgaggatccctagttcctattattggaggataatatttagaaaccacggtctgggcactgcatgtgcttgatgctactgaggtatcactgctcccaggccccctcagcagaaagagccaagaagtataaatacatattcaaacccagttatatgcacatgtctataattgtttctgtgtctgtccgtatgcatatttatcaaattaaatagtagttaagctaacatgaagttagctgatatgtccaactctaatccagcattacagggtttgttgcagccccctctcctagcttatggaaattgtcctgacaatgagaaacctggcttgcaccacctaccatccattcatttatttgttcagcctcagtatttgggtcttcttttgaagagatttctgttactttaaaataataatatataaaagggctttatttttattcattaccatcactccaattgctctgttttcatcaaatcatttcatgtttctcctaggcacccaggaagactataattctcatgatcccttgtatttaggtccagttccagttaaaggaatgtgggtagaagtgatactgaccacttgtagccctaggctctataatctgttgtgggattctctacatatattgtctatttttttgataccaggtataagacacagtggaaaattccaataataaaagagaaaaactatatgacgattcaatggaaacagaaaaaaatcttgaaaaaagtaaaaatccactaaggatttaaaaacaaacactcatcaattagaaatgaaagagaacttccctaatacaataaaatgcatctctgaaaattctacagtgaaaattatacttgattgttaatataataaaaaattcctcataaaatcaggatcaagacaaagatgtccactctcaccacttgtactcagcatttactcctcaaatgggaagtctgagtcattataataaagaaaaagaacaactacaaaaaatagaaaggaacaaaactttctgaatggtatattttgtataaaaaatcccattaaacctaccaaacaactatcagaactagtaagtagatttacaaaaattatagagtacaactttatttttttattggagatataatttatataatgtatagttcactcttttaaggtgtacagttcaatgctttctagtacattcacaaagttgtgtgaccattcttcttatctaattccggaaactttcatcacacaaaatgaagtcttgtacccattaacagtcactccccattccccccagcccagtcccttataaccactactcaactttctgtccctgtgaagttgcccattctggacttttcatataaatggaatcagacaatatgtagtctgtgtgtctggcttaatgtgctcaaggtttatccattttgtagcatgtaaatgtattccattctgattttaggttgaataatattctgctgcatgcgtatatcacattttgttcatccattcatcagctgatggctatttgggttgtctattattttggttattaggaataaaattgctatgaacactcacatacaatttttgtgtgaatgtatgttttcagttctcttaggtctatacctaggagcgagataactctatgattaactttttaagaaaatgtcaaggtgttttatcaaagtggttacagcactttacaatcccatcaaaatgcatgaaggctccaaatttaccacatctctgtcaacactgttattgtctgtcaattttagacaattactacattactatatactatattactatatttactgtctaaaaatgatagactatagtaattcgacagacagttaaaatagtaacccaagtgggtatgaagtggtaccacgttgtggttttgatttacatgtcttaagggctaataatgttgggcatttcttcatgtgcttattggccatttatagtatcttctttggacaaatgttattttaaaattttaaaattttaaattttaaaatttctttatatatctggtatactctttatcaaatataaaatttgcaaatattttcttccatctttgagttctcttttcactttcttgctagtgtcctttgaagcacaaaagtttaaaattttgataaagtctgatttatctatatttttcttttgctgtacatgcttttggtgtttcactcaagaaactattgcctaatccaaggtcataaagatttatacctatgtttccttataagaatttcatagttttagcttttacatttaaatcttggatcatttttaatttttgtatatggtgtgacacaagcatccaaattcataattttgtattattaatacatgtggaaatccagttgtcccagaaccatttgttgaaaagactattctttcttccattgaattgctctggaacccttttgaaaatcaactggccacagatataaggtttattcatggattctctattccattccatttatctatctgtctatccttctgccagtaccaaagactcttgattactctagctttgtaataagttttgaaattgggagctgtgagtcctctaacattgttctttttcaagattgttttggctattttgggtctttatatttccatatgaagttcaggatcataaattcctttttttttctttttttgagacagagtttcactctgtcgccagctggagtgcagtggtgtgatctcggctcactgcaacctccgcctcctgggttcaagcaattctcctgcctcagtctcctaaatagctgggactacaggcgcatgccaccacacccagctaattttttatatttttagtagagatggggtttcaccatgctggccagcatggtctcgacctcttgacctcgtgatctgcccgcctcggcctcccaaagtgctgggattacaggtgtgggtcaccatggctgccctataaatttcttttaaaaagccagtcaaagcaggcgcagtggctcacatctgtaatcctagctcttagggaggcagaatcaggaggatagcttgagcccaggagttcaagatctgcctgggcaatatagtgagaccccattctccacaaaaaagaaaaaaaaaaaaaaacaaagccagataagattttcatagggatggcactgaatctgtagatatatttggggagtactgacattttgctaacttaagctttctatgattatggtgtgtttcaccattatttaggtcatgattaatctctttcaatgatgctttgcagttttcagcgtgcatgtcttacactgcttttgttaagtttattcctaagcattttttattgatgctattatgaataaaattgttttcttaatttcattttaaattgctccttgctagtgtatacaaatataactggtctttgtatattgattttatacgttgcaacctcacagaactcatttattagctcatagtcaatagtacattattgactagaagtgggtagagtagaaatgtttgtcttgttcctaatcttaggtggaaaactttcagtctttcactaataactgtaatgttagttgtgggttttccatagatgttctttagctggttaaaaagtttccttatattcctagtttgttgagcatatttatcatgaaacggattttgtcaaatattatttctaagtttactaagatgattgtatgtttttcttttattctattaatatggagtttataccgattaattttcaaatgtttaagtaaccttttattagtgggataaattatatttggttctggtgtatagtcttttttatatgttgctgtatacaatttgctagtatcttgctgagaatttttctacctgtattaataaagaatagtggtctacagtttcctttcctcttatgtatttgtcaggttttgctatcagggtaatattacaattgtagtttcatctattaacaggaaactttgaaaaataaaaattttaaattctatctgaaatatttaaaaataaaattctgagtaataaatataatagtaggtatttaagatgtttatataaaatattactgagaggttttaaagaagatctatataaatgcagagatagtgtatgttcatatattggaaggcttgatattggtgagaagtcaattcttcccaaactgatccctagaataaatatattcccaatcataatcccatttggctaatttcttagaaaccaggaacataattctaagataaatctaaaattttacaggaactaggatatacaaaccaattttgtaaaaaacaaaaaaagaacaaagatggaaggcttataccatctgacttgaagacttactataaagctacagaaatcagtgtagtctggtacactgatatataaagagctacaaaaccaatggaacagagcagagagctcagaaatagatgcatatttatgtggtcatttgatctttaagaataacattaagaaattccagtgggggaaaggaacgtcttcaagtagtgctggaagaattaaatatccatacagaaaataaaaaactctacactgacctcacacaacaaataaaaattaatttaatatggataataaatctaaacataaaaagctacaactgtactataaagttttcaaactatatgtgtgtgtgtatatatatatgtgtatatatatatgtgtgtgtatgtgtgtgtgtgtatatatatacatatatatatacatatatatacacatatatatacatatatatatacacatatatatacatatatatacacatatatatatgtatatatatacgtatatatatatgtatatatatacgtatatatatacatatatatacgtatatatatgtgtatatatatatatatataacagagataaccttgttttagacaggatacagaaaataattaaccatgaaagaaaaagaaagccctgataaattagacctcaaaatttaaacttctgctcatcaaaagacatcactaagagaataaattagcaaggctcagattggaaggaaatacttgcaaaatatacctaataaaatacttgtttatatatttacatacatatatatttttatatatggctcatacatataaagaacttctatacttcaataagaaaaacacaaataatccaatttaaaaatgggaaaataactgcaatgaacactttacagagaaaattatataaatgaccggtgagcatatgaaaatgatttcgacatattagtcatcaaggaaaaggcatattagattactattaaacatcaccacaaacccaccaaaatggctaaacctaaaaagtcagactgcaccaaatatgggtgaggatgtagaacactaaaactctcacattttgttggtgggaatataaacaattactttggaaaagatctggcaatttcttcaaaaattaagagtacacctatctatgaccagaatcctacttttagatgttgacctactataaatgaagacctatgccctcaaaaacatctgcacaagaatgtttatagaagctcattcatactagtcgaaatgtggaagaatggataaacaaattggtaaaatggaatacaactcagcaatagagaactaccaatgaactcaagaacagactgatctcaaaaacattatgctatatgaaaggagcctgacacgaaagagtatatagagtatggttccatttatataaagccctgaaagaagtgatttactcttggtggggtagggatactgggaggggcctgcaggaactttctggggtaatatagattcgggtgcaacaggcagatacatttgtcagaactcacggaaattcactcataaaagttgtgtgtcttatcatatgtaaattttacctcaaaagaaaaaacaaagaatcgtaaaatttaaattctggtaataatgcacacgttcaagtatttaggaggatatgtactaatgtctataacttgctttgaaatgtgtccaagccagaagtggtggctcacacctgtaatcccagcgctttgggaggtcaaggtgggaggatcacagggtcaggagatcgagaccattctggctaacatggtgaaagcccatctctattaaaaatacaaaaaattagcctggcgtggtggcaggcgcctgtagtcccagctactcaggaagctgaggcaggagaatggtgtaagcccaggaggcggaggttgcagtgagcagagattgtgccactgtgctccagcctgggtgacagagcgagactccgtctcaaaaaaaaaaaaaaaaaaaagaaagaaagaaatgtgtccaaaaataagattcatgaatgatgaatggacagagggatagaatgatgcacagtggtgggtatatgagtatttactgtaaacttctttaaactatttggaatagttaaacatttgaatataaaatgtttaaataaaaaaattctttaaaactaagactttcacaaaaaaaaagaaaagaaaaattaaaagaaaaaaagagaaagcaatcccagctttgtaagttactagccatgcttcataaatagtctaagcataatttcctcatttataaaatataaaaaataatatctactatacaggactgttaaaggactatacttgccaatatatgtaaaaaacagttcctggtataaataagcactgaataaatgttttagctactatttttagtaagcatagaacgtctgtagccataaacccacaaaaataaaacttcctgagaaagaagacaatgtttgcacactttgttaaaacaattgttatgtttgttgcatagaaaaaaatcagattcaccgtgatttttttctacatgtgaataccatttattaggctccctaagtgaatgagctagtagaaaggaaatattatatttaaaaaaccccataaggcatatttttagaaacggtatttccttgactttcattccaggaaaattctaacacacggcacggtgcatgtggagcccagaaaagaaagcctgccagatgccacagcaataaatagagtagggccttggagacgaagcataaaaggaaaatgtggagcatcatatctgcagcacccttctccatctggtatttagcccactgaggttatgggatttttggaaattcacctttgtaggctacctttaattatttttcttgtttatttgtccagtaaacatttaaattgtagcctaatatgagccaagttctatgaaggtcttccaggacctttggaaaatgaagctgggtacggaaatttcaggaaaaaaatgttctaagtacagagtaatgaaaggttaatactatttacgtcttgccatctctttttacaatattaatttcacaaatacaattttagcatttccaaccaataaattaagcaacagcatattttctcaaatggcaggaattctcagacaggaataaaagggagtagaatttcttaagtgggttatgtctcactttgctaagaagggcagaaatgaaaataggttttcataaattatattttctatgggtcttgtattatcatttttataaacagatattttccaagcaagtggaatttcttcacatcgtctctcaatttagtaatctttctgatgagcaaactgagctgtagaatgttgaacattgtttcatcctactatgactgtcatcctttggcttgttgaatatatattcttgtgataattctaagaaactatgactaatggatttttatccagaattttaaaacaacaaaaagttattttaaattaaatgaaaaatacattctattcccttaacttttcttttttggggggattacacattctctgctaaaatttaggatggaatttctaacagtgatggcattgttcggtaactaacagtcttttgtgtgtgtgaaaaattctaaatgagtggaaatgatctcagaaattttatcttgaaaatgtttgcctatagtatttattcaagtgttgtccacattttaggaaagaacttcaaaaatgtccttttcataaaaatatgcagttctcttgtgtctatttaaaagggaagtccctctcctaactccagcatacgcactcatctctgggctatcaatagaagctaaagaaaaaattaaagaaacactggctgcatgccaaattttgggttaatagggaagagaaagctggttggcaatctcccttcctagtccttatcttttcctccccttatctctcctgtgctaggggtgctgggatgtctgtactctgtaacctctttctctgaatggagacagaagcaggaagtcaggtgccctgcactttaatgtcttattattcttctccttgagtaaatcctaactgttaacgggaaataaaatgctatatgtaaatgaacatcgtcacttggaaatcatcattctgggctacagcaccaatacacctgtaatcttaaaacatccttttaatagtaatgaatttgtcaaaaaagtatattaggacatctatattcaaattaagtttaccactggcttaggtttttaaaattaatacaagttgcttaagatggtgaaaggccaaactgttgtgattccttccactatgtatcatcctggagcaaaactcataggggaaaattagatattcgtgaagcaagatagcgagggtttttgttgttgttgaggttcccatcaggaacaagcttatattattggatttacttgagagtgtacaactgcccttgaaatgaaacatcacctacttccaacaagtgtgctctctccctagttcaccctaattaaggaggcttccctatattaattttgtctcttatacaagcatccttgagactctttgtgcttaattatttatgtctatgtctcaagtattaagagcacacttgaaatttaagatttttctaagtttctaacacttactagctttgttttttgcttagacctgttaatctaattttgtcttctcaacacttttgggaataatgcattgcttatccttaaattttgctttgcagtttctgtatgaaagattccaaattcaggtttcaatgtatttgaaacgaagttgctgattcctctcactggaattaagacctacacttacttttctcactcttctttattctatttcaaagtttgatgaatattttctcaaactgtatttgaaaaatttagaatccaataccatgaccaatcttcctcctgctaagccattggtggtctaactattactttttaagaaaaattaatatggaccctgatgtaaaaagaaaagaaaaacaaatatagagtgatttcagcaggtctattactagacatgttttctcatgtttctcggtagcttgaccctcttgtctggtattcctgagagaatgggcctacccacagagaaagggagaaggaggtaaagaagttgcaggtttgctggtgatttgagatgaatcctcatgcaacaacttgaaggcagacagattggaagagcagtgagttgattttctaaagtaaaatccaccagaaagagtttacacggtgttggaattctaccacatttacaaattaatgtgccagatgccatcagcagatctatcattatgatggctattgataaatatcaaaatttgaccattaagaaaatagtactactaatctcatactggggatatcagtaccactacagaaaaattctacttaaaaacatatgtgagctaaaagtgaaaagcatttccctgctgattccacatgtccacaacagcctaagcagtgtggagatggccagcggagcagcaatagggaacgtgtgccaacatttctgataggaactctattttctgaggatttaggctcaattatgaaagtctgctgaaaatgaaacttggcataaatactgtagcttagtagaattccatcaaatacaacaaaaatgaagattaaggagagggaaatcctataaactcaactttcagaaaagaccagagcattgctaaggaaaatcaaaggaagttctcaatacttattaattaatcttttcataaacgaaatcatatttgagaagtggtgagatcatttacagcctaataatttccagatatggaagggaataaataatttaaaggggtaatgattgaacctaggaagggctgtgtcagttctagaaatagtggcttttactcttgaatttttaaaagttccattttcttagtggtggcattggcccaggccacaatcatatacaaaaacataactgaccaaaaaaaaaaaaaaaaaaaaagaaaggctttaatctcttagaatagcaaaacagaatttgagaagagcctaaactctaagatatacagctcttaaaattttaccataaaggacacttttttagagccctaaataaggtgggaaccttaaacacagaccttaattttaataactcttgggaatggatggtctcagttaactctaatcttatatttgtttatagacctcagttttcaattacaggaggtctaagcattgaagtgttagagtgtttcaatagatgaaagatgattaatagaaactttaatatctctccaagtcaaatgaccatgtaacctctacaaatattactgtaatcgctacaaatatttgttactttgtttattcattcagtaattcaaaaaaagatttattgagcacatgctaggtataacgctccataaaacaagcctaaaatctaccaaaaatacaaatatgtattcacttgagaatttctgatagctctcatttagtgaaggtaccagacactaaacaacatttaacttgagatacatctggaacctttaacaacatactaaactttaaaaaaaagtgcatatttttctaatgtggttctgaaacaaagagacaaaaagaaattttttatttgtctaatggaagagaaaaggcctcaaaaactagctgacctcccagataatgaagtgtaaaagaatgtgcaaatgtacttcaaaaagtaactctcctggacaccaactgaacccttagaagctaaaggcgggaaataaccccttcttccttcttttactctctctagtttgtctttgttctgtttcccttgtcatttcccactcttcagacacaattatagttgattgagatataacgagtaaagctacattagaaactactcatggaaaaatcaatagaaaaggatagaggcacattcaacagaaacaacaaaacagaagcactgttaggaagaaggaagtgagaggtttttgtagcagaatgtacggaacagatatttcccaagtgcctcttctatggtaggtgggacatagcagcatcatacagtcacctcatatatccactgtaaaagaggagatgggtgggtgcaggcaggtaattgtccagaaaaagcaacagactggttctattatgagaaagtgaacatacttcatttgtggaaaactatacaacaattaaccactatgaatgaaacagatctccatatattaagagagagattctaaaaaaataaaaaaaaaattgagaaaaaacaagttccaaaggtatatattcagtatgatcccatctatgtaaacttaaaaaatattgcacatatatatgtgtgtatacatatatatacacatacatatatatatatagtatacacacatatatatagagagattaattataactatatatgtgataaatggtataatatacaacaaccttattatcatgatagtacctctgggaaaggagaagtagatatctgaagaacattttaaaatttttaaatatgggggtgaatacatacgctttgctcttttctgtaggtttaagctacttgacaataaaaattaacatttttttgaaatttgttgtctaaaaaaagaaagctgtagaaattgagacaattagaaggagctgttctagtaagtctaactttcttatttctgagctgagctgagaatatacaaggctgattattttccatcttcagaaagagaaacaatggagacttactgtagaagaaaagactatccttgcaatgagaagtcagtggcacttttggcaaatgaatggtcattttcaggtggaagtgaattatctgaatgtagttatattgagtcctccagctttaaaagaatgtttcaactcatacactatttatttgagttactcttttttttctttatggggtgtgaatatgaggtttaagggacacagttaatagatgccaagttttcattgtttctacaaatgtttatagagtctggattttggaataacaatttgcacacttacaagtgttgattagctgggcaacattgcaattaatattacttttttaagctcctcgcaaagacttccttttctttcaaaattgccaataaacattttcaaacataatccccaaggagctcattcactgggtgctgggggactccagcaggaaggaaacctactaacattttattaattttggatcatgtgtaattcttaggattaatggcaaggagccagagaggttttttttttttttttttttttttttcattttttaaatcacagtggaaaataagcctgaaacatttcactagtaaggcaagagtcacttaagatatattattaaatatgaggggtagaaataaatcacagacacaagtggtattatacagtgggcatttttctgaaaaaacagactccgtgcatgaggattagatatacgcccacaataagagggcatattgatctataattttcagtattacatccttgtattttttattatatgctatttttcaactagtagaggaacgtgttctcataaagctaatatttattcttccatgtttatacagctagtagtgcatttcaggaaatgagaaattctgagaagccaaatataacttgatgtcgtatgcaaaaaagaagacaagacagaaaaatccccatattttaaaaacctgactcaggaactcactcataaagctttaaataattaaataacacaacataatgaaagtcttttgatattattttttctattcccataaatgtagccttttcatagatgatacatcttatcatgtagtattcctcattttactagaaatcaaagaaaaggaccctttagtccagttctcattttcaacactgtactcactgtgtgtattttgtggaagctgaggcagatactcactgtaatcccactataaaaattgagatacccctactggaaactgtattgttaattcatgaattcttctcattttattattaagtaacctgtgtactggggaattcaatgatttcttaaacccaaagaaaatagtagtgaatgataatttggtttttcatggagaggctgtattcatattatattacggtaaaagcctcaagaggtcagagccatttcgggggagaaattccccaagcctttggaggagaaactccccaaaggtcaattgtttctatgtcctctccttttagtttataactttacttgagcccttggagaaatcaggagaaacagaagttgtcaagtcatttccccatactccgcatgcataaagatggaactgggtgttggcaacagtaagtaagtgaggcagaaggcagaagtgttgagggggatggcaggaggtgaggccaaggatgttgggactaaagggagagagcagttaggctgtaatcaagggttctttgagctccccacaaaccgatccttgattttctgaggaagcttgtggcctagagcagacagctgaaactatggtgcttggtgaaaagcaagtgaaaaaaacaactactactttattacttaccttttcccagtcatcttgcagatttcagattttctaccctttccgttctcagtaactgaccggccacctttgtggcatcagccccaccacttctcctgaggtccaagcctgtctccatctccatatccaacagctgtcctctctctgccattttcctgtactgagttctaatattatctttccctcatccatgttcctatatcaagaaaaatgatctcctttaaacaccaaaccagaatttctcgttcttcgaaagagtctatccatccatttatgtatgttagtgtatttctaggcagctaaaaaataaatgtaatctcagagtagaagtgcaatagaatggaaagagaatggtacccggagttagaaaaagggggctacacccagctccatctttctgcccatttgggcactgtcagctctaagtgaagtttctgtagtctgggcagttgcagacctccactgctggacaagggaaagaaggtttgagtctggttattacaataactggggttgggggagatgttggcttttggttcctgagaaccgtggttactaaacattcttttatttatttttatttttatttttttttttttgagacagagctgttctcttgctgcccaggctggagtgcaatggcgtgatcttggctcactgcaacctccacctcccgggttcaagccattttcctgccatagcctcctgaagtagctgggattacaggcacccacgaccatgcccagctaatttttttgtatttttagttgagatgggatttcaccatgttggccaggctggccttgaactcctgacctcaggtgatccacccgcctcggcctcccaaagtgcttcaattctaggcatgagccactgcacctggctggttactaaacattctaaacatgcatgggacaaccttgcatcacaaagaactgtcccacttaaaatgccaatactgccctgatgaagaaacatcaatagatgattttcaatgttccttcaacctatttggcctctaaaacttaagtgaaatgtagggaacttaagagactcaggaaagaactgtgaggataattaaaattttggattatgcagatttataggaaaagttttaaaaatgggcttatctctcccaaagagaaaaaggatgatttaaaaactgagactaggatgatacaggggaagtctgaccaataaattttctttttcaatggaagcagaaataaattaacatgatatgagctcagaaattacattggctttcttgagaaagacttgaaatcataaatgaaagaggagacattacaactgatatcactgatatcacagaaataaaaaggattatgagagactacaaggaacaatgatatgccaaccagttagataacctagatgaaacagatacatttctagaaacacacaacctaccaagactaaatagagaaaaaatagaaagcctaaacagacccataactagtaaggagattgagtcagtagttagcaatcttccaacaaagaaaagtcctatatcagatagcttcaccagatcattctaccaaacatttaaagaactaatgctaatccttctcaaactcttctaaaaaattgaaaaggatggaacatttcctaactcattttataaagccagcataagcctgataccaaagtcaaccatgccacaagaaaactacaggccaatatccctgatgaatgtaagtgcaaaaattctcaacaaaatactagcaactttttgctagcaacaaatactagcaaaccaaattcaacagcagtatgcagtatgctgttgaatttggaagcctcatacttcccgatgtcgaaatgtaacaacaaactctctatatattatatacagagtttcagtcatgcaagatgaaaaaattgtaatatataaagctacaatagtcagaatggcatggtactgacataaaggcagatatatggaccaatggaagaggatagagagtccagaaataaacccatatatatatgggatcaaattatattcaacaagggttccaagactccacaaaagtgtaagaacttattcttcaataaattgtgctgggaaaactgtatatccacatgccacagaataaaactggatccttattttataccagacaccaaaaccaacccaaaatgaattaaagaattaaatataagatttgaaactacacaactagtagaagaaaacccagggaaaaagctccatatttggtcttggctgtgatttcttagatatcacaagaaaagaacaggtaacaaaacaaacacagacaagtagaattatatcaaattaaaaggcttccatgcagcaaaggaagcaatcaatagagtgaaaaggcaacttacagaatgggaaaaaatttgcaaaccatatatctgataaggggttaatatattaaatatgtaataaactcctacaactcaactgcaaaatatccaaataatataatttaaaaatgggcaaaggacttgaatagacatttctcccaagaagacatacaaatggtcaacagatacatgaaagatattcaaaatcactaattatcagggaaatacaaatcaaaaccacaacgaagtatcacctcaagatggttattatttaaaataatagacaagggttagcaaagttgtggagaaattggaacccttgtacactgagggtgagaatgcaaactggtacttctgctgtgcagtatgaagattcctccacaaattaaaaatagaactaccatatgatccagcaatttcacttctgggtacatatcaaaaaaactgaaaacaggatcttgtagagatatttacacactcatgttcactgcagcattattcgcaatagctaggatgtggaaagaacctaaatgcccactgacaaatgaatgagtaaatatggtctatatgtagaacagaagattattaagcctaacaaggaaaatcctgtcatatgtgacaacatggataaactaaggtcattatgctaagtgaaacaagccagtcaccgaaggacaagtactgcatgatttcattcatatgaggtacctaaagtagtcaaactcatagaataaggtaaaattgtagttgccagagctgaagggaggagaaacagggagttgctttacaacaggtatagcactttagttaagcaagatgaaaaaattgtaaggatttgctgtacaacatgcagagagttaacaacactaaagtatggacttaaaaatttgttaaagggtagatttcatattttgtgtgtgtgtgttttaaccacaataaatgaaaaaaaaaactaagaaaaaaaggaaattggatccctgggtatgaaggtttgaaaacaaatggatttttattggtttcagacagttcacgcagaatcttgcttgtagactagggaggagcatttaggtaacttctcacgtccttcccagcacttctgtttctatggatacagttattaggttccagcacactgtgatatcctactgaattgacaggctagagagctgaggatggaggcacaacttctcatctaccccataccctagtaaataccccctgcctcactgttcaatgggggttaatcatgaggcccaacagcgaagggtacagtgggaaaactggagtctagcccagcactacagtaacatctactttgattcttagtagaaataaaagaaataaaaaaagtagaaccacagtaaagggctactaagagagaaagcatttgtcaccgtggacagaataaaagtaccaccaaatgaaataaatgcctatgggaaaagatgtgtcatgctagaaagtactgtgttccttctcctttgctcttcatttagttttcatccactcaatgtaccaagccttatcctatatcctgtttccttttccagctttgaaagatgcatggactgaatttagcctttggttaggtctttgtcagaaagtaccttcaaaataaaagtgttttacttggtactatctcaatagcaaacatgtatttccaaaatgaaatgcttgctctactagcaagctttttccttgagtaagcaacaatattgttagtaatttttcaaactgttaatacacatacacacacacacacacaaaaccccaaacaagccctattctatcatttataaatcatagggtgaatatcctctggtagaactaaatgaaaacattcagggcactgagtttttataatttgaaaaatgataatactagttgatattgacaaattcagttttgattttcaacgtttcaaaatataatttatccacaaggtcttaaacaattgaaagtacttaactaaatctgatatatgtagatgcttggcataaatttattgaatctattcagttagaatttataaacacaaaaataaaatttgttttaagtcaatgtggggtatattttatttctaatatccttgttacattccacagggtatacataaataagtatgacaagatatttattttcatttaaatctaactttcaatgaaattaagaaatgaaaatctgtttaaaatctacccccagagttctaattgaaatagagtacaaatattttccattaaaaaatatccctcaaacttagtatcttcagtaagaaaaatgaaaaaattaacacaaacctcaaaactgccagcagctcagaagacaaatgtgttctctggggacttgattgaaaccatgtattcataaaagtcttttaaatggatgctcttcacaaaggaagtctcatggaagacagcatggttctgacatatcagaggcttctggaagcaaagaaaagcacaccgttaggatatgtctaaagtaccattactgcctgtaatggtattattatcacttatatgtgttatcagcatgatgttattaatttctattatcaattttgtaccctaaatcatcttattcatcaatggcagagtgggacactaacctttcaatatcgtatttagaaatttctaaaagtcaggagtatttataactaagcaaacctctgcttttcctcttatctaggctgggattgaataactgtgggcagggtatgagcacaagaacagtgacagtatttactgagtgtctaccagatataaggcactgtgcaagtggcttttaaatctgggatctttaatacaaacaacactgcaattgaaaagtattggctccattttacagatgagaaaaaaatgcacagattgctgacctcaggcttagaacctgtaaccatcaaagttcaaaggccttagggcaggtactttccctcatctcactctgtagccttggtgatttagaaaaatatttcccaaacagaactgacaagagaacagataatgctgcaacatactaaattaattcaaatattactaattaattaagaacttgtcttgcctaatttactttagttttatattaaatatcatcttattcagtcaggcccacataaatacaaatgcccagctttaagcagtatatttttttctaccaacttttcttccttagacaaagagagaacttgctggaaactgagaagctcctttgtgtttggtgtgggattacatgcagcgctacatcaaggctggcactgcaaacttctcatcttcctctggcccatccatgtgacccacagttcctccactgtcctgatgaatgagaacacttagttttcctgattgcatcaggaactgagcccacatcctctatggctattactgagtgatattactgtatctctttgtggctacattcaccttaatggctgagggtgacaaagcgagggctctagttggatttccattctcatttttagtcagctatctctatatttgtttctgatggttccagtgcaacacagagaccccctgcaacttacccaccaccagctgtcccagtacccactctcacactgtgttgcagggctactgctcaccaaataaatgcttcaacacatcccttgaaatgatagctttggatgccatagacttttgtctgtcctgaaccttttagctcatggccccactgcaggaccaaaagtcccttagagagactagaaaatgatggagccaggaaggtcatgcataacttttgaaatttttagtttattggatttttggccacaaaagcttcagtcatgaataaagaaacaagggaaaacgattgatggtattttcaaattctacagaaccagagcctaggattattacacaaagaaaaaggaaaaagaacagaggaaaacagagctagtttatctttgcatgacagaagaaaggtgagcttgacaaagaatgaagaaaaaagacttgaaccaatggatctaaactaagtgagaggaatgtgaaatgaatagcaactcttcttaaaacctcatacactagcattctgtttacttcataccactcagaaacacattttcaggcagggcacggtggcccacgcctataatcccagcactttgggaggccaaggcgggcagatcacttcagtccagaagttcaagaccagcctggccaatgtggtgaaaccctgtctttacaaaaaatacaaaaattggccaggtgcggtggctcatgcctgtaatcccagcactttgggaggccgaggtgggtggatcatgaggtcaggagatggaggccatcctggctaacactgtgaaagcccgtctctactaaaaacacaaaaaattagccgggcatggtggcgggtgcctgtagtcccagctccttgggaggctgaggcaggagaatggtgtgaacccgggaggcagagcttgcagtgatccaagatcgtaccactgcattccagcctgggtgacagagcgagacttcgtctcaaaaacaaaaacaaaaaacaaaaattagccaggtgtggtggtgcacacctattaatcctggctactcgggaggctgaggcataagaatcacttgaacccaggaggtggaggctgcagtgagccaagattgcaccactgcactcgggcctgggcaagtaagtgagactctctcaaaaaaaaaacaaagacaaaaacaaacaaacaaaaaaaccaacaaccaaattttcagattaaatgcctaaactagtaggcccagtttttataaaatcctaatgacaatttttaaacattcattcagccactattcattatatacttatgagccaaacaataagttggaaaattccaggaacactgcaataatcaagatagccttttagtcaagcatcttaactgtcttgtaaagagatacaactaggatgtcaaaaaccataagaaggtggtaccagtaggtgtttgtaataatggggtctgaaaccaaactggcgggggtgttcctgcttcattacttcctggctgtatgaccttgggcaaggtactaaaactgtataacttagcctccttatctgcaggatgtatttcccgcaaaggctgttcgaggattaagtaagagaagccacataaagtgctttgtgcactgagtaacatacaataagaactcatcaaaagttaggaaatgttggcgggatgcagtggctcacgcctataatcccagcactttgggaggccaaggcaggcagatcacctgaggtcaggagttcgagaccagcctggccaacatgatgaaaccccgtctctactaaatacaaaaattagccaggtatggtggtgcatgcctgtaatcccagctactcaggaggctgaggcagggagaattgcttgaacctgggaggtggaagttgcagtgggctgagatcgtgccactgcactccagcctgggtgacaaagtgagactctgtctcaaaaaaaaaaaaaaaagttaggaaatattagtagtattgttgtataacagatcatgggtggtatcagtgatggaaaacgtgctatgaagctcagaggaattggagatcctttctgttggggatgaatggaatcaagaaggcttcagtgaagaaagtagcatttaagatcaactataagtaaacagagagacatgattaggcatttacagaaattctattataattgaaaagccagaatatgatatactttagaaaaacataggttcatgaaattagacattattttccaggatttggtgtgaaagtagacacctaacctaacaacacagccaggtcatagtacaaagaaaatcaacgtactgctaccaagagaggtacacgatcccatggggtcctgttctatttaactgtaatccaaaatgacaccatggcttttaatggagcttggcaagctctagacgtgccaattataaacttagccttaaatttaaatcatagggcttgagactcaaatctccaatgtgacctttcctgggtgttgttcaagaaaacatgtctgtcactgtggacagaaaccacacacccttttactctggaaagtataatataaagatgtactgtattttacaagcacagagccacaaaatgatggtggctataattccctagaagcaataaaagcaaaggctgtttgatttgtaacattcatttagaaatgtcttattgcattaatgaacattcttatttcccgcatattcgggactttaattcaaaaaaagcttggcaggaatctcatcatttatagatttaacatatagttcctctggatacattcattttgcaagggctcactaagccacactactttgtccttgccagacccatacaatattgtactgaacagaggagctaaaagcccacagtggcttgaattctcctataccctccctgtttcctagccatggaaggtctaatcaaggagagttctatggttgaaatgtgttcaggtgttgccaatgtgatagtgtgaagaggtatagcctttaagagatgattaggccatgaggactcctccctcatgaatgtgatcaaggcccttataaaagagtcttcacacagcattcaggtagctggcccttctgccttccaccacgtgcaaacacagcaatattcccctccagagaaaccatcttggaagtggagagcagccagcaccacagacaacagaatcttctggtgctttaatcttgaactttctagcctccaggactgtgagaaaataaatttctattctttataaattacctaatcaatggtatttgttataggaacaacaaaggcagaaattggtgccagaagaatgggatgatgctgtaataaatacctaaaaatgtagaaacagctttggaattgggtaatgggtagaagctggaatggtaatgggtaaatgctggaaaaagcctgtaccgtcatgaacagaacattaagggcaattgtggtgagggctaagaagaagcagaagactagagaaagcctgacttccttatggattacttaagtgtttgtgaacagaatgttggtataagcatgaacagtaaagattattctgttgagatctcagatggacataaggaacagggtactggaagctagaggaagggccgtctttgttataaaatggcaaagaattatgctgaattctgtcctgtcctaggactctgtgaaatgcagaacttaagagcaattaactagactatttggtggagtaaattctgaattttccattaattcaaattgtgagcatttgggaaattttcagcttggacatgtggagaataaaaattaagtgcgtttagaagagaaaaccaagtgcatgaccaagtgactgtttggtaaggagattagtatggatagaagaaagccaggtgctttagaagaaagccaggagccattgacaatgcaccaatggctctaaacacattttgaagatctttgaggctgcccctcccatcatgggcccagagtgctagggctttgagggcagaatggttttgaggaaggggcccagggtgcctgggggatctggggactcactgcccagggcaatctcaagtctctgctccccacattctgttacggcattcctcagcctccccagctgtggcttgagtggacccagctgcagctgtaaaccctggcagcctccatatggtcgtaattctgaggcttacagagtgcaagagctgtgagacacagctgcttccgcctagatttcaaaggatgtctcaggcagccttgggacctaggcatgaacttgcttgccacagaggtaggaccatggcagagacccttcactagtgcaatgactagtggaactgtggggtcagagccactgcagagagtccccagtagggcaatccttagtgcagccatgggggcaggttcactcataaaatcccattattgtagagccacagcatgcaactccagcctgagagagctacaagggctgaactccagcccgcgagagctgcttcatgggctatgctcaacaatattgtcatagaagggtctcctggaggcttggagacccaacccagctgagtatgtcttgaagaagatatgaagtaaaagattactttcaagtcttaagatttaatgtttgccttgttgggttttagacttacttgggacctgttacccctttcttctttgctatttctcccttttggaatggaaatgtctatcctatgtctgtcccatcattgtattttactttatttttgagacagaatgtcgctctgtcacgcaggctggaatgcagtggcatgacgtcggctcaccacaacctccacctcctgggttcaagcgattctcctgcctcatcctcctgagtagctgagattacaagtgcctgcccccacgcccagccagatttttttctatttttggtagagacagggttttgtcatgttggccaggctggtctcgaactcctggcctcaagtgatacacctgcctcggcctcccaaagtgctgggattgcaggcataagccattgcgcccagtcccatcatcgtattaatattttagaagcgcataacttgtttaacttcacaggttcatagcaggagagcaatttgccttgacatgaattatgccttgagtctcacccatagaggatttagatgagactctggattttagactttgagttgatgctagaacaagtttagactgggctactgggatggaatcaatgtattttgcatgtgagaggacataaatttgggagaggggccagggtagaatattatggttaaaatgtgtccccttcaaaattcaggtgttggcaatgtgatattattaagaaattgggcttttaagaggtgattaggccataaggactcctcccaggtaaatgagattaaggaccttattaaaaaatgtttcacacagcatttggataattgctcttctgccttctgccatgtgagggcaaagggttcctcccctccggaataaccatcttggaagaaagcttccctttccagaaaactgaacctgccagtgcattcatcttgaacttttcagcctccagaactgtaagcaaacaaatttttatgctttataaattaccccatctattgtattttggtatagcagcacaaatagactaagagagtgagcctgcaataaatacagtatccttctttatccctttcactgaaaacctgttaacactattttccattcattccaactcataacatcacaatttatgcactaccattgtgtcaattcattcttagattgctataaagaaacatctgaggctgggtaattcataagcaaaaatttattttggcttatggttcttcagcctatacaggaagcatggcgctggtgtctgcttctggcgcatcctcaagaagcttactatcatggtggaaggcaaatgggagcaggtccatcacatgatgacagcaggggcaagagagaaaagggagaggtcccagactcttttaaacaaccagatcttgcatggacttagtgagaactcacctatcacaaaggacatggtgccaaaccattcatgagggatccacccgcatgatcccatcacctcctaccaggccccaccttcagcattgggaatcacatttcaacatgagatttggaggggacaaacatccaaatcatatcaaccataacttctagctagtatttattcttgtagttcatcctgaaaagagcccaaaatgggtcatcctcaggctatagtggtgataaacatttgaactaaagtaaataaggcagggcactgtggctcatgcctgtaatcccagcactctgggaggctgaggaggcagatcatttgaggtcaggagtttgagaccagcctggccaacatggtgaaaccctgtctctactaaaagtacaaaaatagccaggtatggtgatgtgtgcctgtagtcccagctacttgagaggcggaggcaggagaatggcttgaacccaggaggtggaggttgcagtgagctaacaccactgcactgcagcccgggcaacagagtgagactccatctcaaaaataaataaaataagtgaataaatgcatagatgagataattcttaaaatgtaactctaattatgtacatccactactaaagaacttacaagggctccctattttccaaagatcagacctaagttattcaccagaaatatctgttcccaccatcctctgtaatctcaaaacagactatttctgaccaaaacccttggatccagtagaaatggtctgctcactatgttatatagtgaatctcaactagaggtgcatcacaggtgcatggggtgtcgcctatgacaaaagtgataaatgacatctctcttgccctgtttctctgatcagctactactttgtgaaccaccctatggcgaggcccatttggaaagaaactgaaggatctttccaagacaacagccagtaagaaacttgggccctttatctattagcctatgagaaactaaatcctaccaacaaccaatgagcttggaaatatattctgccccagttgagcagagatgctgtagatgttgctctagttgagatgactacaggcctggccattgctttgactgaagccttgtgagagacccagagttggaggacccagctaaggcatgctcagattcctgactgttgtttaagcaattaaaatagggggtcaggcctgaaaaattcctgagcaaatacaaccagaggtcttaaaaatagccttaatcttgcttaaattgccaacataagcaaaacttaactcaggtcacttctgataaatgcttacattagaactaaaacttaaccccagtgcatcgtaagcagctaatgaacataattatgtgactggactttccaagaaagtaccaaagaaaaggccattttgtcattgcaaaccggtcaaataattttattttaccttagcattttcccaataaatacttgcctcattctgtcattgagacactaaacctcttgcaatctggtgttctccatccataaattgtttcttactcaaactctttaaaattttatgccttaaattttaatgcagtgatagttaattttatgttgttaacttggctaggccatggtacctagatatttgcaaacacaagtctagatgttactgtgaagatgttaaaattaacatttaattagtagacactgagtaaagcagattactttccataatgtgggtgggccttatctaatcagttgaagcacataaggcaaaacagactgaggtcccccaagaaagggaattctgcctccagactgtctttggatttgagcttcttccctagatctccagcctgctggcctaccctgcagattttagacttgccagtgtctataactacatgagctaattccttaaaatatcttaagattctctctctctctctctctcccccctcccactccctctcctgttggttctgtttatctggagaaccttgactgttgagatagaactgataggacctatagagagagagatgtataataagggatttattaggggaattggctcacttgattatggaggctgagaagttccatgataggccagccatctggaagttggagaacaagagaagctgatagcaaggctcaattcaagtctgaaggccttagaaccaagaaagtagtaactctcacaccaagcccaaaggcccaggagcctaggggcattgctggtgtaagtcttggagtccaaggacaacagagtctggacttctgatatccaacagcagaaggaaaaggccatcctggctcccagaaagagcgagaattcaccattcctttgccttctttttccatctgggaaccccagctgattggatagtaaccacccacattgaaggcagatcttccccattcagtccactgactcaagtgctaatctcttctggaaacaccttcacagattcccctgggggcaggcctatcattctaatcaaatgccaaaacagtccatctgggtttccctttcatcaggagaaggacaagctcagtgcctactgaagcactgagaataattaatgctttaccagctatctgggtatccctttgttttagtctattctcacgctgctacaaagaactgctcgaggctgggtaatttagaaaggaaacaggtttaactgactcacagttctgcatggctggggaggcatcaggaaacttacaatcatgacagaaggtaaaggggaagcaaggcatcttcttcacaaggtgcaggagggaaaataaatggaggaactaccaaatacttataaaaccatcagatctcgtgagaactcactatcatgagaatggcatgggaaaaactgcccttatgattcaattccctccatctggtctctcccttgacatgtggggattatggggattacaattcaagatgagattttgggtggggacacaaccaaaccatatcatccttagaccagtcacactgacacccaatcaaccatcacaataatcacaattaactaatacgaagacccacagatactgtgagactaatatgacagccctcccatcacatttatcacaatgaattataatttttggattcctctctaatatggtaagcttcatgttctgtcaagcagagaccacgtacatcatgtttgcaaacaaatattgtactgtgtccagcacagtgactacattcttgttaaacaaatgagtcaaaactaaagcttctccagcagtgtcttcatataacctaagaaaatgacggaacagtcccccaactaacttattgtttacgatttatttgtacctttactgaaggtacctttaatattgtaagaaggcacatatattcattctttcacaataataaacaaaatagtagagatgagacaaatcatgacacacgggagtgacacacagagtggagttttatggagttggagaataagatgattgtgaaattgagaataacaaatttgaaattttataggctgctttagagcagaagtatcagatttcaattaaaagtgtttttgaagatgaacgtggcatcaaagtttagaataggaaaaaaggctattgctatttgaataggtcagttagacagcagtggaaatataaaagtagggttggatggaagaaaaatgcagagaaaaaattccatcaattagatgaaatggataatgagaaaaaagatgcagtcaacaattataggaatattttgagcctaggtgtgggggagactgtaagaacactgacagaatgtggagattcaagaggggagctggtatatgtctgcatgcttagggagtataaaatgatagtgactttactttgagatatgccaagtttgagaaatgccacattccttcctatgttttatgaatacagaaaatctaagtttgataaatgtttcaccaaagatcaatagagactatcaaagactatctctaatttattgttcagcgagtataatatatggtaaaatgcactgattttaggtgtacagttcactaggctttgataaatataccttcccaagtaacctacacacaagtcaagatacaaaacatttccatcacccctgaaagtttccttctagtcaagccccactcaaatgtgaaatttcaatgtctatcaccataaatggctttgcctatacttgaactctgtatataatcatacggtataccagatagcatatgttcttttatgcctggttccttttgttcaatgtaatgattataattcttgttaaatcttccagtagttaattcataagtattcaattgtataaacgactaataacctactacatataatattacattatatgaatttaccataacttatccattctcctgtctatggtcatttggcttgatccagtatttggctattaataaacaaagctattacaaacattcttctcagggctttatgttcttatacaaagccatatatcctttcattcttaagtaaataggtgtgaggttgccagggcattaagtttataaggaaccactagttttcaaaaaaatcctgtaatatgttataccctcaggagcacggtacaagaatttcagtattaccacatcctcaccaatgtttggtgagctcagtccttttatttttatctttttcttgtggatgtgaagtggtacttaaatttacatttccatcatggctaatgatgtcattattatggcttcaaatgtttattaaacattcttatcttcttttgtgaaggttctgtttaagtaatttgccaattggaagaaaaatattttctttgtattttttgagttgtaaagctttgttaaatattctagattcaattccttttcatacatatgtattgcaaactattaatatttgccctttctgtggcttgcctattaaaaatgtttttttatagggagcctttaatgtttgtggagtatagttaactgatttttttctataatgtgagtgcttttagtatcctaagaaatagttatcatcttttgactttttctagaaatcttataaattttactttcatgtaaagatctaattcaaagtatatactttgaatcaatttttgtgtatggtctgaagaaggtgttaaggttcattctgtttcaataattgctctagcaattggctctttttctttttctatttttttttttaagagactgtgtcttactctggttgcccaggctggagtgcagtggaacaatcatagctgactgtaaccgagtacccctgggttcaagcaatcctgcctcagcttcccaagtagctggaactactgatgtgcaccaccatgctcagctactttgactatttatttagagatagggtctcgctatgttgcccaggctggtcttagactcctaggctcaagcagttctcccacctcggcctcccacagtgttgggattataggcatgagtcaccacacccagcctccatttcttaatgagcctttctcctatatgtaacaaaattgctttgttattaaatcaatttactgtataagtctgtgtctatttcatgataacatattctgttccattgatctatttgtctatctttgtctagtatcatattttcttaacacttttatagaagtcttgaaatcagaaagctagtcccccaacactgtcatctttttctaaaataatttgacactaataagtccttataattctgtataaattttagaaccaatttattaatttccaccaaaaaaacataaacttttgggactgtgttaaatatacacatattttgaaataaaaatcttaatatagagtcttccatttgcaatttcatttaccaaatgtttcttactgtatagaaatagcactgatactttacatttatcttgcatcctgaaaccttgtaaattcaagagatttttgctaagttcaaatagatcttttttagactccataggattttctatacaattttttaagtaaatttttgacttgctgtctccaaatatttttattattcttttccaatctatatactttttatttattttactggcctgactgcattggttaggacctccagtacaatgttgaactggtgagagtgaacacccacatctcttttcctgatttggagggaaagtattcactgttaacatccttagttgaaggtttttcacagattccctttaacagattaggaaagataccttttattcctagtctgagtttttatcatgattagaggttgaattttattaaatgctgtctctctaactagtaagataacctttttttctattaatgtggattgattttgaatattaaagaatgcatacatacttgaaattcatttttgtcaggatatattactgtatgttaatacataataacacatcactgcagtgattatgtgttatttcctaattgtatgttaaacatttttgtgtctatgatcataaggcatatcgatgtgtgacttttttaataatgtccttatcaggacttggtattagaattacaaagctctcaaacaatgactagaagtgttctccccacctctatttcccgtctttgtttaagactggtatttcttcttaaatgtttgaaggaattcattagtgaaagcatctggatctggagtgttctttgtgggaagcctctgaattataaattcaatttagttaacaaatacagagctattcccattttctgtttcttctaatataagatttagtaaattttatcttataaaaaaaacttgtccatttcatctaagataagtttgtttcttatggcttctcataccctataataataattccttcacttgactaaaccatatatatttcactggacctcctttcttggtacattaaactcgctggtactttttcctcttctgagagcttctccagcccttactgacataattttgcactgccatgtgttttcagtcatctttattagtttgttttacctttgaaaaacagattatagtgtcctcagaggcggaaatatcttaaactttcattgttctccatggaatttagcatagtctgttaacattttatatgtgtttctgagattatggatttgttcactgttggttagcttgatatctattacagatgtgcttggagcatcttatagtaataacaggaagcatgaaaatgttagaaaataatgataataataactaagattggacacatcaaagtaacagaagccaaccttaaagcgcttccaatggccaaactgcaacaatttgagaaacaataaataataatactggactatatacctcaaagaataaaataatgatccatgagttcataatattgtcaatagtcaactgaatgactgaatcaataaatgggtgagaaaagtatctttcttgcagaattctaaatttaaaaaaaaagatggaatgagagaaacaataattagaacatctagttagaactgctacaggcaaaactcaatgatgaatacaaaaaaatgagtggccaaaagccactcatttaacaaggagcaggacagttaaaatgactcaaagtagtatccctaacatattaattactatggtggcttttaacatgtgtctacaattcttttatattcttccatcaggagatggaacttaatttttttccccttgactggatgatagaattagtgacttgcttgaaactaatatggaagaggaaagtagtaattgtggagaaacctggcaagcaccaccttaatcaagtaatcaaggttcacacatcaccatttaaagtcatgttgatatcatgtacctttgatattatgataaatgtactttaccactgtggtatttttccctaatatccctaatgctcttctaactgtgataacatattaggaaactaattaatattctatgaaatatcagacctttactcttaaatattgtcaaggtcatgaaaatcaaggaaaacctaaaactgtcacagattggtggatactaaagaaatatgatctctgtggtatcctagactggatcctggaacaaaaaagggacacagttgaaaaactacttaaaaaaagagtaaagtatagactatagttaattgtattgtgtaaatgttaatttcttagtttgataaatatactatatttaggggcaagcaagagtaatttggaaacatctttggtaacagctataaccactacttccaaaaaagacacaggttgccaatagaaaaattaataataaaggtcaatatccacaatacaaagaccctggacacaaatccacttactcacagacactgacacccggcccacccacagccctcatcaacagggccacctgcagaccctgtcaaatgtcctgcccagaatctctttccaggatgacttgtggagggctttccctaccaaaaccagtctataaagatggagagaggtgactgcttcttcaagtgcacagacaccaacacaaagatacaaggatcacaaagaatcaggaaaatgacaccaccaaaaagacaaaataaagctccagtaaccaaccctaaagaaatggagacctataactgccagaaaaagaattcaaacaattatcttaaagaagctcagtgagctacaagagaacaaatcaggaaaataaatgaacaaaattagaagttcaacaaagagatagaaaccataaaaaagaaccaaatagaaattctggagctgcagttattatgactgaactaaaaaattaaacggtttcaacagcagattcaatcaagcagaagaaagaataaactcaaggatatgtcatttcgaattattaaagaagaaagaaaagtgtgaggaaattccactagacttaagagcaagcagactaatcagcaagtaagctaatatatggactagcaagcaacatcagcaagcaaactaatatatgcattatgggacactcagaagaagagaaaaaggaacagaaagcttatttaaagaaataatggctgaactttttaaaacctgaagacggaaatggacattcaaattcatgagagaactcaaataggtggaacctaaagagttctaggagaaattactattaaattgtcaaaagtcaaaggcaattttgaaagcaagagaaaaaggactcctcacatatataaatctccatacaactattagcagatttttcagcagaaatgttgcaggcaagatgagagtgggatgttatattcaaagtgctgaaagagaaaaaaagttgccatctagaaatactatatctggtaaaaatgtcctttaaaaatgcatgagagacaaagatgttccaagacaaatgaaaactaaggaagtatgtcaacactgggtcctccttataagaagtgtgaaagggagttcttcaagttgttacaaaaggatactaaacagcaacatgaaagtatatgaaaatataaatcttggctggtaaaggtaaatacacagactaatacataacaatgtatattgtaatgaagatgtataaattacttataatcctaatataaagtaaaaagattagttttaagaataactattaccaaaaatattaatgcacaatataaaaagtaaactatcacatcaataactgtgtaataaacatagtttttgtgtgttattgaagatatgttatcttaaaatagactgttataagaagttttatgtacacctcatggtaattacaaaagtatagtagatacaaaagatagaataaaagcttattactacaaaagctcacataataaaacagcaaaaaggaagaggaacaaaagaactataaaacaagacaactaacaatataacaatagtattttacttatcaataatttaagtggatcaaactcaccaaataaatataaaaataagattcaactatgtgttgtctacaagagaagaactttaaatttaaggacacacagactgaaagtaaaagaatgaaaaaaaaatactcaaagcaaacagtaaacaaaataaagcaggggtagctatttttgaaatatacaaaatgcttttaagtcaactgtcacaagagacaaagatcattatataggggaaaaaagagtcagtttaacaggaagataacagtagtagacttcaataactcatcttcaatatggattgatcacacagaaagttattaaggaaaacagcagtcttgaataacactatataccaaatggacctaacagaaatgtacagaacattctacccagcagcagtagagcaaacattgttctcaagtgcatatagaacattctctagggtagatcacatgcttggtcacaaaacaaatctttattttaaaaagattaaaatcataccaagtatctttctgaccacagtgaaatcaaacacaatatcaataacaaaaaaagagaaaattcacaaatacatggaaatttgaaaacacactcctaaacaactattggctcacaaaaagaaatgaaaaggaaatttaaaaagtatgttgagaaaaataaaaatgaaaaatatactaaaacttattggatgcatcaaaagaaataataagagggaattttatagtataaacacctaccttaacaaaaaaaaaaaagctaaatgaatgacctaattgtatgctttaaagaactagaaaaagaacaaaccaggccaaaagctaacagaagaaagaaaatattaaacgttagaacagaaataaatgaactagaaaacagaaaaacattagaaaataatataacaaagagttggttttttgaaaagataaaatacacaaattcttgcccagactaagaaaaaaagattcaaataagtcaaataaaagaggggccattataactgatgccacaaaaataaaaaatatcataataaactattatatgtgacaatatatacgaacacattggataacctaggagaaatgaatacattattagaaacacaggacctaccacactgaatcatgaagaaatagaaagcctaatcggatcaatgacaaataaggagagctaataagtaatcaaaaaccacctactaagtaaaagcccagtatcagatggttccacaggtgaattctatcaaacatttaaagaatgaatgccaatattcttaaactctcaaaaactagaagaggaaacactttcaaactcattttatgagtccagacaccccaatacaaaccaagacaaagattccatgagaaaagaaaataggccaatatctctgttgaacattaatgtaaaaattttcaacaaaatagcagcaaaccaaattcaatagtgcattaaaagggtcatacaccacgagcaaatgggatttattcctgggatgcaaggatggctcaacatatgaaaatcaatcaatgtgatacatcatagtaacagaataaaggataaaaatcacatgataatattaatagatgcagaaaagcactttataaaattaaacacgctttcataataaaaacttaacaaattaggtaaagaagaaacttaccttaacaaaataaaggccttacatgaaaagcccatatgtatcatcacactcaacggtgaaaaactgaaagatcttattgaatccagaacaagtaaggatatccactcttaccatttctattcaaatgagtactgaaattctagccagagcaatcaggcaataaaaagaaatatatatatattttttactttgtaaaggaaataattgggaagaaaaaataaaataatctgtttgctgatgacatgattttatatacagaaaactctaagaagtccatacacacagaaagtgttataaataataaatttagtaaagttacaggttgtaaaaatcaacatataaaaattagttctgtttctatacataaacaattagctatctgaaaaggaaattaaaacaatcccatgtacaactgcatcaaaaagaacgaagtactcaggaataatctttaccaaggaggtgaaagacttgtacacaaaaactgtaaaacaccgatgaaagaaattaaatcacacacaaataaataaaaatcccatgttcatggaaagacttgagatatcaaacaaaaatattttgatttgaagaatatcaaaatgttcacactatccaaagcaatctacagattcaatgaaacctctatcagaatcccagtggcatttttttacagaaacaaaaaatacaatcctaaaacgtatatgaaaccataaaagaccctgaatagccaaagcaattttgatcaaaggaaaatctggaagtatcacatttcctgacttcaaaatatagtacaaagctatagtaatcaaaagaggataacctggcataaaaacaggcatatggaacaatggagcaaagtagagaatccagaataaacccaggcatgtaagatccaatgatctgcaacaagggtgccaagactaaacaaatgatggtggaaaaagtggacatccatatacaacagaatgaaattttacccttactgttacactgtatacaataaaaactcaaaatggaataaagacttaaatggaagacccgaaaccacaaattttctagaagaaaagctccataatgttgacttcagcaatgatttattggatatgataccaaaggacaggcaacaagagcaagcaatagatatgtgggatcacatcaatctagaaaactacaccacaaaggaaataatcaacaaaatgaaaaggtaacttacaaaatgggagaaaacctttgcaaaatgggggaaaataatttatctaataaagggttaatgtcaaaaatatatcaggaattcctgcaactcaatagcaaaaaaatccaataaaaatgggtaaagaaactgagtagacatttctctgaagaagacatacaggtatatgaaaacatactcaacagtaccaatcatcagggaaattcaaatcaaaactgagataccacctcacacctgttaggctattataaaaaataaaaagataacaaatgttggtgaggacacagagaaaaaggaacctttataagctgttggtgggaatgtaaattggtgcaaccactgtggaaaactgtatggggattccttaaagaatcagaactaccactggatagtagaaatcccacttctgagtatataaccaaaggaatcaaagtctgggtcacaaagagatttctgcactatcatgctcactgaagcattattcacaataggcaagatatagaaacaacctaaatacctgttgacagatggacaaataaagaaaatgtggtatatacatacaatgggatattattcagccttgaaaaagaaaatcctgtcatttgcaacaacatggatgaatctggaagacattatgctcagtaaactaggccaggcacagaaggaaaaatgctacatgatactactaatatgaggaatctaaaataatcaaactcataaaagcagatagaatggtggttgccaagggccagaggaagggcaaaatgtggaggtattagtcaaagggtaaaaatgttcagttataaaagacaagtcctagggctctactgtacagtagagtgcctatagttaatattttgtaagacttaaaatttgcagtgacattatttgctcgatcttatgttaaatgttcttactgcaaaataatatgaaacttttggaggtgattaatatgtttatggcatagattatggtgatggtttcatggttatatacttatctctaactcaccaagttacatacattaaatatgtaaaaattttacattattcttacctcaaagtgatttctctttaaaaagatcaatatccaaaaccactctgacttcaaaagtcaggtagatagtactgacttttttaggaaataaaagaaacacctatcttttggtgaggtaatatccaattattttacattttaactttcaaacaactgtaaagagacatgagatttatacttgttctagatgcttccagttcaacatggtaatcggatcacatcaacttattccatgccttctcaggttcccaaatagccataaatctacaaagccaaagaaaattggagtgaatgaggaaatgctagaaaaattctagatgatagaattgaacaggactgagaaagctacagcctaagtacatgtgagaagaaaggatgatcaaaagaaggcagaaatttgagagaattctgtagggaaacaaccagatttctagactataccctaaaaagcaagatatcaggctataatctctgatacaaagtttgcagtcaaattttctttcttaaatataattgtataacacttactgacagacatttgaagaaagttggaaagataaagaagtctgcaatcaacaaacaaaaataacccttgagaagtgtctgtttatatccttcgcccactttttgatggggttgtttttttcttgtaaatttgtttgagttcgttgtagattctggatattagccctttgtcagatgagtatgttgcaaaaattttctcccattctgtaggttgcctgttcactctgatggtggtttattttgctgtgcagaagctctttagtttaattagatcccatttgtcaattgtggcttttgttgccgttgcttttggtgttttagacatgaagtccttgcccatgcctatgtcctgaatggtattgcctaggttttcttctagggtttttatggttttaggtctaacatgtaagtctttaatccatcttggattaatttttgtataaggtgtaaggaagggatccagtttcagctttctacatatggctagccagttttcccagcaccatttattaaacagggaatcttttccccattttttgtttttgtgaggtttgtcaaagatcagatagttgtagatatgcggcattatttctgacggctctgttctcttccattggtctatatctctgttttggtaccagtaccatgctgttttggttactgtagtcttgtagtatagtttgaagtcaggtagcatgatgcctccagctttgttcttcttatgcagccaaaaaacacctgaaaaaatgctcatcattactggccatcagagaaatgcaaatcaaaaccacaatgagataccatctcacaccagttagaatggcgatcattaaaaagtcaggaaacaacaggtgctggagaggatgtggagaaataggaacacttttacactgttagtgggactgtaaactagttcaaccattgtggaagtcggtgtggcgattcctcagggatctagaactagaaataccatttgacccagccatcccattactgggtatatacccaaaggattataaatcatgctgctataaagacacatgcacacatatgtttattgtggcactattcacaatagcaaagacttggaaccaacccaaatgtccaacaacgatagactggattaagaaaatgtggcacatatacaccatggaatactatgcagccataaaaaatgatgagttcatgtcctttgtagggacatggatgaagctggaaaccatcattctcagcaaactatcgcaaggacaaaaaacccaacaccgcatgttctcactcataggtgggaattgaacaatgagaacacatggacacaggaaggggaacatcacacaacggggaatgttgtggggtggggggacgggggagggatagcattaggtgatatacctaatgctaaatgacgagttaatgggtgcagcacatcaacatggcacatgtatacatatgtaacaaacctgcacattgtgcacatgtaccctaaaacttaaagtataataaaaaaaaacccttgagggaatttgagtgattgacagaatagaacttttaaaactctaaaaacataaagaagattttattaaagaaataatcagacaattatcaattttacaaaaatcaatataaagaaaattgtgtttaataattcttccagaaagcttttaaaaactgaaagagaaatgaaaaacagaagacaaaagacaaaggatatagagaatccaaccagaagacccaactactaagaatgccaaggagaattcccagtaagaaaagcaaaggagaggaattcaaaagaaatttccacaagtgaaggtcaggtgttttcaaaattaaagggctcatcaagaggtaaacataatcaatgaagaaaagaatcataaccagatatgtttttgtaagagttcctacagataagtttctaaaaactgaggaggaaaaaattagtaacttacaaaggggcaggaatcgaatttcttgtcagcaatactggatactaaaaaatagagcaatgccttcaaatttccaagggaaaattgtttttaacttatatgtcttaatctagccaaatctagccaaaataataagtcactttcagatatacaaagattcggagtatttacttcccacatgtcctttctggaaaaattcttgaggatgtgcttcagcagtaaataaaattaaagtaagaaaaggcatgaatccaagcaagagcaaggcaagatgcctgtgtaccagttaccccaacctgggacagagggaggtatctaggaaaaaggggatttctaaatattttattctatttcctgaggtgaaagtacttaaaaatgcaataaaggcagattacacaaagaaaagtaaaagcaattagaaactctaggaaaaacaaatacaatcatagtatacaacttagatcagtagttataactacatattcatacctatatattgatttttaaccattagaatcaacctaacaatattacaactagagttgtaatatatttgaaaaacattatatcaaccttaataatttaaaattaaaagcacatatgagagaaactggaaggcattaaagggaggagttatagaaagaatgattgttatggtctgaacttgtccaaaatttgaaactcaatcctcattgtgctgttattaagaggtggatggaagctttggggaagtgacaaagtcacgagagctccatcctcatgaatggatcagtgccttatagatgggctggagggaactggcgtaggtccttttagctcttctgctatgtgaggatatggcattttcttcttttgctcttcctcctcttctatgtgaggatgcttccatgaaaacacactatggatagaacaggcctacactagacacagaaactgccagcaccatgatcttgtgctttccaacctctaaacttagaagaaacaaatttctgttctttatatatcacctagtgtcaggtatttttgttacagcaacacagactaagtaatagtctcatcttaaaaaggaatcatttggtactgtatatgattgagatagaaatgaaagaataagtatattattcaaaggtatacaggtaacgagaacttctgggttttcctctctaaaatatttagaggttttactctctaaaataggagggtattttagcaatggggagctgctagatcattatgtatcacagtgattaagtcaacagataatattgaaattttataaatcaagaaattgtgatcacatacacatgcaatacttgattcagccaatattacacagttagaactaaaaaggaactaacaaaaatataaacatagaaacagctaaaaaaaattattagtttttctttgggcagtaagtctagaggtgggatccaggactatagtttttcattataagccctcctatactctttaatttttaaaagcatatatatgcatttattgatcaaataaatgtgaaacatttattaatgtttaaaaatccatctggaaatcatccagctagactaatgcttcatcataatgcagctctcagcatttaaataaggtcttgttggtaattcagaaattactacattttaaagctcaaatagcaatgtcttctacacattctactctgtggtaggaaatatcacagcaatattttagaacagatgacaaaatagcctatatcagggatattaggtgttaaagaaataaaactggttaaaatatttgttaaaaatatgaggtgaataaatgcctgtcctaatgagtctccccactagtatctaacacatgttagagaaagaggaacactggtctctctgctcactagtacaacaatggatgactgcttaaattgcagccatcctgaaataccttgagtctgtcatttattccctctgatttcctatgagaaagattacaaattgcccactagaatcagggtctgtgagccacatcctccactttcatttctaggacataatacctctgccgtcaatcacagcacagctcaaattttttgaagcatagtgggatacaacagaattgtcacttaaaatttggaatacatctgatgtagcacgaactggactttctaagtgtgttaactactctgcaatatagatttggaaaatgtgaaaatgaagtggaaaaccttaaaaagacaaatgtccaaataagaaagattacagtctgtggatggtattctcattcatcttcaaatttcctttgctttgtgtttaaaccaaatgaagaggttttccaatgtcatttgacacaggcaaacatctgaaattcaacagcaaagtccccttcttgcagaagccttaaaaatgaaagctggtttgcttttcctaaagaaagaaaaaaaaaatgtctccccaacccccaacacccaccctttcctgaaagagaattttccagcagctggaagtttccagacctatgttctcagtgttggacagccttatatttacccatttttagcaaaattagggctcagaaagtttcatgagtagtggtacacatcagacgtctgttggaagtcattgtggaaagggtttctctgtacatatgtatagatctaagtaggagatggaagtcaccaaaataattttgtaacagaacagcaacaacaaaaagaataatctataaatattataggactttcttggtgtggataaaatcagagctcaaaaagagcctccagatcaatccatgtgagattttacaggccttctagaattggtaacagacaaggttttgctctcctgccagccggcactcctatttctgatgcattcatacagagtgatggttgttactaacattgtaattacttatacaatccttttaagaatgtaagttccatgagagcaagaatgttatatcatccactactgtattcaatcatttagaagagtgtctgacatataataggtattctgtaaaatttttaaatgaataaacaccttgtaaatttactgtaaagagcaaaggaataagtacaggtgaaagtgctttgcaaattaaattctaaaaggtgagcagttgttactctgcataatccaattcctgttggggcccgctcctaaaggctctgacaaagccattgcccgcattttgattccttctactgggccataattagactcatctacgtgggagaggcaggataatgcagttgttcaaagtgtaaaccctgaaactggacttcctgagttcaaatcccacctctatgactgactgactagctatatgatcttgagaaagttatttaacctctctatgcttaatttccttatatgtaatttgggagatgataatgatgcctaacttatagggttgtgataattaaatagattactatctgtaactcattgaaaacgggctggtacaaagtaagcattaagtacggctgctagtgttgttgctaccactcctattactatagggatgcagaaaaaatataaggaaattcagcaatgtccatactgcgaactttttctactaatgccacgtgcaagtttaaggctatattttacattgctgaattcctctgaagtttcaacttcatgaactattcttctacatatttagttccttaaagagctcaatggagctacagctcagtaagttatgtgttttggataaaataaggatatgagctgaggcatttaatcatagaagcagcctcaggctctctatccattcttggcttgtttttcaaagcacattgctaaatgtgttttctctttcataaagttttttaaaagttacttggacatgacaagcttctttaaatataaaacagtttcaatttttattgagatttgcttcaggaacattcttagtgttggtaatatttttagacaataattttattcagaagaccttattttatagattaactgcacaatagagttcatgcagttacatttacatggactttgtgctccatagtactgaaatccaaatatcagtttacttcagtataagcatatcagattgacctgaaatgctctagaacttttaaaaggcaaacgccaaaatgaaacaacacaccacctctcaagcatgtattctgtgctatgagcaagatctttcagttagaacttactaaattaggtcaagaggttctcctgggataaaggagtttgccaaagtaattctaaaattcccaaaataaggcacacagcactataacatttcactgattcttactcgttcttttatagtgctttgggaaatgttagaccattggtctgcatcatttcacctccttgtaggggaaaaactgtcaccagcaactgctgcttcaaactgtaataatcttccaggttcattctagggaatccaaaaggcgagcaccacatatttcctttcctttccacaggcgatcatgcaaattccctagcttaaggctgagaagtgcgtatgtgtgtatacttatgtatattatgtatatacagcctatggatattatatatatatacactatggacaatatatatagtatctatggatattatacatatgccatccatggatattatatgtgcataatctacgaatactgtatgtagatgcatatctaatatacatacatatacatgtattcattattttatagaatcaagttgagcttttcaattactggcagatctacaaaggctgttgagatttaaaccattacaaacaattacatgagagttgtcccggagtcacagagcccagaaagctaattctaacctgctttccttcttatgtactatatacttctaattacccagcacggttaggttctcataccattttgcatattttcatccaaaaattcaaacctactccatcctgagaacaaaagctggcaagaagcactcaagtgatgggtgaacaaatgtattaaaaaaagcaacattctgacatggaaatgtcatgtgagctgccgaatggcacacagctccaaagtctaccataatattttgaaacactttgccaatgagcatataattgactgaaaaacttgccagcactattccagagatgtttaaatactacataataaaacaatttacagaaaagaattaaatgttagaagtacatttttagaaagcttccaaaaccaatgtgtgtgggttttttttttttttttttcccattttggagccaaagaaataactctgatattctcagttctcacactttgccttccatatttgacctgctgcctatcacttgcatttttgcatagcagtcacatcagtcagtaataaacctgtatttattgagaactttagaagtacagatatcttggcgcaaattgctataagatcctgcctcatgaggtcagcatctgtgcttttttatgagcatttttccatccatctatctttctaacaagtatttattaagcacctaagatatgtcaagtattgggttagatgccagagagataatgatgggcaatataatgtgactgccaccatggagtttatagcctatctgggaagggtcacagttaaaggaataataatcataatttgtggctgggcgcagtggctcacgcctgcaatctcagcactttgggaggccaaggcaagcagatcacataaggccaggagttcaagagcagcatggtcaacatggcgaaaccctgtctctattaaaaatacaaaaattagctgggtgtgctggtgcaagtttctaatcccagctactagggaggctgaggaagtagaatggctcgaacccatggggcagaggttgtagtgagctgagatcacgccactgcactccagcctgggtgatagagcaggggaagaaagggtgtaaaacattaaaaaaattgttttcagaaaaacaatggctggtatgtagagaaaacaaggggcaaagcggtaagaaaaaagaccggagaggtgagcacaggctgggactattactgtttttctaagatccattctttgcccttggtcactcttctatgatcatttatagttttaataaatactggactgggtaactaacaacacatcctgaagtaataatacacaataaaactattattccattattcttaacacagacttctccttgtaacccagtgaatcatctgtaacaaaacccaaagcaactatatatctattccacaaggaaatttttagtttttttattaatagatgataggtcaggctttatgaccatatctgcatttgtgactgacatttcctttatgagatttattataatgaggacaaataatacaaaagcaatacatttaaaatcaataaaaaaggagaaaaatcataagtactcctttacctttcaggaaaagttaacccttagctattaatcacatagtttaaaaaacaatataggtttcaaagaaatataaggatctcaaaactatgattctgcattaatttattgtataaatgttttcatagaaaacatcaatatttaacagtgaaatgtatatattaatgcaatgtttgtttatgttcaggtacatttatatacatatttgcatgtgcatttatttctgtcaataggcagttacaggagcagtaataattagcttttattcttgtgggttaagtagaacaataatatctatctacttcatgttcacttcttgagacaaagaggcaattttttatttcagctcttttctttttgttggattctattaaagttgaggtagaataaaatacaattcaaaccagttttacatatctttaatgtgtaattgagagttttttgtttttagtcctaaatactttggctccatcacagtaagtccctatgggtagctgctaaattcttaaaccagaagcaattatatttcaggaaagagtcatttaaatgtttgtatctagcaccaaatgtatttttgtcttaataaattataaaatgtctttcctctcccttattttttctaagtccaccctttcttctctcttgactttggcatatgaacttgtacttgtagccaaacacatcagttgagctgggagtattatcttaaacagctggaagggaatgatgaagatgcttggccagcccatcacccagccagccttcctctgtttcctccccacccaagttctagattttggcttcacccaatccaaccagcctcttctaattaactcttccatactcagttgtctaaagcgatatggcaaaacttactgccagtcctattttggattagtttgtagaatatttgtgtctttacaagtcatacctttacaacagctcttgttatatgaatattctacaaattaactcccatcacctatgtctgctgagcattggaatattagttggactgtcaagatgccatagaggagacaggtggtttctatggagaaaagcagctagctgccagaggtccagctccaactgtagcccccccttcctaaaataaccttgtcaccaggattgaggctttctatatgccagattgtaggttgaggcacccacagtttcaacaagactacttagctatggtagcttcatcagtaactttcagatacacattttgtttcattttcatgggaatgcaacaatattaaccccacagaaagaaatggatgctcagagcattaactgatttgttcaagtcacgcaaccagtacacggcagaggtgggaccaaaacacaggacttctgagtgcctgtgtgtcatgtactccaaaacagcaaagtctttggcaatgtctctcaaaaattctcagactgtatctgcataaaatcgctgtgggtgatttttaaaatgcacgttcctggatgcagtcaagacctaagaattacattctctgagagtggggccaagaatctgcattttaatgaggtccctaggtaattttcattcatagtagagttacagaaaggctaagtcttttcttctattcctaaactttggagtatccgtttttcatcagaaatgcttctgggatctttaaattaattgcctgggttgtcttaggaacaagtcaaatacttatataatattttctacatcctaggtcttgttaattgattaaattctcacaacaaccttacaaggtagataatagtattacaatactcatgttatagataaggagacttaggcacagaaaagctaaagggacttccctcaaattacacacaagatgtgatcctgggccatctggctccagagtccatttgtcaaccactacactatgctagtgctacagcttcaaacaaagaatcacagtcactgaaaagtgctggagagcaactgctcgtggaaatctttgctctgagcttcatggaacagatcagagttcctccaggatgtcctgctccatactccaatgccttcacagctgttctccctgctaacatgccatgtatgccctcctaatctgacaaaacctggacacttcctggatgtccagagtgagcctgatgtccctcatttttgttcccagggcctagtgcacacaagcctcctggcactaattatactaacctatacctgcaaatctaagcctattttccacaggaaactagaacttcctaagggtagatattgagccttatttattttctgccctaagtatctagcagtcagcgggaactccatagatgcttgtggaataagtgaatggtggaatatacagtaaagaatggttattccctttataacagaatttaccaaaagtttctgaatccctgtgttcattgacatatcattaatgtcttgacagaaagcctaaaggactgaaaggtaaagccactgccaactggagatcaatccagtatcagataaaacatctttgaagtcatgatgtaagtcagtgggaaagcttctacgggatctaaaaatgtgaattagacacagcttttcaaggacactcctgttgcacaaaagggagtgtacacgttagagaaggtttgcctcagtgctatcaacatgtaagcagatggggacatgaaacagcttgtgaattcagtccttttctctccagctggcagaagcaaggattttgagaactctgctctcctgtctactgaaggatcatgtttccctgctctgcaatgaccatcaaagccatctgggaaaaacaaaattcttttgcacaagaacatagggagcaacagggaagaacaaagctgcagtactttggttctttggctcccgcttctggaaaactctagttggtattttatctagcttgttctctcagtggtgtagtaaatcaaacaggatagttgcaaaatgttctacagtgttggggaagaagaatttcttacatgcctagaaagccaccagggttgtaaattaaattcctcaaacaaagcagccccaaacacacagaatattagcttccccattttgtgtagttttctaagctcttgagattgtgtacatgttaaacacattcactgccattttcttccttgaaaaagattttgagttttctgtcacatcaaagaatgtatatcaaagaaatacaaaatggaatttgtgattagtagaaacagagcatattaatttttccttctaaacaataccctaagatgaaaacaggctaaagccattatgctaatccagtgatggaaggcacagattaccacacaaataaacaatgtgtgttacagaatacagactagagtgtgcctcacaattatattttatggtggaatatatgtttacggagcttttggcctggtcatttaagaaaaatgtccttaggctgggtgtggtggctgaagcctgtaatcccagcactttgggaggccgaggcgggtggatcaccttgaggtcaggagttcaagaccagcctggccaacatggtgaaacccggtctctactaaaaatacaaaaattagctgggcgtggtggtaggtgcctgtaaccccagctatttgggaagctgaggcagaagaatcacttgaacctagcagttggaggttgcaatgagcccagatcgcgccattgcactccagcctgggcaacaagagtgaaaccctgtctcataaaaaatgcccttaagtttgtaggtctctacaagtttcatgtgaaatatggagttctgtgaaagccatatctcatggaataaatcccaatcaatgtctttgaccagaagttcaggagtgagtgccctctgcctatggtcacaggtttaatcaactccagtatgggccagttatctctgctactatggtctgaatgtgtgtgtctccccaaaattcatatgttgaaatcctaacctccaaggtgatgttattcagtggtgcgggcctttgggaggtgactacatcactagaatgggattagtgctcttatgaaagaagcccaaaagagaaccctcattccttccaccatgcaaggacacaactagaagctgccatctatgaacaacaaagttggccttatctagacattaaatctgctggcaccttgatcttgaactgtggaaaattcagttgttcataagccacatggtttatggtattttgttatagcagcctgaacagactaagatgtctgctctgcccaacagtcaaagaatgtactattatttccttttaacatggatcctatgggacaattaggcaggaaacatagatgcttgttcaaagaaacagcatccccaaaacaaaaccaatctaagaagtgcattcctcatgaagaagaatttatcaaccatattaacatgttgttctctcttttaaactcctattttttgcttctttttattcagttcattctcaggaagtgtgttgtgagaacagatctaagccaatgtaatcatcaatattatcaatattaggttccttctggtaggtgagatacgtgggtctcctctcccataccttactaccaaatttgtcatacgttcaaatgtctattagcaagcagacacagcacaggtaatcagttccatgataattcactgtctctgttcttttcagtgccccccagcagtttgcatcaagagctcaggggaggcagatgcgttgatgttctagtgcaatactcagcattattttagttactatagaacaatcctgcaagcagaatggtctaggctataaacctacagtgatattagaaaggtgaccagatttccagacttgtatcactagattcccaaattttgttcatgcaatagtacagaatccacaaatcttaaactccatttaaccattgtaaaaaaaaatacatttctaagtcttctttgttgatcagatatgttgataattgaaatgtttatggtaactacctcatgcatctttgaaatactaaacactctgaattgaatatcctcaattaggtgcttcagatattggtttaccatctctgagagatagaataattcatgtgtaatacacacactccacagtgtccacatggaagaatttaaaagtaaattacagaaagtaaaaacaagtggaacctctatttttaacattctttcattaaattcagcatcaaaatgagtgattccaggaagtacatgacaaaactctccccacccatgtcaagagtccttagcaaatcttgtttcctttctacagtatgtgaaagcctggggatccagagagcatggatagagaacaacaacaacaaccctgagcattagttccaggtaggcaaataaccatacaagtccatttagtttggaatttttgtgctaaagtttccctaagaggtattgtcagaccaactgagatacatattagttcttcctcagacaagtgcaacaggttcaattcggttgagttaaataacattatggaatacatgcttgtgtttctcccaatctcaccatcaaccttatatgccagctttgaactattggcttacaggactgcattaatcacatgcctgcttaaaaaaagtatttgcctactaataagaaacaaattctttagcctaaaaacaaaacttcaacctacctctatagcctggttggcgactgctttgaccatttcttcccattccattgagaatgtcagtgtgagctagtctcaataaccaaaatgacttttcacacctctccaaggatccacccttagctagctctgaggatgtggtaaattaatctgtctcaccacagcacgtggcagaaagcttatactggatgttggtctggcagccagacaaactgggccacccaaagaccaggagaccccagaccccaggagtaggcctgaggtagacaaagtagctagtcagcaagagaaggcagcaccaagcaaagaaagtccaaggaactctgaatcccctgcgatcctctctgacttaccccgtgaagcctgaaatgtcttgtgccataagcaaccttcttggcagtcccagactcatattcaaagccctcgtcaagtttcctctgctctctatgcccttgatttagactgcagaattggtctggacttgcagtgggtttagtgtccctcccaggtccccagtgacatgtattacatctccctccttgaatgctttaccttgctttttaagtatttactaacgtaactgactcctcactgggctatacatttcctaaatgagcctgggccccattcatcttagtgttcccagaacctagcaaagtgcttagctcatagtaaatgcttttaaaaatgttcatcaaataagtgaataaataagtgcactctagtttagaaatgtaacagcacttcctcattactgcatagcttgttgatctagattctcattatcatgaccctggatagtacccattctcaaactcttccatagtggatcagaagcaagcccttgagccccttccccaacaaactttactggaatgtacttcattatccctggttttcattatccttggtaagtacaacagtcaatctgcacacacacacggtatcttgatgttttaattatcttactaataaattccctgaagtaaaaggcatgtttgtttgtttttcaattttatgacaatgttttatttaaattcttaaaaactctccggtatcactaataaataccatatgcaagaaactaggctagctgggtggggcccaaaaatgatatgatatcatctttcttttcacagatctttttatctacatggggaacaggatatagacccatgaactgaatcaccatcacacgaaccatgcagacagaggattagggaggctttgccggggggcggccactggtcaggtagagatggcatgtgaggatttgaaaagaaagtggtactgagacagaagacataatttaagcacttaaggtcaggaaagtggcagcaagcaagtctaggctctaaaatgctttgcagcaaccccagcagtgagcaagaagaggccgggatcaggcccagtggaaaggctgggtcgaaacaggctctatttaagatcagtggtggtcacccaccatatccaaacaatatgattcttccaacttagctaagggaagggagtaagggaagcagggagggaatgagggaagctcttagtgtaattacttgtagaaatttggtaatatatgtacactatgcaggaaacaatggtttttccttaatatagcaatgcatgaggacatatcactatttttcaaacaaaacccagaacagcatactcaaccctactctcttatttggagctgtgtgaaaaagtaaacttaacttttgtccagaccttctgaataaggtaaactgactcatgtctagaaacaggtttttttctatagtaagagaataattaaattttatattttatgaatatattattaaaaacaccaatcaataaactccaaaggatgagttcaagtttagaccaatgagatagccaccataagatgtatctgggtacaacccgatgtgatgacacatattgtgcagggtactataggcccctagagagcagcagccagtattatccaaagactgatatcagaggctcatgtcaggctgcttaacaaccactgagctgggctgggtattcccgctctcatcaagggggactgtgtccaaatcccacataaggagggctgcaaagtctcccctataccttagacagactgcacacaagtcaagtcctttgatgccaaagtaattttgttactgagccctataagaccactctcatgtccttccccctaaaaagtaagagatataaaatatactttgccctggaaggtccttgcttggagtgaatgtaaatagaaggctttgagtgcaaagacctactgaaaatataaatgttctaataatgatttatttgtaagcctaactcttctactggactgggagctccctgaggtctggtctgaatggtgtctccaaggcttcattcagtgctcagtggacggtgtaggctcagtacatgcttttttgagtatacaaaaaataaatgctacaaggcaggagagtggccctaaatgaaaatttgagttttaaagttgctatggcatataagtacttaagagacactgcagaaactgtatagaatcatgtatagaatcatgaatagaatcaatcctacatgtataacaatttatttgtagacaagatcataggagcagcattgtggatatcaaggtgggctcactttctaatgtcagaggctggtgctcattggagtgtgcctctcagtcacatctagttcttgaaatctgaggaaaaactctatttaaaagtagagagactgaaaaaaatgagtcttggattagctagattcagataattcaatatttttactactaaaccacagagatctagattactagggaacagaaattgccttgaattaaataccactctgggtaagctagtattggcttaatgagctttttgtgtactgggcttaataaaaaattgtattagtcattttatacaaatatagtggagctgatgaattactcataataaagaaaaataacccctaatccattttaataattcccatatttcaaaatacagaaatttgtcctcaagcacacagaatcctagatgataatacaggcccagagaaatgaagtgagttgctaaagtcacataactaattaatgaaggagataagattggaaccaaggtctcgcaacgccttgtctggcacacttctaccacatcagtgatttccaaacagtgccctgtagaagcccttcgaggatcctgggacagcaggtgagggggcctggcaggcacagttcccctctttgcatcatgctgtcttttcatgcagacccttgtgctttagtgcactggtacccagatttgtggatttcatgctactgtaaaaaaataaagaatgactacatacaattactatcatgtcataaaagaagggatattttaaaactcaaaacatttggaggagagaatcttggaataaatagaaattatttataaaacacagcatggttccacatttttctcatttcactaagaataacaggaaaaaatcctcaatgtggaaagtcactgttctgtagaccttcatttgggaagcagtggttttgtggcaagaacatagaatttggatttcaaccacatcacagtagcagtgcatcttgaatgactcattttaatttctaagttttgtttcttatgtataaagttcaatagtaattcctgacacacaccacagtccctcactcccatcctctgcaagagttgctcctttcaaagatatctacttctgttattctcaaaaggtgggctcaggactacttgcatcagaataatctgaggtgcatattaaaaacccaagttccttgaacctaacccagatgaggtttccaagaaatggggttggttttaagtggtttagtttagaaggcacaaagcctgagttgttattttttaatgatagtttacaacatctgctctaattaccagaggctgatggtaagattatgcagataaaattcctttggaaaactgcagcaactataaaaatagaaaacagagaataagggaaaggaagacaagaataaggactaaagagaagatgcgaggagggcaaaccatttattcttaaattagttttcttacctgatgaacaaggactgtgaacgggatcaatgactttttaaccaccccattagcagctaaactattttcaaagaaaatcttttaaggaaataaatcttttaagaaagcaatgtcttctgacaaaggcagagttgctctagtagaagtggcccagagttctgtcccgtcaatgccctatctcattccctccatcctcctggtagcctctgaggccccctatgctagaagataatagaatgacctgcttgctctctgaggtattgttctgattccagagaaggtaggtctaaccattaactaatgctatgtattttaatataatcaacacagaaaatgtagccacccaatcaccagattctccctgaaaagtgattcacgtgcaggacatcttaagcagcatggcacaccacaaacatgatcaataagaaggtaccacacttaattttttagtccattactgttcttcacctaacacagaggttctcaccaagtaatctgctccctttctttcctcaccggacccatggaatctgttgcttcctttccatcctccatggctacagccatcgtacaagtttcaggaaggccacccaaccaccttcttcacatcatcctagccttcagacccctttagtccatctaatatcttcttgccaactcattgtcttgatagtgacatctgaaaacaagttctcaccccatggtcttcatagagacaattccaactcattaaccccagacactcacatttcttagctcctctcattaaaaagcacactggtctaggggtctttttgagtcatcagggtccaagctcctgctccacacctcacacacgtgttcctctccaggctcctatctcaggagatgacagattccaccactcaccaaggtgttgagatcaaatccttatagtcactcttgacatgtttacttctctcaaatccccatcctacccacatgtatgaaacaaggcccctcctcacgccctccaccctggccaccatcatgcctccctggcttgctctctgctcccatcttcttctacttttcttcttgctcagctcactctgctccagctccctagccttcttgctgtcctccaatacaccaagcacattccagtttctgggcctttgtacatgcctgttcctctgcctggaatgctcttccccaagatgtctgcatggatatagccctcttttcattgaggttctgcttcaatatcactgcttcagagaggtcttccctaagcaccttatttcaaagagtgcttctacaactctatctttaccctgcttaatttttcttcataacatcaccacctgaaattcaattatatatgcatcagttgacacatttattatctgattccactctcatttgttgtggagcagcatgaagtctgagtggtaactttgtttctgacccagtgtcaccgatgtctagaatgatatagggcactctgaaggttttcaataagtcaatcactcaattaaacaaaaatctaactcatctttaaatccctcattttatcaactactccttcacatttaatattaaataatgtatatttttaaattttttaaattgtggtaaaacacacttaacaaaatttaccatcttaaccatttttaaatgtaccgtgcagtagcagtcattgcattcacattgtgcaagcatcatcaccatccatccacggaactctcttcatcttgcaaaatggaaactccacatccatgagacaataactccccattcttccttctctagcccctggcaaccaccattctactttctgtctctatgaatgtgactactctaggtacttcatataaatggaatcctataaactacaaatcattatatgcaaaacttgaataattctctttaaaccttgcatcaactcaattcaatttttgactggcttatttcacttaacataatattctcaaggttcatccatgttggttctttggcctatattcccaaaagtagaactgctggatcatatggcaattctatttttgtttttttgaggaactgtcctaccgtttcccacagcagctgcatcattttgcattcctattaacaatgcacaagggttccaatttctgtacatcctaaccaacacttatttggttttttttgatagtagtcatcctaacaggtgtgaaatggtatctccatgtggttttgatttgcatttccctagtcattagtgatgctgagtatctttccttgtgcttattagccatttgtatatcttctttggagaaatgtcttttccagtcctttgcccattttttaatcaggctgcttgggtttttgttgttgttgggttgtagaggtttttagatattctgggtattaaccccttatcaaatatatgatttgcaaatattttctcccatccagtggggttactaaataatttatattcttcattttttaagttggttggttctcttaatctatccataacggtttctactttggacagtgtactcacagagaacagagatggtgcctgttgatttgatccatgcaatgcttaacaaacaatgctctatgcaggctggatggttaaagttttttgaagattatacaacaatatagtgtactatttggtatcacttttctttcaatagtggcagacaaatggaagtacaactgttaattaaaagcacataatgttgcctgattatgagtaaaatgtcccagctcactacagcacaattcctacagcattagtggagaattaactagctttattaaagatttggaggactagtcactttttcatcatcctttaattaaaacctccacatcttccacttaaaagcctttgtttcgtacccattattttcattctttattctggccttgaaaaaccaggatgaaaaacagtaaaagcaaaaacgtttctaaatgagcttttcatgctgtaataataaaaaggcatagctttctaaaatactgaaaaaaaataaaattttaatgttctttgaactagaaggccaggaaaagaaacagagaaaagcagtgtttagcagaacattttggagttcaatgttcttttatattctaaaatgaattaatgctactatataatttctctctaccttcccactcacactaactgaaagataccacagttgaggggtaccagttcaaggtcctaaagtggaaagctattgttatactctagcctactttacttttttcttaacttggaatcattatttattttgaagtaaatggcatgatgcagtggtttgaatgtgccccctccaaaattcaggtattgaaacttaatggccaatgtgataggattaagaggtgacatggtcatacgggcttgttcctcatgaatgggattacggcccatatgaaacaggcattacacagcattcggccctcttgcccttctgccgtgtgaagacacagcattcctcccctctggaggatgcagaaacaatgcactctattggaagcagagtgcagccctacagacatcaaacttgccagagccttgttcttgaaattcccaacctccagaactgtgagaaatgaatttatgttcttcataaattacccagtttcaggtattttgttacagcaacactaatgaactaagacacacggcaagacagaacctccctcaacctcagctccctcctcccgaagatccacgcataagggtgcccagcacagaccctcacaaatatcagacacttaataataaattaataatttaaaaaccattagctagaatttggtggatgttctgggccaaacctcatactgtgtgcttcatattcacaatgtcacaacaactacataggcagctgtggtcacttgatgaccactatacaatgttacacttaactgcatatttctccccataacttgcccaacccaagttacagactttctctcccctaaaaatactagaatatgctacttagggaaaggagaacttgattttttaaaaaatatattgattttggagcctacatttctaaatctttgtatacagtttatagagttcattacatagctaatttcagctcagctgagaagaaatctaaaaataatatgctttttggtttcgtcactgaaacattcattctgtcattgaatttagcctgatgcatcttacaagaagaaaaatctgatataatgtgtgtggaaaagaatttgactgatggaaaggaataaaagtgagccagtgcaatgtctataccagaattattatttgtatgattaaaacataaagacacctgaatttatcttttctgcttctgctgtttcagtctcattaagactatgtttctgctttcttctaaatattgttttccatatttcaaacatctaattaagtaaacacaatacaaagtgagatgatatactgtttggaaaaccataaaattatagagtagatagacttccattataatccaattttcattctgtcataattttccaagagagtttcctttggggttaaaattttctaagcttgatttcagttcaaaattgaatgttttcattcacttgtatgtagaaaagactcaattcagtcttttctgttgatcatatgagtgtgtttcctttaaaagtagacaaggcttaattttgttgatgaaacctatgacagacttctagacccaccttactttcaacttcttgggcacttaaaataattacttaagtaatataaagggtacagaagccaacagagaatatgtttctttgccttagtcctccagtcctaccctatgtacaacgtgcccccagcatataccctttgtatacataggactgttgtcttaccacagaaactaagaactagaattgttggatcaaaaggaatgcactttttaaatagtaatatatgctgcccaactatcttccaaaaagccttcactacattattataatctcaccaaaagcacatagatgagaatacctattgcctatatttattaacactgaatgttattgatctattgaataaaaagttatcttaatataaaatttcaaaattatgagtattttattgtccatttaaaaaattgtatctcttatcttgcctttgaatatttatttttcattttgctgcagtagagctgtaagttattctttcatagaaggttttgtacctctaaaagtattttgcctttatgtttgagaatcctaggttcaaaaagttttccacgagaattttaaagtcttgtgcttcactgtattacagaatccagggcggccaaaaagaagtccactaacagaatcctctttctttcttaggtagattttttaatatataggttatttgtctttcatcatgctgggaaagtgattgacccacttaatctgaaggcacaaatctgtcttcgatttagagaaattatcttatttatttgataattgccttgtattttgagaggactgcttcaatttctcaagtaataatattaataatgataacagaagctaatatacgttaaacgtttctgcttgttttaaatattttacatgtattaggtcatttaatcctcatagaaaccgtgttacagtagcccctccatccttagtttcacttttttgcgctttagttacccacagtcaaccacagtctgaaagtattattgcatgctgttctgagtagcatgatgaaatcttgcaccgttccacccaatatgtgaatcctcctttcgtccagaggatccttgctgtaggcactcattcccagttagtcacttagtagccctctcagttgctaaatcaactgtccttgtatctcagtgctactgttaaagtaacccttatttgacttactaatgggcccaaagcacaaggtagtgatgctggcaatttggagatgccaaagagaaactagacagtgcttcctttaagtgaaaaagtgaaagttcttaatatggaaagaaaaatcatatgctgaggttgctaagatctatgctaagaatctgtttgtcaaattataaagaaggaaaaagaaatttgtgctagttttgctgtcacatctcttcaaactgcaaaagttatggcctcagtgtgtgataagtgcttacttaagatacaaaaggcattaaatttgtgtgtggacgacatgtacagaaatgagttccaattgacagcaattgggtttggtactgtccgtggctttaggcatccactgggagtctcagaacacatccccttggttaagggggcactactgtattcccattttacagatgaagacatcgacagaagctaagtaactttcctaaatgatactattagaagcagaagtgccaagtttactcctaggccaactgtctctaggccccaattatataagccaataactaaaaattgtttgcacagctattaaaacaacaaactatgaatgcagctgtcacactaacctgtccaatccaggtagtctgagtttaaatgccaagaatgcctctgactcaagatccttctgaatcagtgactaaagtcagatgactctcctgtgtacatatgctgtttcaatactcatctaatattttatgttgcctgtgagtgaaggttaccttggagagaaggggaagcaactaaacaaagcatccaatgttcatagtatttcaaacaatacctatcaactttcataaatggtcttattcaatggagatagcaagtttgacattgatattgttaagaactaaagtatatgatcagagcagacaatgtatttacaggatttatttcctgatagaaggagtagaatttttccaaaagaatcagagctgtacaaaggaaaggtgcttccatccaattatttcctacttgtcatctctgataggaacccacctgggggtgatctgcagagtctacctgtgttaaatttcttcacatagagctagctcatcatgcaagtggtactaagaaatgaaaattatatggcttagaaaatggtttagcagaatgccaacaagcagaactatctcatgtgcagatattatgcaaccccaggatttgaaaatagttacctttacccactagtcccatgctgtgtgtagaataaaccaggttgagaatgatcaaaagttaacagattatagcaacaatatagttatagcaacaattgtataaaacaaaactgtgtctaaattgaaagtacctctggctacttttaaatcttcaagaacaggaatttgccaaatcattaaaatcaaattagcataattaaggatctaaaattgttagagtattaatgtgattacatttatttaaacccagttaatgaaaaattactgttacacccttttaagaaaaaaattacattaaattatatcattgggtaccatttagattagccagttaatctcaatataaccaaaatctgtatcagtaataggagtgttagtaatttatatataattagaatgaaagctttttggccataaacaatctggggaagtccttataaaataataagtgggaaaacaaattgtcctactctataaaagacattatgcaaaatataatacaaaaaaactaaaataatataatacttttttttacaagaagtaaataatactttttttttacaagaagtaaaaatagtattattagggtaacagtactgtaggaggttttatactttccttaaatttttaatttaaaaagttttaatctacaatgaactcaaacaaatttacaagaaaaaaacaaacaaccccattgaaaagtgggtgaaggatatgaatagacacttctcaaaagaagacatttatgcagccaaaaacacatgaaaaaatgctcatcatcactggccatcagagaaatgcaaatcaaaaccacaatgagacaccatctcacaccagttagaatggtgatcattaaaaagtcaggaaacaacaggtgctggagagcatgtggagaaataggaacacttttacactgttggtgggactgtaaactagttcaaccattgtggaagtcagtgtggcaattcctcagggatctagaactagaaataccatttgacccagccatcccattactgggtatatacccaaaggattataaatcatgctgctataaagacacatgcacacatatgtttattgtggcactattcacaatagcaaagacttggaaccaacccaaatgtccaacaacgatagactggattaagaaaatgtggcacatatacaccatggaatactatgcagccataaaaaatgatgagttcatgtcctttgtagggacatggatgaagctggaaaccatcattctcagcaaactatcgcaaggacaaaaaacccaacaccgcatgttctcactcataggtgggaattgaacaatgagaacacacagacacaagaaggggaacatcacacactggggcctgttgtggggtgaggggaggggggagggatagcattaggagatatacctaatgctaaatgacgagttaatgggtgcagcacaccaacattgcacatgtatacatatgtagcaaacctgcacgttgtgcacatgtaccctaaaacttaaagtataataaaataaaatttaaaaaaagaaagttaaaaaagttttaatttttaacatgttaaagactgaataaatagctctgttaaaataaagaaaaagaagaaaataaaatggtattattttctatccagtttaacattttggtatatacttttccagtttttctctttattattcatatttttaatttaaaatctgtaactcttaaactataatgttaataacaattctgttcctttgtcacttaacaatgcactgtggactttttttacattttaaaatgttcttctatgacagtggttctcaaagtatggtccacagaaccctagatgtccctgatagatccttttttatggtctgggaggctaagtctattttcataatactaaaatgttttttgccttttttactgtgttgacatttgcaccgatggggcaaaagcaatggttggtaaaactgctataagattcaaaagaaacaaggcagattttgattgttgatgtagtatcaaagaacaatatccaaagttatctgaagaaattattaaaacactcctctatttacaactacttatatttctgaggctggattttctccattttcctcactgaagcatcgtaacaggttgaatagtaatgcagctacgaggatccaaatgtcttccatcaagccagagtaagacactaaaaagatctgcaaaaatgtgaaaggatactaaccttcttgttatatgttttgttttcaaaaatatatttttaaagagtatcttatgttaaacaatgtgttttatttttaaatgtgtaaatatatatacaaatatattaaatatatatattaaaattttctattttcatttctaatacagtattgatggatataaccacatgaacaaaagctttttgaagccccaaataatttttacgagtattaagaagtactgagaaaaagtctgagacgtgcagtttataacagcacttttacagaaagcacagtgatctttttcatggacatgccttaatttatttagccctggaatatacatacatttcttgaaaacgaggactactacgtaaatcctaaagggcctggtgagaaatgtgcacccggtgagtaatgacctgattttggagccacagttcatggtcatcatatcttcccccaggaggagggctgattgaagaagaggatctaggactagataaagccccctcagctatgggtgcctacattcattctcctgctgagtttttttctcccttctcaatattttgtgtcatttttctaggatttccacagaaaaacactgaaagaagttggaatacaatttatttcaataaatcgagtattttcctttagctctcatgaagtctctgatatattttttccatttctgattggcattctatcaggtagagtcctgggtacatgagttttgtcacccaactaccttcctgtcctcactacctctgagtccatcactggtgatgcacacggcccttaatgacatggcccagtttatacgttttctaactctagacttcttaaatcagattacttacactaattaatttttaaaattagtttagaaattaaaaaacatctgcccagagtttgaaagcatacaaattctataaaatgccattctctcatgccttatattacttaacaaattaaatatatacagagttagcctcattaaactcgaatggtctctgggagacctacctaagtaactctgaagcagactatattccctaaaatgtattctgaagtactgaggaattttcattgttatggaggcgtttgagcacccattttttagtaggccaggatatccttgccagaatgctaaagagagtagaactaaatgacagtacagccatgtaaggttctcaaactgtgaacattgatgctgtttattccgtaatttagtgtaaaatgagtgtgggaatctttattagtgattttcaagtgcaaaagttgaatttgtcctccaaaaatttgcactggcttttactgttgtaaaccaagccacagcctccttaatccaacataccctttccgttgtatgagtccaaccacaaacacactttagatcctcaagaaataatttctcaagaaaacatagtggagtaagtagcaacccacttgggtccttaaccaggctcctctgggcctaggataactgcacctgggctacaggcttgtgttctgaagaacaggctcagtgttgctggcaactgctgagttaaaatttccaaccaccacactcctcgtccacagccctgatgtctacccctttcctctcccagaatagttcagtgatttccacaccaggtacagagtctgatcagtttccagggataatattttaccttctctcactcctatgaaaaaaggaaaaaaaacaactgttcgctaccccatcccttaactcctagagggtaaagacaataatgctatcacagactgaagacggtaggtgtacctaggctaggtcttctagggattgtggaaaatgatgcttttagtctctttgcaaattacaatattccaagatgaccacagtaggaatgggtgctcctaaagcgcagatgcctaaggtggtctcttcagtccagtatttgtcaactggcaacaattttgctctccaggagacatgtggcaatttctggagacatttttggctatcacaatggggctggggggtgttgccactagcaactagtaagcagaagttaggggtgctgctaaatacccacaatgctcaggacagaccccaaaacaaggtattatttagcccaaaatgacaacaggttaagaaatcctgtcccagtctgatgtcaaatgcatgcttctggatccatggatttaaatgaaaatattgcttacattacttgatagttcattcaattatttgcattcatgtacagttttcattatcagagatctgagcctggctctaacatctactagttgtgtgacctttagcaaggagcttaaacactccacacctgatctatgaatagggaaaataactcctccacacaattgtcatagagattacactacagagtacatataaagtgcttagtgagtagaggttagctgctgctgctatcattatcatcatcattatcatgaaagacttaataactactaggtgcctgacactatgtttagaaatacaaacacattttcttatattctgaaaatacaagaaagaataaagacttagaacctatcactaaagaactcacagaaacacctagctgagcaaaaacatatgagaagacctatctgactatgtagcaagatccatcttttcatttgcctctagcatcccaggaagcaatgcttggccctcttgggtcttcttataccctgccttccagtacctctccccccatcgttaactcaatacactgtagtacttcaggcactttgtagcaaagagttactctcacaaaaagagaaaatagcaagctagtgaatgacttctcgtggacctcagaaaggacctcagaaatcttcaccaagttcacgattcaggtgttaaaagtttcagcccatgagcagcacacggtcagcacatatcatcaggctacttgctccccatggtatttttgggatttgtcaggtagaaactcttaatttagaagaactaagcatctttcaaggaaaaaaaaatccctgctaaaatattattcataatttattttccttattgtatcaagtgacttttacttatccttcttatatcacctgatacagttccactccttgttctgtgcaggaaagttttaatttgcacatacacattataatttgtaactgtaagaatgactgcagcgtcacattcactagaataatggcctgtagcataaataaataggggtcataagggaagtatatgccttaggagaatatcctttaagctgtgcagttcagaaatgaggttctgtcttgcaccgttctacacattcagcggcaggaaaaattacttggaaggtaaaagccctattaaatgccatctttttttgttgatttggattaaacccaaatgattatttttaagttaatgtaaaaacactgtggaaaaatgaatcatgttttaattgctataatgctgcatcatttacttaaactagaaatgattggtgaatctggtttggtggtatgtcccaaacaagccaattagtacagagattaacctctataatcactctctagccgattgctttccataattttttcataaaatttgtttgcattcatgtttttgaatgaagcaggtaactagccttgcattttagaattttagtcctgtttcatagaaaagtttacaatatttgctttggagaaatttattgctgatttacttgcatgtaatacaaaaatcccatactttgctgagaggcttcaaaccataaaaggacacaagataattactttttggactatttaggaagcagggagtttcacttaaaaaaaaaaactccatggtttctcaactctataaatgcttctttaagaaaaatatacattccaaaccagaatgataaaggaggcacagaagtgtctgcatgacagccttcttccttcaaaatacatcaccaccttccataacatctgctctatcattttggtcactcacaaccttatatgctcagaaagaaatatttgtaagatctaatgtaaaaagtgcccagctgttcacccttatgctggggcagtcctagtggtatatttgtcctgtatctaaatggatgctctatttgtatctgtctctatcaaatgtatcagatacatatggaggatataaggtggattatctttagaccaatttacataaaaaaccaaggagcttcctcagatggaatggaagaaaatggagtgccaaggaaacaatctgcttctaggacaagacacaatgatgtcagaaaaatgaagtaatggtgaaaaaaccacacataggtaaagtctttgaatactgagagactggttcagtgggcactcatgaatcctgggcagagaaactgcaataaatgcagagctaataattcagaatggtttatctgaaatctcagtggggcactagaaaggcatgacgttggcactcatccactgatgggagataatactcattactgagctacacataactgccactagatatggggctctgtcaccatggacgggttatcagttgaagtcacaactcccagctaccaatgacaagtgaaggcacagcaactggaaaccttcccagggtagaaggggaataacttgctggtgattagtggtaaataagaggcctcattcacagaatgtatgtgagacactcactggagtctccagagctatttgggaggaatctgagtgagcaagctgaagccaaagaaatgctgttttgtaactgttactgtgatttgtttttatccccaggatgaagtggcttgggaaatacaggaaacttgcagaagtaatgatgactgcgataatagctactttattttctatgtagttctctgcattgtttctgtgaagtaagacaactatatcaaaatatttcactgaaaattaataagctctcaagtgaaattataaaagatcttgtgatgtgagacacactatccaaaagtactgaaccaggtggaggaaactgctgaaaatcaatgtctcctctattttctcacgatataccacagacagagaacattacctagcttattactgattggaactaaggagtagaaaaagcactatctgatttccctggagtctcagggttgtatggggcaccccctgcatctgcccagccttctacccgggaggaacactcctcaaacatacctggaggcagaagacatcctacagggtacttagcctctgtcctgcaaccacacaatagtcctgcctctcagtgaactggcctttcctgggctaaggacccagcctctccagatctatgactgtcacagtgctcttagcgctagctgatctccctcagcctgtaccagggttcaacccatctgatcaggctgcctctgagcctagccctcctgccaggtgtgtgcacgctgatatagccactctctcaggtaatgcctaacttaacatcatgatatatttaatcctcccataaaatatttccttcatttctcttttatttcatcattttttaaaaaaccatagagaagatgagaaactaaatgtggaatggtatgtcacaggtctgaataaggctagaatgaccctaacgtgacacattttagattgtagacttggggtacacatatataaattattgtagactttggggtgggttaaataacattcagattaggaaaacttcctttcattgcttttatactaaaaattactgtatgaattaatgttgaattttaataaatactttatcatcatataatgaggtaatcatgtgctttttcttctttataaaattagtatgaaaaattacattgagtcaatcttgtgcccctggtttaattccaatttgctcatgtattaactatttaatatattacttgctaatgttttcatcaggattttgtacttatttgacataaagttgttaatatcctcttattatatttctaatgtctgcaaggaactataatgatgtcctcctcttttttcattcttaccacctggctatagttttagtctcttctttttccttgtttgaggttgaaaatgttaatagacttctcaagaaaacatttgcctttcctccccgcccctgcccttttggagacggggtctcactctcattcacactggagtgcagtggtgtgatcacagctcactgcagcctcaaactcctgggctcaagcaatcctctcacatcagactctcaagcagctgggactataggtgtatgtcatcatgcccagctaattttttcatttttcaaggatggtggtctcgctatgatgcccagggtggtcttgaactcctggcctcaagtgatcttcctgcctcggcctccatagtcactgggattacaggcatgaaccacaacacctggctcttggctttgatgatgatttctgctgtacatttatttcttgtttttgtttctaaattttcattattttctgctctcctcgttactttccttcttcctactttgctttagtttattttccctttttctaagtttttgagatgaatgttgtttaatttttagtcttcctttgaacatatgcacttaaggctatacattttcctcaaagatggcattagttgcattttatatattttgatatgtcgacatttcaatatcattcaggtcaaaatattttctaatttccactgtgatttctcctttaacccagtatttatacagaactatgtttcctaatttttaaacatagaaatattcaagattttgctgttgttttcaggattattgttactgtcttgtagcttaaataaattatgatcaacttttaattatttataagttttcaatcctttgaaataattttagatttgctttttggctcacaagtttttttatatgttctatgtatactagaaaaaaatgattttctgcacttgtgtattcaatatctttatgtgcccataaagtttgtcatattatttaaactttctaaatgcttactaatgttttgtgtgtactctcaattcctgaaagagatatattgcaatgtcttactctctgaattttcctgtttctcctcttagttctgtcaatctttgatctaaatagtttatattattaactaaaactttgagattattttaacttccaggtgtattaaagctttcacacttgtaaaatatcctctttgtatctagtaatttttttttatttaaggtcttattagtgttagtgtagctaccatcaccctttgctaggtggagagcattagtatttacaacttatccattcttgtatattttgactttcaacctttttacacactcatattttagatatatctcttgaatgtagcattaagttggaccttatccagtcttacagtcttgtcctttaattgaaacattacatctattgacaatgaatacaattacaaacatattcgagtttaagtctaccatcttagcatctactcagctattctgaaccaagtatcagatctggttcagaaaaacataatttgtttttttccctaacactattcagcatcaacttcaaacatgtattatgaggattaaacacatttatatgagatttgtacaagtgctttgaaaatcacaatgtcctaaagccaacttcgtgttactaaatatgcttctattaaagattttccaaagatctctgatgcaggctctcgaatgcagtttcagacaagttgaaaaaaagaaaaaaaactaaaaacaagtattggcagcatgataagactcccaagatgacccttttaaaagaaagagggctcatgacctttggcatagaaaagtatgttggaaggctctcaggaggcaagggcttggtgagtttaaggaatggtaaagatgccagtgtggtgagaagtggtgagactggtgagatggctatgagctaggtcctgcagagctttgtggggttgttgactttgttagaaatgcacttcccagtatgtagtgcaatatcatggtcaggtttacattttcaattgtttattcagtcagctgtggccaaaactaattagaggaggcaagaatgtaggggagtggacaaggtaaccattcagtcttctaaaggaccccccctcaaaaaaggtggtgcctttaacttgagaaacagaagcagatagctttgagatgcctctgagggtggaatcaacagcacataagaatctcatgtggggaataagagacagggtgatgtcaaggatgatgttggtaattctaaatcaatcaacaggctgatgagaggtgtttgcagtaaatttatatctacagtaaataaagtctaatacttatagaccatttatcaaatctactgcatatcactgttgtcttatttctgttctttaatatttacaaatatcacaagcttatgaaaacctctcatagttccacactctccaaccttacacttcttccctctgtttttttttttttttttttttttttgctaaaaatgatttcagggaccagatgctgtggctcacacctgtaatcctagcattttgggaggccagggcagggggattggttgaggtcaggagtttgaggccagcctgggcaagacagtgagacctcatctctacaaaaacaatttaaaaactagccaggcatggtgacatgcacctgtagtcccagctactcagaagactaaggtgggaagatcacttagggccagcaattcgaggctgcagtgagctatgactgcaccactgtactccagcctgggcaaaagtgcgagagctgtttctaaaaaataagaaacaaaaacgatttccaataaaactgaacagtgcaccacatactatattattcttttcacaaaaggcacaatgaacctcagaggttcagaccaggttgacactgtctctaaaaaaattaaaacatgaaagtttcatcgtattgcattttcacaagaaaataaattgaaataggcagtccttgcaaaacacaatttgtttcttccctaacacaatactcgagtaccgctgctttcaaaagaagcatttctattatacaaccatcatgtttgtaattgaaataataatgtcaaatcattattgggcctgcattccatttaggttttcaagttctgagctctctccaaaataaaaagataaagtttctaatggaatcataagactgttgagtaactgaacatttttcttctttttctagttataaaagttatgtcaaaagaatccctccgaaaaaaagagaacggtttctgaacactagaaaagcttcactcactgtcgggggttccagaaaatcccctcagcaatcaatctgcagaacgtcaataacaaatgatacacttccctcaactgcaaaaacaaacagtagagatgccagaggtccctggaatttaaagcataagtgtcttcttcttttttttctttttttccgagatgaaatcttgctctgtcgttctggctggagtgcagtggcgtgatctcggctcactgcaacctctgtctctcaggttcaagctattctcaggcctcagcctcccaagaagctggggctacaggcacgtgccaccacagccccggctaattttttgtagagacagggtttcaccgtgttagccaggatgttctccatctcctgaccttgtgatccacccacctcagactcccaaagtgctgggattataggcttaagccactgtgcccggcctttttttttttttttttttctaatgagacagtctcactctgtcgcccaggctggagtgcagtgccacgatcttggctcactgcaacctctgcctcccaggctcaagcaattctcaggcctcagcctccggagtagctgggattacaggcacctgccaccacacctgcctaattttttgtattttagtagagatggggtttcaccgtgttgcccagggtagtctcaaactattgagctcaggcaatctgcctgcctcagcctcccaaagtgatgggattacaggcgtgagccacggtgccagccataagtgtcatcattcattcagactgctgtaatacaatactgtacactgggtggcttataaacaacagaaatcaatttctcacagttccagaggctgggaagtccaagattcaattcctagtgagggctcgcttcctggttcatagacggctgtctccttgctgagttctcacatggtggaagggagctctctagggcctcttttataaaggtacttgtctccttgatgagggctccggctacgtgacccaatcacctcccaaaggccctaccacctaataccatcatcttaggggtgaagatatcaacttatgaatttgcaggggacaaactttcagtctgtaagaacgagtatgcatgagggctgagaggaggggagtatgtatgttacacatggggacatggaatggggaagggtgtgaaggaaggtgaaggttgttctttcttctactgtttgttatagtgatgcttctcctggggttgagtggtaaaaagaggaaggaataaagagaggaggggaaaaattgggggatcagatagagccctgttttccaaacatcatgttttgagctattagtgaatggatcagaaacataaattgttttggtaagctagaacagaagctatcggaatatactgtatgtaatagaggtaacatttcatgaaatattttgtttcacatatagatgagtgttattgtgtgggtatatgtaaatttttgtgtgttgatttatcatataaaatgcttttcatattacggtttgtagtaaaaaatgagtcactgaactagagtatttaaggttccctgcccctgcttcccacagtacaggactgttatgttaaagacctgatgttcattttttacttgtgttttatgcctttagaacaaaatagtaagttttttctttatttctgttacccataatgatgcaaagaaaaaaaaacccttgcttctgacttttcagaaatcctgtcttattgttctcatttcatgccatgcattgatttcctgttaaatagttttcaaatctcaagccatactagatcactgagcttttaaagattatgaaaatcatctttctcttttatctcttttgtagatggtttttaaaactggcatgtgatgtggctttatttaaaaatacattcccatctacattattgtcttttttctttttcttttttttttttttttttttggatatgtagtctcactctgtctcccaggctggagtgcagcagcacgatcttggctcatggcaacctccgcctccagggttcaagcaattctcctgcctcagcctcctaagtagctgggattacaggcatgagtcaccacacctggctaatgttggccaggctagtctcaaactgacctcaagtgatctgcctgcattggcctcccaaagtgttgggattacaggcatgagccatcgcgcccagcctaagctactgtctaccagaaaaaaaagtacacagtgaatcagaatcactttcttgctgtataaacttggaaagttattcattctctctgagtgccagtttcttgggctgtaaattaaagctaatattatctccttatctagattgttgtaaggagtggagatgattcatgttaagtgcctgaccaaagttaggcactcactaaatgatattttgaattataataaaatgagaacccaagcacacaactatttcttagtaacctcatatataagcaggcctcttgttgtctactgccttgaagagcccatttaatctcctctcaccccaccaagggccaaaacatggcccgacacacagttgatgcttgataaaagttgacagaattgaattaaggggcggtgctgttgtgttttcctgatagagtacacttattgccaaaataattatagaaatcaagttttatgcccaaattagctcattaattttaggctgggagcataatcacaagagaaccgcctatctcccaaatgatccaactacaaagagaacaaaagtcaagcttcatccagtaagcgtcaccttacctggcagaggtttagcgcatctctctgctctgggaagaagccaataattgaaagcatctgctggtcaagacaagcagaacatttaggctgaagagggagtgatatttttgcttatctttaaaaggaaagaacgagttgataagagagaacagtggttttgctctgaaaccagcctgacaaactatattgaacacagaggtccgtacttattttctttcaaaaacttcctttcttctgctcccatttatacataaacaacacatatccctaaactccatccattgttttatcctcgaaattcttagccccaattggcctcactggcagcacatgctctcctgaccacacagctgcgtccaagggaggtaggggcacaaccttcaatggtatctctgctatctcaaaggaatttcagatatcattaaaacaatgtgtctgcgcctctaaataaaacaggccagtcatgtttcagtaaactgacagtcttctctaaaggaccccgaggtgtacgaagttactgagttttcccatcctaccatcttcaaagtgataaagaaaatgcaattgttatgcaactagcctttccagctgaccctagggtggcatttgctgtctactcttaaactacctcacaaaaatcatctttttgtaaagattctttgtttcctctctcatacatgcataagagaccccggggtggaggcagtgttaggatggggagggatggaccgggctcctgggaatggcctccatcagaggcctggtctgtgggccccagtcaccgtgaggggtcggtggggagtgtggagcttcccaggatcctgcctctctccctgttttctgccaagcagcaggaacacacaattcattaaagcaaagccaaaggtcatggactgagaaatagcaagaaacttccagggacttgttgattttggaaacttaatgtccacattgtgtaacagtgtgcatgttccccagggggaagtagattgctatttatgtcagaaagatgtttcagaagaagatgtctcctccaagcaaatagtatatgtctagttgttggcatctactatcctctctcctcttttattcaataaagtgatccaccttatctgagctacacagacctctgataggtgcaggggaggatgttggagggggtgccatttcgataggttggcattttctctgtaatggcaggaggcaatagaactatttgtttatgtttcaaacataaaataatgaatcagcactcgaacaagtcttgaaagataaaacgttcagtgttaattgaatctctatattgtgccagataatatttaagtgctaggaatacggtgctgaataaggtccctgccctcatagacaggtgttctagtaggaagagacaaaacagacaagctaaaacaaattttcaaagagtgataagtgctatgaagatggttaaacatggatagagactgaatggctgtggagggggcagatttcagcagatttagggaaggcctctcagatgagttggcattaaaccaaaaagtaaaggaagagaaagagctgccaagccctatcaagagcatcccaggcagcaggagcaaatgccatgcagtgatgtggaggacagtttggctgtgtgcctggagcctggtcaactacaggcacgtgcatgagaagaggtcacagggcagagcagtagggccagaccccacaggagcctggggatggtgggaggagttcctatgtcactctaactgtaaagggaaacactgagactgcaatcaaataaatctcctttgccgcctcactgtcggagccctgcttaccacatctgaaggatccatatcttccagagctctgcagattttgacagcagagatatgctcctcacacccccagcttctgctttttcattatttgtgactatcaaaacagaattttgatgacaaattatttataaataaaccaatcattaaaatatgtaagatctctcacctatcaccatacatctcacttaaccattctcatgcatcccaatgacttgaacaaaaagaaacagaaccagaaaatagtcaaaacagtacaatttaatctaaattatccttctcacaacatcactgagattgacttgccaagtcctgttcattgtcagattggattctctggaagtgagtgccttctgcaaagtatctcagacatggataacgcaggcaggactaaactgcttttcttcccatttgagttgccaatacctccctctgggccaatcgaggattattgtttcaacaatacatgcaagctaattgtttgttaagccggcccagccaaccataaaatcacaggagagtcaggcctggcccatcctcttgcctctgaactggatcacagttaatatctctgagagttccaccccaggttcacagaccaactggggaagatggctcttgagcaaactctgaattttgtttccatgaagaaaggtttctccaacataatcaactacaatcacaatttttgaaacattcacattcttaagtctgtatctgctttggtttccttaaataaaaacaagccagagataaaagtatggaaataaaatagtttcaaacagagagccctgtggaagaatgcactaacttaatatgtacttccagataaatgacaagatacatgtataagagaagcaaacttctacaaacattcattaacaatgtgtgaagataaaagttatctttgatagaaaaaggtaactgataaagacatcaaagagaaagatctgaaagtgaactttctacatactcaccagataaaacatataaaggggcaattttggtttgttttattgttgtaggtctaaaggaatactttcattttcagtagtttgtcagcaaacagcacaggaaactttactatttgaaatgagtagtctgagttaacaatagtgaccagatattataaaaccgtgttctgcctaaatatatccacaaatcttcagatggcctacaaacccaatattgaggctaaaaaagacatgacctcttgagaggctcttctagaaagtgggactctctggtactagggatatagcactgtgaaccccaaaagggagacagctctgacccccagtgcaatcaggaaagacagatgcaagccctaacttagtttacaggtttgatgtccccactgctgtgggcattcctgtccagaaacccaagtcctccccaagagagtggctagagagtatatgcaaacacaataaacctttcacagaaaaacaatgactttctatgactagaatttggccaaaggctcttcttttgagtgttagtgatataaaattctgctctaaaataatagttttagaactaagcttaaattcctgattatttgaacacattagaaaaagaaaaggagtttctatttcagaaggcatagttatttggaaactgccacagtttctttttaagtcaaaaataacaaaatttcataaaagcaaaacaactaacatccctctccctgaccctccaaagaaacctttcttagaagtattctagttccacacaatagaaaccaaattcaatgtggctgaagtaaaaacagggatgtactggcacacttaatggaaagttcaagggataaagcattcaggtatgggtagaactaggtgcttagactatgaggacctttctccatctcttaattctgctgccctctgcattggcttcatttttaagtaggttatctttaactggaggcaaaatgactatcaggacttccagatttacgttacatcatgcagcaacctcagttttataaaacacaacgaaacttcttctgggagttcaacaaatgtctcaggattgggtctccttaatctggctgggtccacatgccatccctgtggtctgctattcctgtggtctgaatggccagccctggtggcctattcctacagatgtaccacttggattccataagctaagacgggacgacccaaggtgcggctggcaggaaaggaatacaggctgacagatatcactaatggaatgtccatgtctctccctccacttacctgtttcctcctctttcaatcaaaagcctatcaaaactgggttcagatattaccttctgcaaaagcgcttcccaaattccatggaattgtttacttgaaaatggttaatttaaaaaaaacaaccaaaaaaaaccctcttcctagagtctctccttttggtgtaaagccctttctgatcctcccacaaactctgtttccctctaacactgaatttattatactttttgaaactttctgtccatatgtttgtcttaagcataatttcccaaaagacattttatccttgccatgtaggaaagtctttggcacaaaatagtaaaaatttatggaattagactgttgttgttgacagagacagttcttctctctcagagtgtatcaatcagtccactgtaatatcagtcacattgaatttattctgaaatatcaatgaaacagtctctagcaaaactcccacctttaatgtctctatcttgtaaacagaaatctgaaaactcagcaactgagaaatgcatttttacctagtcaatagaattcaaactcagacaagaatagcaaaataacaactgctaaaagtactttaaaataactcattaggaagcacaagtccctctattcaacaaaaaaacgagtaaaataactaattcatctctaacttcatttatattttcagttcatcttctgacttcacaagaatggaagttttgtattctactatgatcaatacctcatgtaaaaatagttacggcacaaaaatgcatgacttttcagatgatgttatttttaacattgctgaaatttaccattacttaaaatatactaactgcatcagtagattctagaggatactcctctgtatcttgcaaatgtatatatgctctgagcctaatgctcttatggctcctcctcagtgtccaatgaaaatgaggtagatcctaaaagaacccagttccaacatgtctggtttcagaattatccacttcaagttgaactcctgtgatcaaggccttaaaagctgtactgaattccacattcaggtcccactggttcaggagacactagtatcaaggctctaagacagcggctgccaatctttttggcaccagggaccagttttgtggatgacaatttttccacagatggcagcagggggatggttttgggatgaaactgttctacctcagatcataaggcatcagaatctcataaggagtgtgcaacctagatccctcacaagcacacttcacaatagggctctcgcttctatgagaatctaatgccttcggtgatctgataggaggtggagctcaggtgataatgctcactcgcctgcctctcacctcctgctgtgcagccttgttcctaacaggccacaaactggtattggtttatgacctgggtgttggggacccctgctctagggtgcaggaaaaggtgaactaatattaataaagggaaggtaaactaatatgagctgtgtgaggcatggtgctgggtatcctacacacagttggagccccacaatatgctattgctcattcaacacggtgtcttcctccagtgtccatcagcagttgggtgtcatactggagggacaatgggctgtgaggacttcccaagagatggtataagtagggagagaaccacatttgctgttctttatgagaaattaggcacatgtcaagaatagttttgcctacacatctttctcatcttctacttgactgcagataaggtatatccaatccttgcttgagataagatgtgactgcactgctcagtgcctcagctatcacaaaaactctgagagggttaaattattactggcccaatttataggtgagaaaacagtgcctcaaaggggttaagtaattttcccatgataatgtgctcaaaaactacaaaaactctcctccttacaaagtttctaagacttatcttcagggtatgtggacatagcaaagaagttgtactttgtattgagttaaagaatcaatcatctctagccaatgagccttttgtgacattacgatagcaatttagatcagcagtttacgttattaaggaaaggagttcgtattacaaaacatgctgcttcttaactgtttaagagtttagaccataagtaacccatatttagagagcaaaaccctggtgtcattgtgctttttcccagtaacatctttcaaatattatcatatccaagagacaagtattttttttaagtaattttgcataactcttaaaaagatacacaatcctaaacttaacttcactgggatttttaaaataaaataaaaattacagatgctgtttcaagatatgctttctcaaatacttttccaagtatagcatacctaacacagaacatagtttacatttgtccatggtgaggcttcaaaatggagcaattagatcaagttcaggggataatttattttctaaaaattatgtggcctttctttttaattctatttatgtgatgtatcacatctattgacttgtatatgttaaatgatccctgcatccctgggatgaaaccaatttgatcacgatgtattatctttttgaggtgctgttgactcaaaagttgttggaagaaaaaataataataaagagagaaaaaaatgaaaattatgcagaatatttctgcttcaggaaactactgacccattttttatcttttaagataaaaacatttttatacaccaaaaacttttatcttaaaaggtacattataatttagtcaaatctgatagtcatgggcttcataagctgcaacaactgattattacatttgataatacgatgactgaaaagcaaaagaacatttggtatcttaatatcaatttaaatttcacccgatcatgatggcaaaattgcccacaaagctgttctagctgttccttacacctttcctcttctacagcacactcagccagtgcaggagaggatgggcccagcacaattgtgtccacacaccacctcagacaagatgaggttattttgacttaaagggtatgtggtaagcttaatgaaatgatttaaataatctttacgcaggccttaatttttttccatttgcttctttagtttagaaaacactggttttatgaggagctgggtttcgttctcagcttctctgtattttaatgtcctgctggcctgacctggtctctacctgataccctgatgtctgagtcatctccaacctctccaggaagaagcagggacctttcgccctgtcactctgagaggtttctgatctcttaccaaccctctttgagagccctgacttaagaaaaaaaatgcttgaaaataaaacaccgaagtattcattgacagtttcaacttcattgtgggagacattctctgatgtcatgaaaggagcatgccagggaggccacccatcaattgatttttgaaattcctagaagccatagaaaagggctcacctctgctctaggagataaacagtacttcataagatatttattaacctagaggctcttaactaaaaaaaaaaaaaaaaagaaaacaatgcagccttttagtatattcctagaaccctcctcattcccctttcattccttagcttattccctcccttcttctttctcatttacacagaatcttagggtcagaagaaaccttgctggttaaataatttagctcttctggctatacattctcctccctttttatttctctgcatctccatgtcccagcttgcttctcctctcctctctgcaactgttcttccccctctcatttgttctgaaattgctgctgcctacatggtaggcactcctgggtatacacagtaggaccaaaataagcctgacatgaatggttttgcctgggtcattaactgaggtccaggactgactacccaaaaagaactacctaaccttgtagtcctctgcctgtcttaatacatgaaggtaagactaggcaatcagttatttgttgagctaatgaatgaacaaatgattgcttatccaagcaaatagcatatcattttctgttaaagtgaaaatacagccctaggagaattagggaggagcttcactggtcacagatatcttattaccaattaatttaaggatattgctccttcctaatagaagtagtcatgataaaaaatgggagtttgtaataatattgaagaggaagaggaggtaattttggaacctgggatattctgtatggggaaatatggggagtggagatgggggttgggaaatctgagcagtcagaggcaacctagagacaccaccggtacctaaagacaggtgttaggaggcaccagaagttgggaatggcacacaaaaacgaaatacagcagcaaaattcaacatgaatactattatttaatgtaggtttaggtagctattgtcataacaccaattcatatgtgctgaattgggaaatcttgcattgagcagtcaataaataataactaaagttaatagtgaatgtaggaccatcaccattttgctactttacttctcaaaacaaaacaaacgagaaaaaaaatgctatcccataagacagactgggcttgacacttggttgctctgacaacgaaggcccaaagaaaaagttcctgttttactggtgtcaaagtactcaccgcttctttaaaactggctcacttaaatatatctgccttatccctttttgatgtcatttgtacgattcacttttgctttggtttctggttttgcaaattgttagttcctgcagataatgacaagtagagggattaaaggaagtgcaggataatgaacaaacaaaaagcatgatataaatcaggcacacagtgatgtttacttaaggctgatatgttggagaactgactgttgttgttctccattctagtcctagagtattgtgagaataaagtatctttctttctttctttctctttaaagagggagtttcacttttgttgcccaggctggagtgcagctgcgcgatctccgcttactgcagcctctgcctcccaggttcaagcgattctcctgcttcagcctcccgagcagctggggttacaggtgtgttgtcaccacgcccagctaatttttgtatttttagtagagacgggattttgccatgttagtcaggctggtctcgaacacctgagttcaagtgatccacacaccttggtctcccaaagtgctgggattacaggcatgagccactgcgcctggctgagaaatcacaaagtatctttctaagtgcactaatgctacttggggaaaacataaataattacaggtggatcctagataaggagacattccttgttacttccaaaaaaattccataatctttggagattccaaagagattttccatccctcccgaatcatatggaatgcgaaaggcaggtatacatgagaatccatgtacacattgaatcagaaggaaagactatggcaaaaatagggagccacattaggcacttaacagcagtctgggctaaaatcctatttctgcctacagttaccttgaaaggaatcctttgctgccctttatgtaaatgcaagtgatttaaaaacatagttagatctgtatagtgctatacaatttacaaagtacttgggcattcattatctcctttgatttttgtaattgttttgtatctccagttccaaaatgagaaaagtggtacccagaagacttgtgtagccagtacaaaaacatgcagtaactggtttcaaagctaggactccaatcaggttttgtttttatttttgagacagggtctcactctgtcacccaggctagagtgcagtggcaccatcttggttcactgcagccttgacctcctgggcacaagcgatcctcccacctctgccttctgagtagctgggaccacaggtgcacaccaccacactcagctaatttttgtattgtttgtagagacggagtttcaccatgttgctcaggagtctggtctcaaactcctgggctcaagcaatccatctgcttcagcctctcaaagtgctgggattaaaagtgtgagccacggtgcctggccctaaccaggttttttgacccctagcccaatattctcttaaactcttaagcaatgttttcttattttcaaaactgaactaattatatcttggatgagaatactttaaagacattctaaaaatacaaagtagctttaaaaataacaaagtgattcttgcattcttatcctgtctatctaagagctcaagtgtcaaatgatatcttcctttctattggtatcccaaaatagtaaattataaaaaaaattgggaacaacttgcaaacccgctaatatcccaaagctttcatgagtaaaaagatgttaggattaaggagaagctacagaggaaaagtgctatcagaaaacatcaccttagctgtgtcttaacaatcacacaaagacaactagcatcagccgtatatgtgtcctcaaccatctgtgttctcaacccttgcttttttgccttgtagcaaactttgctaatttcacagtactgtacgatacttcttggtattatgtgaagtactctatttagacatgttgacttcactaattagtctataaatacttgacttttagccactgctttggtaagtgagataattgctgaggaaaggccaaagcatttacggtcaatcagatgaggaaaaggggaatatggtctttgagctgagtaaaatgtaaaacattatgtggcaaggcagaagctattagcaggatcaatatctctcctagtaccttaataaatcatcacatcaaagccccgacagaggatggagaaaacctcagtctacctacatggaagcttccaaattggaaaataaaattccatttaaattacaaagacccaattcatgtacaatggaaatggcaagctacaaaactagtctccaaatcctggatgtgctaagagtttagaatcattagtgaagggagaaaagcagaaagacaaagaacactgctactctctgggttgcacattcataattcgcaagttgtaaatatgtatgaatctgcccactgcagctagggatgacatactgctttttagagatagcacagagcagagaaatcaaagtagaggaaggtttggccattataacttacctcctcccacatttaacagttctcaatcttctcaaatctccccttacttaaattgctgtcttttggggatggcttcctaaaatgaaaagaacttcgataccaatgaatgttcaatgtatagcaaaaagcatcccatggtgagctctcactgtaacatgggacgtaaataattgtattttttctaaatctttaatcgctcccattctctttgatgcttccaggaaaacaagcaagcaactaaaagaagttactaggctaacttgcccagtttttttttttttaactctagaactaattatttctcttttctaatatgtagtaaaagacaaaagaaacattttgcagagattcatattatagaacattaggctttcccttaaggatacgtatttcctcacttacagagatgatagtgaatactgacactattttgactccaccacagcttttgctttgcagtcatactgtttaattaaaaataggtttttttcttataagctcaaattactctactgtagatctctcaaacttcgtagtaagttgaagctgagaactaagaggtcacatcaggaaatttatttagataggtcataactggcaaatcagcaacaaaagaaagcagggcttctcaacatcttgaaacattcattcatgattaattatttctttcattccacaattatctattagacacttgagtatcatgcttgggcttgatgataattatatcaaagaaagttcccagaaggttctattctcaaaaaaaaaaaaaaagtctgaccatctaagtgggtacataagtcacccaatacttaaaatgttagctaacattagaagatgtaaattatataaaagctgattgtcacaagtgccatatatggctacgtgccaaagaagggctacagtaaacttttataaagaaacctctattggcagggattaccagggaagggactaggggagagggtaaaagacctgagctacatagaatttgaataagtgaaaaagaaaaggacacatgcttcaatcagtaggaaaagcctgggcaagccagtgcaggcacacagtgcagtgcgaagcaggagagagttcacagtgcagatcagtggtaggtcaggacattagagtcccaccccaacacgcaggaaagacagtggctggactgcatatcttaaggtaggaaagtttttacttcagatgggagaaaaatagagagtcaggagaattctgataccatgtccaagtccaagaccatttggggagtcaaaactgtacagaaagaaatatcttctctagaagcagcagatttcatgtatggccagaaggtggtaggggtttccataaagcggtctgaggctatcaggaagcctgtttcttatagaaaaggggtttcagaagacccagggacaagacacaatttcaggaaaggggcactgggaggatggttcttttagcagaaacctcctcacaggaacagggatgagtgcctaagggaggagctcctgcctgggagaggcaagaaaggcagaaatgagaagcagggtggctctgacttatcttcctggtctaaatggaacctagtgtcttgctggttcaggagcctcattctggcctagaaatagcaccccacttccacctcaccagccaggttccaaccgtataagtagttgagctgaaaacaggagattcattttgtgtggtgcatacccatagttccagctactcaggaggctgaggcaggaggatcatttgagcccaggcattcgaggttgcagtgagctatgatcatgccactgcccttcagactgggtgacacagtgagatcttgtctctaacagaagttttaaatttttaaaaaattcattttgtggttgtaagtacaaaaaaaacctcaataatgatgagaaaaaagatatacgaagatttgttggttaggagatcatagctgatagggtgtgtactacttactacaactgctattctcccacactcacactatctcctgtcttaagaagtttaagcaaatctaggcccagtgtcccactgagggaaatcacaagaggacttagaggggtcccatccatgagagctgcaccatgagtacatgctacttggaaggctgcttctgtggtcattctgagagctgggaaaccaacctggtgctgagctgtccagaaggcagcatctgctgattctggtaccactgggaagaacaggacacatctttactagggaaccagctgctagtcaacagctgccccttctgctccccaataagcacctttctgattactgtcagtttttcagcagaaaggccatcagctgttgtgttaatgatggggcttcactggttggaagaattttgcagtctccagtctgaactattcctctgggtgtccttattcaagcagcagttaatttgaaaacaattagctggttgttcacttccttaaggcaaagcaatactggatgggctaccaggttggactaagattccagcagaacactctgaaggagccaggatatttctaggatgggtctgctttgtgttggcttcaggaaaagtctagcatttctaaccctgatcattgggaattagtcactatttcccttagttgctctggcaggctttcatttatttttgcctgggtgacaaggagacacttctacatttcaacattaaacagactggacgattcatttgttttcttctttttttcactcttccaggtaaagggaaaatggatccttatggtgaattatagatgagaaatcaatgaaagatacagagactaaagagaagtagagttttataaaaagcaactggatttgttttataaagtagcagatttccttttacaggctggccaacataatctttgggactgaaatatctttctgataagagtatgtattttctgtcactgaatcctctacttatatcccctgccacacttcatcctgttaatgaggacaaaacaatatgaggaaagtttttctgttttcctcagtctcccaattcctcacctctcttctctgcaaaccactcggcttccataacaaaaaggatgacacaaacagagtaaaaatatgttaccagagactttctcagttcatggcaatattcagtcagctaaatctggcaaactcatacacatctggcctgctggcaagtctgactagaattcagctgtgcctgtacaaggaagcaggggaacagcatttagagttagacagccctatggcctgctgaatcctcaaatatgcaaggggcttattcacaaaatgcttcacaaaaaatggctcctccaaacacatgcatacttatttgatgtttttatacttttttcttttcagtgctaagccatcttctttagttagaactatttttatcctttgtcactttataaactgcaatggaattcagtattccatgtacaaccttaattttctgtatgacatggaaaacaatatgggaatcagagggacttaaaactaagtctatggagcccaattcccaaattgcagatttaggtcttactgtctctcaggcagattagatgacttctgaaaagaaatacttatttaaatatgcttattttattgttattgaggtatgcataaattatcccgttatagctatccaaaactgtgaacaacagaacaagaccccaaactgcagagaatatatcaactcagttgcaaaagataagacagtaggaaaggtgccatacagaacaatattgggagttagcatcatgaagaaggttagcaagatgtgtttataatacaactttcattccaacagaaattataacatgctaagagcatggacctcgaggaaaaaatatctattttggtgggctaagtaacttttggaaaagactaaaacacaaactcctttagtaaaatgctttaatatactctaggccttttctttaaaagtaaggtatgattaaactaaaactttcaagtagttcaatgaactaagcaagaactgttggcttccctccaaccatagtcccacttgctagagataataaccataaaagtttcatgtgcagcccacacataaacaagcatatacagctgcatatttacacacgtgtgtatttgctggtacaggcctaaaatatggaaacatttgctattttattaaaaagtgctcataccatatataatattcatgcaacattgttctgtatcattgacatagatgggtttgttctttttaatggctattttatgtactattgaacaggtatgctataatacctatattcctattggtatgcttttaggttacttctgagttttaacaattaaaaaatacgcaatatgtcttcttacaattataactttctaacttgtatagatagaactaaaacttctccaaaaattattattccaagctacactccttccaacagagtaacaatttctcaccaccactagatagcatcaactgtttaaattgtgtccaatggacaactgaaaaatactctcttattttaatttttgccatcattaatgaggccatctttgcttggctgttatatttttctttgaatagcccattcatattctctatttgttttcttccactgagttgttactttttactaattgagtcccttgtttcacagagaaattagcccatcatctgtcatgtgtactgcaaatataattcctaatttttcatttgtctattggctttggttttgttttggaatgaggagacagtcttctagaaaataagacatattaaataatatattggtaattgtaaagcacagattgtatggcgccagccatcatgtgctttgttcaggtgtcatgcttatcttaggtaacaaggtcaccaggattaattagtgaaaatcctgctgagtttcagatcatctcagtggccctctataaagtgttctcactcacctggcagcctcctttcttaatctcagttggaatctcaaccacaaagtggttgctccttgtatctagaagtcatttaaaagacagtaatcaaaatttctgttctcttttatttgttcctctgcttccctatcaataattctgggaggagtgggagagagaacagtgcgtaatcaaaaggcagacctagcaaattattattttattgataaaataattcagcaaattctcaatattcctgcttcacagtgattaccctagattttatattttagggttttgcacctacctcttatcatcaccccactaactagagtgtagtctgtgtaggacaccgattagactcacccctggtttggcaggcaaagaatgccaaggcaaaagcacagccgacaaagctccctgtacttgtgcagatagagaggcagagtataccccggagctgagctgcaaggtacaaatcctgaccctcctacttgataactgtgttactcggagtcagttaacctctcagagcctcagattcctaatacatatgatgcatataggaacagtgccatcagaataagaagagcagctacatcacaggactgctatagggtgaatggagttatgatgtaaagtagtgcctgggatacacatagcacattttaagtaaatgtggcatatcaatatagtaattacatatagcacaatagaaaagttagagtgtgatgaaatccaataggctttacaaaaatcaagtaagtattagtactacataaccacagaaaagggaggcccaaaggaacagtcaagaaatgcagcaagggccaggcacagtggctcatgcctgtaattccaacactttgagaggctgaggcgtgtgagcccaggagttcaagaccagcttgggctacatggtgaaatcccgtctctacaaaaatacaaaaattagccaggcgtgatggtgtacatctatagtaccaggtacttgggacactgaggtgaaaggatcactggctgaggctgcagtaagccataataacaccgctgcactccatcctggacaacagaatgagaccctgtcaaaaaaaaggaaggaaggaagagagagagggagggagggagggagggagggaaggatggagagagggaaatgcagcaaggagaagagatggggagcaacatggccaaatagaagcctccaccactcatcttcctcataggaacaccatatcttgagtagaaagatgaaaaaatgaaccaatgcaaaataatagttataacaacttttcaagatatagacagtacaataacatataaatagaaacaataaaaagttaaaaagttggggaatgaagtttaaagtgtagagttttttaatactcttctctttattagtttgtttatgcaattagtgtaagttgtcatcaatttaaaataatgggttataagatatttacaagccacatggtaacctcaaataaaaaaatacaatagatacataaaaattaaaaagcaagaaatcaaaatataccaccagaaaaaaatcgccttcattaaaaggaagacaggaaagaaggaagagaagaccacagaacaaccagaaaacaaataacaaaatggcagcagtaagtccttacttaccaataataacactgaatgtaaatgaactaacctctacaaccaaaaggcacagagtggctgaacagataaaacaaaactaaactaaacaaaaaacaagccccaatgatccactgcctgcaagaaacatgctccacctataaagacacacatagattgaaaataaagaactggaaagatactccatgcccatggaatccaaaaaaagaacaggagtggctatgctggtaccagacaaaacagatttcaagacaaaacctataaatggagacaaagaacttcattatataataatctatgggtcaattcagcaagaggatataacaattttaaatataacagtggagcacccaaatatagaaagcaaatgttactagagctaaagagagagacagaccacaatacaataatcactggagacttcaacaccccactttcagcattagacagatcatcaagacagaaaatcaacaaagaaacatcagatttaatctgcactatagactaaatggacctcatagataattccagaacgttttgtccaatggctgcaaaatatacactcttctcctcagcacatggatcattctcaaagacagaccatatggtaagccacaaaacaagtctggaaattttttaaaaaaaataaaatcacatcaagtatcttatctgaccacagtggaacaaaactagaaaccaaacaacaagaggaattttggaaagtatacaaacacatggaaattaaattatatgcttctgaataactagtgggtcaatgaaatgattaagaaggaaattgaacaatttcttgaaacaaatgataatagaaacacaacattccaaaacctatgggttacagagaaaacagttagaaaagggaagtttatagctacactataaaagaagaaaaacttcaaagaaacaacctagcaatgcatcttagttaactagaaaaggaagaacaaacctaacacaaaattagtagaagagaataaataatagagaccagagcagaagtaaatgaaattaaaatgaagacaatacaaatgactgatgaaatgaaaagttggtttttcgaaaagttaaacaaaattgacaaacctttacctagattaattgagaaaaacagggaaagacccagataaataaaaacagatgaaaaaggaggcaaaggactgttagaggctactatgagccactgtatgccaatacattgggaaacttaaaagaaatggataaagacacatacagtctaccaatattgaaccatgaagaaatccaaaacctcaaaagacaatcagcaagtaatgagaatggagccataataaaaggtctcgcagtaaagaaaagcccaggacctgagggcttcaccgctgaattctcccaaacatttaaagaagcatatcacttctatttaaattattctggaaaaaaaaaggaggaaggaatacttccaaactgaggaaggaatacttccaaactcattctacaatgccagtattaccctaataccaaaaccagacaaagactcattaaaaaataaaataaaaaactacagaccaatatccctgatgaatattgatgcaaaaacccttaacaaaatgccagcaaaatgaattcagaagtgaaagatctctacaatgaaaactataaatcattaatgaaattgaagaggtctcaaaaaatgaaaagatattccatgtttatggattagaagaattaatattgttaaaatatccatactacgcaaagcattctacagagtcaatacaatccctttcaaaatgccaattacattcttcacagaaatagaaaaaaaatcctaaaatttatatgtatcaaaatatctcatgtgccccataaatatatacactatgtacatacaaaaattcaaaataaaaaactataataaacagaaaagaaaaaagaaatgcaatgaggaatagacggaatttgaggaggaggcctaaaataaacaaaatcaagtattgtgtgtattctaaaagaggagaagagccttacaaaaacacttacctcagggacaatgaataaactagtgggagtgcagtgaaaggctgtgactggatagtaggagaggattactttaaaaatgcagattgccaacatctcaaactctgtttatttaaatgaaaatgtttacttattctttgctctcaattaataaactgaatcagctattatcagagtagtatttcaaatgtgaatctttagagcaaataattttaaaaaagaaacacctttcccacagaaatactgatgtccaggatggagggctttccaggctggtccctgcagcccctgactacaaatgggaaggcagagtaatgatattgtactatcatcagtcccattcattccttcactcagtaagcatctgctgaatgcctaccaccagtccatcactctcttaaaaaagaagtggtagtggtgaacaaagagaaacaaggtctctactctcgtgaggcttctactttagggtggggaaggggagaagcaatggatacagagcataaaaataaacagatgagtaagattaagattacttgagacagtggaaagagcaataaagcaaatcaaagcaggtgctgtcatggggtggaaggcccctctgaggaagtgatatctgagttgacagctgaatgatgaagcagaagataagtaccaggaagtccctggcagagggaacagcaagaacaaagacattatggctggaaagagcttgatgtgttcacagaacaaaagaaagggcagtgaggctggagtcaagtgccagagtcctaagcaaaaagtaattgtgaagtccaactttgaacgtcaagcacacatttctcccttcgttctgttgactgccagagctttagcagctcctcagctctggacacaaaatgcatggtgttgagctcctcagaagctccagtggcctggggttctctctcatggatccaggaggaagccttgggatcaagagcctgatgtgaggaaagggaaaggactaggggagggaaggataaccagggtggtcacagctccagtacccacaaagacgctctttagaaagtaggggatttcaatccatttgggagaatttcagttaagtttagttaattttttagataaggaaagattcttgccttttgtttccttagtttgtctgtgagcttccaaattagcagtttggacaaaatcaggaacagcaggaaatccaagggtgagctatgtataaatcaagaccaggaaaactaggacagttgctggtgcatcactaaccttttaagatttatgttaaaaaacaagcaagcaaaaaccccaccatgccatcctagtaaacatcccttaggatcattctgaaaaacaaaacagatccactgatggatagaaaatgaatctcactggttatggcagtttttaacgagatttttctatttgtttggcctaatttttaaattcttgatcctcgtaatcaccatgtgggttgcagtagcaaaataacttgtgactgatgataattaagaaaaggaaatttaagaaatgcatgttttcctgagccaagtttcaactaaatgtttttgctactaaaattatgctttcttacacaaatgttgaatataagtaagttgctctggggatgttagtgtttacattttttcccatttgttatttattagcatgaattaatatgccagtttgtatttgacacaagattttttttaattcttgcaataataagactacatttctctatgcagtcatattgctttcttgaaaaggatgattatctcacagtcaatgaacttggtgacaaattataggtattttgatattgcaggtatagtaattttaatgcaacccatcaatgcatagatcaatgaattttatatttattatatgatatatattctactgtactagtatttctaaggaagatgaacacccaggacaaataaatatattttatttctgagtttggaatatacaaattgttattttcagtggcaatagcatgtctatcttctgttggaatgttattttaaaaaatacttctatctgcagcaatacagaaggaacactggttatttgggagataattatttctgaaaaaaatagagcaaagactaaaagctaagaactttgagttatttgtactaaatgttatctagtatcatttgagagatgaatgattgtaagatattgtctccacgctcagaagagaaggtatagatcttcgaaaaatttaataatttactgaattatattctaaataagtttaaatgttcacacatgtgaaaatgctttgtgaattaaaagctaccacaaaatttaagggcatgccattattattttcggagttagtttatcatggcaattcttatagctaaagccccatcaattcttcttttttcagtgaccaggtccagatcatcaaaataagaatgagcagaacaatgagccctcccagaggaagagacagccaacagaaaatgttattccatccaagaaatcaatttgtttattcataatttgaacaaagtatttccatgccaattactgattggtctctccaaggtctttttgttttttaactcaccataacagatggaggaaaatatatatacaactaaaacctgatagcataattagtggactggaagttggggtaaaaaccacataaccaaatccttaacaggaaggtcaatatcaagacatattcattatactttgaatggttatcaaaatacatgtgttagtgcaaatcagtaccatgtgctttttccctgtcagtatttgttttttatctaatttacctatattattatttttaaaatgtgatcttcagcccagtgagttctatcactctcctctttatctagtcctcttataataattttcaatgtttaatatgctttaaaatgggacaaatcatatccaggaaataaactgtttaccaagaggaactttgttaaaaaaagataaactggctgaaatgattaactgtaaaagttcatttcatccctgtctacatgtggcttgataattaattaatcttatatttatgaaaaataggggaaagagaatcataaatgttcataatttagaggaaaggaaccgagacacagagaggtgagtaccttgcagatgagggatcagtgcttaatctacatgtctactctgttcccacagtctgcaaggaagagaaacagaatttataaagtagatttgtaaatcctgataacatgagtcaggatatgattatgtaacttcaaatatctttgcatttaacaagctagaaacccagagcttgatatttgttgaattgcatacatgccttttcctggtttcttgtttacaataaattttgtggcaggatatttagatttgtgaattctagccagactgctctctaatgagactacagcttgtttgggttttaaagctttatgacatttatagatgtttactttgcatctctaaaaaacacagaaatgctcccatactataaaaatactgatctctaaactttcaaagcataatgcaaaaaatccctaggtgacgaacctttgtgatagagtaatacttttttcaattctttgacaagtggcactattatttataaacttgagttacacaggatagtatataactacagcaacaatattttgataaaaggtgtcagataaatgctttgcctgaaaaggctaatccagaaaacttttttccccttcctcttgcatgaaacctcttaagcagttgacaggcacgagacacattgcccacagagagtggcacacactgagaacacacagtatctgacttaaaattccagcttttgccaaagaagagttgtcttcagcagccgtgtcagggtgccccgggaaaaaagacagagactcctctggtcttttctgtcattaagtgtgagaaaataatactttaaccaactagtgtggaggtgattacctcctccaagaaacattttgataaactggcccactccacttgagcttctaggggttaagccagatcacaagctgagaggagggagagcaatgcaaataagaaataacccaaaatgaggcatccctagcacagttaccaattctagcttcagcctttcttttatctagagcgggtcctacaactccagagtttttttttttttctgggtctgccaaaattcaagttcctacactaatttgttgatttgggtctattagtataattattattttcatccccacatttgaaactcattctatgagactaaacagaagaaggcaaatggatttcatttcaaaagccaatttttatctattactagtggctgtctttggggtctgatttgagcagaattctgaggctgagcatggtgagaaagtacaacttaatgatttcatgatatctgctagctacggggatagggtcagatccccagggcttgcagcatgtgtaggtaatcaaaaaaatgtttgttgaatctttggttttatgcaaaatggctgaggtctctttggaaaagaagctttaaaaacaaaagtaatagaaaatcaatggctgtatacccttagatagaaatgcagccatccgctcacttaccttttatctgaaatacttcaatagcccttcctcacctctttccaagctatactgatataaaaatgacctttctaaattggatcatggttgctttttccatccctggttccttattctcataaggctctcttaggaagcatatcacataagcatataaagatcacctagggcagacagatagatagataaattagacagagaggtgaatggatggtaggtaggtaggtaagtagagatagatagatagaactagggcactttcattaatcaatttgctggttattctctgcattctgttcccttgcatcaatacctcagactctttgctatggctcagagacctatgttctcttcttgaaacctttgacttcattgtagctcacagattaagataaaagagactcccagtgacactctcagaagaggaagggtcccctggcattactgcatgaagaggcagattgagacgacaactcatcctttattagaatcttttccttagaatataaagggcaagctccttagtggtttaaaaaaaaaactgtatttctccatctggtccctgctgttttgctcagcttcatacaaccaatcatcattctccaacaatgagccttttaaagctccttaactacaccacgatgtttctaaagttctgcttctcttcactggtgtttttgcttttttgtctgcttgacaaactctgacttggttttgaaaacccagttcataatcatcccacaccacaccctggaaaaagttaatcattcccttctctgggttagctctgcactgttcccataaatatttctatagttgcacgaatcaggtgctttgttagtttaaattagtatctgtgaactggttgagagcaggaactttgtcttaattttctgttttcttagcacccagcatagtttaggacacattcaatataactgaggatacctttaagattttccattagggagaaaaagggaatagtgataatattatccaagaaaggaaaatgaaaaacaggagcagactgcattgtgagatgccatttgtttcatttggagatagtcacgtttcaaagtcccagttagatgtaccacagaagaaattagagggtttgggaaatctgggcttagagttaggaaaggggtttggagctgaagatggtcatctgagagtcagcaacacataggcagtagcggaagccatagatgcacatagaaatgaaaaactagaaaaagtggcaagaaccctgtagttcactaaaaatttggccccaaatttaggagccaatgaagaacatgtggatagatgaagactgggaagaatgataaggaagaacctggaggacctcagaggccaaggacattaaaatttcaaataagaaggggtatcgatcatgttagcatctcataatggttaagtgggatgaaagctaaacagatgagatgaattttctaatatgaagaaaggggtgtgcagggcaaagcacgacatcgagagcaatttcagtggaggcaaaagcccgggatagaacaaactgcagtcagtcagagtgaatgagtgcctttcatccagactcattacagaaactgtggcttaagcaagaagccctcagtggccatctgggtgagaagtggaggggaagagggatggaaaggtgtggtgagaaggaatcagctaatgggcaaagcaggaaggattctactgtttgcacgacaacattttacatattgtatattttaggcaagatgtccctaggcaaatggttccataatcccttttgttgataaatgcctattccctcatttctcatgtttctataaaggggaaagaacatcaactccaccagaagatacagtctctggcttctcattcacttcttcttgggaaggaataatttatctgatttttgagtttgggagaagaaattgaacatgactagctcattatcttcctcccttaaattcataaaaggcacagaatctcctattctgttatgctttaagcagcctgccacagcagaggaggatgacggctgtctaccaatgcctgtaactgggggctcagtttacatagaagggagttgtattaagtccaagtggtcacagatgtaagtcacattctccaattcggtcatgctggtaataaagcttatggtatacactccatctgtctcactctcatgtttgcttctcaactagatgtgaactcaaggtgggaatcgggtgcttaattattattgccttaaaaccttaaaagtaggccgggcgcggtggcttacgcctgtaatcccagcactttgggaggccgaggtgggtggatcacctgaggtcaggagtttgagaccagcctgccaacatggagaaaccccacctctactaaaaaagaaaaaaaaaaatacaaaattagccgggcgtggtagtgcatgcctgtaatcccagctacttgggaggctgaggcaggagaatcgcttgaaccctggaggcagaggttgaagtgagctgagattgtgccagtgcactccagcctgggcaacaagaatgaaactctgtctcaaaaaacaaacaaacaaacaaacaaaaatcaaaccttaaaattacacttcaaggaggttgtttaaaaatagagaaatataagacctccaattcctcatctgtgaggtgaaggggctgaagtggataatctttaagtccttcccagcaatctctacacgtctgtttgctattgtgtgtgtgtatatatcagacaagcggtggggcggtgggggtggtgcatgcgcaaggagtcagacaatcttaggtaaaaggaagggaggattcaaagcaggagcaggcagtcaccggggtagtgagcagaaaggtctcctaggctgaagaaaaattaagagattagagggcaacttacttatgaagagcattttctgagacaaaaatgaaggttgctatatataaacaaaaatatatatatacacatacatatacattataatacatagagataaacaaaaagcaaaatactgaatcaggctggaaaaaaattctccccaattcaccagcccttccatgctcacataaaccccttccctcattagattataagattttgtacctttgcacctaaattttccaagagaaaaaatgaataggccacaaaatgcctaaaagcaaatgctaggaattgtttggctcaaataacaaaacagagacccttaactaagctgaggacagtggaatattattttgccttcttgcctgttggaagcactaagaagacatttccaattccaacgttccatagaccaaaaggcttaggtgaagagggtttccaggctcacagctcaatgaaaacaatgatgatccaggggagtcatggcactcatgtcttcaacactaatggatttcagctgattcatcagtgaacatttctcagaccaaagtggaaaaagcaatttttgtcttctgttaaacagaaatctcagtcagtcttgcactgaattctttcacagaaaatctctgctcttctgccttttcagacacacaaggtctccagcgggtgctctccagagatggaaggaaggtgtgttctgtgcagtgcatcagttgctatgtgttccattgtggcaattgtgattcacaagggcatagctgagccaccacagctttcagctgtaatcctcctggcatctatccctgctgttagagggataattatctggttatccctgaggccagttcttgccattttcacataaaaatcacctcttgcataagacatggaatttaaaatcatctcctcatacatatcattgagtcacttcattacctctgggacatatataaattatgcattcttcgattctctttaaatttttagaggctcatagggacagtgaaggatctcattggtactgaaaatataaggcattccagaaagaaacaataacttgtgtgacattaactgctactagtgttccaaaggctccctgcttggtcaaggaaatcacataaagcatggagaactaatagcaggcttgcatgctaatgactgccggtctgctagtgactgaatgtcactgcctcacatcctcatgctattcatttttcttatctcagtgacttctcccttcacaggactgatttacttctttaaattggcaccattctgagtgtctgcaaccaagaaggcactgaaaaattagaacccacatgcccttattcccatttatttctccaatcccatgcctcaatattaagagagttatttgtctgtaccatggaaatagtgttttatgaattctctggagcttgtttgattttacctttagatgcgtccaagactcactaccatacgtgcattctttaaattctttaaagagagggcgtgacattagcatgaataaaatgcagtggctgtcacggcaagaatgaagaaatgtgtgtgttctcatgccctgccattaagatgaattcacagatgtaagctggcaacacaacacagcacaacacaacactggcaacacagacatccatggagggctacacatttcattccatagttcccattcaatataaatatggctaacattccttaaagattcaaacccatagtatattgttcacctccaaactggaaaaaaacctagtcctgtcacagaagtgaattcagttgcttgatctttacagctgctgataaaagtttgaggagttcacagacttatgggaaaagtgagataaacttcagtatccagcattaaaggctttccaaggcaaaatacattgtgcaatattaatttttcaagttaaaaattggaggtatttgaaaaccattgcttccccaaacaggaaggaaaaccactgtttgggtggtaaaatgtgctaattctgtacaaaatgcctttaagcccttgacctaatgaggttagtgacagggatatggatgactagaacagaaaatgaaactcagaaagaattttgttcatgaactgccatatttctcctgtcatttagccaattttccctctcaaaattacaacatggactgcaaatcttcaaggctaatgctgcatatgacagactaagtgctatttaaaatgtaataatatatctgtcaatctgataggaaaaaacaagaggccacgcgaaggacttttcaggtagacatgggtcctaaaaggttataaagacggtaatcaggaaagcaagccaccacacagcttttcccgtccaattagtaaaagtgcagtattgtcagcgagttctacaaatgaaagaatcctttcagcctgagcactcaatggcgtatacccactctattaagtgaccttcattgtacaatacattaatttctactaaaattaatgttttgggttaaaatcaatgcttagaggacattaatggaaatgatttaatatgtgtgtcatgcatactgtttcaaaagtttttaatctttgtaatttgctacaaaccaaaattatatgagaggtggaagaacactcagaattctaaaactcccactgctgactaaaacataccacttttgttttccactttcatctcagtcagggcatctgtgctattttaatctgccatgcctgaattatcaggaaagagaaaccactggtttcctacaaacatactttatcttagtaggacactttccctctagactctctgtgtggatattttcaaggattcacagcgagacactgggtgtgtacgattgaggttatttaagattttcccacaatgactggcatccatgtggagagacaccaaatgtcatgcctcttcttaaccagttctgaggcggggaaggtagggaaggaaaagcagtgcgcctggggagatggcatgacaaaagagagagccacattctgcttaggagcttattgctttaaaagttcacctaagattgaatttaaaatttgctttaagcacctataatgaaagaacattttagatcttgggagaaaaggtacaagtgtccagcatggagtgaatcgcttggccctttaatatttaacttcactgaaaaagaaacctcgtgaagtcctcttaaaagaacgcaggggactgcacaggactttctcaattgatggcataatgagaaccattaggaagcttgactccattttacatcttaaatctccaagtcctccttgcaaaaggaagcaaacagtacctgcttcccaagtgagacttgagtggaaagtcggccaaaatgagacagttttcagaaaacaaatttcagttaagtctcaggaagctacactactactactttctctattctccatgccctgctcctgacagatgggaaatacatcaactacactctgggcagaggtaagtgacacagaagatttccataggtagtgttcaggtcacaccttcctgaacaacttgttttattaaactgttcctaagaagaacctctgccttcctgttgaccttaaaatcttctcaagaggattataacacaagatgcttttatattgtggttattaacagctaccatttatcccagaggctcaaaacaataggatgaggattgttaccagaagaataagacatagattcctcggtaatttagcaaatttccagctgtagtactccttgcccagtaaaatgcttggctagccctttggtattttactccaggttcctcttctgtaaagtcaaccaacacaagtggcctgacagtcatgatggtgacaagggatgatgttcactttgattgtattttggaggtaaatgcctgggcaaagaatataagaaaccacatcctagcaatatgttgtaatacataagtttctaaaaactaaaaaacaactaaaagaatgtacattccattgaaatgtactggcccttgtagtctaatgagaaacgtaatagaagacaatgaaacaaaaagtattttcttcaattaataacacaactcaggaagaaatgttaagaattaaggaaaaggactcataaaaagcaaccagagttaattgtttaagaagtgcatatctaaccccatcacttgcctacttagattggcaccaaatccttaacacagactgttgtaataggacaacagaagctattaaagggtttcaaactgggaggggagggaagcatgcaatcttcctacttctgtcttcctacttctaagactcaatccacttgccgctattttctgctttctctaggaaagcttcccacagctgacgaggaaattagattccctatagtataatcttgtaggactgtatactttttcttgacacttatcacacttagaattactttttcaatgtttctctttctcctcagacctgtgatgagcaatatggcagccacatgtagctattgagcatttaaaatgtgcctagttcacattaagatgtgctgtagtgtaaaacacatgccagatttgacaaacttagtacatactgctactgaaaaaaaaaatgtggccctgcagaaaccttgattttagcccatgagaccaattttagtcttcttagctttagtaacagaagagaataaatttaggttgtcttaagacactagtctatcgtaattgtaacagtagcaatagaaaactaataaatgtggcttccagaaagattaaattacatatatagatcacatagtatttctatggaacagcactaggttagattataaactccatgagggcaggaaaatgtctgttttctcagctgctccatgttctgcacccagcatgcttcctgacacatatagtcagtccaaaatactgtggattaaagaaagaaatttaaagaaggttttaccccctttataattcgtaattcaatcactattccaataaaaaattattaagcgtttactatgaaccacacattgtgtaaggcactgaagatacaagtataataagaagtggttgccagagaatgggagagaagggaataagtagtaactgcttaatgggtatggatgttccttttagagtgataaaaatatttttttttttctttttttttgagacagagtctcgctcagtcgcccaggctggagtgcaatggtgcgatgtcggctcactgcaacctctgcctcctgggttcaagtgattctcctgcctcactctcctgagtagctgggatcacaggcatgctccaccacacccgactaatttttgtatttttagtagagatggagtttcgccatgttggccaggctgatctcaaactcctgacctcaggtgatctgcctgccttagcctcccaaagtgctaggattacaggcatgagccaccatgcccggcctcaatattttcaaactagatagcaggaccagtgtctggagagggctgtctccacttccaagatggcaccttatggctgtattcccctaaggggaagaacactgtgtcctcatgtggcggaaaagacaaaagggcaaaagaaagaaaagaggaattccctccatcaagccattttataacagcactaacccattcatgagaatgaagccctcacaacccaaaatcctcccaaaggaccccacttcacaatactactgctctggggactcggtttccaacacatgaattttggaggagtcctccagaccacagcattaaccatgcagattgtagaaggaggaatattgcagacagaaagctcatttatagcatccctagatggctcttcaaactcttggccttctctattaactgacaactttctgcttccttgcccctatcctgattgacagttcttagagagtaaagcctgaatctttgaagtcatagtcaccataattacccagagtcacagagcccaaggagcaaaaagctgttcaaaatgggaaactatataaaaaaaaggagaatgggatccagaggcttgatcaactctatgggcaatcccacaaaatatgcatgtaatatataatcagagagaagaaaggaagaaaaaaactaggtttgcttagactttacctgacgacacacgacagccatttgaaacgatctggcttctaataaaaataagacatagagccctaaacacaatttgggaagaaaaccaagaggtcatcaaaatcacaggatatacatgacagtggatagggccacttggcttctcctgtggctgagaaagatttaaaaacaacctgggaatatcagtgaaatttatttcaactaagaattgatgcaaacaactgtacactagataaaaaagaagtggtaatttgaggaaaatgtattatatttgtgctctagaataattttgtttataaaattttttgacacatttgaaaacttttatctctaattcttaataatgaaatgctaataattcatacttaatatacttaatgacaaaatttacctaatacttaatataatgaaatttatcctcagttcatgtgttatcttctcagaaaggccttcccttcataagtagcgtcactcaagaggtacaatcaaatccccttgctttatttcctgcagattattatctgacacttttttgttcacaatgcatccacttttctgcttacatttgcctcctctctctagaatgtaagctctgttagagcacagctgatatggtcttattcactgctttgtctgcaaccacccttagcagagtgccaacccttagtaggtatctttgtagaatgaatcaatgaacacaaaatcaaaatattattgcttgacttaattccacctttgatctcctcccccaatgatatataaaactttataactggaaaatttgttaattttatttctattctagaagtcttactagatttaataggtattatagagttaattaagcaagtgggaccagaaatcatattcctagataggaattcttgttccttcattttttttttccttctgcttgtgtggccttgggtaagctacttaaccttcttatgacttagtctcatcattaaaatcaagggattaatattaatattagctatgtcatagggttgcttgaagactcaaagtgtagagaatagtgtctgggacctactaagcacacattaaatgtaaattccataatgggttgaagtagtaaatgaggaagaatggtggcttaacaaaatgtgggattttctatcctctcaaagaaacagatggttttaggagtaagttatctgtacccagaggtgttcaaacagaaataattatccacttgatggagatattagaaagaagatttatgtatcagaaatccaattacattagataacttttaacagctccctttctactcttgcagtgctaagctcccattgtgaactgaagctgagaagtacacagtacacttcccagatgcaaagacaatgagcatttcagtctccaatatccagcagatgcatttctactattttcacaagggattcagtgtcttctccatacttgcagaacttcctgtttatctttcactatccatgtctatgttattgatctccccatgagaccacaaggaatcagggtggaggaacatgggaaatggagcacaggcattctgggagacagaacactgagagctatgcttgctcagaaggctcatggtaaagaaaattgaaggcaaacctgaaggggaggaattgcaaagactttgagatcttcaaataagtcaaaaacaaaacaaaacaaaaacactacaattcttaattagaaaggaagaacttaaatttatccaaactcaaagcagcccatattctactgtaagtggagggatatgacactggaaaccaactgacatttcccaaagtggtcctacagtaggaaagagttcaaggtgttcttccagatgcccaccaatacagccagcaaggagggtaggggtagggtggtgagggctgtggaaaggggtgcacccacatgcaagcagatagtaatcatgcctttttaaaaaagaagagagacctgaaaaatctaaatccaggtgcagacttgagaatgagaatgagtcaatgggcttctacatgtacatcatcagaacattatctgggatattcatgtccttgacctgtacaaaaaattccaaaacacctgctataccagaaaagatcagttaaatgacattctactttaatatttatgttaactgggttttatcatattcacattgtctaaaaattagcaatttatgtgtacaaagttagttgacactcagccatttggggtttttttgtaaacagtggacacttttgtcgccaacaagtaatgttacgtagcattcacagacatagtatgacttaattctcaccagtcgtaaatttggagcagcttctctgtgaggtattttcaagtgccgaccagaatagctgcactaagaacagttcttgtatgctcaggtgaatacctaaaaatacacacttattcttctttctacagcagtgaaagccattttcacctcccctacaaaagactttgatgtcagtgtgtgtcagcctcagttaagctgttgcaaatcctatatacacatttggggcagttctttcaaattctgatgagctagccaaaaattgcttcaaaaatgttacagtccttcctcactgtttgcacgcaattattggtaagctcattctgagttcaaagaacttcaaagtttatttttataggtaaggttacagcctctcttaatagaattctcattttgtactgtatgtacagaaatttgcttgagtctttagaagtttattttagaaacttgagaagttttaaatttacacatatgttatttagtaagtcatatttaaattcaagaacttgtcaatttaatatagtttgtcctttaggagattaattgaagcaggtggtaatgaaagttaggaccttgtgttgaaatatgatagatgaatttattttaaggctattggaagagctagtttatttgctataccttgtattctcttatacctaaacatagagcaaaatggagagatactcaggtatctgacctaagttattttagcactacctgattctttttttttttttttttttttttttgagacggagtctcactctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcagcctcccaaagtgctgggattacaggcgtgagccaccgcgcccggcccactacctgattcttaatggcttcctctggcatcaatatttcatcagttttattccatccccaaggaggaaaagtccatttcttacatatacaattaaaaatcattttctaaaaagcttaagtcttagcacaagacaaagaattatcatacaagtgacacaaaaaagttttaaaaacattttccaaacatcagcggttattgattacgagtgatactttccctactctcctagtgggtatttttgattgtcaaaatgagctggaagactctgttggcctttactgtgcagaggagccagggatgcaaaacctcctgtaatgcacatggcagccatgaacaataaaggactgtgccaaccaaaatgtcaacatggggatacaagagaaaaatacagaaaccaattaatagcaggaattatttacctctttccatttgtgatcaatcaagtagatttaaaaaaaggaactatacagagtatccaaataacctaactaaaatggtaaatcatatatagtatgttctacatgcatgtatatatcatatctgcaccctggaaacacagaacacaccttcttttccaatatctacaaaacaggcacaaaatttgaaaatctattatgccacaaataaaacatcaataaattccccaaaaaagaaaagtatagaaaacattcttgtatcatgatacaataaaactatcaatatctaacaaaactagaaaaaatatgtcttatcttctgaaaattttaaacttccctcataattttgaggtcaaggaagaaaaaaattaataacatgcagaaaataacttttaaaaaaaatccacaggatagctaaagtcatgctgaaaggaaaattcatagatttaaacagttgattaataaacatgaaataataaaaactaaattaaacattccatccagggagttaaaggaaacaaaactacagaaagcagaaaaagtaataaatatacagaaatataaattaactgaaagtgtcttatttattttcaataaataaattgagaagctggtacctaattagttcaccaaatcaagggggataatgaaggaggctaaaacaattacacaaaataaaaataataagagccagataataccaacatggaagacattttatttctttttctttttttttggagacagggtctcactctgtcacccaggctggagtgcagtggtgccatcatggctcactgcacactcaacctcccaggctcatgggttgctcccacctcagcctcctaagcagctggaactacaggcgcacaccaccacacccagctaatttttaaattttcttggaagagacggggtcttgctatgttgcctaggctaaagacctttttaaaaattataattgattcctttgctcaactctgtgcaaataatttcaaaacatggataaaggagataattttctagaaattattgtatgtcaacctacttccagaagagagagaaatattacactaattatcacacaaataaagaagattgttagagttatcccccaaactggacacacatgcacagacagacagacagacagacacacacacacgcacgcacacacacagcctagatggtttcatagcacaacttgccaaacctttcaaataacaaaaaattccaatgccatttaaactccttcaaagcataagggaagaaaagactaggacagtttccaagttctttttacaaagcaatagtaacattgataccaaaacttgacagattgtaccaaaaagaaaattatggagcaaactcatcttggaatagcaatgctaaaattctaaattaaatattgacaaatagaatccaacagcaattaaagtaatacatcatgactgagtgaaatttattttattcaggaatgtaaaataaattttttaaaaagaccaaaaacttagaaataaatctatcaacaccaaattactcattatggcattcaaagccttttatagatgacacagttttctcttccacattaatcccactatttcaatgacagtcaaacactattactcactttttcttgtacttatgctatttcctatcccttaacctccgctaattttgtatctatgtttggaatgccatctgtctaaacttcctcccagttctaaatatcctatctacccataaaacccaatctaaatattaactcaaaaaagcttatttgattctccctacagacacctttcttctgctgaacaaccaaaatgctatctttcttgcagcactcattatatattttttaaaaacatcaggtcttctattgtcatcaagtaaacacttgttattttcagccatgtattacagatatttgtgtaaaggctctacatctcctatcagatataaacttttcttttttttttttttagggtaagggccatgtcttatgtacctttgtattctaatcactccaagcacaaatctttccatacttaaacattttgacgcacgagcacaaaaaaacccagattgtaaaagcaaactgaagacttgcgaagaatagtttccccttaaaatgtaactgcatgtgcacaggatgaagagttagaatctgaaaatcagctgggcactagccatgcctgccctgctacctttccatagccagaatcacagcagcatgaactgcactcaagctccagaccaagaaactctaattaccttcagcgagcaagtaaactgacagtaacagctattgcaggaggcaaaagcagctacaaccttcaattccaggcacggaggtgggaataaggaaagaagtcgggatggaactgttggtttcattaggttgttggtttggaagcaagtatttcacaaacacacccatccccccactatacacatccatccgcttcatattttcatttctcataatgccaaaatattaacttgtgttctaatatttcagggaagatgtataagctagtgagagtcataatgtcgagtttcaaaatgcatgtataatttgttatgcgtggcagggtgaacagtcctatcagaaatgcacctgaaggtttgctaggaacagaatattaaacagagcagagactatgggatctaacgtgataaactgacattaggttagaacagtacaaaaatgccacattccaaccactgttgatacacttctggagaagtggactttcaatataaagcagttattctaggtgcaattttaatagcaatgaaatacaatgaaatgacaaatctctggttcattctgaatacaagagttcctgcttattttgagaccatgtgaatcaaagaagtcgacatcaccagcactttgcttgtaggctaatctagtagtgacttttgatttcctgctccccctgttgatccatccatccacagctttaagaccagcctgactacaatcattcttcatgtcaccaaaatctccatccgcaggcaagaaggagatacccagctgtcccagtttgttaccccatcgcaagcacaaactgggatcactttctccaccccaactgtggtaggctgaataaaggcctcccaaagatgtgaacgtcctaatccccataatctttgaatatgctatctcataaggcaaaaaggattatgcagatgtgattaggttacagatcttgagatggggagattatcctggatgatcctatggactctatgtaatcacaagggtcctataaagagggaggcagaaaaatcagtgttacagtggcttaatgtgagaaagacttgactggcaattgcaagttttgaagatggaagggggccatgaagcaaagaatgtgaacagcctttaggagctagaagaggaaagaaaaggttctgccctagaagattgggaggcagggcagccctgctgacaccttaattcagcccattgaaaccggtttcagacttctgacttccagaattgtaagataacatatttatattgctttaaggcactatattggtggcaatttgttacagcagtaataggaaatttagacagacaattctgttcttggtctatagcaccacctcaaagcatccttattcattgatcgctcacagttaaccaccctgccacttgacttgccaagacctattgattctgtctcctaaattcttttaagttttgtttttctgtttttgttttttgagacggagtctcacactgtggcctgggctggagtgcaatggcgcgatctcagctcactgcaacctccgtctcctgggttcaagtgattctcctgcctcagcctcccaagtagctgggattacaggctcctgccaccacgccccattaattttttgtatttttagtagagacagggtttcactatgttggccaggctggtctcgaactcctgacctcatgatccgcccacgttggcctcccaaagtgctgggattacaggcgtgagccactgcacctggccaagttttgttttatttttattaacaaactaataacaattgtttatatttatgggttacaatgtgatgttttgatacatgtatacattgtgaaatgatcaaatcaggctaattagaatatgtatcatctgaaatatttatcatttctttacggtgagaatgtgtaaaagcctatcttttcctaaagcgtctatgttccatccatctttccttgtctccacagctactctctgagagaaaacttcagcctgtggctccttactgttctccctacgtctgctcaggccactcccttcgccaaccccaagctgggcaggccattcaccaaactgccccagagggtctttctaagacataaatctgaaatatctcaagacaaatggcttgccattgacagcagaatgaaaatcacctttctttacctgataaaatatctttcacagtttgacacctacctaggcatccaactgtaatgtctgcttcctggtcaaacttgctgcttgaccagcatgacattcatacctggtgcttcaacatgactctgtgcctttgtctgctgttctctcactgctcctctaactgacaaacccctaaatatctttcagtactaaaccaactgtgttggcgggctcttgacagtgagctccttgagggctgggacctctcttcatctctttgtctgcagtggctagctgaggcctccctctgaatgaagaggagggggcaagacttcctttctcataaccgctagcctaccttctttcctgccacattagcttacttttactttcagctcatatttggctttggaattactttcagaattagcagttgatacccgcccagtcagacaccatgtcctcacactcctgtgttttcagtgagcaggtgcaagatttaagaaatagtaaaagaggcggtggctcacgcctgtaatcccagcactttgggaggctgaggcaggtggatcacgagatcaggagatcgagaccctcctggacaacatggtgaaaccctgtctctactaaaaatacaaaaaaaaaaaaaaatttagctgggcgtggtggcacgtgcctgtaattccagctactcaggaggctgaggcaggagaatcacttgaaccagggagttggaggttgcagcaagccaagattgtgccactgcactccagtctggcgacagagcgagactatctcagaaaaaaaaaaaaaaaagaaatagtaaaagaacaatcagctctgatatcctggccacttcatctaatgctaagaccttcattttaaaagatagatttagggtaagaagcacttgtcagtctcaattttgctccagatgaggacccacgcaaaactacttctatgctttcctttcttggttataaagaattccactttctttcaattttcagcatagataagttttttactttcaaatcatccattacttttctctggcccatctccaatttcctaatattgtgtttaaaatatggagctcaaaattaggctctaacatagaccttatcaatggtgaacacagtgagtaaatttcatggttcttgtgtactacatacattctggttaatgcaatcccagatcatgttcaccttcttgataacagccctatattgctgacacatatccctgacaggtgagaatggctttttacctatagagtacttacatgtcaattccaatctttatgatggctaggatagtctatcagtatattttttctggaataataaaaacatcacctattgcaaagagctgtctaatgcactgacagtatagctcatcttgacttgatgttccacttcataattggaaccattagactgaaatcagagcttctgaaaattctctgagttttatttttaaacatgttatatatttatgtgggtacataacaatttcattcaaagtaaaaataaatacagttattcttcaactattagttgatacaacttcactttagaagccataaatatcagaaacaatgatttagataaaccatgtggaaatagttttaggaggtatcctccaattccatttatggaattctctttgcattttccaaaaaaaaaaatctataacaggaaagacagttgaaggcagagactgcattttaagttatctgcctttctaacaaagcaatggaaagggagacccaaattatgcttctgaagtgaaacgggataagcttagcaaaaaatttcatctctaattaactccttaaaaaatttcagtccagattaagtatatttctgttaattaacatatatagttaatttcattttctcatattgacctagtaaaattaaagcatacaaatacatctaaaattttttgacatactttcatgacagattgaacattatcttattaaagcaaaatgtatagataagtgctttggagtgaaaacatctggatcatagtcttagtgcattcaatcactataagatcaaaaaagtcacattactctttaagatctccatttcttttacatgataatgacaatcagtaatcgtcataacgcttacaacaatctactttttccctctgatgtgagtgtggctgagaaatccatataacccttaaaaaaataatgaataagattaaaatacaaccctgtaatgtggaccagtatgatctctaaaatacaatctgacacttcaatatagggaagttgaggttggaatttgaagttgaaagtcctactggagcctcattcccatacctcctagacatatggcctctgagccgtggtttcctcattactgtgtcagatagactacactagtttcaagtttttgttcttggaggtgaaattctgctcagatcctcaataaacaaatgatgaaaacagggctgctctggtgatgccaatgtggcagatgtggggcacttcgcatcctaacccttcattctatggccccagcaaaagttgcatggaacaaaattttaaaaccaatggaagcgatttagatatgattgttttcaattatcaagtcttggtgtctcttaaccatatgcacttgccagaggtggggtgagggagaagtggtattttaatggcaaagagcactggtacagatttggacttctaatccttggtaggctaaatattcaggaaagctctcctttcataaaacatttgcatgatggataaacagctaacttacagataaacacattgctgagctctccagaaaacaagggaagctaacaaaagatgaaacctacaaactaaaacaagaatgctaagcaaaccctgaagttgggccttccatgcaggaaaaaaatgaccaaaccaggaacccagagctttggacattaatggaaaaaaaaaaaaaaaaaaaaaaagcaaagggtctgcagaaagtagtgctgttaagtctgagaccctaaattcaacgggtactagaaacaacctcaccctcagtgaaagagagcaccaaaagccaatagcctgttgcagaggaaacagataggaagcctacctgtccctgcctactctcaggataaatatagcaagaaaataattgtctcccctcagaatctacaacagaagaccagatctcagatggtgtgaagtttatattacttggggtgtcaggaaaactctaggccaaataataactattatcaagatagggtgtcactctgtcacccaggctaaattgcaatgacacaatcatagctcactcagccttgaaaccctgggctcaagcaattctcccacctcgacctccaagtagccagactataggcgaatgccactatgcccaactaattttttatttttcatttttttggagagatgcagtctcactatgttgcccagtttagtcttgaactccaggcctcaagcaatcatcccatcttgtccccagtgcactgggatcacaggcatgagccaccatgcctggcccaggccaaataattaaataaaagctgcccttagttggctacttattgaagccctggtaccccaatgaagcacaggcaagtctattctgcaaaaaaaaaaaaaaaaaaaatccttaatatacatccctcataattcccacagattaagttcagccaagtatgagctcacaagcaaacattaatatatgtaggtgaggaactaagccaacagcaagctacaaatttgcttgatggcctcaggtattagcattaattgacatagaacagaaaatcgttatgctctaagtggctgaataaatgagaggaaaaattttttaatgatcagaaaatatccaatcagacaaaaaaataacaaaacagatgattttataaataaaaaagaaagcttttgaaacaaaaaactgaatgatgggttacaccacaaattagaactcacttgaaaaaaagattcagtgaactagaacaaagacttgaaggagcaaccccagattgcagcatagagtgacaaagaaaacagaaaatgtaaattagaggttatgaggcatgaatgatcgaaaatgagaaggaacacattacaattaaaattgtctttatccaaagacaccataaagaaaatgaagagttaatccacaaacatggtgaacataaaacccaaaaggatgttacatagaatacattgaaaaatgggccgggtgtggtggctcacgcctgtaacctcagcactttgggaggccaaggtgggcagatcaggaggtcaggagatcgagaccattgtggctaacatggtgaaaccttgtttctactaaaaaaacaaaaaaaattagctgggcacagtggcacgcgcctgtagtcccaactactcggaaggctgaggcaggagaatcacttgaacctgggaggtggaggttgcagtgagccgggatcacaccactgtgctctagcctgggcgaaaaagtgaaacttcatctcaaaaaaaaaaaaaaacattgaaaatgcctatgtatcaaaagataaagacaacccaacagagaaatgcgcaaatgtcagaaataggtatttcaaagaagaggaaacataagtggtcaaaaaaaagtatgagaaaatgttccaatagtaaccaggaaaacataaatttaaaccaggaggtatcatttgatactcaagattgggggaaattagaaaagttgtggtttccaaatgttgacaagagcacagagtattgaatacaggtgggaatttaaacttaacaaccactttacacagtaatttagcactgtatttgaagatacacatacccattggctaattatttcaatgactagatgtattatttcccagaaaaccatctgcacctatgtcttacagatatataaggtcttagcagcattatttgtagtagcaaaataaaaataaaaaacccaactatgaacaattcaaatgaatcaagagatcattaaaaacttctgaatagtcatacaatggaatatttcacagcagtgaaaattaattaagtgtagctacacaaattaatacagataaatctcagggataaaatgttgaataaaagaaaagccaaacagagtatgagtccctctatataaactcaaaaacacataaaacaatatattgtctacagatcacacatgtagaatacaaccataagacaacataaaaggcacagaaaggaggtttggtgggagagagatgaggggcagcaaactggagaaaagtacgtaggagacactccatttattggcaatggtctttagctgggcagtgcacacacaggtgttttgtctttctagtcttataatgtaagtacctgttacatgctttcttttatatgtatgtaatgttttgttaaaagtattaaaattctaaaaagagcattggagttgggaacgagcagcaaaccccagggaaaactggagctttggccagatttgtctcagacccctcccacctgcattttgtctcagccaattacagctcccatccacgaatactgccaaaggagtatgtgataatcctggtgttggcaaatagaagttggaggtaacttttcccatggaaactttgaaggcaaaagaccagcctggctttgacaccctccccaaaacagccctgtgccaggggacaccttctcacagcagcccacacacgactcagctccacaatgggggtgactggagggccagcctgtggaccacttacaagagcatcccagagcccctctagagggccagttacccctaatgatcacaatgctttctctatatttttcaccgtgtgtgctcaacaagctcctagtcattcaccttagttgaaaagacaaataatttgaccaactttttgactagatataaaatgtgaaaggagtccaacaatgcatacaagtcacacttcttatattactatttaaatgttagtgacttctgaatttaagaattgtgttactatttgtcaactaatcaatatgtttactgaaacactcagtccttataagcataacttagtgcatactgcaataaaaaatttaaaatcttgagcatctgggacatgtaaaatatgtgattaagtaatttatgggaacattcatgcagctttatttatagataatttaaaataccatcattgcattttttttaagtaaaaacaagtacacaaagaatagaacaaagaacagcttgatttattcttgtcagtaatagaatatcagtatctattagaatgtgatttaagttaattcctcaaaattagtttggttggattttcaatgtttttacatcagaatgcaaaacttattggtatagatttttctatgctgtaaatgctatcttaatgaaatatagaaggaagggaaggaaggaagaagaaattaagctttttctaaagacaggctatatgattcaactaagccaatttaacttaactgcattgatatttgccagattgctatcctcctctgcagaggaaggccctgaaaacactaatgttcatcacaaattctcctaaagtcacattaggatctgataaaatcaataattctttggcacattaaaaattgatctcaaggagatattgccttataattattcctttgccagatacccatacaaaaacactttcataaattgttaaggttttacttaatattctgcatccttgaagttctcaaaaatatcagtaactatcacgttagttattcagcagcaacgctgtgctagtatttcatatagtaacagaatacatgccaactaattccaagaactgcttgtataactggattaaaaatttcactaataattattgtagagaagaccagcagcctagagtctgacaaagattgttgtctggagtgacttctcatctgtttaccttcctacaggctttggagaccatttcactggcaatgaaggaattctactgattttgcccaaaatgcatcctcaggcctacctcctttcagggagaaggaaccaaacgaataaatgatcccatagcctacatcagagatcagaaataaaatggtttggaattgagggtgagtggggagagagtgaccttgagaagccactgcaggagggcccttctaggtctctgaggcaaccacaactcctccagctttgttttcttggttattctgtctgcagcgaaacccttaaaacaaaacaaaacaaaacaaagaagcccttcgaagctcacctgagaagtgactagaattaaggagaggttatggagtgttcgtactcagcaggaattcgaaaccatggaggtagccaacaagggcgccctcacccctgagggtccatttggatttgcaattctattcccccacccccaccctgccacccaatctctgtacacacacacacacacacacacacacacacacacacacacacacacacacacacaggcactccctttgaagcaatttatcaggctttcttctggggaaagtcttggagtaaatattagttttcttaacttatccttcttctattgacaatgacctgttttgtaccaaagaagctactgagtaatggagttatgaagcacgctaaaactgggagttcatccaggtaaagctatctgggattttgtgccagagtctaatcctcttgccctctaggtctggaggtatctctacaaggtcagggagatgtgctcctacctaagtgattgtctcttactgcgcccaacaacgccaggccccattgtgctcggaggagtgaagggattacaagagggcaaaataaactcttccaagatgcacagatacttcccttctaatatctctgcaccatccagagatactagcaaggaaggagaagttccctttacaatttggaatgcagtatccaggaatgtggtataattctttgatttgggtgataggtataaatagcagtggtaaaaacagcaagttacttctgtctacaaaccgaggtcaagtcatcccttcttaaaaaactgttagctggactgttcctgtctggtgtaatagtgtgaataaagattagtctgtacacatacatacaattcctcaaaatagtatcttcatataaggagagttatatttgtataaaagaacgtgtttgaaaattacaggcaatgtagcaacaattcctgaattattcttttgtttacttagcacttcagttcaaaaggctaattagttattttgtttaagctgaggaagaggggctgaggctgacatggaacccaaagtaactatctttggtttatatataggtggttaggatatatcaggcgctgtgtagccctccctttattatctcactgaattttcacaacaaccctgggaaagaggtattattatctccattttgtaagtgaaagaaacaaagagggagagaacttacttaatgtctcatgggctcatagctaactattagcaaagccaacattcaaacccaggcctaactccaaacctcacgaccgaagttgaaccaatacttattgggagatggtgcatgaggcagcagggagattcctggctcccattttccttcaagagactctgctgcaaggagcatgggtgatgaacagcctccagttgccatacctttgcatcaccacagctttcactccaagaccaagattttccagggcttctctcagcccatgtctaagcatgcgctaagaaggttgtcagaagtgaaaggctcaggcagtttatcagagaggcgggtggagatctggaaggacagtgctgtggatctcagatgcctcagagacaccagggctcccttggggtgaacccacagctagggagagatggtgccttagggagggaaagcggcatacctagatcagaaggagcttaatgtaccagattttaagaggctgttaagtgagaagggaaaccgggacccaaatgaggtatagatattgaatgaatagaagtttgtagagtaatagcaggtagaacgaattatttacattttctttttctttggtgtctcctgttttcttcttcctccttgattatctaactctaatctccttataaaaaacatactcttgtcctttttctttcatcctccagtcagcagaaaaacataccaatgaacattttatttcttttttttattatactttaagttctagggtacatgtgcacaacgtgcaggtctcttatgtattagactttatgttcgttgttctccatacagattaattgaacattaaaatttttctttctcaagaagagttaactgctcttttaacatgtatcatggccctcaattaacattctttcatagggtcatagggtcaatggtaagaagagggtacacttttcactttcatcagaggtattttcataggaaaatactggctaacaagatttatcctataaaattaaaacactagtgaaaatcaaattcacttagaaaatatctatatacaatttcacttactaaaagagctaaaataaaggctaaggtttttcttaaagcaatcaacttcaggagctacttgcaaattagtgtctgttcttttctttaccagtcattagcctgaattggtacccaagtcatgttacgagaaaataaagacttacacagaccattttaaattctgtagtctcaattaccatatatgctcttattaattgtttctaagaattcctcttcaaaatgtgtgcaagtaacgcatcatatggaaaggcaactgagttttcatatacggcttaaaaatacaaacttcagaaacacagatgttataccaaattctcacttgcttactcccagctaaactcaatctctgagctttaaaaagattttctaaactgctaaagattaaaaaaatgacattatacattcacatctggctctgtcaccatttagggcatgttaacatagattttaaacatctggggacaggggaaaagatctatcgggagcttttcactaccatgacaactgaagtgtactgttgctcaaatagttcagtctctgctcatctacatttaacaccaccacaggccttccatttttcaccacttaaaaacaacaattatcataggaaataatactcatatgtagaaagttcctagggagagtgtttctttcatttccatcctgctttaatcctgtgggtaggacagatccttcctctttgcagcaatgcagttaaaccagtttatattttctggcttttagacatggaagtccttcctatatttttgagtcactcaagagatggctcttaatgacaaagtcttaatggaaatggtgaaaataacctagcattatttttttctataaagcagcatcctttctgtgtgttcaaaatttaaccaacattctaaagagcatagaatatgggcaataaaaattataggtttcatgtgttaatgttttctgaatggcagatgtacaacatactttagacatactatttttcatttattcttcaaaactacctgtagttagtattattactttggaaaattaaactatggagagaggtacaacattcacacaaccatgtattaagtgcctatgcttgggcaagtgctgtgctaggcaacaggaatgtaatggtaaaaattacagcatgccccaccctcatggagtgtatcagtctgttctcacacggctctaaagaactacctgagactgagtaatttatgaagaaaagaagtttaattgcctcacagttccacacgcttaacaggaagcatggctgggagacctcaggaaacttacaatcacgtcagaaggcgaaggggaagaaagcatgtcttaccatggcagaacaggagacagagagagagagtgggggaagagctatacacttatcagataaccagatcttgtgagaactcactcactattatgagaagagcaaaggggaagtctgcccccatgagccaatcacctcccaccagggccctcctccgatacgtggggattacaattcaagatgggatttgggtggggacgcagagccaaatgatatcatggagcctaccatccatggccaagaaagggaaacaaagggccactgacaggtgggaatggaatctaaatctgacttcaaagcaaaaaccaaaacatcaggtctgactgacttctaaaccaaaagccttgaagtcacctttgactcacctcttcctgtcacacacaatacatccaatccatcagcaaatcaggctagctctggcacaaaatcaatccagattacaaccacatctaaccacccaggtcaaaatcacaaccatctctcacctggattattacctccattcctaactaatctctccatctctagccctttctctatttattctgttctcaagagacagccatctgggtcttgctaaaatgttttgtcagacatgtcactcttctgctcaaaaccctgcaaagtctcccatctcactcagagaaaaagctgagtccttacatcagcctgcagggccctatacaatgtactgggtcactgtatctcccactgctcactttcttgctcactcttttctggcccacagtcttctctattgttcctcaaacatatctggcctcttctcatatcaggagtctgtacttgctgttccctctgcctagaactctcatcccttccgaatggtaccagcttagcaaggcctatcctgcccatatttatgacagcaagcctcctccagcatgccctattctcccttccctgcctcatcactctctgcagtacaaatcaccatctgacatacactttacatgttgaaattgttcactggctgcctcttgtgtctcccggctctacagagctgactgtgctcatctcttcccagctcccatccattgataccatattgctagcctgaaatcagctgtgatcagcaaacactacaaaataggcctttaaagaaaaaaaaaaaagacagccaaattagtgtatagcactctcctcctaagaacacatagccccctccaacaagaaaatatgctgcatgaagcagagtttttgtccattttgctccatgctttctccacagaaccttagtgcttggcacatcataggaacaagataaatgtttgttaaatgagtgaacatttctcctatcctcaagcagattgaaagtactagtatcagaactccaaaccttcattttcagaactgctctaagcatgttctgtggtttagaaagcgtggccattttcctgaacctactccatctgttcctaacgggggctcctctccacttgcatggtctatgggcagaagacacaaggattgccagtgccctccagtctctgcacatgcctctaactcacagacggcaaagcagtaaattgggaaaagcctgacaaaactgttttttcatttttattgtaacttgttaaaacaaatattaaactacagatgatacagtgtgctatgttcaaaactgtagaaaaatgtgtgttaaaactatgggtcatgtttaagaagacccctttaaaaacacgttgtttagaaagtaaaaattttttttaggatccaaggagcagtttaacagaggctctaaaggaaagagcaaactgataaggatctgcagaggaaacatgttattctgtcacatacatggaggataactctttggtaagtaaaagagaaagaatgtcactgacccacgtaaatgtgttaacagtgccttaattcaattgaagtgggaattctagaatgttcgtgagcttggtgaacatgatggagggaagaggtctgaattctgtggtgcaggtgggagagtctgtgattaagataacaatcaaagtattgaactaggagaaaagagggaagaggtttaatagaaccctccaccaatcatgcttccttcaggaacacaaaattggacaactattcacacccaaaaagcacctttaaaagaaccaaaaatcacagtacctggttttaaatttatatcactgaaagaggcactgaagaggatataaaagacaatattgaattcctgatgccaccccttcctcattccatggcagtacatcccaccatcgctgcactctccctcccctaaacacacttgggaaagggagagtgcagtgatagtgggactttgcattgaaactcagtgctgccctgtcacagaggaaagcaacactaggcagaactcaactggcacctacagagggagcatttagaccagccctaaccagagaaaaatcattcaccccagtggtcagaacttgagttccagcaagcctcatcactgcagactaaagtgctctacagatctcaataaacttgaaggcagtctaggctaaaaggactacaattcctgggcaagttctggtgctttgttgggccaaaagtcagtggacttgagatgcatatgacctagtaagacaccagccagggcagccaaaggagtgcgagtaccgcccctccaccaaccccaggcagcacagctcacagctctgggaaagactccttacttctgcttgagatgagaataaggaagagtaaagactttgcaagtccaagttcaggacttgcaacttggatactagctcagccacagtagacaagggcaccaggcaaagtcctgaggcccccattccaggccctagcacctgaatgacatttctagacacattctgggccagaagaaaaggacccaatcttgggtaattcatcacatgctgactaaagagcactttgaccctgaataatcagcagtaggacccaggcactactcactgtgagctttgggtaagactcagagacatgctggcttcaggtgtgacccagcatattgccagctgaagtggctatggggaaggaccccttacgcttgagaaaaggaaagggaagagtaaaggagactttgtcttacagtttaggaaccagctccgtcacagtggcacagtgggatagagcatcatgctggctcttgtggttctcaattccaggtgttgactcttgcacggcatttctggaccagcactggccagagagaagttcactgccctgaagggagagttctaggctggctgtatccaccacaagttgaacgaagagcccttgggtcttgaaggaacaatggtggtagccaggcagtactcactgcagacttggggcagtggtaaccatgaggagagactcctctgctggtggaaaggagagggaagattcaggaggactttcccttgtggcttgggtgccagcttagctacagtagaatagagaatcaggtagattattaaggtttccaactctaggccctggctccaggacagcatctctaacctgggggggatctttctgccctaacaggaagaacacaaacttggctggctttaccacctgctgattgtagagccctaaggccttgagtgaacacaagtggtatccaggcactggttaccgcaggccttcggcaagacccagtgctgtgctggcttcaggtctcacacagcacaatcccaataatggtggccacagggatgcttatgtcacccctcttccagctccaggcagctcagcattgagagagagactctgtttgtctgggagaaagtaagggaagagaagaagagtctctgcctggtaatccagagaattcttccagatcttatccaagaccaacaaggtgatagctctctgagtctgcaagcgtcacagcttgggcttgggttaccctctaatgcagatatggctgcaaggaccaaaaacttataacactaacatcttttcaaatacctggaaaaccttcccaagaaagacgggtacaaacaagcccagactatgaggactacaataaacacctaactcttcaatgacaagactggacgaatacccacaagcattaagaccatccagaaaaacatgacctcaccaaatgaattaaataaggcaccagggttatatccaggggagagagagctatgtgactattcagacaaagaattcaaaacatctgatttaaggaaagtcaatgaaattcaagatagcacagagaaggaatttagaatactgtctaattaatttaacaaagagactgaaataattaaaaagaatcaagaagaaattctggagctgaaaaatgcagttgacacactgaagaatacattatagtctcttaacagcagcattgatcaagcagaagaaagaattagtgaccttggagacagacttattgggaaatacacaaaggagacaaaagaaaaaagaatcgaaaagaatgaagcatgcctacaaggtctggaaaatagcctcaaaagccaaaagcacaaacctaagagtcattggccttaaagaagaggtagagagaaagagagataggggtagcaagtttatccaaagggataataacacagaactttccaaacctaaagaaagatatcaatattcaagtacaagaaggttacagaacaccaagcagatgtaaccaagataaggtgaccaagacatttactaatcaaactcccaaacgtcagggataaggaaaggattctaaaagcatcaagaggaaagaaataacatataatggagctccaatacgtctgctggcaaacttctcagtggaaactttataggccagaagagtgtgaaatgacatatttaaagtgcttacagaaaaaaacttcttatcctagaatagtatatccagtgaaaatatccttcaaataggaaggagaaataaaggagaaataaactatacaaacacatggaaattagacaataagctcctaaatgactagtgggccaatgaagaattatgaaggaaatttaaaaatttattgaaacaaataatatttttagaggaataattttattgtagaagagtcttatgtaagcataagagcaaagaaagatcccaccaaataaataagcattatatatgattacataaaacataacatttcaaaatacatgcacacacacacatcacaatatacatgacagagaaaagactaatatctttactatatgaggatattttataaataataaaaaaggtaaatacatcaatagatcaatagaaaacctggcaaaagatataaacaggcaactcactgaagaagagctagaaataatatatggtaaaatggatggcaaatatatgaaataattttaaaaccttatttgtgatcaaatgaaaatttcaataattccaacacatttatcatatgatatatatacacacaatttccacatttatcttataaaactggccaacatttttatttttaatgaatatgcccagcacttaataaaaatgtaggaaaatgaacattcatgccagctcatggaaatataaattggactaaccattctaatccacaatttgacaataaatataaaagccttaaaatgtattctgtatgaagtaggatatacgttaggatatcagattctcctagggataataccaagggtttgaggagatgatattcactacagcatcatatgtaactgaaaaaaaaggatagggcaatctaagtatccagtagccaaaatgtccaaaccaatcatgaaatatgtgcacaggattggaataatatgaagatgacacaaattaagtagtagacaaacacagtgaactatggaaacaattgacagtgtatttctaagggaaaaagtatcaaaaagtacatgctatcattcatttagccaacacatcgagtgctgaacttaattatataaataataacagcttatgtgtatatgtaaagaaaatacagaacagacataaggataataatattacctttaagtgttgaatattataatgaagatgatggaaatcatccatcatctcactattgttcactgtaataaacgtgtaagactttggaaatcagaaagtaacaagttataaggaagttataaggtgtcatgctttaccatatcttacttttttaaacatgccatgctctttcaatatgtcatgctatattgtcatgcttttccccataagttataatatgtcatgctttttattttgcaaaatcccttctcctaagagtttaataataatgataccaatgggatggcaaaatggttccagctgcttttttttccttttatttattttatttatttatttattttattattattatactttaagttttaggatacatgtacacaatgtgcaggttagttacatatgtatagatgtgccatgctggtgtgctgcacccattaactcgtcattcagcattaggtatatctcctaatgctatccctcccccctccccccaccccacaacaggccctggtgtgtgatgttccccttcttgtgtccatgtgttctcattgttcaattcccacctatgagtgagaatatgcggtgtttggttttttgttcttgcaatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgctgcaataaacattcgtgtgcatgtgtctttatagcagcatgatttatagtcctttgggtatatacccagtaatgggatggctgggtcaaatggtatttctagttctagatccctgaggaattgccacactgacttccacaatggttgaactagtttacagtcccaccaatagtgtaaaagtgttcctatttctccacatcctctccagcacctgttgtttcctgacttcttaatgatcgccattctaactggtgtgagatggtatctcattgtggttttgatttgcacttctctgatggccagtgatggcgagcattttttcatgtgttttttggctgcataaatgtcttcttttgagaagtgtctgttcacgtcctttgcccaccttttgatggggttgtttttttcttgtaaatttgtttgagttcattgtagattctggatattagccctttgtcagatgagtaggttgcgaaaattttctcccattttgtgggttgcctgttcactctgatggtagtattgaaacaaataataaaagaaaaacaatacaccaaaacctcttggatacagcaaaagcagtactaaaaaatttttccccattcagtgcaatactagctgttggttggttatgacttttattgtattgaggtatattccttaatacctagatttttgagggtttttaacatgaagtgatgttgaactttatcaaatgcttattcagcatcaattgaaatgatcatatagtttttatccttcattctgttcatacgatgtgtcacattgattcatttgcctatgttgaactatctttacatcctggggataaatcccacttggtcatgatgaatgatcaagtttataagatctggaacatgacatcaatgcccactttcaccactgttattcaacacaactggaagtcctagccaaagcaatcagacaagaaaaagaaataaagggaatccaaattaggggggaataagtcaaattttttggttgcagatgatctgatatttggaaaaacctcaagactttaccaaaacactattagaaatgataaatttcagtaaagttgaagaatacaaaattaacattcaatgatcagtagtgtttctatatgccaacagcaaacaatctgaaaaagaaatctagaaagtaatcccatttacaacagctacagataaaatgaaatccacagaaattgtgtatttcacaaaaatgtgaaagatatctacaatgaaataaaatacataaaaatatgtattttacaaaaatatctacaatgaaaataataaaatactgatggaagaaattgaagagaacacaaaaaatggaaagatatttcatgtgcatgggctggaagaatcaatatggttaaaatgtccatactacacaaagcaatctacagattcaatgtaatccctgtcaaaataccaatgacattcttcacaaaaataggaaaaacaatcctaaaatttatatggaaccacaaaagatccaaaatagccaaagctataccaagcaaaaagaacaaaagtaaaagaatcacattatctgacttcaaattatactatagagttataataaccaaacagcatggtactggtataaaaacagacacatacaccaacagaacagaatagagaacccagaaacaaatccatacatctacagtaaacttttgacaaagatgtcaagaacataccttaggggaaagtacagtctcttcaataaatggtgctggaacaactggatatccatatacagaagaatgaaactagacccctattgctcatcatatacaaaaatcaaataacaatggattaaagactaaaatctaagagctcaaactgtgaaactactacaagaaaacactggggaaattcttcaggacattggactgggcaaagacttcttgagtaataccctataagcacaggcaaccaaagcaaaaatgaagaaataggatcacatcaagttaaaaagcttctgcacagcaaaggaaacaatcaacaaagtgaagagataacccaaagaatgggagaaaatatttgcaaactatctatctgacaagggattaataaccagaatacagaaggagctcaaacaactctctaggaagaaatctaataatccaattaaaaaatgggcaaaagatctgaatagacacttctcaaaagaagacatgccaatggcaaacatgtatatgaaaaagattctcaatatcattgaccatcagagaaatgcaaatcaaaagtactatgagatatcatgtcaccccagttaaaatgtcttttagccaaaagtcaggcaatagtagatgtttgcaaggatgtgaaaaaaagggaacacttgcacactgtttttaggaatgtaaattagtataaccactagggagaacaatttgggggctcctcaaaaaactaaaaatagaactaccatacgatttagcaatgccactgtgagttatatacccaaaagaaaggaaatcagtatttcaaagagatatctgcactctcatgtttattgcagcactattcgcaatagccatggtttggaagccctcaacagacaaatggataaagaaaatggggtacatctacacaaggagatactattcagccataagaaatgagatcctgtcatctgcaacaaaaatggatgcaaaggaggtcgttatattaggtgaaataagccaggaatggaaagacaaacttctcatgttcttacttatttgtgggagctaaaaattaaaacaattgtactaattgatatagagagtagaacaatgatcaccagagactgggaagaatagtaggagcagggggaaggggagtagttaatgggtacaaaaatataattagatagaatgaataagatctagtatttgatggcagggcatggtggctcaggcctgtagtcccagaactttgggaggctgaagtgggcgaatcattgagcacaggagttcgagaccagcctgggccacatgggaaaaccccatctctactaaaaaaaatagaaaaattagccgggtatggtggcatgtgcctgtagtcccagctacttagggggagtaccgcttgagcccaggaggcagaggttgcagtgagctgagatagtgccactgtgctccagcctgggtgacagagcgagaccctgtctcaaaaaatacatatatatccagtatttgacagcacaatagagtgactacagtcaacaataatttattatacattaaaaaataactaagaggataattggattgttcgtaacaaagaaatgataaatgcttgaagagatggataccccatttaccctgatgtgattattatgcattgtatgcatgtatcaaaatatttcatgtaccccttaaatgtgtacacttgctacgtaaccacaaaaattaaaaattaaaaaaaaaatcacagagtattggattaggccaaaagtgtgcatacagagtttgtgcttattgtgcatagagtttccttctttattaatgaagctttctgtttttcctttctttagagttatcaatataccctaagtaatttatttgtaaccgcatagtttgttggtaaaaagttccctacaattttccttattttcaaatattaccaatggcagtaagttaacacattcatgggagcaaagctacaaaaatgttaagtctggccatatagaaaaccctggcttgatgtgtgtttagtgcttaaaaatccccaaatatatgagatacattattacatatcatctgaccaacaattttgtagagcaaatattgcaaatcctgaatattataatactcattatatgcatgtagataagtataaaaactgaagctcacagaggttactgctcaccaattagggcaagtacagttgctgaagtcccagcctgcagactcaagaccctactgctctttctaatgcatgatgctgattctcttgaaggtaagtttggaatcttcagaggtatgtgttaggcatgggtagatataaggattctctgataaaacctctggtagagacatcctgtgaaatgtctgtggtctttgtctctgggtaatatctgtctaatcctctcttgagctcagggagttgcaatggcttaaggctggaagcaccaagtcactgagcagagaaacatccaggaacaggcatgcatgtatgatgcagaatggctgggaatcattccatcatgtgacaccactttacgatatcttcctttgttatgtgttcctgaaaaatactttagaaacatatcctcttcactaaagacatttcagtaattgactccttaattcaataaatgaaagcatcattattttgaggtctaagaatgggtacgagcatggggagggcaaagtgtcatttctggttgaatttcctgagaataagaacaccggactttaaacaatatgatatgactttttccccgaaactgaagttatttctatcctatttaatgtcacatatattttaactattatgtaaaaaacattgtgttagatgtcaaaggatataaagatgactgagatcatttcttccctcaaggaatcgccaatccaatgaaaagatgaaactcatctttctagaatacattttcccgtgtttatctttgaaagagtacactgaatattatacaacttcttcttgatgactgagggacatcattccaagccagctgatgttctgggccacaacaataagcacagctgcagctagaaatgagtgtgacaggagctcagggctactggtcataggagttaaccaagaactgccttctgccatctcaaattgggtggatgaggggctggatagataacagatataaataccctgatgtcatgattgctttttggtcttttccctttttcctcccatcctatatatgaaccaaagacctgcttcatgactaatgtgctttgaaccagcacaaaaccgccattagccatcagtgaggtatacaggtagcaacagctgaagacctttcctgtcgggcaccctgcagagtgtccaggtctgacctaaatgttactccttattgctgggcctcctctaacgtcagtgtcagctacccacctcctttcatcacttgaatttctaaaccaactggcatcaccccttctaagctctgccagttattctgctattcagaactctccgttctcaaattacaatgtgtataaaatgtccagcacagtgcctgacacagagcaggcactcagtaagtgctagagcccctttccttgtattttatagtctaatctttgatctgacatttttcctgtctctgtgtctttttacgatcaggtggatatacataggtacttctttatggttagcaaaccaaaaaatcacaatccattactttctatttgtatgtatctgtgaatgaagctttttttccttttacccctgcataagatacttcttaggttatctacaccttaataactcatttgcaactgtatagatagcttaaaggttcttttttattttcataaattttctccacccagtggttataatttaataaagtagtcactgtggctgtatttatattttgtaagtaatttatgttttggtacaatgaataattctggatgtgagttatgtgactgtgaatatacagtttgagctttctagaatctcttcactaccattctgatgctgcctcctctcatctaatgacaacaacctcatagaagagataaaagtctaagattcaaatctaaaaggcaaagcaattataaagtatagcacatgtagcatctaattatttttccacatataatgtcacacatgcaattggaaaaatgttcttttgttatttgtaacataaaccatgtcattttattttattttcacttccttgcagactctcattaaagcttgcacacatattattattccattgaaaagtaataacttcattattatggcataacaattaatgtaaggtgtatcaacacaaatatttaaaaggaccattacaaaagtaagaaaaacattaatctactactagggacttacttcattcatgtaagaaatttttccatcttctgtccatctggagaagagcaagataaattaatctttggttccaaacatttttagagttgttttatcaggaaataacttcctattttcccaagttttgaaattttgcaccttctcataagtataaaagaatctcagcatttcactttgacccatttcaaatttatatggcagatttccaaatgctgggaattgcaaagtgcctgttcttagcacatgatatctaccatctgccctggccatcaggatagggtccagatagttctccaacataatattgtaaagtcaaagtgctcttggcatttatgtaatatttttgcaacattttgcaggtgataaataaattgtaactttttcaaactgggactcatctaattacatgcatgggagcacttttcttgtgctgtgtattcaactgtgtatgcttgtacctgctcattcatcctccacacccaccccacacaatctgtccaactgagatttgatcatgtgaatgctgagaaaggctaaaggtttggtacccattcaaaatgatatttttaaagtacttattcaacatttattagatggagttggggaaaacttattttccattaagaaaagtatgtctctctttatgcttagttaacgaacaggattagttcacgcactaaatgaacatatcacttttatttgggtcagtctttcatttcacaattttgtggtttctcattaagggacagcattagttattcatattcaggagggcagaggtaactctcacagatatggttacaaagttacaaaatagatttcaaagttcttttatttactttcatgttgttaaaacatttcccatagttttttttttttttcagttcagttttatgacttaccgatccaggaaaatgcttggaaagcacagtaacaacttttaaacttaatattaaaaacaaataaaattgctcattgccaataaatatacctatgtaaaatactactcagtgtaagaatttcaactgacagtgacctgtcaaattcaggcaattctaaaataggatggtggtggttacactgtgcaaaatattcaatagagagagttcaggaatgccaataattttttgttattattatcaaaacattcaataaagatagttcaataatggcagcaactcttactgttatctccctcctatcccaccttgggggccttgtaataaattttgcttgcaaattgcctaagtgttatatgtggaaagctaagttaacaggtgtcatgtttcccatttataccactgatgttccaatgcaaggtgcccggggaaactgccatcccttaatccagctctgctcacccagacatacacatatacccatcaatccatctgttaggcattaagaattacaatagtataaagaacaatcctttggtgtacatatttaaatgttaaatatatactgaagggtttgaagcaaggatctggcaaacacgactgcatcacacatttggttcagccctgtctggatgtcagaatgcatccgtcattttggatttatgtataatgacagaaatcaagtcacgacccatgtagtctcaaaaggctacttagatgatgatgaagatccacaatactccctgaagtactgctgattcttcaactccattaagaatatacatctctgacattttaaatatcttaagtcagtgattttggccatctaggaaaaacaatgttgcagcatgtaatttaggtaatttcaacagagccagttcaatcttaaatcattatttctaatgcattctggcaatactttttttgtaaagtgaaattatacaacacttccagaaaccacagaatgtgacttaacaaccaattacttgtacagtttgcaaaacaagtaaacctcccagcagctgggagcttggctgagaggcctaggcttgcccttggcatggtaccttgctcttttctatgagttcacattgctttctagcctgctaatgcactggccttatgaacacagattccctaaatgctctccaagagtctgatatcacattcagggttaacacattttttcccttgttgcaattcagcagttttttacagtcattcatatccaaccaattgctgtcaacaggcatcttcacatatgaatgttaatagcatattattaaagagttcctggtaatttgttttgtgggtagagttgatgaggggtgactataggaagggaagccaaaggaaaaacatttcaactactctggaagctgacctctggaaagcagtcagagagaacagatgaaggagccaggcaagctctttttgaataagatggtgtgtattacagctaggaagagccaacagagtagatctcacagtgaccagcccagctaacagcagttgaaattgttagtcatgaaaatacagatgccccctgtatggattaccctcatattttctcagtcactagtttgagagtatcatatttgagagacagagtttttcttgataattgagaaagatcaaaaagggaactgaattttcattggcaaaaagactacataaatagaagcaacatctttgttggtgcctacttgtcatcagctagaaaggtccgattttttttgcaaaaaccttaggaacaggattcagggtaccttccaaaagcgaaaagtaaaggcagacttcagggctcctagaaagtttacatccaagaattccctataatgtaaacttgaaaattaatgctttttcctccacaagaacttgtttcaaaaagttagtctggtaactcattctcataaattgttcttagtatttttcttgcagattttcatgatatggttcccaaaataaatcagtagcaagcattatgatctgtgccttccacttcagcatagtactttgctccataaacataatataatgaacatttatgtatcactacctttcttacttttctttactcacttcatcatatcaacaaaatgtatttgatacacagttgcaaataaatattaagctttacattttgtaataaatatttctgagtaataaaaatgttccaactgatcaaaaaatttgatatttgatgatggcatttgaagagatgcatgtttattagctcaatttagccatttcacattgtatacatttttttaaaacgttgtacatgataaacacatacaatttttatcaattataaaaaattttgagtgttatatttgagtgataacaaatttagatgagttaacagaatacatacatacctccttaataaattttattgtttactagtccatcttcaaaagttcatcatattaactacagtcagaaattggttcccaaagttcattatatttattacagtcaaaaacagtttctaggaagtctattgtatttatacaattaaaaatgactcaactattgggtacaaggtttcttttaggatggtgaaaatgttctaaaatgatggttgtacaacctgaacgtaaatgaaaaaattatgtactgctgaactgtacactttaaatgagtgaattttatggtatgtaaattatatcccaataaagctatttttaaaatgggtcaatcaaggacactaagagttgtttatttgaaaagttcaaaaaaattgacaaaccattagctagatcaagaaaaaactcaaatcaaatcagaaatgaaagaggagggattataactgatgccacagaaattaaaaggataagaggctactatgaaaaattatatgccaacaaattagataatccaaaagaaatggattaattcctagaaacatacaacctaccaagactgaaccataaatagaaggtcttaacagacctataagtagtaagaagattaaatctactaaaataccaaaaattagccgggcatggtggtaggtgcctgtagtcccagctactcgggaggctgaggcacaataatcgcttgagccccggaggcggaggttgcagtgagccgccgagatcatgccactgcattccagcttgggctacaaaataagactctctcaaaaaaaaaataaataaataaataaaggaggtatatctcattttacccatttcattccacaataatgaaaaataaaagtgtcagctgtcctaggaatgcagaatataaaaggtggggcaacagggcatgtggtgctttccttagtttactttgacaataaaaactcctatctctgttgctgctggaatagcatttattggaaatcagcctctcaacagtcctcacccatcaggaacaggaatctgccattagcttgacagcatacagagcaccatatcagggttactatgggaagactctattgtggcatcagaaacacaaaaaacactggatacagttagtttctgttgacagtttcagaagaaaatcccacagattggacaggctgcctgctgaaagggttgtcactacacacagcatgccctgaaccctggaatgaagttacccctatctgtgtgatcaggaactgaacaactctgaggctctttttctaagctcttagattcctgcaagaacctcacacttacctcctcacctggctttggacctcaagctaaaagtgcaaacagtctgcctactttccccataaacatttccccaaaataaagggcttttttttttttttttagcacttgcttacttgtgttctcactttctctgtcttcctctccctccctccttctctccctgctcactgtcatcagctgggtcccaatccagtttctacacctacattcatgactaatgacccaccagcagcccctaagagccactaggctgtaatgaacattttcctaccagttacatgtggtaggtctgggaggagccccccatttccaatgagggtatgttaaatacagttagaatgatgcgggatgtggactctggagccttgctacatacaaaatgtggtctgaggaccagcaacaaggcatcatgtgagaacttgctaagtatgcagaaccttagaccccaccccagaactactgaatcagaacatgcattttaacaagatctcttggtgatctgaatgtacattaaagtttgaggagccttggtataaaatttgaatatattttgagagaagactgtggaatttggtgggggatggggaagtggtaggattcttatgtacagggctatttacagagaaaacaaataacattcattaaatactgaataatttactttctttaaaataagaggaataaataaatccaattactatatgtatagggccttgagacatcagtgagcttaaggaatcttcagcagtaaggcttaaatacctattcttattctttgtattttaataaatctgtttgcataagagctttaaattgtatcagtgacaagtaggtatgttttcataatggaataatagtgagcaataacgccccccaaaagaggcggagcaaggcataagtaaacaaaatgtatgtgtgtcgcatacatttcaacaggtgaatccagcatggcatgatggaaacttaagttccggggcccacacaggccccttccaaggaccaggaactaactttgcattcaaaattttgttctctcttcttacagacagcctcaaaaattacataatcttaaaacttcacaaaacctggaaccatgcctgatctaattaatcatgaaaactcttcttaagtttattattattattataatactttaagttctgggatacatgtgcatagaacgtgcagttttgttacataggtatacacgtgctatggtggtttgctgcacccatcaatccgtcatatgcatcaggcatttctcctaatgctatccctcccctagcccctcaccccccgacaggccctggtgtgtgatgttcccctccctgtgtccatgtgttctctttgttcaactcccacttatgagtgaggacatgcggtgttcagttttctgttcctgtgttagtttgctgagaatgatggtttccagctacatccatgtccctgcaaagtacatgaactcgtcctttttttgtggctgcatagtattccagggtgtatatgtgccacattttctttatccagtctatcactgataggcatttgggttggttccaagcctttgctattgtgaacagtgctgcaataaacatacgtgtgcttgtgtctttaagtttgacattatatatatatatctatatagatagatatctatagatctatagatatctatctatctagatatctatatagatagatatctatctatctatctatctatctatctatatatatatatatatattttttttttttttttaggacggagtcttactctgttgcccaggctggagtgcagtggtgtgatctcggctcactggaacctctaactcctgggttcaagcaatcctcccacctcagcctcccaagtagctgggagtacaggtgccgccaccacacctggttaatttttgtatttttagtagagatggggtttcgccatgttggccaggctggtctaaaactcctgatctcaggtgatcctcccgcctcagcctcccaaagtgctggggttacagacacgagccaccatacccagccgacatataatatttttaaatcctttcaatacactgggaaacatttagaattatatcactatcattcaaactacaaatgaaaataacaatttaattgacacatgacctaggaataattctgctcatgtgtaagaaaaactgtttgtaatgatatggttcatatcttactcttctttccatgttatcatttaacatgattaaatttaacaaatatatcgtttgttgacatttctctctcttcccttcttcttttcctcctattttaacttaaaaacctaactactgcagaggtggggaggtactagaggaaatatccaaaaatgttcctcaggaatttttgtttaattttgttttattattttcctcaggtttgaaactcatatctacttacattttttaaagaatgcaaaaggtaaaacaagtaaacacacacacacacatatacatacatacacatattaaaaagataaattctggtgacattttagtgactagtatttcaaactatttaggtaagatgttaacagtgtggttttgagagttacatgtgagtgtatgtatgaacatatacataactgtatgagagagagatctagaaattgctgtcctgcccaccaaaccactgatacacctttttcatacagttaaagtagctgtgcctcatcatgagctagaatgtattccgtatgtatggttatcaatataaacaatctgccaatgctgggcattccgtgtgtttctgattttcattttataaatgaagctgctatggatatccttatgcacgctccctcttgctctttccttattttgtcctgaggacaaatccctgttatgaaaattgcgggataaaactttggaacacaataccagtgtgccttctgaagagtttcatcaatttacagtacaatcaaaagacaatttcacttttaaaacatcatttgctaatttgagagacaaaaaagtctgtttttgtttatatgcttactttttaaacttttaaagtaaaatacacatacagaatagcacacagcttgatgagttgctgttaatttattcctttttatggctgcatagtattccatggtttatatataccacggtttctttatccacttgttgactgacaggtatttgggctggttccacaatttcgcaattgtgaattgtgccactataaacatgcatgtgcaagtgtctttttcaaataatgacttcttttcctctgggtagatacccagtagtgggattgctggatcaaatggtagttctacttctagttctttaaggaatctccacactgttttccatagcagctatgctagtttacattcccacaagaagtgtagaagtgttccctgttcactgcatccacgtcaacatctactggtttgttgttgttgttgttgttgttgttatggccattcttgcaggaatgagctggtatcccattgtggttttgatttacattcccctgctcattagtgatgttaggcattttttcatgtttcttggccatttgtatatcttcttttgagaattgtctattcatgtccttagcccactttttgatgggactgattttttcttattgttgagttcgttgtagattctggacatttgtcagaatgtatagactgtgaagtcctttgtcagatgtatagactgtgaagattttctcccactctgtggtttgtgtgtttactttgctaactgttccttttgtcatgcaaaagctcttcagtttaattaggtcccagctatttatctttgtttttattgatttgcttttgagttttggtcatgaaatccttgcctaaaccaatgtctagaagggtttttccaatgttatcttgtagaatttttatagtttcaggtatcaggtttaagtccttagtccatcttgagttttgtataaggtgagagatgaggaaccagtttcattctcctacatgtggctagccaattatcccagcaccatttgttgaaaagggtgtcctttccccactttatgtttttgtttgccttgtcaaagatcagttggctgttaagtatttgggtttatttctgggttctctattctgtttcattggtctatgtgcctatttttgtaccagtacaacactgttttggtgactatggccttatagtttgaaatcagatagtgtgatgcctccagatttgttctttttgcttagtcttgatttggttatgagggctctttttttggttccatatgaattctagaattgttttttctaattctgtgaagaatgatggtggtattttgatgggaattgcattgaatttgtagattgcttttggcagtatggtcattattcacaacattgattctactcatccatgaacatggaatgtgtttccatttgttcgtgtcatctattatttctttcagccatgttttgtagttttccttgtagaagtctttcaactccttggttaggtatagtcctaaattttttttttttttttttttgcagctattgtaaaagtggttgagttcttgatttgattttctagccactgttggtgtatggaagaactactgatttgtgtatattaatcttgtatctggaaacttcgctggattcttttatcagttctagaacctttctggaggagtccttagggttttcaaggtaaacaatcatatcatcagcaaacagtgacagtttgacttcttctttactgatttggatgccctttatttctttctcttgtctgattgctctggctaggacttccagtactatgttgaagagtggtggtgagagtgggcatccttgtcttgttctcatcttgtcagattctcagagagaatgctttcaagttttccccattcagtgttatgttggctgtgggtacgtcttagatggcttttattacattaaggtatgccccttgtatgctgattttgctgagaattctaatcataaaggggtgctggatttttttcaaatgcttttttttgcatctatttaaatgatcatgtaatttttgtcttaaattatgtttatgtggtgtatcacatttattgacttgtgtatgttaaaccatccctgcatccctggtatgaaacccacttgatgatggtggattatcttttcgatatgttgttggattcagttagctggtattttgttaaggattttggcatctatgttcatcaaggatatcggtctgtagttttcttttttggctatattctttcttggttttggtattagggtgatgctggcttcacagaatgaattagggagggttccttctttctctatcttgtgaaatagtgtcaaaaggattgggtatcaattcttctttgaatgcctggtagaattctgctgtgaatcgctctggtcctgggcttttttgttgttggtaatcttttaattacaatttgaatctcactgcttgctattggtctgttcagggtatctaactcttcctgatttaagctaggagggttgtatttttccaggaatttatccatctcttctaattttctagtttatgtgtgtaaaggtgttcacagtagccttgaatgatcttttgtatttctgtggtgtcagttgtaatatctcctgtttcctttcttagtgaggttatttggattttctctcttttcttgattaatcttgccaatggtctatcaactttatttatcttttcaaagaaccggcttttttttcctttatcttttatatttttttggtttctatttcatttaattctgctctgatcttggttatttcctttcttctgctgggtttgagcttggtttgttcttgtttctctagttccttaaagtatgaccttagaatgtcagtttgtgctctttcagtctttttgatgtaggggttttgggttatgctttccttttagcactgcttttgctgtatcccaaaggttttgataggttgtgtcattactgtcgttcagtttgaagaatttttaaatttccatcttgattttgtttctgacccaatgctcattcaggagctggttatttaatttccatgtatttgcatggttttgaaggttccttttggagttgatttccagttttattccactgtggtctgacagagtgcttgatataatttcgattttcttaaatttattaaggctcattttatggcctatcatatggtttaccttgaagaaagttccatgcactgttgaatagaatgtgtattctgcggttgtcggatgaacttttctgtatatatctgttaagtccatttattccaaggtatagtttaaatccattgtttctttgttgactttctgtcttgatgacctgcctagtgctgtcagtggagtattgaagtcccacactattattgtgttgttgtctatctcatttcttaggtctattagtcatagttttataaacttgggagctccagtgttaggtgcatgtatgtttaggattgtgatattttcctgttgaacaaggacttttaccattatataacatctctgtctcttttaactgttgttgctttaaagtttgttttgtcttatgtaagaattgctaccccagctcgtttttggtgtccatttgcatgaaatgcctttttccactcctttacttaagtttatgtgagtccttatgtgcgaggtgagtctcctgaaggcagcagatggttggtgagttcttatccattctgtggttctttcaagtggagcatttaggccatttatattcaatgttagtattgagatgtgaggtaccattgaattcatcatgctatctgttgcctgtgtactttgtttcgttttgtttttttgctttttaacttgtatttttgttttataggtcctgtgtgatttatgctttaaagaggtcctgttttgatgtgtttccagaatttgtttcaagatttagaggtccttttagcagttcctgtagtggtggtttggtaatggcaaattatttcagcatttgtttgtctgaaaaagactgtatctttccttcatatataatgcttagtttcactggatataaaattcttggctgataattgttttgtttgagaaggctgaagatagggtcccaatcccgtctagcttgtaaggtttctgctgagaaatctgctgttaatctgataggttttcctttataggttacctggtgctcctgtctcacagctcttaagattcgttccttcatcttaactttggataacctgatgacaatgtgcctagatgaatatctgtttgcaataaatttcctgggtgttctttgtgcttcttgtttttggatgtgtaggtctctagcaaggccagggaagtcttcttcaattattcccccgaatatgttttccaagatcttagaattctcttcttcctcaggaagaccaattattctcaggtttggtcatttaacataaccccagacttcttggatgctctgttcctattttcttattcttttttctttgtctttgttggattgggttaattcgaagaccctgtcttcgagctgtgagtttctttcttctacttgttcaattctattgctgagactttccagagcaaaaatgtgtccaaagcttcctgaatctttgattttgttttcctttaagctatctagttccttgaatattcctcccttcacttcttctatcatgttttggatttccttgcattgggcttcacctttctctggtccctccctaattagctttataactaacctcctgaattctttttcaggtaagtcagggatttctttttggtttggatccattgctggtgaactggtgtgatatttttggggggtgtcgaagagccttgttttgtcatattaccagggttgtttttctggttccttctcatttgggtaggctctgtcagagggaaggtctagggctgaaggccattgttcagattcttttgtctcatgtggtgttcccttgatgtagtactctcccccttttcctatggatgtggcttcctgtgagccaaactgcagtaactgttgtctgtcttctgagtctagccacccagcaagtctacctggctccaggctggtaatgggggttgtctgcacagagtcctgtgatgtgaaccatctatgggtctctcagctgggataccagtgcctgttctggtggaggtggcagggatggggatcagggatgcaatggactccatgagggtccttagctttggtggtttaatggtctatttttgtgctggttagcctcctgccaggaggtagcactttccagagagcgtcagctgtggtagtatgggaaggaatgggtggtggggtggggtcctagaattcctaagattatatgccctttatcttccgctactagggtgggtagggaaggaccattaggtcggggcagggctaggcatgtctgagctcagactttccttgggagggtcttgctgaggctactttcagggatgggggtgagactcccaggtcactggagttgtctacctagaaggattatggctgcctctgctgagtcattgcaggttgtcacggaagtggggaaagtcagtagtcacaggccttacccagctcccacacaaaccgaagggccagtctcactgccaccatgcccccctcaacagccccacgtctgtttccaggcagagagcaatacgagtctgaaaacctgccccaggatacctgcctccaactacgaaagaaaagggtttggttttttgcctgcctgtggagtctgcacaccggatttgcgccctcctttgaattctggccaggaggcttctcatcccgttcaaattgttacaaagttcagctagagatgtccttctccctgtgtggttttaccccctgctcctctcctgttggatccccatggtgccaggcaggaatggcctgctaggggacccagtgagttcccagggcccttctcactgtttcctctactcctgtattttgctcagctctccaaactgactcagctccaggtaaactcggaaacttcttccacgaacagaccttcagcttctccagtgggagtgtgtgttcgggagaggatggtctcactttcacggttggggcactcaacagttttgcggggtggtatcccgggtccacttccttcagagggtgtgtgggtcctcttgggatggctggtttgctcttgcggtcgatctggagctaaaattcacagtgtgagtccccgcacactgctctgtccagagatgcaatctagtcctgcctcccatctgccatgatgatcccgctcctccttttcattgttgaacactattctatgatatgtgtatatcataatttgtttaaccatttgcccattgaaagacatcagggttttttccaatttttgagtattgtaaataaagctgctatgaatatttgtgtacaaatttttgtgtaaatgtaagtattcatttctccaagataaatgcccaggaatgccattattggtctgtatgatagttgcgtgtttagttctttatgaaactgtcaaatcatttttcagggtggctgtaccattttacattcccaccagcaatgtagggatttagttcctctgcatcttgctagcatttgatgttgtcagtagtttttattttacttattctgattcatatatagtgatactcattgtgattttaacttgcattcttgtaatgactaatgatgttcagcatctcttaataggcttattggccatctctatatactcttcagtaaaatatttctttgtgtctttttcctattttttaactgaattgttttttactgttgacttttgagagttctttatatattctagggtactagtcctttctcagatatctgctttgcaaatattttctccgaatccatagcttatattttcatctactcaccaaggtcttttgcagagcaaaatttttaattttaatgaagtgaaatttttccttgctttgatatgaagtctaagaactttttctatttttagataccaaagattttttcgtatttttccaatagttttatagttttgtgattcacattaagtccataatccatttcgaatttttacataaggtgtgctactgagaatgaagttcatttttttgcccatggatatcaaattgctccagaaccatttatttaaagagcatcttgtctctagtgaattgaatttgcacctctgtcaaaaatcatgcaaatatgcacttctgttcatatttgtgtgggtctttacctgtgttctctattttcttacagtgatatatctctatccatcaccaaccacagtcttgattactgtatctacataatctcataaaattgcctagactaagtccttccactttttaaaaattgttcaaaatattccagttcctttgccaatccacaaaggacttagaataattttgttgacatcctcaaaaaatattcttgggattttgataggaattgctaccaatatctacatatcagcttggggagaagtgacatcttccactccataaacatggtatgtctctttgtttacttaaatcctttttatttctttcatcagtattgtatagtattcagcatgcatttcttatacatgttttgttatatttatgcctaagtaactctttttagagcaattgtaaatggtatcatatttttcaatttctgtgtcaatgtgttcattgccagtatatcaaaatacaactggcttttatatgttcagcttgtatcttgcaaccttgctgagctaactccaggatttttttatagattctttgatatattctatatacacaatcatgccatctgcagataaaaactttttttcttctttctcagtctattgctttttgctccttttcttgccttttggcactctgttgaataagagtagtgagattgaatatccttgccttgttctcaatcttgaagagaaagcattcagcctttcacctttaactaaaatgttatttctaggatttttgtttttgtagactgtcatatatcgagtttaagaaatcccactattccttctttttttccaagaattttcatcataaataagtgttgaatttaatcaaatgatttttctgcatcaatcgatatgatcacgtggcttctttcctctaacctgttaatgtggtggattgcatagattgattttcaaatattgaaccagcattgcatctacaaaataaataccactaggttatggtaaacaattcttttatatactgctgaattctatttgctaatatttgctaagtatttttacttctctatttatgattgatactggtagacagttttcttttttgtactgtttttgtctggttctagtatcaaggaaatactagcttaataaaataaattggaaagcgttgcttcctttcctattttctggaagagactctgtagaattagtattaattattcttcaaacatgtgatagaattctccagtaaaacaaatagggcctggatatttctttggggggagttttaaaattataaatcatatttccttagtaattacagtactattcaaattacaaacataatattgggtgagttgtggtagcctgtgtttttcaaggaattggcccatttcttctaagttgtcaaattcatgtcagtgaattgctcacagtattatcttaatttccttttgatgtctgcagggtcttcagtgacatatacaatatatttggtgatacagtaatttatgtatcctcccttttttgtcagtcttgctagaagctaattgatctttcaaataaagagcactttattccactgattttctctactatttttctgttttcaatttctttgacttctgctcttatctttatctccctttttctgcttcaagtttaacttgttttgttttagttttttggggtgataaattattaattcaagattatttcctcatttttaatgtatgaatttagtcctataaatttccctctcatcactgctttatctacctacaaattttatgttgtgtttccattttcatttagttcaatatatttttatgtccccgatactctgacccacgcattgactaaaagtatattatttagtttcaaagtgttggaaattgtcctcttatatttctgttatctctagcttgatttatttggatcagagaacatactctatacggtttcaatggccttatattaagggtttttaaaatcactcaagctattatcttttttgggatatagtccacaggcatttgaaaaaatatatatattctgctgttattgggtggactgttttataaatgtaaatttgatcctattagttgatggttttgtgagatattctatatccttactgattttctgtataactgtcctatcaacttttgagaaaggggtgttgaactctccacatataattgtagatttgcctgtttctcctttctattctatcagttttcacttcacgtattttgtagctgttgtctcgtgcattaacatttagaattgcaatatcttcctagtagattgacctttgcatcattatattatgtccagctctgtctctgacaattttctttgttctaaagtctactttatctgatattaacatagccactcttgaattccattgattaatgtttgtatatcttttctgcccttttattttcaatgtgcatatgtcattatatctgatgtttcttgtagatagcatacagttggttcatgtttttaatcaccctgacagcctccgtcttgatcgttttagactatctgcatttaatgcaattattgatatgttagggcttcagtctgttatcttttgtttttttgttctgcttttcatctctgttttttcttgtgttccaagtaagttaatcattttagaattccattttgattcacctatagtgttttaaatgtatttcttatattttaatggttgctctggttattacatatatatgtataattcagacagtctattagtatcattttatcagtttgagtgaactatagaaaccctatctactttgaagtctctttgccttcccccacttaaaatatagttgtcttaaatatttcctctgcatttatttacaacctacatcagacagggttataatttttacttcaactaccaaatatatttattaaattcaaaaggagaaggaaagcttaatgtttacccatgtttacacatgcttttgtttactgtgttctttcttcctttctaatttcccagagtcccttcttttattgtttcttttctatttagagaactttttcaaatcgcatttctagggcaggtttaaggtgactaaatcccttcgtcttccttatcctgagatggtctttatttctccttcattcctgaaggataattccactgggtttagaattatgagttgataatttttctttcagcacttgaaaaatattgtgccactttattctgggtttcattgtttctcaggagaaacacgctgtccttctaattgatttttcctgtgtcattttttttctcactttcaagaatttttcttgaatatagttttcagaagtttaattataatgcatcttagtgtaaacttttttgtgtttattctgtttggggtttcctcagcttcttgaatctgtaggtttatatcttttccaaatttgagaaattttcagccattatatcttcaggtacttttccagcactgctctctttctccttccttctgggacttcgatgccgtgaatgttagatgttttgttataatcccacaggtctgtgaggtgctgttcattatttgcttatcattattctctttactctcatcattgagattggaatttctattgttatgtcttccagttattgatgccttcctttctccccttcactatgctgttgagtctatctgctgagcatcttatttcagtttctgtattctcagttgtaaaatgttcatttagttcctcttcatatttccttggtgagactttctatttctttgctgagctttctatttttgcatttatttcaagtgtaattgctagtttaagcatttctaccatagctgctttcaaatccttttcagataattctgacagtcatcccaatgttggcagctattgactgtctcttttcatacaatttgaggtcctcctggttctttgtataaagagagattttcaattgaaagctgaacatttttatattatgctctgagaccttgaaccttatttaaaccttctgttttcactggcttttcctgaccttgctcccataggggaaggaagaatgccatctcatattgccaggtataaaggtccaggttccccacttggccttcgctgacacccaagtgggaatttattttaactgctggatatggttggggtttctagatctctctgtggcctcctcagacactgatgtgagggtagcaccatgaccactaggcaatggtaaaagtcccaagtctccattaggtctccaatatcacagccccagcaagaaggggcaggggtacataatttttgttaggtagaagtggaaatctaccatctgatactgcagcatgaatgaggagaggggacaagtcgttaccaaccagcagggatgaaagtcctcgctccctactttgtctctgatattaccccacaggagaatagttatagcctctggaaagtgaaagaaagtctagcttctgcactcaggcttccctggcacgggtaagagtggggccacaattatttctgttgtttggcaaagagattagtgtctaaaagtgttctgtcttgctgcaatgtccctttttctacatttctggctagagagagtaggcttcactgggggctttttgtctgtgcccattggtattcccagcttgctagcttcttcagtgtcaagtcttggatatgtaagataagaagacaacacagggaacttaccaccaggttattcctctgggtctcatgtccttaaccagtctactt

SEQ ID NO: 1506 - DNA, 573452 bp, Homo sapiens
tttctttttctttttctttttttttttttttttttttttactaaaacagaaagactttcaggaaaatgtcatttaatgatttcagctatacattacatatacaactctgtagcctagcaacaatcattgctacaccatcattaactttaaatattttgcttggtgagctattctcaaatgtagcacattttaagattttgccatcattatgactgtggaatcattgtttggttttcataggaaacagatctgtcacagtatgaagctttgtttattttaagaaactggtacacaattacatttccacttacaagagaacgccacagatataactaaaggcaggcttcgatggctccacaaaggttgcgtgctggaccaaccccacacctcctgcttccccgtcgcaccgccctggccaggttcacatggtttcatttccagagatgctttgctcttcgcagttaggtagttttaattccttcaaaggcacacagcttccatcttttttccagcgtggctcccacacccgtgaattcctgtttgaacatgcgtggcagcctcatcaaaagcatttctatttcatttgcagatatctgttagaaaggaaggaaagtcactttggggaaaggaactcatcttaaaggaggaatggattggggaaggatgagctttcccagtgatatgaacagcatttagttttctactgggctgtcagggggatgtccttatagaaggaacattcagaagtactgaatgtgattatcccacctcccgagcagctggcggggtggggcgtgggttggctgggcggaaagtgccaagttcacccttcatatggatggctaccttactggcagcaccattcctgaacagccctcccctgatataaaaggagatggggagggaatttaagagggctcccagcaaatccatcaccactcctggaaagctactagtggcttcatcctcatctatgaaggacagcaattttctttaatgctgccaggagcagaagacattcgggtggatttcttgccacccaaatttctttctcttccttaattttcacatagaccagagaccataaagcttttggaatggaatctaaactccaaaacctacaacaatacaagtcttgatatctagtcataaaattcaggtatattttttaatgcaacttttttcttctccatatttttatttgatgaatttttacaccaataattcattttaaagaacaaatcagccataatccctctgctctagcacagtgattgcttttgttgtcctgtgttagcatgccaatccatgtgtatgcatgtggattttatacagcagggcggccaatttggggtctgatattctgtttgaatatccccaaaatttggggtctgatactctgtttgaatcctgtatcttcattctcacaagttaaatgacccttacagagataattagtctctttaagcctcagcaaatggaaataacatttaataaggatagcatgaaaattactggcttaccacagatatgggcacatagaaatgttcattgaatcagagctattacactttttcatggtgtaatcactgtagagatatcattttagagtctacactttccatttaacaatattaggattcatttaaaagagacaccaaatagaccaagaagtcaaatcaactgtttatttaatattctcatggaaaagacttcatatgacacattcaatattcctgggcctataatacaaaactttagttaaatagaggcagttctgaaaattgaaatacattgtattctaaaatttttgggaattgttttgaaatctgaatgcattttctgatacacaccatattagatggatggttaaattcccaggtcaaccgacaaaagcctatgagacagattatgtgaaggttcataataactttgagaagtaagttttctttcagtcaccaccagtgttctcatttcattctcacagcactctggtgagattcgtgagcagatattaagatgcatctccattttatagttcagaaaacggtgtgagctacagagggttaagtgttttatcaaagacacaacttgggaaagaacccaagggttctttcatgggttggggcctgggccttgattggtgtgccttaagcacttcccatgattgtcaacagccaggggtgaacaaccaggggtgctgggaggtctttctcagtagcggtcacctggaggcacttgttaaaaaaatcagatcccccagccagcctcttctctggagatccggattcagctggtcttgggtgtagcccacataatctatttttaacaaccatcccagatcattcttatagtcaggcatatttgggttaagaatggggacttaggccgggcgttgtagctcatgcctgtaatcccagcatttggggaggccgaggtgggtggatcatgaggtcaggagatcgaggccatcttggctaacatggtaaaaccctgtctctactaaaaatacaaaaaattagccgggtgtggtggcgcgtgcctgtaatcccagctactcaggaggccaagaggcagaagaatcgcttgaacctgggaggcggaggttgcagtaagccgagatggcaccaccgcactccatcctgggggacagagagagactccgtctcaaaaaaaaatggggacttaagccagacaagcttggattttactctggctaggcctcaagctgtgtgactttgggaagattacttaacatttgtaattctcagtttcttcaggtgtgtaatagaagtcatatctctcagggtattgtaaggattatatgtaaaatgtaacacagtgcctggcacaagttctctctccttatgtagacatgtatatgtgtgtgtgtatggaatattgatagaaaatgacactattatctaaccttttgtagtacggagtggtatgtggtcaaaactagtttttcataggtccaggaggcagctttttttaagcctcatgagaccaagttatcttctcaaagagttcccttctttcttttggaggaggacagcacagatcatctatggtgggctctagtctccagtcaaattcaagtgccacccctggcatgtccttccccagatcaaggagaggccatagcggaacacacaggccgaggtgcctgccagcccaccagcaccttgtttacagtgtaaccgccacctcccttggaaatgtagggaagaaggtttgtgccattcattagggaggggataaaaagctaagtttttgagggtaaaataaatatctgatttaaatataacgtgtaggaggccagctggggtcagaaggggcagtgccacccagcagccctgcagctggctgtaaaaagtgtgacaacttacaatcaccaggaaacttttccttgccaaactcttctgaaaacactatttaattctcaccacactctcataagatagggaataatttaccaataagaaaactgaggccctgagagactcagtaaatcccacagggtaacacaggcagtaagtgtggaccagacctcctggctgtggtgccttgttcttaaccacccctgcccacctccaccagggagaggaccatggagtaaggacaggaaataatcctcttggtcactgcctctctggccctgggtgggtgtggatgccatggcaggcatctgtgtacaggagggcagggctcctctgtgatgaatactattagagtgatagcaacatcaacagcaaaaaactgaaaattcccaactcacctggctcacacacgttcatattgctgatgctcgggcacccccacattaaccatccatcaaaacggtaagcaaatcatgggaagtcttggctagcatgtactgaaatgtggcaacatcttgttttccatggtgtcttttgacctgagcctagactttaaccacaaaggaagcaggacaaggcttgcagcgggacagaggtagctaccatttaccgagtcttcactgtggggcagggaagagtaaattcttcaccagcattatctcatcagaaagctcattaaacaagcaagtgcccccctcacttgctggagtaaagaaaaggagacacaaaagatttggatcacagtgatagaacaatcagtaacctcttccagtttagtagttaagtaaccagtcacttaacttctttgggcctgtcttctcatttccaagacaagggaattggaaagaaacacagggaatgccctgaggacttggtttgtgtgctggcctctccatatcctagctctagccttaggacaagccattcaaaatttatctgtcaattaggttgtggcaaagatcttaaaatgagaggatgtgataggtcttttgcgcaccttaaagcacaaaacaaatgacggtccccactttagtagcacttattgtgtgccaggtactgttctggaatgcttttcatctactaagtcatttaatatcaaggataaccccccaaaaaccactttacagatggtggaacttaggcacagagatgttaaataagctgtccaaggtcaaacagctaagaagtgatgaaactgggatttgaaatcctcgtaattacttaatacatacttcagattttgagaaagccagaaattagtgtaatgggaattaatctcaaatgtattagctgtagtttctgttggtagtgtaagatataacagctgggttctgccacaaagatgcaaataatacagagttgtgtcataattatggaacagaccacttcaaataaaaatctatctaaaatatccatttaataaggctctcagcagctgggcatggtggctcacacttataatcccagcactttgggaggctaaggtgagaggatcacttgagcccaggagtttgagaccagcctgggcaacatagagagacccaatctctacaaaacatacaaaaattagccgatatggtggcatgtccctgtggtcccagctactcaggagactgaggcaagaggattccttgagcacaggggttggagcctgcagtgagctgtgattgctccactgcactccagcttgggtgacagagtgagaccctgacacaagaaaaaaagggatctcagctaattctagaagaattccttaaagttgtttaaagatatttatatctcatgacagaagaaagatcagggagaaagctgtatcaggtaagttagttttatgattttcaaacttttcccctaccctgacaaaataacctttatgatattttatcttttgggatttttaagacaaattcaagagaaaattcaatttgtcctttgttttctccctatggccaaagaatttttactttataaatacttccacttacttcagttctgttctcttcctaataatttgtcagctattatcatcttgccatcacaatatcctttgccttcccaccagtacattctttgtctagagaattgagactctggagtcattacttaaaccaagcacccagacctcactggctgagctctgagtgaagtttacccctttcctcatctcctgcacgattttcttccctgaatcacttctgagaccagggattctctctaagctcctacttctgttcacacatggagccctgggttcctgggaagagctgttgcttgcccagcaggtaagtgaaggggtagaacttggagcaaggattatgaatccagcccggctttcagagtgacgcattccctcactcccaagcatattatgaggagatgattgcaatacacgtggttaagggagcactgtgtagcactgtgatatagattagagatagatgccatgactatgaaatcttttccccatacaccatgtatttggtgctctagcaagtggagaggatagtcataaccctgaagttttgattaccctcttacccaggtggcttttgttccaagaaatttgtggcctatatattttcaatctttgatattgtcagtggattcttctacctgttttgtttgaaactttcttaaatttattcttttaggaaggatttatttgctacaaatacaaaaaagaaagaaagcaaacatcagaaggaaacaggctgtgtgtaactaaggagcttgtgtgctgttgataccgcagaggtcatttataaaatctgcttgatttattttttaatttgctcactctaggccaagcctactgcctccttgcccggcctctaatcacatgtacaaatggacacaagcagatgcaaatcaatttgttctcatcatggttggctccataccccgtatcatcaggcaagggaagcctggtgaagaggggctcctgtttgggctactgaaaagacgccggcagaggccggagcgtcagggaagccagttgaaaaccagacttccttccatgggcaaaactgacttctagcctttaaatgcacatttaaatcttgttcattcttcacatcctgggcagggcacagtgttagcacacacagacacctcacaacaaatgttcacagagagaaatacaaaatgtagatggggcaaagggaggggaggaaggaagggagaaagaaggaaaagaggaaagaagacaagaagtcaggaattcgaaggagtgaagcaagaaactggtagaggaagggaaggaggcagaaaaaatgtgatgaaagaaggtaaacaggagagaattaaaaggagaaaagaatatggaaggaaaatgagggcaggaaggagagaagaaagggtgggtagaaagaggagaaaggaaagaaatgtggcaatgttggctaaagcatcccagagggaagccaccagaagaagcatggactcgagggtaccttgctgttaatcatgactcacagatttcacccttctctaactcctagttcagagagtatcttccctacccaatttagcacttcattagttcatgtctgagtctcaaatcatttcataactaggctacaagcttgttgagaatagggttctatcttaggtttcttttgtgccttggtcatctcctgttcttctctggtccctaagacagtgctgggtacatgaaaagcagtgaattatcccagcattcattaggtccctggtaaccttaccaacttctctcactgtggtgcacagccttttttttgttctttatgtagtcaagtggggagtattgttatctctgctgtcatatgctttccagaagtgctgtaatatctaaaaaacccattcattatagtctgtctaaaggatcactcattgatattactgtgacaggctgctcttaaggagaaccccagaatatgcatactattaaggatcattcaggtgggcaatctcataaacactactgagagcatttccccaccctcatcacctggttatagtctgggaaagaatgctatccaattaattaaacaggatctgaatctcctttccatagccaagacatttaaattttgtgtttgcagaggtatgctattagtacagaagtgcgaatgattctcccctctgtgggaaatgtaacacatgcccatgacctctcaagctggtcacagtggtgtcgtgccaaaatagcaggtccttctatatcctccagcctctgtggccacattacgctgagtctggttttcagaaccaaatcttccacaccatgggccttgggaagaggctgcaggtgtgtagagggggcaaccagacacgcttggaaaactgagccttcatctcctaaaggatatataaacagggaagagcagacgaaccctcctcttgactgtaagaagtattcatctgctaatgctcaagtcaaatgtttcttctgggctgcttcggagagacaagaggttgggcttgatgggccctggggctgacatgggagattctatgtactgatagaaaccattttcatcatagtgctgcctattttaaagagtttgcctgctgtgctctgggcatgatttttgactcagcaaagcttcagaagccatggctgcccccaacccggaccctgttttcctctgaatgaatcttcctttttcaagtgtttctgatacaagagaaccgggtgaatgagagtgggtaatttagaaaaggccaagaagagaaaaatatgcaaatatgcaaatatcaacagcaggaataatatttaactggaaaatagcttattattgggctacatggttttaggaagccatgtgcaatgtacatgcccggcataatttaaattaattccttccattcctagtcattcttacacccatatgtagcctttggggaaatcctgaccacaacagtgacattacaggactgggtggagcctgctttccctgttctcatcagtacagggtgggcactggattttgctctctggattaaaaagtctaaatatcctctcagcctcactggaatagaaagcatgtggtctgatccctggtgcccagcagttttagagtactttttcaatatactttctaccccaggcatgagaaggaacctgacagctctgtgggcgtttcattcagaagatggagagctatctgggagtaggcaggggacacctcgtgtgtttcctctgtgagggaaatactttcttcatcactctaaaataaaagtaccagtctgcgatgagatacaattcctttgactgaatcccatccagaaaggcccatcatctaatggccagggacaaggcatgtgaattctctctcctcagagactggtaagggaacgtcacaaatcttacctgagccctgaggataagaatagaacaagagcttctacccgccaccccctccccgccagccaaaacaaatcaattcattacttatcaatccctgcccattcccaggagatgattttacacacacacacacacacacacacgcaggcacacacacttcactggtgatcatcatagattctcagcctgcgatgatggagtggaggaaacaaagtgtcctgaaattctttgataaacgacaagtggattgttggccattttagctcctactaaaacaacagctgcttctcaacaaaggcttctcacttgggacttgcagaaagggagaacagaaatgtcaacagtacaagggaaggatggtagcaacaataggaatcatttcttgaggggttattctttgccaaacacattggtgcaagcagtgttttgtttaatcctccaggcaaaggtggtggtgatattaaggaacaataataccagtaaaggggaaacaacagcagagaaatccttcaaatctatatgacaacaaaggaacattgtgcagcaagtccttcttatttcatctgagtttaacatgaatgctttctctttcttacctgtgcatgtgaggggaaaccacaatgaaaaaaatagatgattctgaacctctagaattttaaaattctctaactcctttcaccctgttttgttctaccctgtcatgaaaggcatgaaatctgtatgactgaaaagattcctctcaaaggggaagtgttagatccatttaagaggttaaacagttttgggatcatgtattgggaagattatttgaatcaaaataagaacacatgatagtcatttgatgcatgctagccattgaaaatttagcatgatttagctgtgtctgttcagggacacagcactgcagtctgctggtctggtcgtaccaatcccatgcgttttgctgtgctctatggaggaccttcttacttatttccattttccttcatgaccagaaatttgacaggcaactcgctggcttctctagcttctctgttttgcttctgtgtccaccccgctcctgggcttccctagtgttggttaatgatgttgttttattttgtcagggccccttccattgttcacatgaatttgacacataaatcacattctttttgtctcttctctatgggtacacaaatactgcggtggggtaggagtacagctaatttgtggatgggaaaaaccgagcttcagggaggtgaggaatgatgtctggctctggatgtgagcctggaggggcacagctgagaagaattttgcagccacttttttctacttagagaacaacgctggaaaacagccattaatacagctttcttgagtcatatcagatctttatattatttgggatgatttttcctcaattgtgtgaagtccagaacatggaatcctataagaatatggtctgaggataatgccctattagccacactcacctgatttcacccttattttgggaactttcaggtgaacctatatttttaaatctctcataagctttccaaattaacttggcatctgctaaaagtcattgtcattttagataactgctcttctttttacaaagacaaaagcaagcaaaaagaggagaacaagctgccaaaaactgaggtccttgcaaaagagaagggctgatcaacccccataggctgctacagccctagttcagttcatgcagagtccacctgcaggcagcaatcaacatgctaaatttgagcaacgaaagttcactcgagcaaaataatttaccttggagtccagctgctgcatgtatgaccaaagatattctatgttggctccaaaaggatggacgtgaagaaacgttgatatgatacctgaattaaaaaggcaaacattggaaattattcaaaggcatatgagagtctctggttaaataatgctgtctaatcccagtgactattttgtcaggctgagttatggtcttgccatttctagcagcactcaacaagcattcaataatagcacattctgaaggcagtaagagtaacatggcaaacagaacactttatctcctggaatgatagtagttagcaaagctagactctgagataatatacagctgaataaagatatttcaaaacaaagactcctggaagcatttcaactaccaattttatgcttgatttaccaatataaaattatagttattggaaggataaaattatcttttctttccctcagtggactttgcagtatgaaaatggctcatacaactgtgtcagaaatcacactgcctcagattttcctgataattacaattgctagatatgaaaagtatttaatctatatttcccccaactgccattgaaggaagcccaaattcttcctgaaacatttgctgttctctctggttgtcgctcttgtttaaaaggagccagctcattctccccttcttgctgctgtaatttacaagatcattttaaaaggtctgggaatggatggtttggctgcagtttgattataaattataaggctcttccatcgtgcaaatcagctgtcaacattgtactgacaaatgaaaagctggacgttgaagtcaggaatgaagtaaaaagcattaccttcctcttctccctgctcctggatccaaaatcaaaatagtgaacatgaggaagtcaactccaaaaactgtagactgctttttgttaagaagttgtgcacttgttattcacgatagcaaaaacatggaatcagctcaggtgcccatcagtggtggattgcataaagaaaacgtggtatgaaccatggaatactatgtagccataaaaaagaaggaaatgatgccctttgcagcaacattgatgcacctggaggccattatcctaagtgaactaatgcagaaataaaaccaaatattgcatgttcttataagtgggagcttaacagtgggtactcatggacataagaaggagaacagtagacactggggactgctagaggcgggagagagggatgagggaaagggctgagaatctccctattagggattatgcccattaccagggggatgggttcagtcataccccaaacctcagagtcatgcaataggcctctgtaacaatcctgcacgtgtacccctggattctaaaataaacgttgaaaaagaaacaaaagaaaagttgtcctcagactgatagttttagctttctgttaaaaaagtttcaagatgaattaaatctgagggtaagccttcatgttctgttttttgtgagccttcatgcttgggagccagggaagaccctcacctgtatgaaatgccatctgggtgggcacaggtgcacacagcattcttgtactaggtcatcctataggtgaccttggattgatctgccatagggtttcatggctccctgatgctatgggatgagtgtcaagtttttaaagaaaagttcccagttcatcctcaggctgagaacagaaaaccaaagggactctccaagacctatcctcagaatgttgctttcccagggcttctagaggatgacagtgagatggggaggtagaaacaattcccacatttccctgtaaaggtagaatctcagtttttaaagactgacctgttcttcctgagatacaaagaactaccacttcattctgaggttatattcttccttttttcttgtcaaaatgtccttttttgaaataatggcaatggtagaaggcaatgatgatactttaaaaatatctttaagtggaaaaatagccacttttaatgtactcagggagcattgtgttgtcccctccccttatttatttacttatattttaattttagagacctgacagctacttccctgtaactgaaattctcaattctggtgaagtggcattctaagtaattctattactaataagagttaaaatataaaagctcaggagtgatttctttaaaaaaattagaatatagtagaactatttaaaaatgattattttcatttgcatttccttttttgttttacaaagttttaaattgatatataatatttgtacatattttttgggtacctggcatattttgatacctgtatacaatgtgtaatgataagaatcagggtaatttgcatggccatcacctcagacgtttatcatttctttgtgttgagaacatcccaaatcttttcttctagctattctgaagtatacagtaaattactgttaactataatttccctactgtactatcaaatactggaacttagtccttctatttgttgaatgagagagtaagggctgaatcacagttcgtgtagagggaatcccctgtttcacgatggtgagtggggctttcactgaccatcccaggtactatggccactgctttccacagagagcctcccacaagtgatgggcaggagaaggacaggggagggagaaggaagagtcagctttggctttgtgagcaggtgagggggtgctcctagtcggaagctttttttctcctcctcccctgcagggttctcccagggaggtgagggctgctgcaaggtggggagcagcattcctcgggtggacatctgcttacgcagcagggctgagacagggagtggcagcagcactgcagactttggggtgacaagggtgtataagtctcccatggagaaagagggcataagacttgagcagtcttaagtaaactaccccaggcaaataaataacaatatttttcatatttaatattccccctggccagagagccttcaacatctcctgcataacctacagccttttgtaaatgtccataggtgtatggttatcaacataaatgtctttaataggatgaatagaacaagtcagaggaggatggggtgggttgggggagaggttgataacccttagcctaggagacgaagtgttgacatgggtcatttagggacaccagaaatgggaggacctagagtgcctctgtgaagttggcaccctctgtgaacatggatttgctcctccactgtctactacctttcaaccctaatcctgggtctgcaccccaaggagctgtgctcttagtctttgtgtgttctggttccatatccagaacatagtacacattcataagaggtatatgttgaacgtatttatttgccagaactggaaatctccagtatacttgtttaaaaattctattagtctattattgataaatgggaataaataagaaccttaaacatttctacaagtagtaacagatctttcaaaaaccaggtaactttgagatattattcactgaaaattcttactcttaacccgtcctgtcatggatttagaaggatggagtaacttggatgttttgagcaaggaaaattttcattgaaactattttgctcataactaaggggaaaatcagattctaaaatcagattagaagtcctgacgtggacttgagtgttcttttaggagggtattcagaaccatctctgtggtagctgatattaagaagccattagcttttccttataagagttcagcaattgccactagatatatgtagggccaaggcaggcagtcacaaataggcttcccaagcttttcctgtggatgacaacccaattatccagtgttgctagagacacagccgaaaggaaagcatgagtcatcatcctccccggtaccttgcctctcctcagcccacctcccactcctgcatctgtccatccctgtagcaccacagaagcatcagtcatgccacttgagaaaatgtttctaggccctgtgattttggatcaggttcatttgagggaatctttctaaataaacaagtaaagcctctttgcagcttttttttttttttttttttttttttaaaggaactgggacattccctggggatggaaaaaggatggctgtaactcaaaagttaatgaaaaatgccacaaacctggaatatggagactattttatggtcctctggaatagacctaaaggcttggtaaaatgaacactaggaatggagggtggtggatttagctgttactgaactggtggatctccaaggggatggctcaacaattggacttgcttgtttccatggagatgtagaaggcctccatattggagaatgggtttccaaaagtggaaaaaaaattttaagtgcctaatttaaaaaaattttaaaagaacaaaggaggttcagtaccattgggctttttgcacatctcagaatcttaaaaactactttagaaagagtaactagctctagaggcctgtgccaaacctcgttaggaaggtccatttaaattggctacccaaaagcactctgagcttctcccatcaaaaccatctagtttatttacattattgggtctcactaagactaaggatgcagtatttaaattaaccaaatagtgccagatttgtactgcttcatcacttattttaatacttgaaacacttagcagccaggaggtggcaaggtgctagaggcacagcattgtataagataggcaaggggctggtcctgtggaacttttattccaggtgagcaacacagataataaacacaaagatgaaaaataaaaatttttagatagtgcttagcacaatgaagaaaacacatcagggaagaggacagaagagacagcaacctgcagtttgctggaacgctaccttacacaaagcgattgatgtggtttggctatgtccccccaacaaatctcattgaattatagctcccataattcccacatgttgtgggagggacccagtgggagataactgaatcataggggcagtttccccatactgttctcatgctagtgaataagtctcgtgagatctgatggttttataaggggaaacttctttcacttggttcttctctcttgtttgctgccatgtaagacatgccttttgccttccaccttctgccatgattgtgaggcctccccagccctgtggaactgtaagtccattaaacctctttttctttataaaacacccagttttggatatgtctttatcagcagcatgggaatggactaatacagcgattacgtgaagccctctccctgagaaagcagaccttctcaagtgtgagatgagaaggagtcagccatggaaagcccgggggagaccattccaggtacaggccacatacagtgcaaaggccctgaggtggaagtgagctggcagaacacactgggctggagagtggcacatgtgtttagaggtaggtgggggccagatcacgcaggaccttgtgtgccaggggaaagagtttggattagatttaaattctaaatgtggcaggaaaccaaaagagtggttctaagcaggtgcttgacatgatctgaattatgttttaaaaacttccctcaagctgctgtatggagggtagagcagagggggaactgggaggccagttggaagtgtttgcatgagactggagtggtgagtcatgatctggactgcaaagggagaagcggactccaaagggagagccagggggctggtgtgagcagtgaggctggggaagaatgaaagatgagtaaacagtttttcacttgagcaactgggtgggactattttctcagatgagaatattggggaaggagcacattagggcaggaaaaaggggaatcgggagttctgttttgtcctcattaaatttgagatgtgcattagcatctaagtgaagaatattaaatggcagctggagatggtatacatttgcaatggcaacaaaaagggatttgaagccaaagtattcattgagattacctaggtagagaagaggcctcaagactgaaggctggagaagcccaaaatttagaggtaagctgaggaaaactcatcagaggactctgagagggtttaatcaataagaaagtgtggcatcatgatggcggagagaagtatttccagatgtgagtagtcaaccacgtaaagtagctgccaggtagagggagttgagaaattggtgacataaaattctctggtgatgtggaaaagaatggttttggtgtgaggatgcaagtcagactggaggaggctggagagagaggggaggagggaatggtgactgtgagcatagtgcgttggaggaatcctgctttggacaggggcaggaaatggactgttgctggaaaggggtcatggtgtcaagacagattttccttctcgtttgttgcaaaggtacaagatagtagagttcatgtttatatattgatgcacatgatgctccacttacatacaagatcactaaggggtaatgcagctttcataatagtcctcatacattacagagaattgagttgaaaaggaccatctaatcaaacttcctaattttatgcagtatgagggcttacacacttaccacagtggtttggataagtgatttgccttagattacccggtggatgaaatgcctcaatccacaaatatttaggaccactccccctcccccaccgctcagggctgcttagagatcattaggtattatggtttctcctttgcatccttatacaaaagatgggagtgggatgggttagccctgttatagtttaattatattggttacccgatgagaataaactatcactttgtgcattcagtttggtcagcacattattctctttgagtggaatgagaaatggaatattgccagaatatactccccactacccccaggctgcttggagttttcattccaaactctctgtgtcaggttctaaagttctggctgagatttgctttctctacacctacactggttgatagtctcctaggaagcttcaaaagaccctggggcccatcagctcactgggatagaggagcaccttggggctttccagagaccttggctctgcagatgaacagctgtgtctctagacacagtcacatcttgctgggaattaccagaggcctgaccataaaccagcctgaaatagtcttgtttcatgttgacacccatataaatggtccacggatgttggagaatcagcaggaaaaaaagccatgcaaaatctgggtctcctagtaagccctgaggggacagttgtctgtgggcagctgcagagtgatgaagcgtatatgggaagtggagagaaactgtaggaaaccgatcaaacacttgtggtttgggctgatgcttctcagtgccttgggattccaaaaagctttaattttccaaaaaagtttattccgcttacttggtgagtacaaaacctaatcttgtatggttggttagttagttttgtgttgtaatatttgtctgtcttattttttcgattaaacccctcagactgtatttgaacctcttagtagtaaattgttcctggtacctgaaatgcccttaacaacttctttatccatccagtgaaaacctcttcatcctttaggactagctcagctgtcctttcttctgacaaggcatctgtagcataagtagctccttctctgtgtctctgattttactacgaaccacagttcattgtaattaactgcattctttctcattatctatgaacttcttgaggggagatcatctttccaccatcagttaatgcatgggatagcataaatcaggccagcgtttctcaaaacatagtaccagatatgcctgctttagcatcctctcagatattagtattgcaatgaacaggatcactttcttttttttcttttttgacagggtctcactctatcacccaggcagttgtgcagtggtgctgctcacagctcactgcagcctgatgctcgtgggctcaagagatccttccacctcagccccccaagtagttgggactacaggtgcatgccaccatgcccagctaacttttttttttttttttttttgtagagatgggagtctcactatattgcctaggctggtcttgaactcctgagctcaagtgatcctcctgccttggcctcccaaggtgctaggattataggcgtgagccaccacacctgtgtgtggggctaaagattctgccttataaataggctgcctagataattcttttccacaatgaagacggattattcttatcgtaggctcttgataaatgtttgttgatttattgatatggacatttgtgccttggaaacaagatttaggtcaatgactcattctttatggtcagtagttttcagagaggaacatactcccaagattacttttctcaggtacagcctaaatatagcctcaactttattcactgaaatcaccaaaaattattgcttaaccttctttaaaaatatttttccatattctactcagctgtttctttatacccacattaggaggagccttctgcttctggtatagtctggttttgtgcacgtgtgagatggtgactgtgatggaaatgatgtgtatgtcctgatctgcagaggactcaggatatgtaagaaagtttgcccaatcattgtcaacctgaggacagttctcaggggaccagggaggttttagagaaaagctgctttgttacagttaaaagttgtggagaagtttttgactacatctggatagtatttacaatgactagcatcaacagggcgtcaatcagagctgctgggattgaaatctattgtgttggaattattataaaaagcaagagaatatagagtgatacggacccagagagttatactctcagctctctgcagaactattagcttgtcaataaaaaaaatttgatccatttttcctttataacaatatccagccaaacacagctcccaaactttggccccaaatcaaaagtaatgactcattctatcccaaacaacttcagtgtatgccaatccaacatgcaggccatatgtgaaataaactagttctggcatagacattgagcaatgtcaagctgaccttatgtgtggttactatagcattatgaaacaaaatgctaccctgcaatgcccccataaaaacagaattctctaaggtccaattatatgtcaacctgtctccacaaaaattgattacaaaatgaataacccagaaatcacaaaaataaagtattttccaggggcctgtcttctttagttgaattggaagacccattaattgtcaagaagaaagtccatcagaatggtcgaactctaataatactcaggatccagatctgcaaaattccaaattatgtcaatgaaatcccacggatcctctctaataaatatcaactttatgccttgaaataaagactctagttttatacaatagtcataagaatgtctgggcagaatacacccttttgcccagataaatcagtgtcacaaataattatatgtaactagaattgctcattgtttaggaagttctagcctcagttttattctttctgtagatggaatccatttgaagagcttttttctcactccctttctcttccagggaatgctttctgccagtgtgcgtttcttatataacatttatgtgccccaagagggcactgatcatctgactatattggcatacagcatacactataagcatgcagatatgatgaagattttgccaattaatgtttccaagttgtgggagattttctgctgtgtccttggccttctaggctggcctagagcatgacttttgtgtcctctctactgacttaattattccaagggaagatttcagggggaattgcaaagagtatttatgactgctccagatgtaccagaaggccagagggctcctagaatcattcagtgcatgagaattcttcagaaaagtgtagccccagcaccaggaaatcctttttctctattctgatccagagcagttttgtccctaccacagtctgtatctagattccagaagcttcaggggagctctttatggacgcaagattcaggtatctacaaagtatgaatgaccaaactcaatgagtagataggatcatttagtggcaggcagaaactgcagcttttggcaggatccattttgctggtcttggaaactctttcccattgtggcattcttttggaggattatcctcttttggaggattatacaaaagagtagaagtatatagatgttttggaagtgggtttggcaaggaaatcacatctgttgccaaactgtcattaagaataataaaataaaatattgagaaaggtagcaaggtaatggataactgaagggaaagttaaactcctaagtttattttaatcacttaagtctctggcctcccttctacctaaatgttctcatatattgattcaaaataagtgtcaccccctgtttctcttttgctctactcctaacttcaaatgctaatattagtaaactagttcaaaagaccaacagtgaggggaaaagtcttggaaaatttagaattggttgtatatgctttttattggagatcctgactaatatttttctttctaacacacttgatttaactaattttatatagttttttgtgataccaaagacatcagcaggcatagcatgttataaatgtaatcttcctacctactcccattaatgtactgcatataaagcacatcatttaaaaatatttgaagtagccaactgaaaaaagtacatgtatgtgtatacatatataaataaaacctaataactacttagaaaacattttaaatgaactgtgttctccaattaaaacataaaagaagcagctatctctagtgaaaggaaggaaataaaaaaatagagactggttcccatttttttaaccttcaagtggacagaattcttcctacttaaagagggaaaagtttactgcagatcattaattgctttgttcataccctaaaagcattatagggaaaaatcacaccttggtcacactgagtgacagagaaacagttgtcagacttggacatgttttccaatagaagaaaaatccagttaccaactacatatgggttcgttttgggttcctggaactgatagcacatcagcatgtcttctgagactcatgcatggcatgttattacagctgtatatcatcagagcaaaaaaaaaataattggttttcctgggagtatctctaagttgatgtcatattcaataaccctgtagttgaaaaatctatatatgatggatggactctggactgtcttttgaatttaattcctcatgtgccagcttctctaggtcctgttgtacctgtcatttttaggtgagcacatgcagtatttacaaaatgcacccagggaccaggcgcggtggctcatgcctgtaatcccagcactttgagaggccaaggcaggtggatcacctgaggtcaggagtttgagaccagcctggccaacatggcaaaaccccatctctactaaaaatacaaaattagctgggcgtggtggtgtgcacctgtaatcccagccactagagaggctgaggcaggagaatcacttgaacccggcagaaggaggttgcagtgagccgagattgtgccattgcactccagcctgggcaacagagtgagaccctgtctcaaaaaaaaaaaaaaaaaaatgcaaccaggcactatttctgccagataatgaactgctgaagaacagtttgtcttgcatgtacattggcctcattcttcagtcttaaccatgccaccatggagccagtctcacctggcaaccccacactggggtcagtgccaaggtgcagcttgaatcagttctgtgcatcacagcatgagggtggtggcttcccttcctctgaatttgagggcttcaaagacagccttaaacatacaggcatctaagatgggcttccatgcacactgccggcacatcctcatcaagaattcttcctcgtgaaaataagtaagacatctggatccactgaggatgcttcttttgttcatcctggacaaaaggatccatacttggacagggaagcctgaagccgattgtcctggattagcctagcatcagtaccctgcatggccctatttgtcagcattgcaggtctagccttgggagtgactttaggatgtggcctctgctaaggggcttagagtttaatctcagggttcaaagctgctcttgagcctggggatatggcttggtttggaactagatgcaacctggcctccagttggaagtgacatgcccaagctttgaaattcagatttgtaacatgtgagatgcaacttagcgtattcttgaactcagtttcatgtctgacaatcagttaatatatacagttacagaaaggcaaaacccccattagtttgtatgccactaatttgaaatgtatgtaatataatcttgatgaaattaatctcaccttttaccagaaggcaatgctgtttaaattaataagttaataactaaaatattaagttaattacctaataattatttaagagaacagatgaagaaaacagaatttccttacctattagcagagcttctttctctgattttaagccttggcttcttttctcaatattgttctctcggtcttggttgactaatgcaactgtcaacacattgatttcctataaagttaaaagccaaaaaccatatatgggtttatgtagattctgtgcatgtcaataaaaaacaccagatctcttaaactctataaataaggtcatcacttctatttataactaaagatcaaatcttttatacaattgatctatttgcccaagagtagaaaagtaattatgtaaagttaggctcctaggtactgctccccgcataccaagtaattctctgcacaagtggcaaatttggcacaagttatcttagatttttgtccatgttttcattaaactctgttcattaaaactgtgtttgattatagctactttaacatgttttatttcaaagatgaataatctttgggaaagcatacaggaaactgatttataataccatgctaaaaatttctgagtgtgtggagaaatagggcctattggggagctaagatagaattgttagaagtgtttttaaattgagtaggtatggatcctcatgaataaatgcaagaggcagataaagcaaagcttggtaaattcttttttttgaaaactaaaaatgaagagttgtacaacaagccaataacacgtgaaacattgaggctggactatttttagttctttctgtagtcttttacatttaaaaacagagatgaagatttaactcatatcatcctagacttttgatattaggactcaaaatggagagtgatttaatggaaagtcaaattaatgatctgcatagatgacctgcatatatgggatagtagaatcattagggaagttgagtcttactggaggaaagttgctcactgaaagatggctccaaagaaggactagtatatgagcagtggtggggaacctgcagggatgatagagaacaggtacggagagccgaatggacgaagaattcagaaggtttgaacaaatgtgttgacaggtgtccctagaactggaagtggttataggagagatatttagatagttagtacaaagtaacaaaactggtcagatccaagagtacaggaagtattgggagcatgccgagcctgcaaaaagtgaaaaccacacccgaaggcattcaaagaaaaataaacccagcacatgccatcaaaacagatctttgagcttaatttaacttatgagctaccactttgtaatccaggggtaattagaaattgccatgaaagaaggctctactgagaaattgcagttggtaatatctgataagcattttagaggctccacttaaggtcccacttatttgctgaagaccaagtgatgaagactgaatgagaaatgaaaatggataaggtaaagaattgagaaaatcacagtgatgtgatgatatatcacagggaagaacttggttggctagagggtataacaggcctcaggctgatggtaggaaaatcccaataaggacaggagtcagaaagagtttggggagtggtctaagctaagtctggagccagctgtacatcaaaggttactagagatgaaagatgctcttacaaatcaaaaacaggatcttgggagcaagcctcaatggaaacacaatgaagaattttaaaatagaacaaatccaaaggcttattatgtagatgggattagaacatttataaagaggaattgcaggaaaggaaatagaaattcctgctatgataaaataacatttggtactttccgattaggctgattaggcactttctccattggaacagagcaggtctgtgtgtacacatcatctttctagggtagtggggtcaatgggcctgctgaattctgttagttgtatgccctaaggacaaataggtcccacagggacatggcagatggacttccaggcctgggaggttaagattgttgagcagacgcaagctgaagctttgtaaggtctcccaagagaggtgtaggaagaaagtggatggaagaacattaactaggataatgattgcatcattaaaaaaatacaaaaaatgaaccctggagctgagtggaaataatatctccaagagagggtgatctgttcacagcctggatgataattggggccaaatgaaattattcagaatgagtttagcagataacaggcccacattaattgccaagactgagtggtgtcctggggccatcacacagttgaagatccaggttcattgagggaaatggactgtagagggcaggcagatgtcaggagccagcagagaaaggcaagggtggaacagacagaccacctgagaatgctgttttctccccaggtccaaaagtggagtcacatagaaagggggactctgagcaaggttcaaagaaatactgctgcatcaacaatgtctacaaggagccagataagacccagtgactcttgctttggtgatgttttagggttgaaaaaattagtatggagagataagagtcttagggtcaccattctgtggaagtatttcttgagattggatactggagtgtgtgctctgctgaccacaaatggtgtgttctcatgcagtcatggccagtgactggagtggacacatctctctgcatggctcccacaacagtccagcaggccttggcttgatggacacctaaggcttggcagacatctcagcttttggggacatctgtgagttttgtccaggttggagatggagctgtttttctgactcctctaggaggcagaagaactatgctggaagtggtacagtatcattgaagctgatcaggcaggctccaaggaatgcttgcttgcatcttataataaactggcctcaagaatctccaaaagggaaaacatcatttccattagagtcaagggtgtgtccaagcatattaaatagtctatagcatagcattgagtgaagtggaccaacttgtgaccactcaaaagagtcactactgactaagctccagatgctaagcctgccttgggcatggtataagctcaggctcttgctgacaaagtcacagagctaattagatgggtgaatgcttatgtcatccattttgccaaagagaacagttaaagttaatatagctgtgtttcaagggatagaagacaggatagtgattttagacagccacattatatgttgtagttttaccttttccaattattagaaaaggagagttttgttttaatgactcactaatcatgggttccttagaaaaataaggttaatttgatttgtctgtatttatattggtattgttcagttgaacaagataaggacaattatcgataatctccaagtatggggtagtctacaaagtagatataagcaacaactgtaccctctctctttgtttttatttaatgtctagaaatctaagttatcacatttgtcaaaagagctccatcatcatgattggttaaggcgaagggaatacacagagagaatgtggaattaattaattcccaaaccaattccctgttgcacttaagctaagcctgtttttactttcagccaccaaataaatatttctgctacatatatacatcacatgcctactatatgccaagaagttctaagtttttaaggatatggcattcaaactgatcagaagtgcaagcttacccagggaccagcaagcaattcttataaaaggtctaaaagaaagaaatatgagaagatgaagctggagaagtaggtagatcatggtaagaagtgtagattttatctgggaggcttaacaagtgaagagttttcagttctgcattttaggacattggtttggaggcaaatgaaactggagtcagcctactgcaaaaatgtatccatttttgccttttgatgatgacagtcaaaacccatgcagagtgcaaacagcatttaagaggtggaactaaaaaaaaaaatctggtgacctggtggctgatgaaaatattgagaacaagtaggtggctcagtgaataggcaaatggagaaagaagctagtctgggagaagattgtgtgttcagttttggaaatgttcaacttaaggtttctatagcatcttgtcaaaatattttggaggaagtaggattagccaggaagtaggatgtgcacgtttctgaacttagaagcaaggctctgacagctctttttatggggcctttctctggttttgtttgcagcaggaaatcttgatgttttcttgtgggacaaagagcaggcttgcttacacttgatataaaaaaggtagattcctaagctcagtgtttctatcttgtaacacaaaccactgcatgtgctggcatccttctggacccctctacggagatactgaggttataagatccatgagagtagactggtgaagccaaaattcttctgggaacagtctctcagtgggatttcatattctctacacaggacattccaacttatctttttagtaattggggaacacataaggacattgaatcataaattacacatggttttgctcctttcttaaaaagttcatggtccttattactctctccaccccaaatctctagagaatggaaaggaccttatcagaatgggaaagttttatcattagaaacataaagttatgaagaccctttatccttttatcaccttaaaatcctttagcctgatagatgcaacatgcccagaagaatgatgagtctaccagatattccagaaaagaggttccagatgcctagcaattacaaagtagaagtgagtgagtggggatggagtgggaggtgaggaaggttactatgtatgaattgttagtggtatacaaagtacacagcgggacgggaacattaggatggagatcaagagtttcctctcagtgagatctattggattatgaagtagtctcccaaaggaagtgggaagaacacagtaaaagcacaccagactagaaaatgcactgcagctaacaattctgcacttgacatgagattggagattacctaataaatcttttctcagcctaccttttaactctaatttctgtgatacgtagaaggaatcattaaagggctggagaagaggttttcagtaactggaaactagatgtcacagactttttaaaagacttcttaaagagttagctacttgaaggcagaaatttcccttctaagagtcctcatcacttactttgagaaatgatcaaagtaatttatcatttagaggagctctttttcaatagcttattgagctagaatcatgctttgttattttgtttttgtttctctccacctacccaagcccctaaggaccaagaaaatggcttccctgccttataaaatccttctgctactgctttcacttaattattcctgtggcttccttacctttagggctgttttctttctgttgcaaagcttcttgaatacatgttgtccacctgtgtctactgcctcatcatctgaaatctcagctttttcatcagtcactccaacaaatctactctgagatatttccagtgaccctcttcttgccaaatgattattttcccagtcctcttaccatgtgatatttgacacccttgacattggcccctcttaaaccatctgcctcacatctgctacacaggaggtcctggtctttttcctcttaatttcctgtttagtcttcactggcttttttgtttcctctgctggcccagtgaatgtaaagaagaggctactctcttcctcctcttctctagctttggcccttgccaaagtgtgctccccaatttttcttacctgttccctttctttcattctcgtgggttcagctatgatcaatcttaattctttaagcttctgttctttaccaccaactgaccactgggcttgtctgcctgaatttaccaatgcccagttcaaattcagaatgagaggtggccatgaggcagtggaagagacactaaatacttgggtttcagccttggctcttcctccagcagccaggtgaccttggcaaattactcaacatcttcaagacccagatcacttgtctaaaaatgaggggctgggtagggccaatcatctttgaatagtacttgatggaacctcattagctttatagaggtgacatggatggtccaaggggacacatctctggaattctactctttcactcctttcttttgcttaatgatacagggctcctatgtaaagcttcatttaaagaaatgtccttaggccgggtgcagtggctcaagcctgtaatcccagcactttgggagactgaggcaggtggatcacttgaagtcaggaggtcaagaccagcctggccaacatggcgaaaccctgtctctactgaccatacaaaaattagccgagcgtggtagtgcatgtctgtagtcccagctacttgggaggctgagacaggagaattgcttgaacccggaaggtggaggttgcagtgagctgagtttgcaccactgcactccagcctgggcaacagagtgagactctgtctcaaaaaaaaaaaaaaaaaaaaaaaatctgagtccaggtccttcctaatgtaattttctaaaattctataattttatgactaaaacccagttcatctcactcgtcaaactgcatcctcttctaacttttctgtttttattaaagtcagcatcattcttccacttgctggcgctcaaaccctcattttgtctttgattcattctctactatcccctaagtgcttttaagatgtctctaaatccaaattctctcaagtgtctgtgagatgtctctcctgctgcattcccatttccactagtgctctactctcggttctacgtgtttcatactttgttttagggatgcggtctcactatgttgagcaggctggtcttgaactcctggcctgaagcgatcctcttgcctcagcttcccaaagcactgggattacaggcatgagccactgcacctggcagatttcacaccttgaccattttaaccgctgcaggaacctcctactttgtctctgcctctaggctcttcctcttccagtctatcttacataataccaccaggtcaattttctaatatgtgacttttatctcatctatctctggttaaaacttcagatgctttctgataacctacaggaaaaagtcagatgctgctgcttggcattttgggcttactcctatcaaactagcatatcttctttctatgctatgtccagaaatgctcttggaaagctctctcctccttgccttgccacttcctacttacattttacacacagcacaagtcctgtatctcccagaggcatctgtttcaggccacttgcaaggcttccttatctgcacacatttcctacgccacttatatggcagttcatcacttatacatcacatttcacctatttgtttcctccacaaaaccactgccttctttagacagtaatcacatctaagcaagtgaggcagaatggccgaatggaagctgtgttctaaatctgtcacattatttacatactagataactttaggcagggcatttctctaagccttaactttctttaatgaaaaacatggataataccatgtgcctcttccccatggttgctgtgaggaccaaatataagtgagacagcgctttcaaaaactataaatttctaggaatagattgtggcatgattattacaaccattactcacttttatgattcacaggattgattggatatggaacaagtgttaatatatacttggggtactgaatccatgcaacaattctgtataagactttgactacaattatataaaaatatttatgcaaaaataactgtggttgtattcaaaaatagtggatattttctattttctctatttttctgtcagtgttgttgttattatccttataagtaaagaaagaaaaagaaaccaatgatatacagttgttgttttgaagagctataggtaaggacagccagttgctgaatacttaattaagtaacatactgagtgacatcacccacaccctaaatagagaaaccaccgccatgtgacttcccctatgaccctccaagggctggcggcctccatagctgctagtgcaagatgagtgggacagtcgacaagatctatgtggtaaagattctccatgtcaccccggactctgccagcagcataccacaaggctcgttttccttccctgcctgcttgttccatggccttcttgtgctgttggctcagttctgctaattgctcataggccctactcttaaacatcacacttcatgaaatcgggggccctatagataattgtcaagatgtgtatcagctacattcttatcctttactcacattttgcaaagtttcaaaagcaatccatcaaatgatgtgccagttgccaataaccttcaaattattccttatatgattagaactgtggttgggggaggatggagaatggagatatcccttcacactttcctttatgggcacatagcaggtgcccagtggctgataaatgaaagaatgagcctcaaacaatggcctggaatattgaaaacatgatgatttggacatagaagacactggttctatttgccgctggcctgctgtgtttctttgtttcatttttgctgtttgtacaaagacaggattgaagtggatgacctccacagtgtcttcctgctccctgattccatgcctgctctgtgcccttttccctgacttggaccttcccttcagattcaggtagccagcttggtacagaccatataaacttatcctttatttctgatgccagtaagaattagagaggaaagaggaagcagagtgagaaaaacaataaaaaaccaaatggatgaggaaaggattgatgagcatgagtgactaagctttagaattttttatggtttcttatgggaacataagaatgcatccatcccccaatagtgagcaggatcgcaggaatttcctgtggggcagcaatcccaaggccttgctgatctaatcagttgtgaaatcttggcactgcccatcccgagggtcgtgggctctcaccacctctgccctttcccagcagcctttgatggtcaaggtctgtataaggggagcctcagaggcccaatagttttcagcatcagagagataatctgaaagcagatgtgtggggctccaagatgcagtgattcatcatgatgtgaccatattttacattctgagatgttccaccttattggggttcaattgccggatcggaagcacatacattatgtctttagacaactccaagaaccgtgttttctaagatttccaattgcaaagattaaaataggcgagaactagttacggctcacacgaaggaccctttaaagaaagataaaaactcagtgtagtttactgccagagatatccagatacagcatttatcctggtggccttctttctaggtcatctttggttatatttatttaacaaacatctgtacagtacttactatatgcaggaagtgttataagcacttgacaaatataaactcaattgtcataagtgctcttcgaagtcaggctattacattcttaatttacaggttaagaaaatgaagaataatgaggctaatgacttgcccaaggtcacaaaactagtaagaagcagactcaggatctgaaccaatgctgtcttgctccagagtcctaaccactacactaggttgccggttgcgtggatattgagtgcctgtggcgctctgtgaccaaatccctcctgagggctgcctatagtcctagctcactcaggagccagccaggctccaggcaggcctggtgagctgtggttcttgcataaacatgaaaggaaaggggagcagggaggaagccacccacgggctggctgaggagcagcattagcagggactgagggggctggctggctgctgctgtttgcgggtgacggacttctttagtgtgacttttaaccacagtctgcaacagggagggatttcaaaggcagagtgctggggccaatgaagaagaagaggtgggacacatgctctcttgatttgaaggatgtgggtaggggaaggccaaggtcagaggagcactccaaaagactgtggttgggccacatgcaggattggctgggcaggtggagaggctcaggcaaggaggccccaggtgcttctccagccacaccccaaggatgtggcaataaggtggaaccacagaggtgacaggaagagaaagaaaaggtggatagagaagccattcggaaggaatggaaagaagccattctgaaggaagaatggaaagattctatgtgtgaagcagagaggggcgagctaaaatcatttaaacaagtcaggtctacacagctagcagaatattgataccagaatcagagatcacgaagaattagaagtattgcctctaggctgggtgcggtggcttgcacctgtaatcccagcactttgggaggccaaggcaagtggatcacttgatgtcaggagaccagcctgaccaatacgttgaaaccccgtctctactaaaaatataaaaattagccaggcatggcagcatgcgcctgtaatcccagctacttgggaagctgaggcagaactgattgaacccaggaggtggaggttgcagtgagccgagatcacaccactgcactccaacctgggcaacagagtgagactccatctcaaaaaataaataaatacataaataaaaaagtattgtctctaatattttaaaatattggagctgaggtcttagaaaggcagctggaaatagggaagatgagggtgatgagctctcaccacctgtgccctttcccagcagccttccatggtcaaggtctgcacaatggaagcgtcaggagatttttcatggtagtacttcaggctgtgaagggcgtggacttgagtagctatagcagtgtgagttacattttctacatactgaagagaaacagctatttttgagatcaagtgtattttttcatttggttatatctaccgtggcattcaggctgggaatacccctttccagcctcttgcacggtcccagtgcacctgttgtccccacagaagtagcaacagtgctgcctttcaccctcaaagacatctgtttgaattttatgtgatgactgtacctataatctctacagagcaacagtgtcctcagtacctggcacagtgctctgtacacagatgcaacatatatatatatatatatatatatatatatatatatatatatatatatatatatattttttttttttttttttttgagacggagtctcgctctgtcgcccaggctggagtgcagtggcgggatctcggctcactgcaagctccgcctcccgggttcacgccattctcctgcctcagcctcccaagtacctgggactacaggcgcccgccactacgcctgtctaattttttgtatttttagtagagacggggtttcaccgtgttagccgggatggtctcgatctcctgacctcgtgatccgcccgcctcggcctcccaaagtgctgggattacaggcgtgagccaccgcgcccggccgcaacttatatttttaaaagaaaaaatataaatagtagaccctctaatattacatcaaatgaatttgttactacatagacaggccagacctcatgggtgaaaatgactggccatcataagggtttggtcagtaccctgggcctggagtcagctagaagtctatgaggaatatatatgtatggtggatagtgaaaaaaactatgcaatcgctttggacattttacagccttttggtccctaaatacatttattgtagtatcattttaaaataacacaatttctttaatctcgtaggctgaaggaggtaaggaagttaatttttcatttgtatctattatcaatgctttcaatgttttaagtattaacttttaatttttttggagaccaaaccataagcttataaccttttttcctttcttttccaaaatatataaccttttctctttcttttccaaaatataagacatattttctagttgactttcttagtaataacctttgttttctcattacaaataaaaatatgtattcactgtagaaaatatacaaagtaaagattaaaaattaactgaaattctactaccaagatataaatgctattaacattcagatatttgccttttatagtttatatataaccccctcccacatacatataacatatatatgtgtttgcatatacacatacatgtatatattgttgtttaactcttatttgaaaaataggattatgatacatatatagcccccaagtagaatattctacataaagaacagagactttgataggaaaggatcatttcaatttcttaatgtttcccattaaatactaagaggatcactgctgcctggatcataacttaataatgactatcacagttcacaccatgcttaaattgtggtctcaagctggcaatgaaatgactttcttttggtctagttttgtgacagccatgttaaacaaaaatgatctaaaaatgagaaaaaaaaaattcctttgtatccagtaaccccattcattatttaaactgttgtagtattttatttttagttttactatatgccactgtagacataaccaaatgaaaaaatacacttgatctcaaaaatagctgtgtgtttctcttcagtatgtagaaaatgtaacccacactgctatagctactcaagtccacgcccttcacagtctgaaaaagtactaacatgaaaaatctcctcaaccaataaaactagagcagcaaacagaagacattcaagtgaaatactttttaaaaatgtatgtatgtgcatccagaattagtcggtttgatttatcttgtatgatactaactctattgctggtaaagattaattttattatggtgctcctggcatgttattttctcagttcatttctcagtatgacatttcttatttttctctgctacaaagcacccactatcataattttcacctgctgagtttatgttactgatgataatattaaaatttagagggttttttgacctttctagtggtaaattaggtcataaaaatagatgggacacaatctgataaatgagaaagagaaagatttgattattattaaagtaaaatcaaattttacaaggttttcctggcatactgtgagatcttagtaaacattgaatatcttccttctctcacacccccaaattgaattctctctattcaccgctgccttgcatatgccacacatgagaactattccaagaaccaagcgttcctgattgcttctgcatggtgcactggagatcttctgattataaaccaaataatacaaataatagtggtgataataatactaacagcttttattgagtgcttggtagatggcaggtgctggtctcttactatctccattttatagattaaacactgaggcacaagtatgcctcgctgtttaatctgtaaaatggagataataatagtaagtagcttccttaagttcacacacctggaagttagtggcatcatgactgggccccaggcagtgataccccagggcctttagtccatgctgccttctgtctgaatgatctctccggaaactatagcttctccacttggttcaagcccttgatcccaccccaagtctgttccttactgagaagcctgcagtcagtcttgagtgagttcccttttcagttgtgtgccctctcttcattgggcatgtgctcctggaggacagtgactgctctgtgatccaatgtgctcccaacaggcggcattgtgcctgtcatgtggacttggatggaccttgttaggagcggctagttatgggtccactgactttttttgcatattatccaaatcaatgtgatttcttaagaaccagagtctcacaattactaatgatgtattttcttttgggggctgaatggcagcaaaattcaacatttggattaaatgaagtatctgtacacctcagttcagtataatttgattgaatttattgagcctcctcctcttttcatttattgagtacctacaataagggtacattttgtgttaagacaacaagattcaaagatgaataatagtggttcctgctatcaaagaatgtaggagtctatagggcagccagctatgtaaaatgtattaaaatacagtatgatataagccatataaaatatattaaatacagtatgatataagccatgacaaaggaagagccagggtgctggggaagcccagagtggcacctagcctgtcctggggtggagagtttgtggaaaagtatggtccacagactggtaacactggcattatctgggagcttactagaaatgcaaattctcaggccccagcttggacctgcccagtggaaaactctagggtagggcccagcaatctgtgttttaaaaagctatctttgattcgattgcttattaaagttcgagaagcatagcctcagagaacataagactcacaggcacaacaattagacaagaaaacatatatctaattaaaacctgtaaaataagaaagttggatgatgtgatctctaccacctcagttttaactgtcagtccacgagacttttatacacatcttaaagttaactggagtgatgtgtgtttatcttcaagatcacctgcagataatatgcagaaggaagatttgtacttctcacctaaccactccaaacagattcatgagctgactgaggctgctgcacttccatcaatgcaatcatcaatcgatgagtgttactaatgtatctacctgcataggctcattactgtgttaggttctgcaaggaatacatacaaattctccactttaaggaacatgatctgagttggggagataagcctgtcagaagtgggttgttcaagatggttggaatgatgataaattgtaggaatctagagaagatggtgattgatttggactgatcttagggtaaggacctaagaaatgggaattgaggtaggcttaaaaacaggcagaatttgcattgcagacaaaaagggcgataagatagatggagaagctgagttatcaatacaaaatctaattacttagaatttttaatgaatggtgcaccaagctgaatttgacctgctgactcaagccatttattcaggaaatcaggccaacattttttctgaataccaggctgatggttattccattttcaccaaggggactagtttgaatactgtcatataaaatggtcaggaatgatatatatgcttacagctgtgagacttatatgttatgcatatatgtgtgtgtgattgtgcgtgtgtgtagtgaggggacagagaattatactgacacaggtactggggcttgatatagattgtagttgtatactgttcccatagtttcaagtcatcttcctaaaagttggcatggaaagaaattgcctttgcaaattagattctgcaagtctcaaacataagtagctcaccagcgtacactgaacagtctggaaattgtccagacagagaaagccactctgtaatctcacagagaggctgatagaacaatagaaacgacgtgttactgagcatcacggccacaagtctcccctgcaaggacagtttcaagctgggaaagctgagactttgaggtttttcttggaaaaaaaaattaatagatttctgctctattaagtgttccaagcctggcggaatgtcttcaggggaacctagagttttcagagaatggcctccatatacctggcaaggtgctgctgcccagagagggtgacagggaaagacttccctggctctgatgtctgcacagcttagaaatgcactctttctttttattttcttcttcaggaaactcttgctgtctttcgataaaaacataatttaaaactgtaacaaaacatgtgaatgtcttttcctttgggcaacagctttccttccaaattcaacttttgctctgcctgaattaggaacacgtggaggagataaacattgaggtgcagtttgctgaatttctgacttttgtgagaccctaggttagatttaaagccaccagtgtggggttcatagtcttggaggtttgatttaaatgcccagttatagctggctacaaacaggatgtcaggtccccctgggcatggtggcaggtcagtaaggagggaaggtgtagctgcatttggtggccatgaactcacaactggggatagttctcactgttaggccccagcaagggaaggggggatctccatcagagctgggaagagttttgaggttggaaggattaagacacactccagtttgttgtgggaaatttaaacatatttattgccaagtccaatctttgtttcccccaggaagaccaccaaacatgttacttgtagactgacatttgagcttttttgcttccaattcaagagccttattttaggataagcatttcattaagtgtggatatttgtgcaactgcaaacatacctttgatgcaagcagatttcacagctagagttggcaggagagctgcatgatggtgaaaactgctgctctgccgcctgccagggtcaatttagaagggctgacacgcagggcaccacgacacttaggcagctcttcctgttccagtctttcccgcctttcttcccttttttcttcattctatctttgtacctacttttttccttgtcattttcctacatatttcctcaaagaaatgccacatcccagtgagctatgtgtcaatgagatggatgaggttggagatgagcagtgtgtgaagaaatagagaatgactgccctttgcagcactgcagaaccatcctgggagagctggagagtaccaggcaaggaatccttgccaaagaccaatgtcaaagatggagtcagaccagcactggctggtgcatttcacaactctccccttcctggtctcacgtgtggttagcagaaatgaagtggtgcgaaaatcactatggaatatttaataatctaaatcataaaaacaaatgtctaggaagccctatggctcctgagtagcatacagaactaagaggaaggggagttcacctgctggtgcatccttgctcctggctgcttttataccactaatcctggtgccttgtcccctcccctgctgccttcatgaggcactagggtaatctgcttctgtccaccttttgggctcccgactctttccatagatgctactgaatgttcctcctgttccttgttgctcagggtatcaggcagtgctaagccatacctcttgtgaggcaggaataccgtaattgagccctctaggtttatttgactttaaaatgatattgcttgcatgcaagtcatgtctgtatgtttgtatatgcatcccttgttgatggtttggagcttacctggaacttcttggccataagtagaaataaatgcttaattttggggttgggttagaactcattttgttaaactttaaattaatcactcttcttaatctcacatattttctcgagaggatggacaagtctcatttgggtacggatggccattaaccttggtctggggtccatacagagcataggctctagaatccctaggccacaaagaaggttcggacatagagttcacagcacacgacctcaaataatatatctaagtattgttctcctaaattatttatgtagtatataaaatttgcctttctcttcaaaatgcaaatattattgaggctatttcctctcctgttgaggaactcagtctcttctctatgtggtaatatctagccattattatgggctgtttatttcattatttaccaagtaggggcttagctttaattaaaaaaaaatcagtgaatcttcctctgttcctaaattccaatcaagtacaaaagcttccctatttataaattgctttaaatgatagctgaattaaccaatacattgtcaatatccactgcttattatccatgagaacaaaaataagattttaaagtcccacagcagggactgattaaagaaattagagtacatctgtggcatgaaatattaggcagtcattaaaaatcacaaaacaactgataccacagaaaacacaaatgatccttagagtctatcatgaataactatatactaacaaatcggaacacctagaagaaatgcatacattcctggacacatataatctaccaagattgaaccatggagacatagaaaatctgaacataccagtaacaagtaatgagattgaagcagtaataaaaagtctcttacaaagaaaagttcagaacctgatggtttcactgctgaattctaccacatattaaaaaagaagaacaaatagtaatccaattgaaactattaaaaaaaccacaggccaatattcatgataaacatagatgcaaaaaatcctcaacaaaataccagcaaacctaattcagcaacaaattaaaaagaccattcaccatgaccaagtgggattcatcccagagattcaaggatggtttaacatatgcaaataataaagtggtacatcacattaacagaaccaagaatggaaaccatatgatgatttcatagatggtgaaaaagcatttgggaaaattcaacatctcttcatgataaaaactctcaacagaccaggtatagaaggaacatacatcaaaataataatgaccatatatgacaaacacagttaacatcatacaagatagggaaaaacggaatgtttttcctctaatatctggaaaaagatgagaatacccattttaccacttttactcaatactggaagtcctagccagagcaattaggtaagtgaaagaaagagcatccaaattggatggaagaagccaaattagccttgttcacagatgacatgatcttatatttagaaaaccctaatgactcggccaaaaaactggtagaactgatgaattcagtaaagctgcaggatacaaagtcaatgtacagaaatcagtagtatttatatatgccaacagcaaacaatctgaaaaagaaatcaagaaaactcatttacaatagctaaaaaaatgtaaaatgcctaggaataagtttaagtgaagaagtaaaagatctctagacaattatgaaagactgatgaagaaattgaagattacacaaaaaaatggaaagatattccatgcctatggattggaagaagtgatattgttaaaaaggtcaatactacccgaagcaatttacagattcaatgcaatcgctatcaagataccagtgacattcttcatagaaacagaaaaatactatgaagccacagtaaccaaaacagcatgctactagcataaaaacaaacacataagactgttaagagtagagaacctagaaataaatccatgcatttatagccaactgattttcaacaaaggtgtcaaaaacatagattggggaaaggacagtcttttcaataagtggtgctaggaaaacagtatgcagaagaatgaaactagacccctctctctcaccatgtatgaaaatcaagtcaaaatggattaaatacgtaaatgtaagaccagaaagtatgaaactactaggagaaaacattgaggaaatgctccaggacactggtctacgcaaagattttttgaggaaaacctcaaaagcacaggcagcagaagcaaaaatagacaaatggaattacatcaagctaaaaagtatttgcacagaaagggaaacaatcaacaaactgaagagacaacctacagaatgggagaaaatatttgcaaactctccatctgacaagtgattaagaaccgtaatataaggaattaaaacataaggaactcaatagcaaaaagacaaataatctgattaaaaataggcaaaatatctgaacagacatttcttaaaagaggacatacaaatggccaacagttttatggaaaaaaaaagatgaacatcactaattatcagggaaatgcaaatcaaaaccacagtgagatgtcatctcacctcagttaaaatggcttttatcaaaaagacaaaaaataatggatggcagtaaggatttgaagaaaggggaaccctagcacgctgttagtgggaatgcaaattactacagctgttgtagaaaacagtatggagtttcttcagaaaagtaaaaatagagctaccatatgatccagcaatcccattactgggtatatattcaaaagaaagaaaatcaatataccaaagagatgtattgatatattgcagtactattcacaatagtcaaaataaagaatcaacctagtgtccatcgtcagatgaatggataaagaaactgtgatatatatatatacacacaatggaatactatttagccatacagagaatggaatcctgtcatttgcagcaacgtgaatgaaactggaggtgattacgtaaagtgaaataacccagacataggaagttagacaccacgtgttctcactcgtatgcgggagctaaaaaagtggatctcatggagttagagagtagactggttgccagagtccaggcagggttagggttggggatgaagagaggttgattattgggtgcaggaatacacttagataggatagagtgtgatagttcagtaggttgacaagagttaacagtaatctattgtatatttcaacatagctaaaagagaagaatttgagtgttcatagaataaagaaaagtgtttaaggcagatgatatccaattgtcctgatttgatcattatacattatatgaatatatgaaaatatcacaggtacctgaaaatacgtacatctattatgcactgataaaatacattttaaaaacctatttaataacatgggcaaatgctcattattgataaagaaaaatgtaggttgtaaaattgtccatatgatatgctataaatttgataaaaatgtatatacatgcacataaacaaagataatggaaatacaaagaagtggaaactgatttgtgagtggtgagatggcaaatggttatctttttattttttctgcatttctacattttccacaaaaagaaaatggtacttagggataacagtatttatgcatatttatatgtatgtatattggctctataaaagttaccaatctccattcaaaacaattgcttttgcatttatctctggtaggattatcatgaacctttctgggggaggacattctgtctccaaaatgggtaacttttgttcagatcttggttttatctatacaggtatccatgtccatgtcagaccatttcacacagcactgaaatttgtttcctttgcctgattttctctaacctggcctggaggaagaaggtattttcacttctctaaactcaatctgtcagctttattaaacttgctaatcctgttacatgctccaaattcactaatgaccaagcaggtaccaccaactctggccctgataaaaaggacaaacttctagccccagcctccagcagtggaaacatagtcagctggcattgaggtgtctgggaaggaaacttctctgagccttgactggatacaagaacattcaccgtgagccagcttctgtctgtttttgacagcagttccctctctaatccttccttggagctctgtacatgctgggatgggggtgtcctaacaaggtacctttgcaatcattgaccttttcaagggtgctgggttgggacatgtgtggattttttcagttggaactatgggtttcacagtgaattgcagcacatacagttaattcacagcagaaaatgtggtgaaacagctggaagaaggcagctgcataggggcaggggttgtagagggagagcagggttagaggtggggaaggaaacattggcaggagaaaagcaataatgttacagggctataactgggggagaagagcaagttctgggtatgagcatttaatatgtggacagggtaatatattcaatagggtaaaggaaatattagtccacgaaaaatccaacttcttgacttcaggcatctgcagagcaaaggtgacctcagacatctacagatatgggcccatccctctctaaagggaagacaaagtggctcctgattttccagttgagcttttctggaggccgtaaagttctctgtaccactcattgtgccccactcctactagactctcctcccaagcctaccatggagccagtccttccaaaaaaggtctcgtctccagaggattgctggaaaaatacaaataaaattacttcaagctcatcattcccactgtgatactgacctacaggcagagaatgaggcctgatggaatgaaacaggactagcaggttttggtaagtgaaaggcatgaggacatggagtcagctccatgtgggggcagaaatcccatctttattactcatcactgggtctccaaaaccttgcccagtgcccagtgtgtccaaggctgggtaacagtaatgtctaacacatgctgatcacatcagcactgcaaagcaaggctcacagtaccctatgaggtaggtatggttattaccttaattttggaggtgaacaaaatggaagtgcaggggttcagtgtatggcttagggtcactcagattgaaactgggctgcttcatgtccagatctgttcttaacctctacactctgctgcctccctcaatgaatgtttgtgggtgtaccaagtagaaagtgatgtcaggctgtgtggggacacaaatgaggtctctgtacaggtcaagggcagcaaggaggaaggctggaaggagaaacatatggagcaggatgcaagagctgcaacacctttggtcccaagctagtgcttgctgggcttagtcctggtgggtctgggctcattttccttctttttttctttgagacagagtcttgctgtagcccaggctggagtgcagtggtgcgatctcggcttactgctacctctgcctcgtgagtcccagttcaagcaattctcctacctcagcctcccgagtagctgggatttacaggcatgtgccactatgcccagctaatttttgtatttttagtagagacagggtttcaccatcttggccaggctagtcttaaactcctgacctcgtgatccacccacctcggcctcccaaagtgctgggattacaggtgtgagccaccgtgcccggccttattttccttttgatagagctgtgggttggggtgaggaaggtgtgaaaccttatatttgtccctttctgctttgtctgctcctctcccagttcaagatcggggcccctaagaccaagcagcaagttctgggaagaaagaatccagcctgagttgttttttacctttagaagatacggtcccattctttcgtacaggttgtctttttcttttttgccttgtttggtacatcagtatgtattctctctcacgcctccctgcctaaagggtggaagctacattcagaaactgagcagaggactcagcacatgcagaggttccctcacatacatcattaaaatacatggttaatgatagccttctgctgtgctgtactaaacttgaagaatgttctttgcacatatctcttccatacgctcctaacgtctttactctgacagacttaaagacagctctgaggatttactttcttaaggaggtgacgtgaaaaactgaaaagtcttttttcttttgtgtttttgtttcactggtgaatgggaaggtgttctgtttgacagtggcaaccttcagcatcaccaattaaacctctttacaaattgcaaatgatttctttaaccccagtgtgggagtgtgaattgagcaaatagaggaatgtgaggtagcaactttactataacagaaacaaggacaggaggagagaaaattcatggaaagcttttagatcaaattgttttaaacattgctggctgaagctgtcactgcatttcattcctcctacctgatcctacagttctccctcctcatccttcccctccaccagacacacacatgcaaggatcataggtggcgatcctgctgggaagaaggtcatcaaaaaagatgcaagataagaacatgatatatatacatatatatttacaatttaagatgttgatatctgttatacataattaccagggaccaggttattcagcagtcctaggaacgtggagatagctcagagacagagatgaaaagaaaatttataggtttgctttccaggaaagaaaattgggtctgaaacaactgaaatccttaaagaaactggaataaaggttagttttaaatttggttacacttaaatggttgacttgcctatctgtcgttaatatatccagttccaactacaaagagaaaacaaccagcaggcatgagcgtgaactgcacaagtcctcttggagaacaaggcctttgcagttgacgtcagtttctggccctaacagttttaaatctgctttcagaaaacttctcctgggcatgcattcgcagatgatcttgtgataaggggcaagggttgggctttttaagggtgtgtctgttttgagacctcaagcatgctggacaatgtgttggtcagatcctggtggtacacagtagaacgtaaaaacaacagaaaagtaatactaacagaccatgagctagatgagtcttgagactaagacaaatgaggaaatacaagactctacgtatcctttagtggattccttcaggacgactaatagatactataagggtgcagcagctgcaccaacattctgaatgccaggcaattccagaagtttgaagctccctgtcagactccaccacacagctattaatatacagaatcccccagaaacaaatatgagatgcaaccaagatttatggatatgttaattacagatttataatagcaaaaacaggaagttaaatgcctgacacacaggcgtgtggttcaattatttcacatctacattatacagccgttaaaaatcatgtctttgacttggaaccaacccaaatgtccaacaacgatagactggattaagaaaatgtggcacatatacaccatggaatactatgcagccataaaaaatgatgagttcatgtcctttgtagggacatggatgaaattggaaatcatcattctcagtaaactatcacaagaacaaaaaaccaaacactgcatattctcactcatagatgggaattgaacaatgagatcacatggacacaggaaggggaatatcacactctggggactgttgtggggtggggggaggggggagggatagcattgggagatatacctaaggctagatgacgagttagtgggtgcagcgcaccagcatggcacatgtatacatatgtaactaacctgcacaatgtgcacatgtaccctaaaacttaaagtataataaaaaaaaaatcatgtctttgaggaacatttggtgacaagaaaaatatttataataatataatgaaaaatcaaaaaggtacaaaactgaagacaagatgatagtatttatttattcatttatttatgggcttttccctctggtcatatacatgactggaaaaaactaaaataaagcgttaatggtggttatctctgagtaatgagataccaagattttttttccttacccctatattcttttctttctataatttgcaagcttcaaacatacttttgctttttacttttataataaaacatagtggttttaaaaacacaattgtcagctctcacaagaacacccagctaagttggcaccagtccactgtataattgttattaataaatgataatgcatgaaattcctgcccccagatataaataattataatgaaaaataatttatttgtctcagacaatagcctttggtccagaggctttaaaccttgtgttctgccttaaaattcatcctgccaaaagtcctgtctgctatattaaatactttgttatttgttgagacagggtctcgctctgtcacctacgttggagtgcagtggtgtgatctcggctcactgcaacctctgcctcctgggctcaagtgatcctcctgcttcagcctcccaagtagctgggactacaggtgcgccatgttgcccagtctggtcttgaactcctaggctcaagagatccgcccacctcggcctcccaaagtgctgggaatacagacatgaacctccacacccagcctatattaaatactattgatgcatgaagagagaattaatacttgttgagtatgtactctaggcttggtgttaatgtacatggtttcatttaacacacaaatgaggaaggtgaagttcagaaataatttgtctcagtcacatggctactcagtgatcaaaatggattcaaaccctctcagtcgggtctgaaggcctcgtctcttttgaccaccacaaggctggtggcaacttcagatgagacgtagacttcatttcagacatttaagaatagatttgcaaaatattgccagtgctcctaatgtgagggcaaaataattgatgattaattcttttctttcacataccctagtggaggtactggggaaacttccaaaaggagacaaagttcagacagaaaagagggtgagtaagtaatccaccacctgggaaacccctgataaaacaggcagtgattgtaaagattagcccagccctctgcctagggagggaggtggccacccgcagtgactggcaaggactgtcaggttctgttacttcacaaatatctcccccaccccctaggtcaaggtgctgctcttccttcctactgagccagaaccccatctctcaacagtcattgctttgagttgataacaaagcctacgtcatagactctagacaggtatcttaaaaaagctgaaaactttcctgtagaagggacaaagacctcgaagattatctcactttactttttccattgaataataagtgacttttaaaatttttcaaaaagggcctatgggctagatactgtgttaggcctgtctatacatgtatcatctaattcaatcagcagatcaatttataatcaaaacatcttagctagaacctcacaattacaagtacttccacatacattctctcatttgcttctcacaataagccttaaggaaggcaaggtaggagttatccccattttacaaaccaggaaactgaggcctactgccactttgtctggcttattggaacagacagcagcttccctggaagccacagagggactggctgtgtgtggagtggatatgaaggttttggttgagaatgtggcagccttgtgtccctggaagacagggtgctgaagaagggttttagggtaaggatgagggtcatgaatatgagagtggaaagataaactatgtctcacaacattgcctatggggagctctgtatgaatggcttcctcctttggctttctactttctcaatcctattcactccccaaaaccaaacccaagtcccacagatccaggaaacctttcttgattatctagcacaaagaaaccatacgtgtaacaccttaaggttttcccaggccttagctcattacaatattatgacatgcttttgagataggctttgccattctttttacaagtgagaaaaaggaagctcagagaggttaagtaacttgtcaggctgatacatttaataagcagcaaagtctggatttcaaactacatcacatcatagctgcctcaacttcctgtacacttatcatgtcctgtatcttgtcatgtgtttcttaattccttaactcagttgtaagttccccgagggcagacaactagtcttatatttctttgtaacccccatttctgttcccctagaacttagcagagtcctatgagcacacaagtcctcaataaacatcatatgttaaatatctgctgggtaggaacaataatgattaagtgggatttttttgatactctgaatattaggctctctgttgtatataattaaaacaagagtgaacaagaaatatataatttctcctagctctagtgtaatcaggcattcattatcatgtctaattctgtgttcagtgaaaagaactgcttagtaagcattttctttgatgaggataatcaaatacagatatcagagagatttaaaaaagacaaaatcatcaaacatatggagaggcaatgatctacagggtataatattccatctgagactaaagaactttcaaggcaaaaagaacacttgtttactttttgacaattggatattcaaggaacactaagagaggaagtcacggtgtaactgggatcttgtaccatcacacattattctttatcaagaagatggatgcactgtgctactgttctgggtgaggaacagagaaggagtacatttcaagggctattctgagagaaggggttttctctgagaccttttcagcatgtcagtcatttaggtaccaccttcgctggcaggcaaacttaatgaatatacatgcaatgcgcaactgattaccctgtcgggtctcttgctatttccctcccagtatatcatcagttatagttttggaaatacaaagagctcaaacagactcactgaaattagaatttttgatggtggggattagctcacatacttctaaattgacatttgataaactaggctgacaatagcagtgcctgtcaatcacattttcttgccaaacccatatattaatcttaagctgctgacaggcagagcttctgatttcctttatgtggtagataaagtgctacatccccatgtgttcaaccaacgtcaagcaagaagaacaaataccaggtttgtggtacctacatttgaatcctcatggctgtggccattggtctcgaccaattccttggtaccttttaactgcaaattttaaggaaaaacaacacaaaacaaaaaaatgaataagcaagcaaatctcttaagtatatcatcttgttaactgatttatctgaggttgcattttataaaacttccaatgagataaaacagatggagcacatatttctaatgagccttattggagccagtttgagaccaatattttatgaagtttgatgcctggcaaaagaataaatgggtcttggtcattattttttaaataataagattagaaagcagttccataggcataaaatgtataaaattggttcttaagaataataaatgatttcatttcctagttggattgctattaatttaaaccctgcagtgtttgcaagttgccaccagcaaaatgatgttatattaacgattattcgtgaatgatgcattttcagctgcttttaacatgctactgtgctaccagacaggtcctccttgagaatatatttgaatgactgacatctctggaggactaaagacggttgcttctttggtagagaaagagtttggatgacatctccttggccgctgaggcattagaagaaattatatttctctaatgagatttttagcagtgaacatttgaaaacatttctctttctcagaggcttaggagtaatcagttataaggaggtttcaggaaacctttaattgtcattttatcctatcctgacgcaaaacagacatttagaatcagacggcaaaggaagagggtgagctggcttgcaactgttttgccagtattttttcctgacttaggaaagcagcatctcctccattatcttttttatacctaatacaaagtattcatggtaggaaaaaatacttaagatttgaaagaaaatcaatgcacatataccaccaatgtgtttgattcataacattggttccttctggctacttgtgcatattaaaatgaaagcttctttagttttttaaggccagtcttaaactcccagcaaaaaaaagccctacccgctccatgccaaagaaggggttttgccaaaggaatggtaacatgaagaaattgaggatcaggtagttgattatggaccaaaggctctttggctcatttccatatcactcccacttaagaaaaaagtctgcccactgttctctagggcaacatcattgatggttctacacacaacagacacaggggagcatgggcgatgtatggcatatatgacaaggcagaggtgtgccacaataataggaatactgtctattatcacaggacacaaaaggactttttaaaatcccctcactcttttcctagctgagggtttcttattgtaggtatccctcatcttcatcaacctctctgctcatcccaccttaggtcctgtagcttgtgctcccatgagttcgagtggggttagctcagaaggtcttgttctttttcagcagaagtagaggactattttgtgaatgtctgttccacctttacgtgtttaccaacataaatgtgccagttgctctcctctcttttaaataaactccattcttcccattccatgatgtcctctaactctgctctcgctttttctgctcctgtttattctcccctcactccctgtctcctggcattgttcactccgctgtgctccattgccagaaccgtggaggaaacccctccccgctgcagcccacccctctccttcctcgagctgcagctccaggacagctgctgctttgttcttctctctgctccctgttcttctctcctttagctgctactctcccccaggtagggctgaacatcctgtctgatgaaactgaggtttgtgaacaagctccagaggtaggaagctatcctcattgtaaatgagatgaaaggcaggagtcagtggggcctggagggacctagaaaagctgcatcttcgcaaatgggaagactgagagcttaggggttagcgtggccttccctggaggggctggggcctgagggtgggaaaggtctgccctcaggacctatcctttcttgtcaggattcccagcacggggcaatcctgtgaatagcaacattccaaatctgcagagcagggtgtatctttccctgcatgtgtccatttgtttaggccacatctatgtgggcactgaaactgtttacgcatagagttactctacacaaatccaaagaaagcctcaaaggcagtggtcagtggaggtgagaggtgtcatcagtgcacatctgtgtgtgggtacagggacatggaaagaaacctgtaccctgcatggccccttttgcaagaaccaccaaggggtagcaggtgaggggctcttggacaaacagcttggtaatggcaccagcacccaaaaacatttggtgtcaggcttaaagattcttggtatctgtgcttgtaaagagctatcccattgaaattaatattgcagatttaaaattcttccttctcaattgtattttctaggtctttaatgattttagctgtttcgaatcttcttcacgttctcttttttttaaaataatggagagtgaagtgtgatgtttcacccataattgtgtgtgctctgctctttaaaaatgcatgccacaacaagatatatcaatactttcagcaaaactcagaatctatttttatgactagggtttggacttcaaaataaaggatttgagtcatttagagaaaagagaaattcacccctccccactctagtcaaagctatctaaaagaaaaaaaatcggggtgagagagcagaaaacaacaaaagctcagagctatatctggttgatttggagcaaatttggaccaactcagttccactttgctgggagtcttttcataatataacagtggaaagcacagtgatttcaggtctcctcaactgcaggtcattgtgaattcagtcaactagatttttcatttcaatctactatatctgaaatcatacagagtcagcctcagtacaagttactgaatctatattcatcatataaagataattattagttttataaagcattttcttccaaagctataaaggtttataaactaatatctgtacttttctctcacaaatcactcatacctttgggagaaaataactaaaaagatattttctggaccccaaaccattaaaaaaaaatcactcataaagtgacacagagctgactttatattttctcaaatgtcacctttgaagttatgtatacagtgtaaggttatttatacaatataaaacgattatgtgtatgaaaaatttaaaacaatctgcatttgattactcacagagggttggggtaactgtatgcaactttttccttcaaattaccattcatacattgttggcagcaagtgaaggccagaaataggaaggcatttcaagagctctcctggctcctctcatgtagatagtgggcttagatttcactctgctgcctgccgagtgttccatcttaccctgctgtaagacaatactttccaatccacttatcaatgtcaggccacacttttgtatcaaagaaagccagaatgaaatgatcaggtttacaaacttcatataaaaggtctgttgctcaccatggttagataagtaccctgatgcacagggaagatactttttaaatgttgctatgaatcagtccttgttcatgtgtctgcaggagtctcatgggttatgctgaactcattttcctcactgttagacttaagaggaaaccagctgcttactttgaaacatacctcattgccagtattttgaaactttatcgaaatttgattgtcttctggaagaaactttcacacaacactggcaggcttgggcaatctaaacaagtacaggagtgaggatagcgatgctgggaatgaggttataaattccgcatagcaaagctgctaggaagtttgacagggttcagactaattgtactgcagattactttcagtaaatgtttgcacgggtgacgcacaagggaggtatgcaatggggtgtttggactgattcataaatcagagctgtttcattcacttacttgttcctgcaggacttttagtaacgcttgtgtatgggactgctcttcctttgcttgttccaattctgactttttgttgtttaactcctcctggatggttagcaattgctgtgaaattaaaggatatttagcataagtaggattgaaggtcaggtgatttaaaaatatccacaatacccattcaaaattatgagtagaagatgtttacaagtcttgaagcttaattcagacctcagttgaccttgtgtgttttccgcactaagtatcaagggcattgcagttttgacacactttaggttgtttgtgatactgatgcacaaaacttgttttcatatttgtgaaggcatcattatattcctttgagcaaatgcctatttgtaaaactatataggatagtgctaatacattacattcatagatgaaaaaattataatatagtcaacttgtccaacgttgcttcatttcacatattacagtaaagctagctttacagtaactctataaagctactttgccaagtggctgggaccacaaaagatccttttactttctctgttatgatggtgatgttttattagatcagtaggactgaagtccaaactgcaatcaatatatcagctgagaaaactgctgatataaactgtcaaaacatcaagctatggcctacactgctatttttaagcagggccactgtatggatttttgtaagccctgagcttcccttgccctatcaactgtaactcatgtgaaggctttccttgtctgccaaaagcacagcgctgcgcagtgcgaattctttgggacatggtgatatgttaatatatacataggctggagaatacattcaagagctgcaaaaaggccctggaaacagctctgactattcagagcttcttgacaacaaaggactggttcgaaaagacagagtgcatttcttctgctactgtacataacaattgctgtactaatgatctggaaatgttagtggattcctgctatgaagagacctgtctccaatagccaggctacttcttcagggccttgacaagctggctgcagagctgcctggccagttcctaaccatcaaagcctggagaaacactggcactggatttctcaggcttaaacctaccaactggaaggattaaattaaatctccaaatctactggtttggggggattttgcagggtaggaagtactcagaaaaacacactgtgctttccctgggacttgcttgttctgctaactactgtggcactgggtataaatgtaagaacctactttggtcctgtagcataaacagtgatttcttgcaattttctaaaagctcagtgtgtcctatttcaccacctgcccatggaataatcaatcacatgtgaggtaatgtacacattccatatgcgctcacttaacaatttgtgggatttaattgtgcatcattgattaaagtacagaaaccaaggagcccattttgcactttggcacagtgacaagcacctacattgtgtccagaccgtggggaatggctctgttccttcattcacattcctgactggccctagaacagttccaaagggaactggtgccctgacttgggtaatgccgagtgaattttacttcatgagacgatttcaaatccaatccttaaatctcttttgaaaaatgagccaaatgaaagataggaagttgtcttcaaaggtaggtagctcatgtttgcttattgcagcacttgaggtggcaaaaccaaaaataactgatgtccagaagaagggaggtggacattaataatcgtgtatctgtatcatcagacactatgcagccatttaagatgaagttgcacaaatgtcttctaatgacacagaagaagctcaaaaagcactgctcagcaaaaaatacattcaggttacaaaatgtaactttgcagcatattcataggaaaggatctagatgctgtctctgggtgggtgggttcatgtatctttcttttttgcttgtcagttttctggtatatctgtaacacatactgctttagtaatgagaaaaaatcaaatgaatttaagatcggggaagaacaaagagaggaatactacttggacacctctctcagctattaccaatactgtgaataaataagagggagaagtgcattggagtcttcattgcatccgcacacttacaactcttccttctattaaaacacacacacacacacacacaagcatgtgtgtgcatatacacccctttctcttgaccactctttttcttttagcctccctcttatctcatccattcttggattcacactttttaaatgaaatgtcttccctctcatcagtgcttccttttcttcttatgtgtcagtgatgtagtgtctagatttttatttcaatgtgtttttccaaaacatatattgtcattgttttgtgtgtttttttatgtgatattatgtttcttattgtttgctatgttttaaattagcattatgtttttaagatccatccatgttactatttttttgttaatgaatttatttaaaaatctaatagattttccccttttattcccaaaatgtgctatacataaggaaactttgaaattcccttgagattttactgagcttgatttattattattttttattatactttaagttctgggatatatgtgcagaacgtgtaggtttgttacataggtatacacgttactattttatgtatctaatccatgcttctgatggggtatatccaccccattttacccaacccactctcacagtgaaggccattcagattaccccaattcttcccactgtatacaagcctgcaatggaatatgctagtgcaagttcccttatggccctgtgggaggatttccctgggatgcatatccagtggtggaactcttaggtaaaagagtgaatttggcaaagctgctctctgggatggttatgccagtctacctgcctgtcagtggtgtgtaagagctgctgtgctctactgaataataacactaaaagcattgttcggctttctaattgttgccagtttaatagaacaccaagattcttcatctttgaaaaattttgtacttctttgattccctgtgattttaagcatcttatatacttgctagctataggggtttatttataatttttaaaatagtcaagagcagtggttcttaattctgactctccattaacattatctgtgaagattttcaaaaaaatacttatttctgggcctgacacaagaccaattaactcagaatattgagaggtgggacccaggcactgaccatttttaaaacaccttcacaggtaattattctaatgtgtaactggggatgaaaaccactgtatcctgaaatgcttatttaatcttgcttatttaatcttcagtctactataatgtgactttaatccctagtactctactcagactgttctcactacagtcaccagtgccttgctaattgccagctagtattccaggttcttttcttctcactacacgctctctccaggggatcctattcacgcccatggctttaactacacatcacatgtgctggtgctttacaacactgcctttacagcctctgcctctttcttaccacctaccagacccttcacttcctgtgtttacaactgtgcccattagcacacctacccttcccaccccaaccagtctaaacgtctttccctggtaaccagagttaaaaccttgaagtcaacgctggccctttcatcaccttcacaacctctttgccggttccttgaccttttctccatcccatccttgctgtcatagtaaaggctaccatctcctctcctctgggtttttcctgttccccctgccatttacccgacactcctgagagagttgacttcccatgaattaaagtgctcccatgattaaaagtactgttaattctctaacccctatagataaaatctaaaccactaaactcatccttccccagacatgccagctgcttccatgacttatgacaagtttaccactcagaattctgcctggcttattcctactcattctttaagcaccacctcaaatgttgcttttggcccaagatcaactcagatgatgcctttgtaaaactgaaaagagccccatcctctctaggtagagacaatccctcaccaggcatatggttgggcactggctttgaggcttgatttcattcccacttacccctttggcctgctgctcttgtccagggcagaacctacactacgaaatgcggtagccttgggttcttgctccaaaaaaatattctctaatcactgaagcaaagttagttcatctatcttcttgctcccaaagcacttaattcaatataccacatttcatatctgtcttcccaaccagactacattcaccaatattaaggtcaatgattaggttacctctaatatataatagctgctgaatgaataaatgaataaatgaagggataaatgaatgtttgctcttgtttccccacttctatgggattaaaccatgatccaacaacaaacaataaaaaacccaccaaaacaacaaaaacaaaaacaaccccccaaaacacctgaggaatgataaactactaatgtattgttctaaacatatggatacataaaactttttgaggaaaacagcagtttcatttaagacattttgtttcattacctggcagttccagatatcctttttaatctgaaaagaaatatttctcaacaggctaaggaaatccaatcaatgaatttataattacgtaatttattcttcaagtttcaccacaataagaacaaaatcaccattatcagaaaaataaaatcactcctagactgttttctgcattctgcaaagttaatgtgctcttttgttttcaaggtataaactcataaactaatatttatatattcaaaacaatggtgattcaaaactgccactcttcatgtgactagaggtcctataaaaacggaggtagttcacaactagatgatttaagtcagcctttctggtctttttcacttgaaatttatgagtctctataatattctttccagtttgaatttttaagtactaaagtgcctcaattatagaagttcataagcagctagaacttaatcagaagagtctcttggttggattggctgatggcagcgtaattttaacatttgagagtgtggcattaaacagatgcactattacattctttggtggttacaatggagtgtgttccaattagacaattatccatatgccaatcaagtggaaacacttgggcggaccataagcaggtaaataaatgctgtacctgacacatcttgatatttccaggccactgatttaatgggatcatttgtaatgctctttggggatgcagacttcagtatgtaatgggtctttctttctgacaaattcaaagagcattacaaatgttatttggagccctagaataagtgaggtcacatttccatttttacagatgggagaatcatgggcacatagagattaaggtcatgctgtctgggagacacctaccacttgcacagttcaattttcctacctcaacccgtggtttctatcctggcaatcacactgcactgtgaatttggaatggaaatcagaacatgccaaacttaaaaatcctcctagcaacgacttctatctaaacattcatcatttccacttaggagccaggcttgttacagacatgcttttgtgtatacttctgtgagcggtgtgtcaaatttgacgtccctttaagaacaacaaccccttccttgtcttttttcttaaattgtataattttgttaccaaggtgaagtttttatatagttaacagactatgtaagtttggttccatgaaagtcatagatgacagtgcaaataccctatatgaaatacatcagccacatcttgttgtaagctgaaattcacaggattgtgattaattcaggaatctttggcaggatagtgtggggttaggagaacttctgtgggatggaggagtaagtaccctttctaaatttaggttggtggtgggtcaggtaaactaacacaaggtagatagatatagacagtgactgacaccaacacacacacacacacacacacacacatacacacaatttcttttcttcttctgtttcaggatttccccagtgcttggctctttgtttagttctaaaacaatctgctaatatttattcattcattcctttagtcaacactgagctcctgctgtgtgcatggtactgggctgggcaatgtgaaagatacagaggaaacaacagtaaatagcctctcctctagatgctgggtcacaaaaattcttacatgtacatgataactaagtcaggacaatacaaaggactcttacaatggctataactagtatggtttccataggaatccaggagatttctggggatcagtttaggggtcaggagaatgagctcaggggatccatcttgaatcataacttgttccacttattggaaatgagccactgaatattcacgataatctgggaatatttgaacccacagaatgttatcaatttaaattcaatgtgttttttactcttttggttcagttttaataactgttgttccatctctgtaactttgctataaatcagatgtcctactcagtgggataatcctttaaggctagcagagtatcacctaaggaaatgagccccagaggtttccaaagggaattctcaccaaaggcgatggtgggtgtgactgcgtctgatggtctcatcccagcagtccttttaacatttgctctacgtggcaatacccatgagtgtcccgccccatcctgcctctgtaaccctgttgccaacctgatttttcccagtattttggcctgcaatctgaactccacctgtgaccagctctgccagatccctgtcctactgtagagcttgagatggaagtatacaccccttaatcccctttctcttggtgggatcctgttacatcccaccgccccacagcttactgtgtcttcaggtctccccaggactctccagaccatccactgctccatcaagttttggttctcactgacttcagaactctttaggaatgtcagccttaggtcccgctgatgaggtctacctatgcttgttttccatctgacactgaatcctgagctaatccctgattgttagagaaagtttgagatttaaaaattcaagtgaacattatcacaacctaagagcaaggctttgcctaaaggcaaacacatctaacaggatttctgacaaaggagagagcctgtctctggggaaggacaatcatttgccacctggtatctacaatgctcacttttctccttggggaaaaaaagaattgaactagcttgaattttcttgttacatgggcttgtaagactactcaagatctattctagtttaaaacgtcatctgcttccacctggggatgaaactgcactcaatttacactaaggcatgagggtatccaagcctatggccagtgtattaaccctggtgcccccctccctgcctcaggcatggtgacccctgggggagaaacatctcttggagagaactccaccattcagacgactgataacaggaatcctggatcatggaaatgaaattgtgttcacagcctaatatgctattacactaggctatacatatttaattccttgggtctttcctcataaatcaattcctctaggcctttaatctcgtcaatatcttttctgatattgaattttaaatgccattctcattgctaggcagaaggcaatctctcattcatgatgagatcaggcttcatttatagctgagagatggtgggagcatggccctgttccctgaccctgctgttaagatcctaatgtcagctagaccgcacagccgaggtgcaggcctgcctgggttgatctctgagaggtcaagataatgaaccctggggtcatgcctatcattactctgggagcctgggacagctatggagaggagtgagaaagctcaagtaagtgtttccaagggtctggcttctcatgggggtgcctgaggcatgaaggaccctgctgcaccctgacctggcaaggatccctgtggaccgagtaaggcatgagctgaaggatgcacactgtgtgcgtacatctgagcaatgtctcccagcgcaggggtgaagggagggcacaggctgtgtgttcgctaggggaaaagagggcatggaggaactccagagaacaaggacttagagctgaaaatgtttccaggttccctagggctggcctggaatgcagtgggatttcctctgctgcagagaaaaggaaaaaaatccaagaatctttgagccatgaaaaatctccaaagggaggagtgagtttttttaggacctcaggaggcacagagaggttgagaaaacacaggaagccatctgagatacagatttgagggcctaagtctgcagcaagtggcggggcaccaaggacggggcctgggctacctgccttggtgtaggagttaagcaggtacaattgtacaaaatgtaaaaacaataataaaactaaaggtgtatccatctatcatcactatgcaccagcaattctaagcaaaatcattgataaaactctccttcctcataacaatcttttgctgatctaaattctaattgttgccattactgttaagatttaataatatgtatgtaatcttcaaattagcatattctgttgcttaccctttaacaaacattttatgtggcaactgatttggaaaatttctagctttatacagtctgccccagctctctctcacacatgacttagctgcacacatttgttctgatttgagcttgctttggatacagtgtctccagcctcctgtagcactacatatattctgcatttctatactagattcaaaataaacaatgacagcacagttttgcaaagacgatgaactagaacttgagctacttccattcatcccacaggaccactctgagaatttttatgtttaaaatttaaaacaatgaaacatttttagttggcaagtgaaaattttagttcatatgtgaaatatgtttacgtttcagtatttttaaaattgaaaattttctttatagattgcttgctttaaaactaaaagacaaatcaagaaaatgttacatcagagacacaatacttgcctaaattgtgccctttgcatttggttttattaatacttatgatttactggacaattatttatatacagcaatatgttaactataatcaagaatcaaagttctaactgttaggtaaagtaaagaaaactattgaatagatagttgcaattttttccttttatcacactatttaattttcttactggcataaatatacatgaagttcaaaagaaaaaaattttagtctgcatttctttcttggccattattattcattccattttatgataattaatgaaaataatgttgtctaaatttagaggaggaaatatttaaaaaaggatcctctgagtgttaaatttcactaggtgcacaattatcaggcagccagtgcctgagacggggagagtcatgaccttggcctgttgggctaggggctggggagaactgtttcatcagacaagattttagagaccatttcctttgcttgaatgtacccctgggagggactggtgtgaaagacagatgcttcgtggcattcccataatccactggagttattaatcatgatatactatatcccaatatggcaacattattctgaaaagaaatatagtcaaggactggcaaaaaggcaaaaatgaagctgcatgtcggcatttcaaaggctagcgtgattagctccattatcagcttgctgtgcaagcttgaacaagctactgctctggtctcctcttttccccaagccttctatccttacaactgccaaatgaggaattattgatcattcacaaagcaagatatcaatgaatttcttgactacagaacacagtaaaggtagatgtaaaagtggtttggaaggctctaaaatctattttctcttctacagatgattttcttaacactgtaatttgcagggtcatctcaggttcccgtttttcactttcttcacatgttaaataaatataagaatacttaccagtgggatattgtatgactaaagaacatgtgttaagtatgtgatgctccttgaatgacaaaaggtgcccgctgagttaaatgaaagtgctgtcattatcctctttgcaaaaatggaaacactaagtcccacgaggtgaagtgacatttaagtcatatgagtgggcagtactggggattaatattcagagagaaaggtcggttgttcagccccagcctagccatgctgggtgcactccttcagcccatgctgaaaacataggccagccaacttgaattaacaccattcatgcaattcacaagagaaggtgtcaaataccttgctgaagtaggaacatgtatcagtgacattctctcccttgcctttgctggcagttcttctgcaaatggtaatccaatttgcttggatttatttattcttatcagttttgttttttgcaattatgtgaggtggtcatcacccatcctctgggcacgtgtacagttgttaatgtagaaatttaaaatattaacatgctttccagccaggttggcccatttacttcaatcaaataagaacttgatggaacagctgggtcttgcactatgccctgaaggcctacagaaatttgttctttctttacagattttataacctagtcatgatcagagattacagctagaaaaacccctatgggtgacttgtagccaaagacctgtggccctctttggaggtaccttttgcaagcgatctgggcctcattcagtttaaccactggagaaccaaacaataacttgttttagcatcattaacaacagatattaccatcatcactagtctctttggttgcaggtttaggaaagaagcttttgccttaatcattatggaataagaatgtgttggagtccagagagcttttagttgaatcttaatggtgagagttgcaatgatctagcctgttttgcagatcagtgaagagagaaaatacagctgaaggtctgatccatcagccatagatgtctgactaaggatggaaaactttattatggatttagaaggtctgtatcacctatattacttaactcctgataattgtagaactttagtgaagttaatccaatgattacaatattcccaatttttctttgttaatacaagtaaacatttttacaactaggagaatcacacatttaggagcagggtaaagagagaagaatagctctgaacttagcacatttaatctttaggtggctctggaacaagatatgtaaataaatgggcacattcatcaatcactaagggaagtgagagggagaggaagtttgctccttcccccaaagtttccaagttatttaaacacatttaggctggtctggaacccaacattttaggaatgtcagagtaactagaacctttggaggtctccaagtttcacctatgccctaatccagggtcaagccctggataaactggtgagggctgcattagacaggaacagtttccccataggctttcaaccacctatagcaactactgaacctctgaactatctcagatttgccctgtctttgaacttcagactctctgtaaggaaaaataataataatagcagcagcagcagcagaaaacctcaacaaatactgccattgtgaaatgtgccacatattcttaatacctgctgctgaaatctatctggcaaaatacaatacagcaccaccatcttgcatagactccaaagtgtagaaaattatcatcttaaaccaatctcctctgcttcagaaacattaaatatagaaagcattaaagaagtgagccgagttagaccttttgcaataaatggtgtcagcatggccatgaatgataacagcaaaaaaggcctccaagatatgaaaattaagagaaattagagccccagcttcacacttattattaatatccacatgcctgtgatgaagtgctcctctagctttagcagtccccctactctcagttggcaattgcatacattttaacattgcatgtgatgtttacccgtgaaaatttccaatcacaagttttgctgaagtcatctgaaagtccagctgctcacagtgatggcacaaaaaagatgatcatttgtgatatatgggtatttaagttttcactgtagaaatacgggagggataacaccaaggttagtgttgatgacttttcaaaagggaagaatagggagaccacgtttttagggtctgctggtagactttatgtagcaatctttttctgcttccagggacaatttgaaaatgtaaatcatgatacaaagcaagtgacataaatcagttgcattctagtccaagtgattatatgaggattgaaagagattatatcgggattaatctgggaaggttaaaaaaatcacattttgtcactgaggttgctggggataacctttaacaggataagaaagttcctttctattccaagttgttaaaaccttcatttttcttggttgttttagtttaaaatcatgaatggatatttggtggccatcaaaatgtttgtattattctggttttgcctgttaatgagatctattacattgatagatttttcaaatgttgaacttaccttgcattcctagaataaatccaatttggtgatttataaaataccagattaattttgcttttctaaaggaattataaatctttgtttataactgagcctggcctataattttttgattttaacttttaactgtccttgttttatttcagtattaagtatactagccttacgaattagttggaaagtgtgtcttccttttgtgttctctgaatgagttagttaaagattggtattcttttttctttttttttttttgagacagggtcttgctctgttgcccaggctggaatgcagtggctcgactgcagcctcgacctcctaggctcaatgatcctcctgagtagctggaactaccggcatgtgccaccatgcctggctaatttttaaattttttatagagacagagttttgccattctacccaggctggtctcaaactcctgggctcaagggatctgcctgccttagcttcccaaagcgctgggattacaggcatgagccaccacacccacccttggtattatttttcttaaatgtttggtagaacttgcctataaagcaattttgggtctgttgctttgatataaaattttaagctattggccaggcgcggtggcttatgcctgtaatcccagcactttgggaggctgaggcgggtagatcacgaggtcaggagtttgagaccagtctggccaatatggtgacatgccatctctactaaaaaaatacaaaattagctgggcatgcacctgtagtcccagctgctcgggagctgaggcaggagaatcgcttgaacccagaaggcagaggttgcagtgagccgagatcacgccactgcattccagcctgggtgacagagcgagactcggtctcaagaaaagaaaaaaaaaaatttaagctattaattcgagctttcaatttctttccaattcagttttgattagttattttttcctattgaaatttgtctgtatctccaaagttaaaaaattgtcataaaactattcctaatattcttatatttctttagtctctgttgcatctatagttataccttatttttaatactgtttttaggttgttctctttttttcttgatacatgttgccaaagattttccattttattcatcttttcaaacatttggctgtgttgatcttctctattgtatggttggttgctattttagttatttttattctttgtattatcccctctactttgtgtttattattttttgtttgtttatttgagacaggatctcactctgttacccaggctggagaatacagcggtgtaatcatggctcactacagctttgacctcccaggctcaagggaattatcccacctcagcttcccagttatctgggaccacaggcacgtgctactatgcctagctaattaattttttttttttttgtacagatggggtctcagtatgttgaccaggctggtctcaaactcctgggctcaagcatatcctcccgccttggcctcccaaagtgttaaaattacaagtgttagcaactgtacctggcctatttttttttcaatagaaattggatgcttacctcactgttactagttttttttcctaaaacaaagttttaaatttttcctttaagttctgctttagctgcgtcccacaagttttgatatattatgttttaattatcaattacttctaagtatttttaagttaattctgatttctttttgaagctgtaaaaatgatgtatgttttaaactttccagatatacaaaatttattttagttatttttggcactgatttctaacaatttagtgtggtcaaaaaaatacaataccactcttttgacatctgttgagatttgctttaaggcctagtatgggattaatttttgtaaatgttcccagtatatttgaaaagtatgattttctttatatgtcctacatattgagcttatagtagtatatatttacaatgttatggacttcacagttaggcctttacaaaaacttcctgaaagtgaagttaagtggcactgaagataagaaatacaaaccgttaggaaagaaatataaacaccagagagaagaggacaaggtgcacggagaatgagagaacaaaatcatggcataccaccctatgtttaaatgactgaaaaatgtgtaacacactgactcagcaaatgactcagtataaaatgtaaatcatgggtggaaatatacatatcttaataccatgaatgagaattccaaagctggccaacgaaagccactctgactgaatctgagtgatacctggtttaaaataaattaagatggtaatggtggtggagggcataaaaaatagaatgcagttgtctggtgggtcagcaggatgaattaagagaacaaaaggaagaagaaaatatgataatttatttttatctctttgaaaagtcactgtgttggtctttcatttataagcgctacttattacactcttccttggaaacttactgacaaagttcaaatatactttcttctttattttcttccccagtaaataaggctgttgtggctatttgttaaaggtgtgtgtgtgtgtgtgtgtgtgtgtgtgtgtgtgtgtgtgtaagagagagaggggagataggaatagagacagagacacagagaagaaacagaaagcgcaaaaactggaaactggagaggtaatgagaggcaattataaaagaggagatagaaatatgtagagaaggagagtcagagacacagagagaagaaacagaaagtacaaaaaccagacagtaattaccagatggaagaagctgcacatagataagaacttgaccatgcagggtgtattcactgatcaattgagtgagatgggtggtctgtaaagtgaggaccagattgggcactaacttgtttaagtttcccttgatgactattcagggtgctttgttaaacagaggagaaaacatagtctttaactaaccatctaacatcttggaactgaattcccaattccacactttggttacaattccagacactttaactgactaagtttggctgttctattggccagtatttaaaaatgattaacactctatgtttatatatatatggagaaaaagactgaaaggctatatgtaaatgttagcaatagttatatctaggtagtgacattatgaatgatttttatttccttttatatggttcttttatgtttccaagttttgtgcattgagcataaattcttttgtaaaatgaaaaaataaaacaaaaatttaaatgacaaaccgagacccaggaaaactgctactcccacctatatttctcttcctctgtgctttctcttagtcatataagaaggattttttttgccgaggcaggcagatcacctgaggtcaggagttcgagaccagcctggccaacatggtgaaaccctgtctctactaaaaatacaaaaattagctaggcatggtggcaggcacctgtaatcctagcactcaggaggctgaggcaggagaatagaatagcttggacctggtaggcagaggctgcactgagccgagattgcgccactgcactccagcctgggtgacaagagtgagactctgtctcaaaaaaaaaaaaaaaaaaaaaagaggaattcccccctcttcttctttcttctttgttccaatgctgtatttctttgtccccccatcaaatttctccctgcattttcttcactgctttcatttctgatgagaaggaaattggctggtcttcctaatcctgttgcctctcctagccagctgcatagaggaaagccctggagcatgaagacccccaactgcggccggagttgaaatgggtaattacatcagtctggctgggagcaggacacctgctatagacagccaaccatgttgctggcagggttcagggcttcagtgtgaatgagtcggcttcttggcattggtagactagaaagaaatgaagtcaaagccagaccacaaggaatcattttagtgtccatagctggagggagaaagatgacaatggtcagcgtggtaggccagtatatgtctgcagcaaaagtccgctttgatgtattacatttaagaaaagatccatttcactataaatctcgtactcatcatgtgatatagactgtaagtcaggaggcagtttccaaaagaggcagtgaaagggaaggtcattcaaaggtcatttaaagactgccaggaacacagcgttgggaaaaggagagttcctttatcctgggaatggaagtctactggagagtcaggatttcccattgcagacatcagggaaagcagcaaaaagcagaagtcaaatgattttaatagtctgcagggcaatgccattatttttgcccctggctcctacattgatttgtctgctagcctcattattttgagaaggaatgattactaatgaggatgcatttgatgatcaaattaattaatggcagagcaggataactaatgatgagatgaagcctctcatagttaaattttattagggcttctcttccccttcccagaagtgaattcagagatttattttcatgattcaaatttaataaaagctgcatctatgttactttcctttcgcaggttcttgctctgctaatgcaaagaccaaattaggggctatgacacagagtcagaaaataggcaatgggtttttgccagtaatattttagcaatctatctccaagcatatgaaggagggaacttcttgtcttctgctgtcttgatgactgcagttctgaagcactgctttcagggtacactctggaaagccatggtgtggggttatagagggaacacaggggctcagacaggcctaggctgcagttctgactctacatggtgtacctgtgccctgggtcagtcacctgacacctctaggtctcagtttcctacttgacacactgggacagtcacatacccctgagttgttgtgaggaccgcataaaataacatgaaggtgcttttgtgagttaactggagagactggccttcctgttgtaaggggcattggagtaaacagcacaggccaccctgtgtcaggaaattatgacctagacttgtcccgactaactctgtgagcctgagtcttcttttaagcctcaacatcttttcatattttcacctggaatatggcaatgacagttcacacttgtgagtagcttttcaaaatgtcctcacgtacatgatcacatgtgatgtatgattttatcgtagcaagcccttactgaggttggaggcacctggtctccaggagaagaactggaggtccagacatcctgagtttcccaaagaagtacagaaaacaaacagtgaagctgaagtcacattttccttctactagttcagtgttttcatttcattattcatgcccttaggtggcatcagtacggcttatcttcttcctcatcttatgacctctggtcagtgaagacggcaagatactcagtgggccatcctcactcaaaactgctaaaaaacatataaggaggcttcctctcatcttcatttttagtctttgtatcttgtccagaatcaaaaggaaaagtgctctgaaaagtcccaaacctcttacagatgtcatgtgtgatcctttcaaacaggtagggctttgtaatgtaaagccctgggccgagaattggagaattggtttctatttctggttccaaatggagccaaccgttccttcaagagtctcacactgaagtgagatacttaccttcttaggatgtaccaggagtgtaatctgcaaatgtcagaaaatgcacacactgccagcaggaaccctacaaatgaccttgaacagcctaaagaaaggtgccaaggaattatgaggattatcatcttgtggcctgttattataatgcaccatcccaatattcttggccgaggaatggataaaaaatgaaattacaaaccctggaatagttaaaggaagaccatggtggaccccaaatttggcaactcttgtgaaccttgatgtttaagtcactaaacctttttaaagccgtgtaatctgagagatgtacatgttttaagatttttctgattctagtaaaatgtcggtggcttttaatatgaatgtgggaaatgtcttctgcatttcccacagccatattctattctatcctattcagaaagaaagaaacttaatctgggttgtcgaagaatcagataaacatggggtatgtctttgcagccacagcttgtaaagactccaggtttttatatgtgtatgtctatttatacatacacatatttattttttgagctttttaaagctgaatatttgactacttgtacatgagagtctaagagaaaactcctttctctacactgttaataagattttcttgccctgtccagtgatactgaattattttctgcactaatgtataatctgtcatatattaaagatattaggatatcattcttcctgaatgagccaataaccagatcattgtgtatgggctattccttccttctaattgaacatttttgaggctcatgaactctacttagaaggtagatcctcctgatacattgcaacttaatttccaaactttctatctttagtttttttttacattctacatctaagtatttacatctttcataatggctcttaaaattagtaaagtttcaggatacaataactgtgtacaaaaatcagtagcacttctattcaccaacaacatccaggctgagagtgaaatcaagaatacaaccctacttacaatagccacgaagaagataaaatacctaggaatacagctaaccaaggaggcgaaagatctctacaaggagaactatgaaacactgctaaaacaaatcagagacaacacaaataaatggaaaaacacttcatgctcatgggttggaagaatcaatgtcataacaatgttcatactgccaaaggaatttacagattcaccactattcctatcaaattactaatgtcattctttacagaattaaggaaaactattataaaattcatatggaaccaaaaagagccccaaacaaccaaagcaactctaagccaaaagaacaaagccagaagcatcacactacctgacttcaaactatatactaaaaaaccacagcaaccaaaacagcatggtactggtacaaaaacagacacctagaccaatggaatacaacagaaaactgagaaacaaagatacacacttaacaaccatctaatatttgacaggactgacaaaaacaagcaatggggaaaggactctctgttcaataaatggttataggataactgactagccttagacagaagattgaagctggactcctaacctttcactgtctacaaaaattattaactcaaaaccggtcaaagatttaaatgcaagacctcaaactataaaaatcctagaagccaatctggaaattctcttctcgactttggcattggcaaagattttttggctgagtccccaaaagcaattgtaacaaaaccaaaaatagacaagtgggacctaattaaactaaagagcttctgcaaagaaaaagaaactatcaacagagtaaacagacaacctacacagagtgggagaagatattcacaaactatgcagctgacaaaggcctaatacccacaatctctagggaacttaaatcaacaagcaaaagccaaataaccccattaaaaaatggacaaggcacatgaacagatacttctcaaaagaagacacacaaatggtcaacaaacatatgaaaaaatgctcagcatcactaatcatcagagaaatacaaagcaaaaccacgaagagataccatctcacaccagtcagaatggttatcattaaaaaagtcaaaaacaacagatgctggtgaggatatggagaaaagggaacacttatacactgttggtaggaatataaattagtaaagccactgtggaaagcagtctggagatttctcaaagaacttaaaacagagctatcattcgacccagcaaggccattactgcgtgtatacgtaaaggcaaagaaatcattctaccaaaaagacacatgcactcacatgttcattgctatgctattcacaataggaaagacacagaagcaacctaggtgcccataaatgataaatttgataaggaagatgggatatacatatatatatatatatacacacacacataccacagaatacaactacaaccataaaaaagaatgaaatcatgtcctttgcagtaacagggatgtagttggaggccttaatcctaaacaagttaacatagtaacaggaaaccaaatactgcatcttctcaattataagtgggagctaaacactgagtacacatggacataaatatgggagcgacagacactgtgggctgctataggggagagagggagaagggcacggctgctggatactatgctcactacccaggtgatgggatctgtacgctaaacctcagcatcacgcaatattcccatgtaacaaatctgcacatgtaccctctgtatctaaaatagaagttgaggctgggtgcagcggctcccgcctgtaattccagtactttgggaggttgaggcgggcagatcacttgagatcgggagttcaagaccagcctggccaacatggtgaaaccccgtctctacaaaaaatacaaaaattaaccaggcgcagtgacacacgcctgtagtcccagctactcaggaggctgagacaagagaatcacctgaacctgggaggtggaggttgcagtgagctgagatcacaccactgtactccagcctgggcaacagagtgagactccatctcaaaaaaataaaaataaaagttgaaaaaaatttttaaaagctcttagaatacaatttatcattaccaaatgttgaatttttcttttaaaggggtttctctttttccatttttcttgtccttctatgcttgtgcattttcctttgaaagcggtttttaactggagaggaagaactgtttgttcttctgcatccctcactacttctgcacatccttcccatccctgtgtctggaacggactctactgttctgtgtcctgcacatgcatgggggcttaggcgtgccctgctctggaccattagtcctgccaccttctcttctagaacagggaaacagaaatagtgtggagagcaagttcactatctatctttgttccatatttcaacctcttcatgtcaccttttcctatttgtcttcctttctcactttcagaaactattttactttgtgcatctgcctcttcttgctgattcagctatcttcactccaaagtgtgccaccttaagttcccttgtccttcctcctagacattcatgaacctgcttgctgttcctcctttctctatatgtttccgggcagccagaacaatttgcaatactctccatgcttcccactgcaccacttccccctgccccaccccagccacatggtaaccaagaattcattcaaagactgggttaaaggtaaaggcccccgaaacaggctcctgttcaagatgtcagaggcaatgtatgtgtttgtattttcttcctccagagactcaattaaaatatctgtcaatgaataaacttacaaaaacaaggagaaaggaaagtgagttccaggagttcctagtgtatgacaggttctggcattcaagggatccccacatctccttaaaatgaagcctgcctgtcaaagagctcttggctggccactgcccaggagaaagactcggccacgcagcagatccagacacagcaatgagcaaagccacagagcttcacagaaaagcaaaccaagccctccacacctaaatatacacagactgccagccatcaccttgctcatgaagaaacctgtacataaaagagagagactgaaacacaatagctaaacaactaatcctggagtaaagagagatgattcaggaaccacaaagatcttaaaaatcctacttagtattcttaaaaagatttgagaagatactgcacccataaaatacgaataagattgcatgagaagataatgattagaggacaaaataacctcttgaaaataaaataatatgattaccaagcagaaacttcaattggaaggatcaaagataaagttaaaatggaagatactaggaaaaagatgatgggcatggagcgcccacctattaggtccattatctgactggtgggtatttcagatagaaattaaaaacagaagacaaaagtgaaaaatgatcaagaaaaaggaaagcctcctgtcacaaactctggtgacactctgtgctcctgcctgcagccctgcatttgctcagttctctggagcactaccttctgaagttggctgggagcatctggtctgctgcacttttgaggctttccacaatttttaagggacaaggtttaaaaaaaaaaaccctataaaatattagtgaatatgctcattttatctctttccctaaagctttctaatcattaaaagcaccaataatgctaccacagcctccttcaccaccatagccaccaacacagccatagccaccgttgccactatggccccttcaccaccatagtcatcatcctcaccataactacccttcatcaccacagccaacattaccatcacagtcaccatttctaccccagtcaccatcttcatcacagccacctttaacaccatcctcaccatggccatcaccacaaccacagccactagccccaacatggccaccttctccaccaaagtcaccatccttgccacagctgcctccatcaccacaaccaacattagcatcagagtcaccatccccaccacagccaccttcaccatcacagccaccaacacaaccacagccaccatcctcaccatggctgccttcattaccacagccactacagccattttcactaccatagccaccattctcaccacagccagcaacacaactgaggttaccacccccctcacagatgccttcatcactacagttgacattaccattagtcaccatcctctcactacagtcaccgtcactaccacagtcaccacagctacctttaccaccatagctaataaggccaccacagccagcacccccaccacggccatcttcaccaccatagttaccttcacaagcacagttaccttctccaccacagctaccttcatcaccacccccaccatagtcaccaaaacaaccacagctaccatcctcaccacaatcaccctcacctccagagccaatatcactactgcagtcacctttaccaccatggcaaccatcacctccacagtcccttcatctccagagccaccatcaccaccacccctaacattattatgatcttgattttgacatataacatcagacttaattacatgtgagttttggggaggaattgagtgcaagcttttctctttctctaaaaaaaacgtacttactaagcaactaaatagtttaaacaagattgcagaagacatgctgaacttacccaaggggtcagatgtaatcactatgtttaatttcaaaaatactttcatttattccttagcagatattccaaagtctgactcttacccaacatctgacaaaactaactggggttactttgtattttaggaaagtagtaatgttatatttcttcatcttccataaaattagtctaagtgggtgagattttaacaatgcatacacagaaaatcacacatatgttctactttgagtataaagaaaaaaatgcttgtcacttaatttctaaaatgcttttgatcataatcatcctacttttcccattttttttttcctgatcttcccttgctgaaagttgtcaagacagtggaccaggcctgcaccttactaatgtcaagctaagagtgtgagagagactgctccacatgggccactggcttgctggcctaagacagctggtcttcagactagatttaacactgttcaaaagcatcggcttatttaggaaggagccctttgacataatcatcattagtcatacgcacttttatgatcagcagtttttaatggtatcctgcagttatccaaatatttattagtcctgtcaatatgatttacacaaggcttcaaaaagaattctgatttttaagcggattattaaaaaattatgacatgttgacctatcctcatgaatgaaaataaaaatactgcaaatttgtgtgtaaataaaaccataatgagatatcactataaatttactacagtagtgaaaaaagacaaactgaccatgccagtgctgcctgatgaggatgcagaactggagtttgcagacagtcccgagggaatgcatgatggtacagacgcttgggaaaagagtttggcggtttctctgaaagtaaaacacacttgccatatgacccaacaatcacattcctaggatttactcaagtaaaatgaaaaattatgtctacacaaaaagcctgtaagtgaatgtttatagcagatttattcccatttgtcctaaactggaaactatccatccactaactattgactagacaaacaaaccacagctctttcttacggtggaatactgctcagcatcagaaggaatgaatgcctgatacgtacagcatcatggatcagtcttagattcattatgctaaagaaagaagcccaactcaacaggttgcctactgttcaattccccttatatgatattctggaaaaataaaagctataagggtagaaaacagagcagtggttgctgggagtggggctgactcaaaaggggcaagaggcagcgagtgctggaactgatttatatattgattgtggtagtggtggttacgtgactgtatgcatttgtcaaacttcatagaaggtatgtctaaaaagaatatatttcattgtatgtaaattttacctcaataaacctaacgaaagaattcagtgtggtaacctgaagaaaaataagagtttaaaatatgtatagtctttacttgtacacctaaaagtacaaatgaaagtcaaaagcctcactatccctgtggcagagacaggttaacttcactgccagtttaagatcaggtaaaggctaccgtgttaccatggatacaagctcttattctcttttgtatgaaacctttcatattattaaattgtgactcacatggtgcaggggtaaactcggaaacttccagacaaagtcacccaagagtttttccatgttaggaaccctgcccatagtgttttcttcatgaacacatgcaaaactgtgtgatgtcagtgaacatatccttaaggggttaaagaaagaaaggttagaaaatttttggctaaactgaaggcgattccaaaagctgtctgctagtcctaaggtcattaaggctctttctttttttgttgtttgttacagaaataatttcccaaacatagactggaaatggtgacatatgggaggctgacccctcctctctctgtcatctttcatgtgaaaccatgattttctgatttatacagtggatagtgtggagattgaaggcaggttttaaagtcaggctaattctttgtggtgggattcaaattagcaaattgtggtcatttattcatacaaggtagatcatgatagaaacaagactttaaaaagcacttatattttaaaactctgtaaaagatgttctgccacagagatagccatacaccgcctaacaaccagtaaacattaacatcatagcagccaccggggacccagtgctttctgtaggttaaagaggcacacctctcaggccttggctctcccgctccctgtcttgctcttcatgatccaggatcccacacagcccagagctcccataggcaccatgctaggcttgcctccaggtctttgtctattcattccctcatttgacacagatattttgactgtctactacgtgtctgttatggattgaattgtgccctgccccccagccccaaatccaaatgttgaagtcctagcccctactaccacagaatgtgaccttatctggaaataagtctttgcagatataagtaattaagatgaggtcatcctggagcagagtggacccctaatcctacatgaacagtgtatttataaaaagcagaaatttggacacacacacacggagaatgacaagggatgatgaaggcagagagcagggtgatgtttccacaagtcaaggaaggccaaagatttccagccaacctccagaatctgggagagaggcaggagtcagactcttccttacagcctcagaaggaaccacccctgcttttggaccctagatcttggacttgtagccttcagaactgtgagacaatacatttctgtctcaactacatttttagctatataaagtacatttcctactgacaaggagattctgaaaagttatgagaagctcccttaactgaatccctccatcaggaggatggctcaggtggtgatttggaacactgctcctttgtggaccaggcacgtggctcctcagtgcttctgcaaccctgactgagcagctcaccctcgcctcctctgacttcttttaggtttgaatttgcaataacctaaaagactttatacacttttaaagcaactgggataatcttttctagagggagaaagggagagttgtgtaaagtgtgacatagtggcttttgggctaggtctggcgtcatggtctttggggaaatcgacggcctctcatcttggcgagggtgccaacaaacacccaatgttggggcacatggacaaccccagaagtctcacacagcagctgttacatcgattttcaagtacagagacttgagcaataactgtaatgacattttcctggctggctctgacctctgaatctcactgattagtctaacacacactgtgaacatcaaccagttaggactctaagccaagactcaaaaattgctttaaaatggcagaagatgtttaagatataatttgtacgagttggttattaacttgttcacttcccaatccgtgattcttttttatactctccctctcaattatttttccctgttaggttgatgtatctgtagtagttacctctaatcactaagatacttctgtaggcaatccatgctctggatgttacagagcagtcaatatggatgggggaattaaaaaaaattgactctatatattttaactttccatcattctacttatatttcccttgtttaaataaaaacaatcttttttttttcagaaaatattgattggatttgtatattcagagggataatttaaaaatacccatgatgataatatatgctctgttattctaaggtaactcaaaggcccaaacaccttaagaatatcaggtaccaattgacgttttcagatacaaatctgactgtgaatctttgactctattccctcactgccaacagtcagattttcccctcctgtcgacattttatatcccacagtacctgttccttttccctactccaaagccctcaactttcatttcctttttaacaattgccataaatatacatctttaaattcagtatgccaggatgaggtctggcactcttcaacaaaaacacagctattgccctgtttctaaagttatttatcccccaaaactctgatgcttcatgtattccatcaacaaacacttcttaaacacgtaatgtgctcaaagaacctgactagatcctaagtgtaatacagaaaaagtggaaacaatataatttacatttacactaaccttgaagacagacaaacaaactgcttttgtaaaatcagttgtcgtgctttgaagttaaaagttctaagattacaaaatgcttgtatcatgcagggatctgctaggtatttgccatggggctatatttcacatgcagcctttcaatctcctaaatccaaatcattttcctttatttcctacctccagggtgatttcttcaacatattttattggcttggcttttctccagattctacccttccacaaacagtcattagcacttttctgtcctagtaacatagctttttggttgtcatttcttctccttcaccctttccagcacacggctgcctttccattttcatttaatacacatatctctttctctcaaaaaaaaaaaaaaaatctgggccaggtacctgctgcatgccttgcatggtttgctgcagaaactgcagttgctggtccttggtgaggttttcttctgttcggaaaagctgttctttttcttgtttcagcagctccacctcattcctgtaggcatccagctgccagcggagactgtcattctcctctttcagagcgtaggcctgggcagccagggctgagggacaaacagaacgagttcaggtgagctaccttcttgcttagcttgaggaggccttctgtgggaaagggagtctgtcacccaagttcttaatgtttgtaccagctcagaaataaaagcaaaatgccactccctgggcctctcttttgtagtcggtatgcatcacttctctcggaacttttatctattctgtttgtcctgtcttacatgtgaatgtttcttatgggcacaggattaattcctcccaaattctcatcccttgacctctccctcaatgctagacaccctcacagacattggtatgtggtgctaggtggtgacaacatttagaattccaggcaacaatcatatctactaaatattgtcttccccctttctacgggattgcttagctacttggagggctgcttgctttcaaataatcagcagttccacaggttgagacatgcggcagcatcccaggggagagaggaaattatatgcacaccactccttcctgctctactgctgggacaaattgcacagattgttttcctccaactcctatcagaatgggaagctagttccatctgtttcaccaacagattaaaactcttttcctctacaaggctgagtggttactctaatacctctccctgaaaccccaaattctccacatttagattcagacttcattcatatgtctatcttattaagaaaccaagacagttaactcagggtctcacacatctcaaggcttcagaaatagccgaaactgaaaaagaaacaaatggtaccaaacaaagattgagggtagggaaatccctttccctagtttctaccttattgcttaggggtctctccgaaaatcaacatagcctgctgagcactcataaagcactggatcaagagctttgtatgaactcactcacttcatacccccaccaagcctgtgatgccggtgctggtcttatgctcatctttacagatgagaaaaatgtggcacagagaagttatgtaactcatccaatcccacaaagtaagtagcagaaagccttcacacccaggctgcaggctccagagtctctgctctcgattaccatcggtccatgtgtttagttcttaccaggctgttcaaaaccagtctcacattcccccaccaactctcccaccactctccctttaatcttccccctcacagaaaagccattccccacttgtgtaagcaagagaaaagtgaaagaaaatttgaaacgcttgttaccagaaacttcaaacatgtaacttccagtagataagggcacggtgtggagcccactgcacaccaggtcgtcagtgcatgcgcgtttccagcccccgctccccgtgtcagaggaccaaatcaaggtcgcctcctgagtgttctacctgcacattacagttccatggtgataaagctttactgaggttctctgagaccacagtgaattctctcctcaaatatcaaatgtcaaattatgttaataatagttttatagttgagtgttttacagtactccatcttgcaaaatgataatctctgtgtagtacacactgaactactaatcagacagaacatgcaattacccagaaatttccctacctcaagccagtagggatcaattacttaacacgcatttacttcatatttactgtgctcaggtccgtgagggcatctcagaccacaaaaagaggagacagaatacatctcttctctcaaagagcttaatctagtagaaactgacacatttaaaaagaaactattgctttcaaaggaagaaaggatagtgtgatgtctggaatacagcagacactcaataaatgttggttgaatgaataaatgaataaataaatgagtcgagatgcatgacaaaaaaatgcatcctataggagttcagagaagagaaataaaaattcagactgaaggaataaaagagggctttggaagatgaaaaccccaagaacttggaaaggatgtctctcagtcagaagccagagcataagcaaaagcccagatatgaaaatcaaaggtagaacacttggggcaagaaggagagaaactcgaccaaaagccaagtgtttgcctggaagcagtgagagaaagggaatccacgtcaggtgatgggagaagatggggaaggttaggttcaatggagtggccaattgagaaccactgacagcgcttggagtagtggaaggacatgatgaaattgggatttaggaacattagtttggcaatggtgcatggaatgaactggaggctgaagagaatgaataaaggagatttcatttggtgtatgtgtgtgcaaaaccaaggagcagccacttttacagttttcagagacctactcataaaatcagaaattatccagcacataacccgcagcatgagccagtgctttttaacattgtgcagcccagcttcagatcttgtccacaccctgagataccacctcctgacagctccgtttaccaagccataaggaaatggttatgaggattcatttgtgagagggatgttgtaatagggcaaaatcacagaaaatgcaaatgatgaagaaagtgttggcactgcataggcacattactacatttagtagcattcaaagacacttaagtcatttccttaggaagctctatttggccctttttcaattcagagtggcatttttattatcataactgatagcaggtgtttgtgaagaaatcgattagtacgcagggatggaaattacattttccaaatgaattgcatagtctgcaagatatgctgaaatctgtatagcaaaatgcaagcagctataaagcatgtgccaacagcattatttaaataaattatctgaacataaatacatataggaaagtgtaccatccattattttaggggatctcttacaaacctatggaatggtactgctgagagttcttattcttggctaagccaagtgactacagtgcctgccaagcagtatataatattgtttgcattcccggaataggaatgtgatatcatcatattaaaaaaacccacaacagctgtaattcccccaccaaaaaaaaaaaaaaaatcaataccatagcaaattccatcaacatttttataattggggcacataactgatttacattcctgattaaatgatttcaagcttggtttttacaaaaaaattttcgttactcatgtggcagcaagtagttatcttctaaagggtgagaaattgtatattgactccacttagcttcaggccacctgtttgtaaacaccactcagtgtcatactgcagccctgaatctattcctcagacaaggctgcctggaagaggctatattatgtttcttgggccagagcgctaacagaaaaaaaatcctaataatttctgacttaatataacttctcagtatattaaaaattcagaaattggaaagggaaactttttatttctctctcttctctttctttctttctggaatactgtactaaattaaagagttttgaaaaaatgtgtcatcaagcttccataataaaatttaccttatgagactgcacaatgaatccactatccaaataagtataaggattaaaaaaaaaaaaagtacagtgtgcatctttcggtaggaattcctaaggagtgcaccgagtgccaataaatggaatatgtaagagacaccccatgtggattaccaatttccgataataaaaaaagaatagaattagacaccttaaatgtcaaccggactgaatgtgattaaatattttgttggtgattttaaaggcactgctgaatctagtggtgcctctggattaccatcaattaattcaccagccacccatttatgtatttattaagaaaacatggtgaggagctgtagcattcacaagaagcttaaggccagcacagtcacccatttctagttactcagtaatttagaaaaattctgaatactggaattttctgattggatcaaaaatgaaataataaaattggaaaaattttgctaggcaagattgttatacttcaaaacttagcactagactaaaaaatgaccaaagtgacactaatgtatgaaaatcaatccaaaggttgaacggcactgctgaagaaaaggcttaaaggtattgcggcatcttgttatattctttactagattctatataaaccattattctttatattaattatggtcaaagtgacctcctcttctgtctcctgtcttactgtgtttccatgggaacagataatgccatgcttaacttctttaagtaaataatctggagaaagccttgaaatctcttttaccagcctgagccagcctcagaaaaatagttagcaatatatgaaaaatgtaagttgttttgggttatgtcccagtaagctgacagtctgttaatatctttttcatgctcaggcaagatgtaactaaataataaaacattttaacatatcgtttctaacaatatctgtgtttctccagaactcttagtctttgtgtgtttggggaactctgtgtttaacattccccctccactttgccagatgtcctcctgaaatgctggaaggacgctgctgaactgtagatttccttcccacatgcaaagaaagtctttttcaagaatttcattggctgctacccaggaaggcagttgtaccgatagcccctgaacacaggagggcagaggcaggctggcctggcaaatgtcaccacaatatctgtgtgccttcaacggctgcctcctcagccacgatcctgcctcctgctccactaggaaagggagctgtagttatggcccagtgacagggactctctccagcttctatctgcttctctgcattctgaatcttcttgtgaggtgccttgaggcctttagaagctattctgtggcagagacattatcacgctgtgtactcaaactcatgcttctctttgtatagagcagtgttgctcctgagaggtgactgccctagagggtgccatgtgagcagtctcatcaatggagtgtgagggggagtgaggatgccttctgcacagtccctcagtctctgcctgctgctggaataggcttgggtctctgagtcaccacatggaggaaaggtgcccacaggcccagaatatctgccttggactgttgtgtgcccaaaaagtaacacttttttttttggttaggccatctttatacagcagctggtgttactctaacccagtgttctccaaacattggcctgcattacaagctcctggcgggcatattaaaacacacttttctgggccctaccctcagtttccagttcagtttgtctgggaggaagcccaagaattagcattcttccaagtcccccaggtggtgctgatgctgctggtgcagagaccacactttgagagccactgctcagaccgctgctcattctatcccgattcctaaactggggttgtggttggcttgtttggagaaatgcttctgaaagaaccacatgcttggcttgtcattctggttttattccttgatctccttttgtatgagccccgactccatgttctgcacctgggaaggcagccctgttgcatccctgtgcccaggtcccatgagctcagcttgccccgtgccctggctatctcctatggaagatttgggcaaaaggcacagtcactattctgctttcttcaaataacagtagcagtaatgggaatagcaacagtggtagtgacagctaatgatttttatgtgccaggcactgaggtaagcatattctttacacagtatcctttcaccatcatgaaaacatgatacagtcaatatgattattatttctattttccagatgatggaagtgagtttatgggagacagaggttgctggttggaggtaaaaggtgtggctctaggactatattcctccatgtaatgccaccaggctagcttagctccatgtaagtgccgcccatcccagagaaaggagtaaaccagggaccctactgtagtggctagtttgctcctaacagaagtaaaacattcaatttctggctctatctggggagtgttctgctggagagagactctgctatgaaagcagagaggatgatcctgttttaaaataaacatgcaggtattttctgcaggacaaacttggggatgatttatggagaagttaaactcactcttcaggaaatcttgaggcctggctggaaccacttagggatcctactttctgccctgtgtccctctcctctcaaacggccacactgatacccactaatcccagagctcaagagcctgagttgctaataatgctttattgagagagttttgtccatagacccatgctgatctcaggattcccaaagatccagtatgagactattcaccccatccatctgaactcacctatgtttgatttttaaggtgtctgtgccttcagttagaataaaggtgacagaaactcctctgcgttatgctgacctcccatgaactctgtcccctgagtctactttgcttgggctaatgaaggccaaagacaaggaccagtaccatgtcagaagattaacagaggcttggggtccttcatcattggtagcctcattctcagtggctgctgttgccatcagtgcctcccagtggccaggcacagagctggaaagtatcctaggatgacatctgccaacagccagtctcctgctggagagcctcttatggtaccaacaaagtacaattgatctgcttttcaataatacctgtatcaccactgatcaatcttcctcaaattgctcacggaaatttcttctgctacatttttgcaggattattattattacaacttagcattgacataacatttcatatgtgcagtgtgtattcgaatctgcacattagctattattagggaaagctaaacagaagcacaatgcagtgtctatttccatctttgtgtgaggccagcggaataagggtaatttcgggagtgcagggtaagctagatcctgttacgatgatggcttaaatgtgagtctggaggcacaatgggcagcaggtgactcaggaaaaaaaaattctctgctccttcctccagagagctcttcctgaggaagtactctgcaccagcagcagaactaggaggtgctgctgggctgctgccactatggagacttcacatcatgcctcatcacttttccatttacattactatcctctgctccgacccaaaaccatccccattttcctcagaggaaaataagcaaaggaaagagacatgttcacttcttgcaaaagcaggataagtctgtcatttaaaacactgttgaaggatgctctgtcaggtgaggatgcctttagagtcctccgggaaacacatcagaagtgaacgctgcaagcatgagctgagctccctactctaagccaagccggggacagggcagggaagcagagctctcagcccctgcccagcctggcctgcgcagctcccagcccagccgcaggaagagctacagatatggaacctggtagaaactggttagaagggctccaggaggggccatcctcacactgtgtagtgggagtcaaataagggagagaaggcttctggctggaacataagagctgggggaggctctttatggaaggcagtggttgagctcacacattgaaaagctgaaggaaagcagagtgggactgctgcacagtggacactgctttaccaaaagattcggcgatctccaggaggatgtgccatggctatggagaggcgagcaggctgcttcctactgagccccaaggccaggcaggagcatctcaggagggggcacttttccccactcttccttttcttttaattcgattttagttttctttttcactttcagtccctattttgatttccaagattatagggccatttaaaaaaaatcttctaaaggctttaaagattcttttttaggaaagtcaggcttagctaagccaagctagacaataaaatgacactggctttcaggaattgtaccccctcccctgcagacagtgcacctcccttgggtgtagtactccaccatgggcttggctctgtgtgacttcatcctaactgacagtagttggtcttggccaaagacagaaactttaaacagcaatccttccctccaaaacaactcctctcattttctcaccaatctacagtataaaagcagtgatctctttttcctcccatcttacaaatgtccttcctttttaacaagtggtcatttctaattttcatcaagaaactttccccttaagaagtgtatttcccctctcctgctctaccctctacatagaaacacacacacgcacacacacagttatattagtatttgaattggtgcttctaccatataaaacacatccacactatgaaatgtgaaatgatggccagctcaaacctaaagtatatcttctcagttctatgcattgctctttgcaaggagtagcatctttttttgtaaagtttttattttatagtgccaaatacttgcaataatgggttgaacagaaaactttttttgaaagttacttccgccttaggtaaaccctaactatccagactagtaagtgggcaccaagacttcacttttatgcttgggcaatgactctgcttgggctgtctctgagcctcctcctccccactgttctcattaccaacattgaaattgacttatgaacacttacttgtgtctggcaataggatagaaagtatctgcatcctctctaaatgtataaccaaggtgggaggacccagtatgaacaggtagctggcatcttgaggtatctgtaccactttggtatctcttaaatgagaaacctgggactcatcccagatgttacgaatctgagattctggaatggggcccagggatgtgcctttcagcaagtttctagggtgattctgatgcatgccaacattttagagccacctccctggcctttagggaccaggtccccacttcctaatgctttcttcatgactttcttctagtcttagatttctttcattagtttttcatatttgctttctttcagccttttccaacagctgaaaggaccttctctcctgcttttacaacccaacacagccttctgggcttctctgcctctgccatgtcttctcacattccattaacctatcggcctgctccttgctgaatgctacctcctgcctctccaggaatgacactgtgactgaatgcttgcgtaaatcctacaggcagtgtctccaaaacacattgtcctcaactgctcgatgttgttgtgcattacttttctttgcagccatatgtctggagaaagtttctgctatggcaggcttgtggcttgcacccaggagaggccaggctgaacctctggaactaattgcccttgaccgggccccgggaacagccttttcactgtgggagaggaggcccctcccatgtacacatgcttaccacaccagtctctagattcgcagaggcttttctccttggcgagtggccaggcatgcctgcttccctctctcactgctgacggatgagcaaacagttcctgtctattctcctagaggtagagaaaggcagagactctgtccttggcttgcatcaccactcatatcaggccaccctccacactttgccctcccttttcaagccgcccttttttccagtgaaccagaggatactccaaatgtgcccgacacagacctgtgaggggacttctccacctgggtctcacacgctccacttaaactacctccctctcacttctcctttctttgctcctttatcattgcctatgtcagtcacttcctgtccactacagatttttatactttactccatttttgttttcttctcattcccacattactttacctcacctcaacccgttttgtccttctttcccacctaataggtgggaaaagaggtaacctttctcacatcctcacaaaaaaagtttctgctttgttcattaaaatgatttgttttgcatttctggtgagtataatttttcaggtagcaatattttattcttaccagtgcctccttaaaaagcctttgcaagtgctgaggtgccagttaagcactatatgacagccatcatcctcacattacaggccagtggttttcaatcctttgtgcagcgaatcacctggggactgttttaataacaccgatgcctgggcattaacctgcggccattggtatgtgtataaagtttcccaggtgattctcatgtgcagacggggctgtgaaccacacattcacaccttctgctctacaccagcatcaactctccacattgccacagtgcctggtatttgcaaaatgccacagaatcccttaattgtttatttctcacagtcttattgaggaactctcaggatgagcctcatgtcattgctgagaaagctgaggcttggtgaagggatattatttgccaagccatgccagaaataaaaccaaggtacttcaagggccctctgacctcatctgctcaaagttactttttttttttttttttttccagagtctcgctgtcacccaggctggagtgcagtggtgtgaccttggctcgctgcaacctctgcctcccgggcttacacgattctcctgcctcagcctcccatctagctgggattacaggtgtgtgccaccacacctggctaatttttgtatttttagtagagacagggtttcactatgctggccaggctggtctggaactcttgacctcaaatgatccgcctacctcggcctcccaaagtgctgggattacaggtgtgagtcactgtacccaggctcaaagttacttctttactgtactcactgactctaaactccccctgccaacaacacttgttctcactcatagaggtccctttctcagagccattctaacactcttaccacccagatgagcctctcttccaaagagagtatcatagtgagcttggcagtgcttagtaaggcccgacagtggagaggaaacgcagaaggaagccaaggacttattttcggaattctcaatatttcagtgattcagatggcttcagttcacattcttcaactggacacatcatcacttctttttatccccagagttcgagtgccacaaaatcttgctttgacaaactcagcattagtcttggagtccttgggcagggaaaatgcatgtattttataaactgtctggatggataaattacagcaatttttccctgggaaagagttgttcagacatttaaaccctctatatattgagcatgataacctttctcacatccccacaaaaaaacagtttttgctttgttcattaaaatttgttttgcgtttctggtgagtatagtttttcaggtagcaatgttttattcttaccagagcctccttaaaaatcctctgcaactgggcgtggtggctcacgcctgtaatcccagcactttgggaggctgaggtgggcatatcatgaggtcaggagatcgagaccatcctggctaatacagtgagaccccgtctctactaaaaatacaaaaaattagccaggcgtggtggcacacacctgtagtcctagctgcttgggaggctgaggcaggagaatcgcttgaacccgggagaggttgcaatgagccgagatcacgccattgcactctaccctggtgacagagcgagattccatctcaaaaaaaaaaaaaaaaaaaaaaaaaaagcctctgccagtgctgaggtgccagttaagcactattaatcaaacactaaatgctttttaaacagctctacctttttttctaattgagaaacagagctgtttgggcaagtttatgaggtgaccttgattgaattaaagaggtcagcgatggaacagacttcaaacccatattcaatgatttttttaaaaatgacttccttccaattaagcagaaattagcataaaatattttgtttctgaaaggttaaaagaattcctctgagaaggcagctgtcttgttactagctttttattgaacatgagagggaagggactatgggtagtttcatctaaagtgctttgttaacatgacactgatgatccagcatcaattacaatattccttaggagcctaagtgttacgtagaagggtcaaaaagtccattttaaattttatttcctatttcaaagtccaagaacccaatgactttcaattactaagaaagaaagaaaagaaagaaagaaaaaagaaagagaaaattaaatcaacatatagtttatcatttgcaaaaattgcaacctagttctacagaaaaaagcttcagtcattacctctttaattcaatcaaggtcacctcataaacttgcccaaacagctctgtttctcaattagaaaaaaaggtagagctgtttaaaaagcatttactcatcttcctcttagccccatccttctgcttgccatagtcccccacattttaatgacctgaaagaacatcaccttcttcctaccaaaaagagtaacatacagagtgtctgatatataatgatggaagcagaattccacagaggggagggggcaccacacacaggtgatactttggggactactgggtgtgtctgaggcacagtcaccctgagagacacactcgacataacatagtgctctgcatcccacatatctacccctgccaacctcaaagagtcgagtggacgtggattatatagaggagagaggcacaggagtgctagagaaagagaaggggctctgaagccagataccagctatgaggcttagggcaagaaactaaacctccaagagacctcagggtccttatccaaaaaatgtagtcagtactgtgaggattaaataggtaatagggttttttttttttcttcaaaatgaaaaaaatatcccccaacagattaaaaattagttcttcctagttttaatttcctatccattcatttaacaaaatcttgcccccctaccatgtacaatgtagtgggctgggcattctttatgttcaagtttatgctctcacacttctttatgttagagtttatctactagtttttggctatgacttcggagggcacagtgggcagagactgtgaggacctgtgatctgacactattccaagaaaagccgaactgatgttatgctacgaggatttttcagaggagagaagcaaccctttcagatccaagtcagtgtctcagtctttcaagactttgttagctattctttccccttaatctggcactgtaaagaagacaaaggatatggtcccacacacattgtgagaatttactgaatatttgttgttttaattttatcactgctttgtattatgacattgtttaagacaattcgtggaggcaaaggattaagggtagagaaatggatggctttaggaggctcggtagataaactacactagaaaagtctagtattgcatgtggagacatttcataaacaactgactggtaaatcactacaagaaaaataaaatctctcatggtacttccaaaatatcttctaaatatatgttgtagattaagttgtgcctgaaaacttgtaatcacaaaaaaatcacaagtatcaaatataaacttgtatttattcagcagctcacctgatcattatttgggggtaccaaaattcatttttctcattaatttaggacattgggggaagggagaagacatattacttccaagatcagaatttccctgagtctgtgaatctcaagaagattgatattactgtagatgaggtccctcagactcttattttaaagctatattggaggcacatctcataaagaaaagcctcgggaatagagaaacagggagaggcacttcaataagtcttgaaattagatggtgagtcaataaactggtgatcctcaggtaggctctcccagaccctgggggtgcaaagaaaacatgggatgagatgggaaatcaaagggctgatattgtagctcagatcatttcagatcaaccatcaagcatgtgcctgaggtttgaggaacgtcttcatttttctctttatctttttggggacttatgaaatggaaaacatgggttgtgacagtgtgtatggttaccaaaggaaacacataacacagcagtgaacatccctatgcacttcacctcttcaaagcattttcttttcttctttttcttgtctaaagccatacagcagactctgctttcaggaaataaatgtcactcaattagcaaatgggtggtaccaatttccagaataatttttaagggtggcatttctgttgggatgggcttaaaaagagtttgctgggtgcgttgcctatattgaagcaaatctccttctaggtagtgggaaaatacagaaaatgacgggaagaccaagcagaagccccagtcggctttgtctggattaacattttaaggtaataagcatctccaggctacctttgcctctaaaaggcattatggcaccatgtacactgcaggcactcaaaatccttcgttgattttatttggttactgactcttatggtatcactgaaggcatttgaaagagattctggagtccttttcccataaaattcattggtgccataacagggtcattaacctgaaaaggagaaagctagtattgagctctaggctttccacttacgatcttgggtaaataacataacttctcatcattgccaatctctctgtgggtaagaactcaacatttctgcctggtttagaacttgaattatttcttggatccattatttaatatttataccaatatgattagctcttagaataagaaattataagattatgtggtctgggaaggtaagcatattatggtgagttaaatgtggaaattccctaatttaaagcaaaagaaggcaattcaataaactatcattatctgatactagttactattccttactattcttgactttccagaatgactgaaaatgtctagggagtattcctcaatcaacatggattttttcatagattctcctaggtaatttataaattaatatttattgtagttttaattatttaaataatacatgcatatattgacatttttgaaatgcacagaaaaaaaatcacttgtaattacaccatctggtgataatcagtctgaatattttgacctatatcctcacagattttcccctaacataaattgtgaatataacacatacacacacaattggaattatccatgctggtttgtaactgcttttatcacttcacaacatattgagaactttctttcattccattatatagtctaaaccatggtttctttcaagactgctcatggatatacattaattaatcaataccctagtgttcaatgtttagatgtttctaaattaattctgagaactgataatttaggtaactgctttgagctgcaatgaccagcatgccccaagtagaaagcaagggcctttgggacacagcagctctagaacttaaagggggctcattaaagaccctgcaatgccctgccggaaatgctacaattaatagactctgtcttgtaacttttgctccagaaatgttcttcctacttctctgctagtgatgggagtctaaaataaaattttctttctctagccacttcctagaaggcttcacacattgtgtcctggaactggggagaagagttgctgagctcttgctccctctttgatatcaagagcattcagtcaagtgaaagagaagggtctctaagccatttagatgtgggagagcttactataataataatttcctataaacttcaatttccagggcttctaagtatcatataatggcaagtagaatttccaagaaagggaaggaagtacttactttttaaattagttatgtggctcttaactacctacggttactagaattctacaagacatcatcctgtcttcattttctgtgttcatgcagtatccctagcatcttcaagtcttcgattaacgaagctcatgtgcaacagtgttaggagtcaaggtataatagctttatgtcacctactgtgttttgatgaacaatacagtataaaagcagaggagaattaggacaatgatgttcatcaacagcacatcactgtgctaagaggctggtaacagtgtatgttttaatgtggcctagtactgattcttttggccagtgtcctactttaacaatgttacagtcacacttcaagatttcagatggagaggtagagaagaaaatcaatagatactatttttccactaccaactggcctacatatatatagcttctctgccatactcacattcaagggacctaaaagatgcctttggaaggtctggcccagttaccatgcttttaataacctcaggaatctactctgaccacctcaaagattttagcttcatctctcaaaggtccacaggaaagagcctatgatccaggaagaatacaaacttatttgttctctattttctattccattaatatataaaaagaaaacttttaacaaaggcttgcttgttacacaaggactcttgtctgaaaccaaaatcatgtagaattttattcctgagccttaaaaaatacacggaaaaatacttatgtagttaactgtgcaaaagaaaaaaattagaagccaaaacattcttctgtaatgttataacacaattttgttttcttctttattcattattcttagttgttaggttttcaaaaatgaccaggtattatttttattcaaaaaacaactttcattttttaaaatgttacatgctgctagagcgcaatgaggtgacctactgaaagtgttttctatgagcatctgctagaatcacaggtgagcatttgacaaaattcatcgatgttgtaaagggtaatccgtttttcaaaatcagagattcctgagtattgcttataaatgaaaacggaaaatcaggaataaattctactgaagaattctctcctgtgtttaggaaagaacaacaacaataaaaagcttacaaagttgcccagattctgtcatctaaactccttcaaaaaatatcctgattttttctagaagttgtgcaaaccgcacttaaattccaacaacactgtgttaattttgctcaaacgcaagctgaaaacatattttaacatcctgtcagaatgagatactaagagtgtcgataaaatgacactaaaataaatgtaaatttggattgctgttacaagtggctgcttggctctgctaagacgttaggttgctatagtactttccatagcaactttgcatcttattacataaatattccctcagtgtccttcaagcctgctacagaaacaggattaaatccactctcctatgtaatgatcctgcatcaaaccttaccggaatgaaatgcccagaacacataataaactgtaatgtagataatggtgttcctggcagtcaataagcatcagggcactttgggctgcacacaggcggcggtgcagtgaccctgtactactccctggtcatgcgtcttaacctttcccaggtcaaggcgtcagtggctctccctttgtgaagattggttgctcatgtcctcattctcctcctctccctgccaactgcccatcagctcaagccctccaccaggctcaagggactcatagcactaagcaagaagccagggcctgacaggagctgggaacatgctgggctgtcatgcaggaaactttgtggagaccccacccaggtctaagctaggatcaaacaggtatggattgtttaagaacttcagctaggcctcagctgaatttcaccgaggtgtggcacagttgagtagttaagagtattagggaaagtccttggtcctgtagacaccaatgtcagcaacacagattaatcttacataaaataccagattatggaaagtttgtgcacatatgagagagatgtcaagaatcatggcattgataggtgctacataaaaataggattataaaggggctaagcttaaagacagtttaggctccaagtgtgaatttacaaaacaaacacagtctggttgggcagaaggagtgcttccattgaaatggaatcttctgctacaggatcaatttaaatagcatctgttttcctgcatttaaaaggtgaagcaatttacaaaaaaaaaaaaaattctacacttttcagaagcatatccattacggaaagggaattgtaactgcacatgaaattagggaacttaaaaatccacccaaaataaatatttatttgaattccttgggcaagattagcaagattaaaagaaaaaaaaaaaaaggaaagaaacaggaaagccttggctcctttgcaaatgaaactctgtttagagtttaggaagaaagcaggctactcagcccaccttgcaagatttcttttatcatctttaagccacattagttctgattcatcacatttccttgtttggcccccttgggttcccagaagagaaaatgcttgtctttaattcagtggtcagtgatggacacaccccactggtctatttctctttcaggagatggtgccctcggctgtcattacatgtgaaaacagcttatccttctatgcttccactcaacacagacacccctgcccttggggtctgctggcgcccggagctcagatcctggcatgtggcctcagactgagccatctcactttcagtgtctgaattctcttgtccctctgccaagttctgagccaatctcgggtgagcctgctttcagttacattcagtgcttcctaaaaggaagtttctaccagtgtgaatgacagagccccttgcagttggccccttcagtcagctgctgcaccctggtctggtatttagtaaccctctccttcttctgtgcctggctggtgatggggtaacagtgagcctcttcttaagcttgtgcctgattataatcttcctgatgggcatttttaaggatctttcagaagtactaccacccagaaaatacttaatcagaaaaaataggttgtcctgctattcaaagaaatcaatgggatggtcagagagccctattattattatttttattacttattttttttttaacataaatcttccagctacatatataactattcagataggctgatactgctagttccaaccaaacctaattatgagttcctaatttgatttagtggctgaaagatttggaaagtccttgtttgaattcttagtgaaattaaaaaaaaaaaattccgggccaggcgtggtggctcatgcctgtaatcccaacactttgggaggccgaggtgagcggctcactaagtcaggagatcgagaccatcctggctaacacggtgaaaccccgtctctactaaaaatacaaaaaattagccaggcgtggtggcgggtgcctgtagtcctagctactcgggaggctgaggcaggagaatggcgtgaacccgggaggcagagctcgcagtgagccaagatcatgccactgcactccagcctgggtgacagagcaagactccgtctcaaaaaaaaaaaaaattcctttgtacctatgttatggtgaattttcatgaaaaattgacagctcagaaaaacactcttcataatttagagtgtctgctcctataaggagctcagagtttaaatgaaatgcagttaaaatccaaaaacatttgtttgtgtattatggaaaggcataatgattgtctactgagcaagggactttttagttttactcttctaacatttgtgttcaaagtacactcatcaaatattgggtgaggtacatacactatgtagtgatgttcattttggtttataataaatttaatttaccagctttaggacatccctaatatttttaactgaaaacacttttttcaaatgagtcttacaccctagagaactgggtaccctgtatctaactaactctgtgtgccctgggtccacagcaccttggacatacaaaatgtagataatcaaaacagtgctgggttaaagctctctgggccatggcctgttcgccatgtgacactgaattttgtacgtataaagttctgaacattttgtttgaacatgcctctttaatacttgccatttcaatttaattagagcaaatgttctcagggttatcatcctcctatcaacttctgggacaaaggcatcgaaaacattaagatcagaagaaggggaatatgaattgaagtccacagacttttattgattacgtacttggggaaaggcccagggccacgtgttggaggatgactaagataacaagcagagttaacatttattgagtacttactagatgctcaacactgtaagtaaagtcagaagtgccttgcatgcattgacttattaactctcacaatactaaaacgtatcgggttttgccatctgaggccttacaatctaggacagccttcctctttcctttctcctttttatttcttgcgaacgctatcccgccccacagagtcaacctggagggagagagggaggaagggagtggaaaagggtaagggagaaggagagagggagagagagggagggaggaagagagagagaaagagaaaaaggaagaacagatctggattttaaagtctggcttcatttcagtaggaggcagactaaacaacaataaatttgaatttttatcaaaaattatcttcacaggcttcagagcaggatgccgatcttctagaatgaatgcttcaataaatctgtcattatttttgaatttattaacaaaattgattttcatttttatcagcatcttagttttgctccagtgaactccttttcccctttaagattcaactgatcaagaagagtgaacaccccacccagaattctattgtagatactgcagaattatagccaaagacatattgcaaattattatatatggtaaaaagaaaagtacaatgaaatattcttcataaccaaaaagcagagatatattgaaacattttgattattttttaaaaagtaaacccaaggtatcatataagtccttacacaataaattgtgcctttcctaaaaaccaaacaagtcaattatttccatctcttccctgccccccaaaataaaacccattacagggtactttttgtcttagtatggagatgacaagcaaagctggccctgggggaccacagacagagcgccctgcagtgggtgcagcctcagcacctcctcccggcacaggcaggtgacaactgaaggatattctcttctggaatttccaagaattcctgggtcagctactacccaggaggtctgaagcaaaatcccactgtttaagcagagaggaaattggcaggggattccttacagcatggagaatttcacttccattacagcactggcaattcccctgttagtgaattagagtgctacattttgagaggactgctcctatgtaggtgactggcagatgcaaatgtgtacctaaaaacaagggatgtgtcacccaagaagataccgctggaaggtgtttccctcgggctatggcctccatcctcctgcttcaagcaacagttagcagggatttgtctgaggtttgaacaaaagaccagatgggaattcttgctgtcaggctgtgtccccaaatatgcagggctgaaagaaaaacaactgcctgcctttgggccagatcttcagggccccgtggaataaaaaaggttagttgccttcctttccctttaatcagtcctgtgctttcttcagaaaccacatgccacattctctggtccatctcgttttgaaaagcacgaaaagactttgaactgctcggggcctggcatttgaactccggttctttcatctcttccctcagaacttggcatacaacatgccctgcactttgctcattaattctgctgaccaagtaacaagactggtgaaagttttttttaaaagttcaggctctacttcacgttctcatcagatgcctggggaataaaccgagagaggtgtcgggggatcacatctccgtcgatgcttctgcagcagaggccgggccccgatcctataagcatgtacgtgccgcaagacctcagtgagcatactattcagagtcatcattattctggtcctatcctaagcagactatgaaattatacacaattcttacttgggaaattgacaagttatttaaaaagaaacatcaccaagacaaaacaaaaagccacaggttcaaatgagaatttctgactgatgcagttcttttctcctacacctaccttgtcaggatattaagaatccaagtttcatgtcaacttgcctctcatccagaagcttcacaaaggatgaaagcgcttttgacaaaaaaaaagtttatttctttatttgaagatcttgttgaacttaagaaattcacacaaatccttgcccccttcttttgctatgtgaaggtttgtagaatagaaatcctgtgaggaaggtggtctcctcaaataaacaaacccaagagtaaagcagtcctgaggaatctgatctgggcttagcaggagacatacatcattgacacataagtgctgggttcatttttcagacaagggatatatggcttcagaaaatagtggcatggtgcctacttgtatgttaagcacctgaaagattaaaatgaatgaatttgagggtgaaagggaaagtttctaaggcagtggttctcaaactttggcatgcatcagaatttcctatagggcttaaatcacagattgctggacttcacttccccacaccctgtagccactagacgtttttgattcagcaggtcttgggtggggcctgctaacttacatttctaataagttcctagatgatgctggtgctactggactgagaaccacacttttgagaaccactgctttaaagaaattagagccctttctctatatgcctgtaggcaggagctttttcttatgaccatcactcgcacccctacattctcttctacagccctggagaaacagagcatcctgaccactttgcagtcttggtgacctgatccttttagaatcttgattttggtttcttaataaattagtaaagatcctcgattcctggtcacctgcaatctttctgttaaaaagtctctaacaggtgtatgttttattcacttatacacatgaggagacagatcaaatctataccatctctgtaattttcttttttgggaatgatggcaattatggttcttcctaggtccttcggacaacacccttccaatcagacaagcagtctcccttggtgtctcatgttttgaatgagcttttcccttgcctgtttttacaataccaatggatttatatataattcaatgagagcgttttaaatcagcagctcccattagacagagcacacaaagcaaggttctctctaagtttctcttctttgtacaacctaaggagtgacacccctagcttggtaccaaatggggccagccttttaattacagattaggtgaaagaacatttatgggaaaagaagtctaattctccagcatcttggctcagaagctagaaagcttcttcagggattaaacaattcccatgtaagaagtacactgactaaaaccaaattttatccatatttttagcatcagctgtggctgccgtactctggaaaaggattttcatggaaacaggcaaatatccctgaaaaaagcttaatggccccagatctacgtacggagaaacaactggagcaatttaaatcactctgttcccaagaaggagtttaaagttctattaataaaaagcagagtcactcaaagatgaaagtttagtataattcaaataaaagtgagttatagggccatttacttattccccatctgagatttggaagatcattatgatacctcatgggtctgtggcagttatcggcattacctgattcatcgactctcattttctttgtagggctgtcacagttctcatcatcagacatttccatttcttcttcgcggcggatgcccatgagctgctcactttgagcattccggagctcctgcaagtagaggatacacaaatgtcagagtcacagacacatatggctttccccaatggtctttgggtatatatgactggcatattaacattcagaatccaaagcttttatctcccaaatatagcctcacctaacctaaaggaggttctgaggggtgtggggtacaggggagactgaggtcaggcttagattaatccctgctcacccatgactagggctctttagcaaataatttaatctctcttgagtctcaatttcctcatttgtacaaagcggataataacatccacctaatagggctgcaaagattacatagaaatacctgttacatggctggcacatgtacagtaaggacttagaaattatggttaagaacatgaacagtggaattttaaaatggactgttctaccactgacccacacggtgtgacattaggaaggattcttcatctctattaacctaaattgctcactggaatattatgattaaaaatagttttgaggatgaaatgagttaatgaatgtacagtacttagcatcatgccagacacttggtttgctcagttgataatgctggacattattatttctcatgcaaacatagtgcccctgcatgtgtgtatgtgcccatgtgtgatcacatacacacacaggcacacacacacaccattcagatatccaaaattcaaaattagtaagatgttagggaacaaaacacaaacagatgccctttctttcgtattgcacacggtcatgttggggttactgtttttgttgcaatggttgctttagcatcacataatttagagccacagatcttaagatcacaccttactttctccatttattaggggagtgactacaatcaagttatttatttgagactttgtctagtcactcacaagtgaggaataataatacaaggctgtttacatgtagtagcatatgtgaaaactcattgtaaagattaaagaattacacaggaaatttcttactactgtgcctaaaatctgaacattgtaatacttatgctaagtatttatattattattttgtatcaagctgtatattacatatttgtgaattcttccttattcattctgttctcttacatgtactatcttcagaaatacttaaaacaggggaagcctccattattctttttccctctgtaaagtctctaaataaaaatcaaatagttaaaataatttcatgttatgatcaataaacatatgagtaataataaaactaaattactacaactgatttattaggggcatgacttgtgcccatttgatggacatgcatatatcactccatgttatgggttttctccattcttttctctccttagctcacagattttaactacagcatgatggagaggaaagtatttattgctaacagcatttgaatggtcaactctgtaccctgggaatcacccttgcagaagacagggaagggagaaagcagagagacaaggtccgaggtggggtgcaggggcaccaatcacaggcagccctgagaggccagagggaaggcagacaaggctcctaatttgattatgccacccagaataaacaggtgccaattccatcttaaataacaccatcaggcattggaggtgggtgtcacatgtgattagtgcggaaatttttaggctgtggacagctaatttttctactgacaaagagcccaattcccaaagaggtggcttaacacttgaaacaaggaaaagtcaggtggaaagaataaatgaggctgaaagggactgttgtttagtccctgcgattaatgacaaactgtcatatggtagttgttcttgtgggaaagggtggtggaaaagaaaaaaaaattgaggaaaaagagctgagggtgtttccacagggtgcctctggttcagcattaaatcactagtacactctaataaatctgtagaggtgttgcagataattaacagatgctgtacatgggaatgtgggaaaaaatcaagccaattatcaagcttatacgcaactgagaaatcatccacaatgttaaattaccaactggtatttaatcaattcagcgacatgcaagagaaaatcacagctaatttagaattctgtggcctaatgtatatcaaaagaggtggggaaagtagcaggaaggcaaaaagacccttcgcaggagcacctttgacagctgcactccatctgtccttctggagcatcatttctgtctcctagtaccaaacaaagcaagcaggctccttagacctgcatggaagccttcacacgtcctgctccccaccacacccacgcagaggaggcagggttaagcgaaggtgagaagttgaggcagacatggcaggaagtgtgattcagatcaatatgtgacatttgctgacactcacattctaatgatggcctttttatgctcaggtttattcggcagcaggccaccagcctttctctcaacattccttttaatcatgtttggtttttatgtgaaaaaataaataattcacagactgatcattcccaaatctgaatcatagtttatggactccaatttgtgttttcataaccctcagtttgtctactgcatcacaaacagaggactcttttttttttaatcttgaaaatcagccttgacctcagtcttaagtcagagtcagggagaacatcaggtaagcacccttcatttttctggcccctgaaaaattaaagagaaatcccacctcttccttactcataatcctgaacagaaaaacagaactgtatcagtcaccaaccaccgtaggcattagtgaacaaactaaaaaatgtccttcttaacaataaattgcactagcattttaagtgtcacattattgtgaagtcattcggtattcaccataataacagtgataataaagaattcatttggtattcatgtggatattacatctagtgctattggtattcaactgtaatttagcattagttaatgggcacttaaaatgctacccaaatgattgatatcatagtactttgtgattcctcaaactctatataaaatacttattttacaagtgtaagccaaaatcattaaataaataaaccttaccttccataagtttgggattttgaaagaggggaatgtcatttagagaactttaatattaacatgctagagatggagaggcatccaaatgaaaaacattctttcattaaaaaaaagaagcaaagacagtatacttacttttaaattacaggttcaaagcgtacactactctgtggagttaaaaataacagctggacgaccagtgactaatgacacattttggtccttctaagtggcaaggaggtcaaattctagactgttctcttgggggtagatactcacttcacacatgcatggttgctgatgggtggacccagttggcctagatattcactccccttacaacattggatctggagagaagtgtaataggacttaatggctagcatagggactaagatgttgcttatgataagaaaatatggacggaaaggcgtacttgtccaaagagcaaactgtcatcatcacgtagaacactaaaaaaaaaaaccctctgtatttaaaagccagttttctattgtaagctccatttttcttcaaaataatttgctagggaaagtgtcttggtttatttctgaaatctttactatgaatgggaaaaagtattttctcccattgcaggggagaaaaacactgtgttccctaagtgttaagtcagctgcttttctggacaaggaacaaatctcagctgcatttggagctgacagtgagatcagacaatggcaggcggactgcccactataacagaaaccatcatggctgcagccatgctattctctgccaatccagctgtgtgatggtggttaaaaagtaataataaaatcaccaacctcagaatgctttcgccaaatgtctatgttcttgcgctgggctttcgagaaatggtcccaagctttttgtctggtagaagcgttgaaaacggccacaatctgctcaactttggtgaacaaggaagtcaaacaagacaagtaatttatgttgtgatcactatagggaagcaaagcaaagacactaggagtctatggatgatgtcacaatagaaacaacatcatcaatatccatccaatttgtgcctttcgtacttacattttagcaaggttggggatgtctcccttcaagtctgtctccacaactttaggttaaaacaaattctaagtatgaccgggagaagggcaagggcatctacttccaagcattctttagctgttgtttcaatatgtgatttggtctatctatatacctagatctatagatatatagacactggtgttggcatccagatatacagacaaagtaatgcaagggttgggtgcagagaagtgaagtcagggagaagtggctgaacgaggaagagccaaacatatcattttctcttttggtctttatctcaaggactcaatcacagtcctctcaagacattatcatgtccaagttccaaattgggacaatgaatagccgtgccatgtctcccctcaatctcagggggccatttttcctccttggctcctttttcctccccctgttgcactgactgcagccagccctccagccctctggcagggaacaggaaccatagcctctacctcaagacagaccaaagctcacccaaccagtggcactggcatgcaggtcttatttcaaccaccatatggcaccctccatagctcctcatgatcacattccattatcactttcacaaggctccccgccctctggctcccagaccacttgaagttctaactctattatcttgacttaatttagtacttctgctgctttcaggcctggtgctactggactggtaaatgttgaggggttatgaacaaaactacatagacaaaggcatgggctcttagtagtgggtattatgggtggagccaactaactgtagacttaatcttgcttaaacagttattgatccagtaagcatgagattaaggaaattaaagcactaaattaatcatatgattaaacctgaacttctaaatttttagttaagaaggctcagttaaaattagcttctcaaggattctaacaccccatcaacataaatctttcataagtgattcccaaggctctattataaaaaaggacatcaaagctcttccaaatcttctggtgtccaaagaatgtcaaagagcaatagagtaatccccacagaagaacaacacttggtgccataatttttaaattagcacacaaaataaatgtatgatggagcagaaggaaaaaagcagattccattcacttacaatatcgtgaatacttttctatgctgatgaacaactacttctcaatctatggctgattttcacagagggcttttatctttttgctattaatatttttactattttccacttcaggagaatcccaaccccaaatctccttatttagcaaaacctgtcatcatgtcacatgatgaatttatttgactcaattttaacaggaggatttgccttcaatttgtctcatactctccttgggcacatgtggcttccctcctcgacctcaactggaagaactaaactccagactaaacacctggggctgctctaagtgctggccatcagctgaccactgatccttagtgctctggttggctgtcctgcagcacagctggcagaggagagaacctgttccagtggatcaccggggctttctgcatgttttgtctgtacacaggctgggatcattgggaatttcagctgccttctgtaggggcaacacagaacagtcagccccaaatctaggctggcaggggtggtgatcaagaggttattaaagagtaatgggcttcgttgcttataataacatagctctttggcatcatttagaagaggaagaactatgatgtcctgacaccagtcctaaggggaaaggacaatatgggttgagactgagtgtttggttggtaatagtgaaaattctgacatcaatcagagaaggctgttaataaaaatgaaacactaaagaaaagtatatctgttcataaaaacgtgtaaggggccagagagaatgaaggtaaggaagactagtaatgcacctggaggagtacagaaaagaaagaactaagaagaaggacccaatggcccaatagtgcacaggtttaggggtaaaaggagatcccctaatatctactcaagccatgtgctattagatatttcctgtttgtggctaagtgcctcggttacttagaacatgttattaccatatcccaaggcataagttcagttcattcattcattcaacaaacatctggattcctgttagctaccaggaacttgattaattgctagaaatatatgatcaaggcccagtcttgtctttgatgcaatcatagtctcggaagagaaagaaagacaagcagataattatcctgtgcaagagaggtgcagatgacagctttgaagacacagagaagagaagagagtagctaagtagataggtggcattagaaaacattccacaaatagggcaacatttctgccaagtcttaaatagtgaagcaatgcctgcttggcagagaaggcaggagtggcctgttcaaaggctggtatagagttgtgggaggatgagtgaaagtagctgtggggctggggctggggctagtgttaggtatgaatcaagagagaccatgtatgctaactctgattgggaactttatattgtaggattggcttgggagaaattacaaaggaatgaattaaggcagaggctctggcatggagtgtggcacaggcagtcatttgacagggagacttgataggaggaggcagctgacttgctacatgggaggaggaagaggggtgcgaggtaccacgatgactggagctggtaagtacatcccaaactatgagaacaagcatcggtggagggctgagaaagaagataaggaatttacttttggacgtattgagtttgagatgcctgaagaccatccaaatggagctgaaatatggattaggggttcagaaagaagtcagaattcaaagagatatggccaacattttctgggccattctccatttcttgtattctttttcaatagggtaattaattagatgtaaaactaagtgggatttaattttatacttatgaacttatacactttttttccctataccaatcaaaaagcaaaacaaaaacaaaacaaaataaaatcccacaaaaccccaataactgtgtaactcaggtttggaaaccactctcacagtattcacacggcccagttttacctctctcattgctgcacacactgtccctgaaccagccatttgtcttgcaaatgaaagttcctgggcacacacgaaaaaggactctggaggagtgctttcatcagcattaattcatcatcattagggaaaaagcacctctaagagtatgccctaatgaatgtcattcaaagacagcatacttttaagctcataaatcaggatgactactggtattgatgtaaatacactattcattgcttatagcaggaaacaccagagaggaagtccatgaattagatgaccactgactacctctctggtataattcatactacttactctatctatatacaataaaacctgttaagaagttactatcagaacaggctcttcaaaactttgcttctcagagaaagatataaccagcaaacaagatggcattggcatttgttcaaagcaagtagcttatagaagttgtgctgcaggcagaacaaattgagacctactccctacccaatgccttcaccacctcagtggtccacagagtggtggccagaggccccacacaatcctgtatcagataaaaagcatagattctgtttgattgccacttacttattcaagaaagtatactcaaaagttttgcaggtaaagggaattttttttctttgagggataacattttcccaaatcttctattagcaactgaaagagctctccatcagaaaatttaaatttacccctcacactttgcaaatctttcccccccaattctgtgttttaattgtttgcctaaattaggttatttgaggatcataagaaaattaaaaatgataaattcttcagaagtatgcctgaatgccagttttagatatcacagtagagcccctagtatacccagcagctgtaaatgaccttaagggcaggataaacagagccttgatgaagttgctaatcactccacagagctgcaaaccctcactagtggttattcattagcttacacatatgtatgtgtggagatacatacacgcacctagcatacacacattacacacatatatgtatatattcttccaattttaaacaaacccataagactaatttaacaactttttttgcacttttccccaccccaaaatgtttggacatttgctgagtttagagcacacttcttactgatagagaactttacagactatcatgagaagcgctggtcttcagccttctctgggagggaaagctcagaacagaatatccatttatccaggaacagaccacactgaagcaagctccctgggaaaaagcagccactgggtgcaaaagctcagatttctgggctgcacaagactcctgaatttcaagctctgggcaggaatgcatgggagatgaaagagaaaggttagagtcctctagagaacacgaacacagcccttttcccttcatgtcttgccgactgccttctttctcacaggccctgcacctcttgtattccttgttccagctaaatagcggtgaaagagccttaatccagttagtgtcccaaatatctggagaaactgatttagtccttaaaggcagtaggcttgcctaaataaagcacctcaaacaaatcttccaagcttagtttttgttttttaatgctatctgggctcatgttagagcctcaactctgcagggtacacaggacatttttctttttttaagggataacattttcccaaatcctctatgaatagcccatgagagattttcaaagggatatgacacaaatgaaataggtgacctctcccaccccagcttgtttttgttgttttaaaatactaatagctaggggagaagggacagaagaaaagtgtaaggctttagatgtagtgctggaattggtgagccttggctttagactgaagaattataatggagggaatgcagtaagcgattccagctctcaggatacccagaggagcaagacaaggtccaagggagaagcggtatgtgtcggacagcacataagaggaagctgctgctataaaagagattcccagacagactcctgcacattcactcgggttctgggtcctgagcatgaaggagctggcagtcagcctggcagaaagcccaggaaacagagaatgaatacggtcaaacccatactttaaggagggatggaccggaatttcaaatagaggaagaaaagggcattctggggttttgtcttgagatatgttaaaaaaagcctcacatgacattgtgagtccattacagcccacttaaaactgaggccaagacaccaacagcagacatcatattactgaacttcctggctagatgaggccagatatttgttgcttttagggcagcatccccaacgtttttggcaccaggaaatggttctgtggaagacagtttttccatggacagggggttggggatggtttggggatgaaactgttccatctcagatcatcattagttagattctcatagggagcatgcaacctagatcccttgcatgcacagttcacaatagggttcacgctcctgtaagaatctaatgccgctgctgatctaacaggaggcagagctcaggtggcaatgctcactcacctggtgctcacttcctgctgtgcggcccagttcctaacaggccatggacagtactggcccaggggctggggacctctgttttagggaatggaatttgaatagaataaagagaagcctactgatcacagtatataaaaaaacaggatgttttaagcaaatttcaagcaagcaagaaatgatcaaattgttcaaataaaacagaaagatattaggtatatagtgacttttaaagatttgcatcactccaagtatactccagggaattgtagagccctttattaatgcatatatttaaaaattttggaaagtaaagcaatacatgagattataaatctaatagttcctcaaaatatatagcatttattaagctttttaaatccaataaatctcctgcctagattacccctactgactaaatgaaagtaatgtatatacagaagaaaaaagggacgatataaaaaaaaaagtctaccttcccatcttgacaactctaccaagttctctttttaaaggtaaccagtaaccactattaacagatcctagcacatccatccagaaaataaggttatgcatatagtacaaacagtgtgtatttttctatgagaaaccttttttacttacacaaaggtgctaatattatatacgctattctgtaccttggttttttcacttaatatatcttggaaatctattcatatgtatgttatcaataaggctgctataaacatcttccaacatatcttctgaaatccttacataaatatctttataaaaaattcttagcagtagaaaggctagataaaagagcacctgaatttttaattttgaaaggtactggcaagttgcactctatgtccctgaagtgtttttcagtttgtttctcttaccctttgccaacagtgcataatcaaatttagcttttgccattcctgatagatgacagaaggcatgaattacatggtaaccaattgtctgcaccagtgatatgtatgtttgcagtttccattacaaataacagaaacaagtccagactcattgagcctgccctgtattcagttgttggctcgatgctaagtcatcacatagcagcaggaggagagacctggtttctggggatcttttcttctttgtgaccctcgaaacggcaaccctgatctcctctgagtctctactaactcccttagtggttatgaaaatcatataatggtaataggagatttctttctttttgagacggagtctcactgtcacccagcctgaagtgcagcggcatgatctcggctcactgcaacctcagcctctcgggttcaagtgattcttcagcctcagccttccgagtagctggtattacaggtgcgcaccaccacacccggctaatttttgtatttttagtagagacggggtttcaccccgttggccaggctggtctcgaactcctgacctcaagtgattcacccgcctcggcctcgcaaagtgctgggattacaggcatgagccaccgtgcccagccctgtgataggcaatttctaattacttagcccttactgggctaggcactatgcttgatgatttaaaacagtagttatcaaagtgtggcccctggaccagcatcatcaacatcacttgagaactcactagaaaggcaaacactcagactccagacctaccaaaggtgaaactctagggatggggcccaacagactctgctttaacaagctctctgcatgattccaaggcatgctaaagtttgagaacctctgattatcttacctaagttttgcaacgactgtctgaggtaggtgctagtatgaatgcccatttcattgatgaagaaactgaggttcactgagacgaatatttacttgtccaaggtcatatatttagcagtggtgaagttggcaatggaaattacatctgtccaacttcaaatcatgtatttatacccattatatgatgggccaaagtcttatgagctctgtggtgtgtaatgtgctagactttgtactacacactggggataaaaagggccaaatatgcagctggtccttgagctgctcagagtccctgggggagacaacatatatatgattgaatcgcaagatgagaattgcttaagagagctgcagagggtgccaagggaggccaagaaaggcttaaaggaccccttggctgaaacttgcagctaagttgaattttcaatgcaaacaagccaaacattggaggttatgatggagcaggaagctgcatttacctctctacaaaagtgtattgaggaacatgagccacagtgcagaagaatcaaagtgtctggaaaaaaagtccctactttttttgtgtctaccaggctggaaccaatttctctcagtgtgtgccctcagccttctcattttgtctaaaatccagtctgtcctactttttttgaaataaaagtcattgaataagcctcagcaggggaaacttacagaagtggggccaagggagtgtttttatgaatacaacactgttttgggggttgcatgtagacgggaagagagagttgggaaatctgtgttggtcaagtcttagctccatcgctaactagctgtgtgacctgaagaaagtgtccatctgtttgaatcccaaggcaaagggggctaggctagaccatcctgaatctcctttctggctctgggagcctttagaacagggcttagcaaactttataaggaaaggaacagatagcaattatttttggctttgcaggtcatacatctaccttgctatagaaggtgtctacacacataagtggtttctctccttaaatagaaatcctctcactttgtctgtggctactcttccatgattctccccaggtacaattttctttggttggaaaacaaacactaagttgtacttctctttcagttacgcagagtcaagaacacatcatctctgctttaaagtaactttactgacaccttacttttcctcaatttgaaagtgtcttggctttaaaaaatctttgtaaaaattttttttatgcatggattttgtccagtgtagctcagagactgtttcccagagtaccccaatgctatcaacacacattcccctcgcctgatgtggggcagtggctagagtccagtcctagacctgggctcatatcaaagtgacagagttttcatctttagctcccagaagttatacctttcctgatttgctgaatttcacttaatatgcactccaattctttattgttccagagtgtaagacttgatttctatcttacattttggtattattaaagatttttttaaaaaaacataatgatttgactcagtgtatatattttccacgagactgaaaggaaggataccaaaaaaaaaaaaaaagaaaagaaaaaaaagactcatttcagttctggcaggcatagtgtcctccaccatcacctttggcatcctgtgaaacagaacattctgtgctcatccttgatgctgaagtttttatacatattattttctctggatatttattccctgagaccaaagaggtatttttttaaatggaaataatgtttccagcacttaatgcattggcaaatacagccatcagtacaattttgaggagaaatagaaaacctgtcacattgctaaagcagttatggggaattttttcccatggatgaactacagcaatgactgctacagacatgggcaaacattttaacacttcataaaattcctttttgacagcaggggacatagaagccaaatttcccttggtggaaataaaaaatgtttggctgagatgttcctaagaagtaaatgatttcagaaagagcttttcaggcagaagaaatgtggacgaggacaccaatctgcctaaaagggggatcacagtacacagagatcagaaacccctcacatttcactctagcacttagcacacaacttgacacttgataaatatttgtggaatgaatttaatcattcagacacttgaggcttttacaattttacccaagaagatagatgagggcgtgacagtggagaactgtcagtgccctgcgcagctgtctttgacaataattctgaccaatcttcagcacctgcagaatgcaatgcacataacctcagggttgaaatgtggcttaaaattcacagtgtagcccaggaggagtaaccttcacagcaaggtataggcagaacatttgcacagagtaatatctgattgcctgttctatgatcactttaggagctttgaacctcatggttgggtcctggaagatacctgtatttagatatccagagacgataaaggatccacatggttgacataagaactgtggaatcttaagggtggaaaggaactttaagggattactggttaaacccttttattacagagatgagaaaaaggagactgaagttgcttaaaagactttcccaaagtcacaaggctaattagtggtcaaacttggattagaaccagatctctctgccttgtcaaaagtctttccaccatttgcagcttttaagacctaagatgaggctgatgccattacctatcacaaatgtataaagttgcatgacagttctaacctttccaatctccaggttgaaatgatattgataacggtactctaatactcctactgtaaaattctcaactaaagtatatgccgtatgctccactttaaagagaatggcatattagagctaagatcattgagatcacggtttactaaaaaacacttaggctgtgttctgcaatattaggttctagcccaattttcagcaccacgttcctttccacctgtgattggtcaacaaccaatattttttttcttaggtcttctatgtgcttacaagaattatgccaggtccagaagtggcacagtgaggtagaaaagagaacagtaagtggctcatgtctctatttagcctaaaatcttgctagagggaaaatcaagcaaacaaaccaataaacttgatgcacataaaataattagaaaataagtaagtcctcaagtagatagtattaacaagcgctgcagaaggtaggtgaaagggagatgattatgggttataatggataaacaaggtttcatggaggaaatgtgatagaagtggacttcaattttggcacttggaggaggggaaatagttcaggcaaaggaaacagcacaagcaaatgtgtggaggtaggaaagagggtagtgccagaagcaaatacttcattttttagccagatagcagcatttatactcagtgtgatgacagcacacctcttcaactctacctataagctgtacctttacatttataatattcttaattttcattttacacacacacacatacacacacacacacttagaaagcaaactgtacaaggagccaagagtcttggttctaaactgcccataaactactaaatgaccaaagcctctcacgtctgctctctgagactcagtttcctcctctgtaaaatgacagggtttggcccaaccctttaagatccctcttagctctaacattctataatttctgctttttatccatgctcattatatgtatggcacatattcttaaattaatgttaatcaacccttctgcactgctgctggctttcccatttgccttttctccagtttgttcccttctctcttaccaggaagcatgttgggaaagtagcaaaatggggatatcatggagtgtttaaatttttattagatatgtgtgtgttgtaattgttaaaaggcatgcaaaacttatcatcttggcatgcatattaataactgaatgtggtagtccatgcttcctgaactttataaacagctcctgtacgagctttgaaatgacaagctttgttcataactgagaaactgaaagtgggcaggcctatggggagtttctgtgaagtatgcatttttaaaaagcaaagataaaaactccaacgtctccgagttggaaaacctggggaagtttctggcaaatggacgggttaagaaatgacataaagatgagactaggatgctatcgggataaggtgacatgacaaagatgatttacctgttccgaatttttttttctctttcttctatatctaggaaatgaggtctatccagctggcccagaagggaggagaaagccccaggtgccacagcaggatagacgatgtcctcatctaacatttttcataactggacatccatggtcagaagagaaaaatcgccctacacagaagtgaatggatgccatactccccaaaattcaggttgggtttttttttttttttttttttttttttgagatggagtctcgctctgtcacccaggctggagtgcagtggcgccatctcggctcactgcaagctctgtctcccaggttcacgccattctcctgcctcagcctcccgagtatctgggactacaggcgcccgccactgcccccggctaattttttgtatttttagtagagacggggtttcaccgtgttagccaggatggtctcgatctcctgacctcgtgatccgcccgccttggcctcccaaagtgctgggattacaggcgtgagccaccgtgcccggcctcgggttgggtttaattacagccccctgacactttaagctaagactttgctaaaaacaatgactgtttgatatttaatagctggtcctggggtgaagaccagagatataaaaaaggttagaactttcataaatacgggcagaactaaacaccaacaaagctagagggtaactgatggactttgatggagacctttgaataaatcacaactttttctttatgttattatgaatgacttgtgacgtttttcaaacaacttttgttaagcactgaacttcaggaacggtggctggagagcaatctaggccaaacatttgagcctatggatcctttccaaatgaaagcaagaacaagtacacaagcacagaaaggagataggtgcatctaatccagctcatggatcacatctgaagtttcccttgtcctattcaaccaattggttatttccagccaaatccataaggggacccacatgcttttaccatgctttgaattctgcaatgtacctgatcttccctagaagctgcggagtgagccctccgtgtttggcttgtttgcggcctgctccactagttagccagtttgccaatacacctgcttccaaaccacctcacaacaatttcccaacatgcttggctgtttagtggacaggctaccatggaatgccatgaaggacggcattgacactggggagatctttcggcactgacactaaggagatcctttatgtggagagggagcagttggggctgctatggaataaccaggagatttccagccacctgggagaaggaaagctgaggtgcaattcctgaatactcatgcttaacaattctaatctcattctaagggaagaagccaaaatgtgattcctgtggtatttgccaggaatattaatgcagacaaatggggtgtgactggttctgcttttggaaaatgcagcaagtgtgtcagtcactgaggactttagcagttattgttttacaagcatccccaaagtcctgacatcaaacacatcttaccacactgaacagagctgtggaaagcaagaagtacagttgagacacaaacatagctccactagagagagggaaattcgggacaggaaaggagaggcatttggattaaaggatgaggagatgtgtatgtacctaccatgttagtcaggttactgctaatagtttcacagactgggttcctttttgcagccctttttgtaaaagcacatagaagagaatggaaagttctgaggttgctcaatgagatatgcaatcttctggttctgcctcacaggcttaattctagcccaggctcacatttaaggtatcccccatcttcgagtcatcctgaaagatcttggctgtcaaagactcacaggaaggctcctcagagtctccattgctgggatgtgtacaccgtggccagcactgtaggattttcacaatctcggttgatatctgccaactgctgaaatacttctcagaatcaaattacagggctaagggggactcccaaatagtaacaggcagatggtaaatacagaggttgttggatggttacaattggggatactacaacgtaaatttctgatgattctttcaccccaactctcctaatatttcctagcctctgaccaagaatttggtaaagtgtggcaatttccaataaaaagtacagctattgagctttttctctgatttgcttcattatgcatgcaagttgaaaccttgtttcctgcagatgatgctaatatcaatgccaaactactcaacgaggtcaccagaaatttctgaactcactgtttcagggttccctcctgcctgtcttctgatctactcattcattcactcactcatccaccaaatatttcttgcatatttctatgttataaggcttgatatatattgatgacttgatatatattgatgtctcttcctttgtgatgcctgctataataactaaaagcagacatatcatgaaatcactactcatttggataagtgttacaaaggaccttcataaagattcagtgggctgggcacagtggcttacacctgtaatcccagcactttgggaggccgaggcgggcagatcacgaggtcaggagatcgagaccatcctggctaacatggtgaaaccctgtctctactaaaaatacaaaaaatcagatgggcgtggtggcgggcgcctgtagtcccagctactcgggaggctgaggcaggagaatcatttgaacccggaggcagaggttgcagtgagccgagattgcaccactgtactccagcctgggtgacagagtgagactccatctcaaaaaaaaaaaagagagagatgcagtgatggcaaatctactagaagagggtggaccagaaaaacctctctgaagaggtggctcttgatccaagacctataggataagaagaagtcaagcacacagagtatgggaaagggcaccccaggcagaaggaacagaacgtataaagccgagtggtggaaggtggttttgatgggctcagggggaaaggggccagtggaaatgatgcatggtgagtctgaggataactgaagctaaagaagtgagcacagagagctctgtcagctagggacagtgaatattctctaaatgcaatggggagatactcaaacggtttactggggaagacatgacctgatttgtatcagatggaatgtgaaaataaatcaaactagagtagaagtagaaagggaagcactctgtatggcaaaaactgcaaaattcttcctagtagccattctccactcctgccttattatgagaactccaattttactctggagagcagcaggcccagtcaaaaattatatttctcgcattctttgtagttaggcatggccaggtataataattctgcctaatgaaacctacatggaagttggctggggatggatttttgggcaagtttgctttcttgctataatgacgcaactccttcctgtgtctttccttctcttttcttatgtgatttcagctggaaaaagaagatgtgatggcaggcgaagcagcagcaaccatcgtagacaactatccaggtaaagcgaatagcaccagagagacctcagacctggcagccttgaaccactggaccagtaccaacaaaccccacatctggattttactgtgtccagagagaaacatcttctacttgtttcagataccgtttggcagaattttctgttactcacatgtggatgccgtgtctaactgacacatcaagtaaccaaagcctgacttgggtggtggcggttacaatgaagaagggtgggccgaatcggggtatatttttgaaggaagaaacaatgggacttcttgatgacctagaagtcagttgtggtggtgggagatggcagatatataaaaagtacaagactttggcttgagaatttatgagaatgggaaggaaaaaccagaagaggagcaggtttgaagattaaaagcaaggattccacttttgatatttcaaagttgaggtgcctaagaggcagtctccactcctgtggtttccaggagacaggatcttgctggtcctgccccaccccttcattcactccttctcagggagtgatgagccagcctgcccagggggagtgcctgttctgctcacccactcccttgtttaggcatccaaagtgtagcctccaggtaatgtggctggggccttcagtgctgcctgaggctggatgctcaacacaacgtccaacattcagaagccaattattgctgtaaatctccacgtcattttccaatttggtggtaataccaaaaagtatttgtagtcccacatactacacttttctgtccctctctcagttgcttcaaatatgggccaacttacacctatataatgacaggtagacattttgcgttctttcagccacatcacaggggcattttaataggtgcctctttcaatagttactgccaaagaaaacgaagttctcacctattcatggctgccctcttatctttattgttagagccaagggttgagtcttccttgctcattaggactataaactgcatggaaattagaacttatttaaaattgatgccagtgagcaaaagataaaaacatacagtaatcatttcactgttcaggcatatgacttcttaccataactctgaagaaagtgtattattagaattgttttactatgctctctctcatttttctctaccagttcactcttaccttccctccatccactgatccattctcttcttccctcctttaaaaactgctgtaaatattgctttttaaaaattctatccctaataaccttagagtttctagacatacactcttaagtaaagggccattcctcaaggctggtgaatctaggtaatgtggtctggtatcagtctgtgtgaagacagaagtcttatttttcctattccttttctttaaagacagattggtcttatactggatatttgatcacttatcggaatttacatttgggaatttgttatatcatatgctacgctgctgtaaaacctgtctttgataaagtcatgtaagatacttttacatttaagatctcagttttgccctctcttccatcctatcctgacagatacattattccttgtgtttgcactgatgaaagaggtgataggcattttggcacactatatcacagaaaatagtacttatcttcagaatggaaatatacatcccatatgtcactaccacatagggccctgcacctggtatggaatggagcatggcattgttacagtgtcattcaatggcttttaccaagcaagagaacatcggcagctgtgatgcatgatgccactgtgacattaactacagacacagatagagtgcccataaaaaaaatatacgccctttttttgaatagagccctgggtaattaccctgactattgttctaagagaaagccccacttacaccccttcatcatttagactctggacataaaaaaaaaatcactggcattgagtagttaaggcaatttgctttccaaatgaagaaaggacaaaaaaatctctactcttgagttgcccattttgacagccacagctcccccagataaaagatcctgaggagtttttctgatagtacccttttcctacacagagcccaaggaaaatgtgttcaagtttgctttctactgtcagcactaggaggacataggggtctgtgcggacagcctgcaggtgaacggtggcggccctgcagctatgatatgaaccatggtgggtccagcaggcacagatgcatctagctgccctgccctggtggccaggcttgctgttctgaggaaaagctacagaaacgttgctcaccttgagaagtaaactctcagggcagggtccgtgttcctccaagttgccacagaacatgaaataggttatgaagtttgccattcaatatggagtaaaaatgggaaattattgaactacttacccccaaatgaaaaagtaaaattaataaaaaagaaaaggcaaaatcacaacaaaagagatggcccccaaaattttacttacattgagtgagaatcccagttaaggcatttttaaaattctccttggcttcctccatctcttgctcatgggtggctttttcattcattagccggcggacgtggctgttggccgactgcaccatggaatagaactggtttgcagagcgccgattcacttcccctcgttcaatccaggaaagcagcactgtgatagcctctgaaaacttgctatcatctggaaatggaaaaccaccaagtacaaatcatgccaagatgagaaaatacactttattcttgttcctctcaaaagacagagcatagtccaacctagtggatatattttcagaactcagcaagttagctttcctgagactgactgccatatcatcacttaacttctcttttcccatctaacttcagggcaccacagaaccactcaggaggttcacactctcatctaccaactccatgagctcagctgtaggagatttgttctgggcattcttaggaataaggtacagcctcattcttccaccaaaccttgatttctctttcttaagatggacttgaaaaactgttactaacctacttggcctccacttcatttctttgttcctttatcaaaaatattatacagtgttaccagttttctcatttatagaatcagctgagttagtattaaaatgtggaagaaagattggatttttttaaaagtgtttgtaatgtatggtattgtccctaaggcaggtagtaggaataagtcaattcttgttctactgtagttcaaaactaattccattttagggctaataccatatatttaattaggctgaaaaatagaatatttcctaattttccacaaaagagaacatgtttcctgaagtgttccgtgtttgctttagatggctatggagagcccatctgaacccagtttgagatgtatgtgcatggtgtggcggggggataggaagtgggaaatgaagttccgcctgaaaataagtgataaagtctatttcaaagaaaacagacttgcctatttggggatggttactggaacaaacccgtgttgtatggcttggaggtggagaaaaagaaagtttgtgggtgattaagttaattagaactggaagttgtatgtcagttgttagaacattaaccaatctgactactgctgaaggctcattgcctactttccaggcaaacctgaggggagaagcttttcattgtgttctgcaatccctagaaaatgtgctttagggaaaaataccctacatttttacaagtaaactaggtagactctgaattctaaaaatcaggagcaaaattagattgaaagattcagattctcacccattcatttaaaaaatactgagtgcctactgtgtgccaggtactgtcccctccactggaggggcatcggagacatccttatgttgtttgcatataaacatacatacactccacatgaatagacagggggagatgcatgcttgagaaaaagatttcgtttcactcaccagattttaaaatcaatcattgagttcttattagtattttacacatcatacgaaaccttcccaccgttgagtgctttgtaaatttatagggtgctttacaaacatctttagtatcttttctcccaaagacctcctcccagaccaggagtacagcttccttagcatggctgctgcttgcccaggaggtgtgtgtcctgaatgaaggtggggctgaacctaattcaaggtcctacggctgaactctggaaacctctgccttccccaggaaagaaagcagcttttagggatgtacccatgctcaggcaccattctaagtcctctcctgctgcacagcagccttctagatttggggatcaaaggttttttttctgagcaaacctgcccccctgccctcacactttaaccagaggagataactggcctgggaatgcccacaaaacaccctgtgaatgacagactcaagtttccttgaaaatctcaacccataggcacagaacacacttactgagtatcgtagccacttataccattttgttaactctggaatttcagtctaagttcaaccctcagtgaactccagctgcaatggtttcttatctcatttcatggaccgaagcagcttgtgtaagataaaatctatcacacaacttaacattacgttcagcccatggagaggcccataatttagcatgatgtttgtgagaggcccactgcaaccgttactggcagaataaattgtgcctccctccacactctctacctctcttcccaccaatatatgttaggagaatggacctcagaacagacagcagaaataaacctaatgcttagaagaaatctttttttttttcctctgaaaagataacaacagaaaaagagaacactgacttcatgtactatttttcccctttgctgtgagtttcatgtctacataacacagagaaagaaaaatccttaacatttttgttatgagctttgcagggacagagtgtaatgctgttcacctctttctgtcatatacaggtagtttttccttctcttgcttgtggtcgcttagttcataaatagactaactttactatcaggaaaaaaaacacttcaattttaaaaatgcatgtttgctcaaatgctctgaaagccacattttattgcccttcacacctagacctagagcacaataagttcaccagcagattatagtttcagaaagaggaaacaatattcttaggattaagccactgaaaatacacaatttcaaaagtaagtagccaagagattttctaacatgttaacaagtactaggaagcagaattccattagcctaaaagaggaatatagtttcaaagactcccaatttcatcttcatttctgaactttctgaaactgacaggccgatatatgattgatgtactgacattcaaattaaattaaaaaaacattagttaaggcatgcttgataactccagtcaatatttgttgccatgtaagaagtgactttaatttatattaattaagactaagtcagtaactccctctggatggctacaggaggatattgggagcggtcattttcaatactcaactgtaaattcaattttgtattcagtggaaagatcactgagaaagcagaaaacaatataaactaatttaaacaggatttagattgcagcattattaaagctattcatgtggaaagaaattaacactgcttgtaaaaatcacatcaaacatgcacttataaaaattccaaatactttctgtgaacatgctcaggcataactctgaactggatgcagtttagaagctagaatgtgcagatgtgctttttccactataagaattgagaacgattggtatatgatggagtgaatataaatcatttgctcattagaaattacccaccgttttctaatcaggtcctcacaatgttaatgcacctgagttaatggacaggtccattcacgggtcttgcctttttcccttccatccgtccgtccccgcttcctttgccagagccctctttgttaaacagcacggcgtgcctccctgcatctgctcatgctgtgcacttatccttgggtctctcccactcctggtccccctggtcagctgttattcttccctcaagattcagcgtaagtgccctttaataaagaaatctcttctgcaactctaggatgaattaggtgtctctttgctatgtttccacaattccccgcatatcctgctattaaagcattagtcgcactgtatggtaattgttggtttacagatctgtctccagttttgaggggctaatatgagaataaaatttccaaagacatatttctagacatatttctgtcttctggttactctgagtttttccctttgtattttatattttattgcattctacagtagttcctccttatccacagtttcaccttctgaggtttcagttaccctaggtctcagttaactgtggtcaactgcagaccgaaaatagtaaatgcaaaattgcagatacaagcaattcatacattttaaattgcacactgttctgaatagcataatgaaatgtcacgctgtctcactctgacctgaccgggatatgaatcatccctttgtccagggtatccacgttgtctacactacctccctgtgaatcacttggtagccacctgggttatcagatccactgtaatggtacagcagtgtttgtgttcaagaaacccttatttggcttaataatagccccaaaatgcaagagtagtgatgctggcaatttggaaatgccaaagaaaagccaccaagtgcttcctttacgtgaaaaggtaaaagttcttcacaataaagaaagaaattgtatgctgaggttgctaaaatctaggataagaacaatttatctatgaaattgtgaagaagtaaaaagaagcttgtgcatagtatatatagtgttcagtactatccatggtttcaggcatccactggggatcttggaatgtatcccccaaaggtaaggggagactactgtattcctaatagatttgtagcaattaatactggaaagatacaaatgtaatggttaaaagttaggaaacatcagagttgataataaacatttaaatttcatgtcaaagagtattttcacacatgccattatctacgagagatagatgttctcatgacaattaagctgaatgatcccgttatacttcaggcttcagaagtcattatcactggcaatgaaagttaagagtgatgtcagataatcccacagaagcaaggccctctgcagtgaggcactaaacagtttatcaaataactcaaaaatgtttttgaaagcatttttaattctgggaacgtaattgctctttagctttgtgaggagtaaataatattataatgatactatcagatgtcaccactggaatccacgcccatctcatttcatttctggttatttcagactttgttaacccccttccttctccctctcttccacatttattgagtacttggcacatagtaggcattacaaaactgcatatgggagaactctttgctatattctaagaccaggtgcaggagcagcctttgtgagcttgttaaaaacacagactcagcctttctcacacctccagaattggaatctgcattttactccaggtgatttgtacgcacatggaggtttgagaaacactgaagaaaggactcagtgaaggccaggtaaactggttaggagctgaccaaagtaagagataatgaaatcctgaagtggaaagtagcagctgagatactagagactttcaaaaggaatagatgtgattcttaagagctttgtgagtctctatccctgtccccacgaccaattaaatccctgtccccacagctgtcacttctatccaggaaataaaaagggttcaagacttggaaatgggcatagagattactatagaccctttctatggaatgctgggcatgaattacctaattctacagggggtgggaaactttaattctttggctaatctctgactaggctattttacaactttgtaggagtagaacataaattgtggcaaactgataacaatacaaataattcgtctctgtaacaatgcaaattaatttttgttcagtagaaaatgtaaatctttataaagcgaattctccttcgaaacagttttaacattttcttggtctccttattaattagtgagttaaataaaatcattggcacatgttcattttatatttgtaagacagtcatgatttcaccgccacagtattctttaacaaaagacagggcccatgctacagtcatatctgaaagtccagggcatggcacaaagcgatgggtacctggtgaattttaattaaactgatacatagataatgatggggaaaataaaccaaattggtaagtgttttttgtttttgtttttgagatggagttttgctcttgttgcccaggctggagtgcaatggcatgatctcggctcactgcaacctccacctcctgggttcaagtgattctcctgcctcagcctcctgagtagctgggattacgggcatgcgccaccaggcccggctaattttgtatttttagtagagatggggtttctccatgttggtcaggctggtctcgaactcctgacctcaggtgatccacccatctcggcctcccaaagggctaggattacaggcgtgagccactacgcccggctggtgtttttttcctcccgctttgtgtgcacagggagaagcagccctgaatttcagaacaatagataggataagagccaagccgggagcactgaatacgaaacttaggtgggctatagtatccttatttacagctgggtctataaaggaacaatgaggagacagggattttatgtttgaacggaacgagggaaaacaaggaaggcattctaaaatgcttttctttccaaagaaatggagggacacacacatgtgtacacacatacacacacaaggaaaggtatgtctgtagttatcactgatttctggctccaaagatagctggaaattgctcacagtgtacagtcacagagtcatctaagcagatttggaatttcagtatggtcaaagcattgctgctatcacaatccccaaatttctgtacatgtccctaaagaagtctccttttcctggctgctcaattaaccccgcatcaactaaccagatcacagacagcataaaaggctaaacaaagagttaatgttcccttctacccccaaaacacacatgcaatctccttaactatttagtagctgtaaaaatgagaaaattaagggggcaatatgaaaatgcactgattattcctgctttagggtcgagcaaaatatttctttttattttatttatttattttatttatttatttatttattttttattatactttaagttttagggtacatgtgcacattgtgcaggttagttacatatgtatacatgtgccatgctggtgcgctgcacccactaactcgtcatctagccttaggtatatctcccaatgctatccctcccccctccccccaccccaccacagtccccagagtgtgatattccccttcatgtgtccatgtgatctcattgttcaattcccacctatgagtgagaatatgcggtgtttgcttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccaagcaaaatatttctaaataaaacggcctatcttgcctctatgaaggtcaataacacataaggaaataatttgcaaacaggctcctatgtttcatatttcccttactctatgaaggaagcctggcttttagctaatgggacatccacttggctcataacattattgatttttactttcatggaaccataaatactgacaaccatctcagcaaaatgctggtaccacatctgccccttcctccctctggcaggctgacatgaggctattctatatgcaaataagagtccagttctctggaaattatgaatgttgatcccaggaggatggtattcttgttgacacatcaggaaatcccaaaggccctgcctgcaaggctttgtcaggacgtcacctaattcagagagaaactcttcatttcatcacaaaatgaaagattatgtgaagctttctaagggggtacaaagtacgtaaaaacttttaaatgctcttgccaagagaaatcccggtgaattagaatataatccttcctcactgtctaatcaatctcttcctcccacagtccaaacacagggttcctccaggggtggatggtctgtgttagacacactgaaattcattatctcatctgcctggttgccactgtttccaataaagtgtaattatggtgttattgagctccttcccactttctcaaagccatgctataaactttgggtttctgagcagttacttcccagtcggtcttcattaagttgaattgtctcggaacaatgtctgtttaaccagcaggatgcttactaattttcttttttagaatttgtattaatgtaacaggcactgggtgactccatgtctcaggcactacacaaatacaacacagtgttacctctggtttcagaaggtcaagtagccagtgaatgggataacctggtcccagaagatcctccctctctcactccagcactgcccatccgggctggctatctcccctgtgacagcactgtgcacttcccacatataacaggaggattattatatttattataatagtgcactattataagtggcaaacgcaaggtgatttgttattgcctgtgtcactcaagacacctaaactctttgaggcaggggcttgttcaccgttgtcctttccaccactggctaggacagcgccagtcatatggtaaaatgctgattaacgaatacttcttgagtgattggaaggatggctgagcacacatcacatcatttccatgtacatctggtcatgcccagtagaaccactggacagaaattcaacgtgctcatagatccaaatagcagaagaagagagaaaataattatttttactgagcacctactatgtgcacagttttagcattggacaggacatggagagggccttgtgggtcataagaaagacttggtttgtacagattttgctaaataaagctgattttcaaagagaaaattgtaagaataaacaagtatgatataaaatagaggaaaagtatctgtaataaatctaagtaagatttctcaggggaggaaaaaaatcaaatccaattaggtattttcagattgcatttccatttcctttctgacacagatttctttaccttaggtattgactgtattttatgtccccacatcaatgaaatcatcttcagggaaacagtgtcctcagctcctcctgtctggctttgcaacattataaggagcatggagtggatttcctctctaaggcagccaatttcctaagcaattaaatgctgtttatattccaaactctatgcttgggttgaaattgtcaagcttgatattacctgactcttgcctaagatgtatccccagctagttcattctactgtaacagccatctattaaaatttccaatctgttctttcctcaagggatcacacagtacttggcaaaggtacagcttctgaattctgtaaattatactcatctatataaatatatacttttgaaatggcaaggcttgcaaattactttaccaaattgacatcccaatctgttatcctctaaaaggagcggcaaatgccacatacttcatacgtgcggagacacttctgtactgggttcttaaaaacaacataactagatgatacgcttttatgaaattcctccaggaggtcacagatcaaggtgcagtttttgtcacttctaggtgtggacaaactgaatacagttagtctgtgtagatcataatctgataccacaatacattggatattaaagaaaaattattgttccagtgaatactccttgttgagaacattgctgctgtatctcattttggccactccttatggtttctaggctggagggaaaagtgagatgatatctgtatctgcactgcatatgccctttattaaaggcacagccatggcctatgtatttacatcagtaagacatgttttctcaaagcagcagacacaccacaagagcatcagcaagaagcattccttggttacggtgcgggtatttcagtggcagctgcagttgattaaggattctcaagccctggatgggggatgaagattggaagcacagcacccccgctgccacctttttttttttttttttaaagcatagaatgtcaacttcctatcttcctaaaataggtgttaggcagcttttcatacattttttttagtgaaaacatccaatccactttatacactgccagcaatacaccagctatgttctaaaacacttgaaggatcaatcacatccctcttctcatcagaaatctgttaatggcttctccactgtttatggaataaaacccaaatccagcaatagccttcagggctctgccatctggcccagactgccattccagctttacctcactctagaaaggcagcttctatgctgaattcctttctgcttctgtgggtttttattcttaggtctccagcctctaactagaatgcctttatgcctctttttatcctggggaaaaaaatcttatttattctgcaaatttcaaattatgcctcctctataaagactttcttgacactttcatcaacattatttgcactggcccctgagtccccaaagcatattgcatttaccttggttgacaatcatgccattgacttggtattacagttaattgtttatctgtagacacctacatgtggccaccaactgtgacttacattctctcatcaaatcctgacagtgctcagtgacctcaggagggtctgaccatcatttgcctgtaaaatgcccatatgttgctcagctcacacaactttggtcagtaatagaactgaattcacatgtcatcctaacttcaaaatctggcatcactgtagttcacgggggcaggtaccagagccttcctatgtctttatttcccacagcataaaacaccagggagggcctcagaaaacattagaagaaataaaacatactctcttctcttgctagtcatcctgtaaatgttgcatgtgtcccttcaactgcatctctgaagacagggatcccattctatgtttcttttctatcctcgatggaccctagtaccatgtctgctgttttgcctgaagaaggctttaggagtctggtaaacatgcacactctatagagctggaggaacactaagaacgccccaccaatggcacaaatagttgctggctcattaaacactgggtcagaagataatagcctgctttggggacctttctgtcccctcattcagtgagttttgttgagtgactgtacatacacttttatggagaacatgggtgagcattctggaaaggggcaggggtctgtcccaggcagaagatgaagcccaggtgtctgcagcttccaggagaccccccagctaaccccaccccagctctgtaaagagtctgtgcttacaccagactcttacagccttcttaaggcatagcagacattgtgctgaagggacaatggtggacgcaggagaaacgcacagggttccgtgtctggggatccctgtggaggaagaaaagccagcgtgggtggcccatacctttcagcttttcagccagcagagcggcttcgtgctccgagtagtgcattatggcaggcggggatgggggcctgagccggtcctcctccagcttgcgccggtgccgctcctcccgggcacgcatcctctgcttgcattcccactcatagaagtcatccctggcctgggcaaagtccacatgaaggcggcctgaatcctttttgtcggtgctagaccctaatcgcatcctataacctgaaaccaatggaaactctggtcacaccataatgtaacaatggccacagttttggtccagaccttcaaggcacgcttaggcaaatgctcacttatttcttggctgtcactacggatacatttcccataggaagcgggaaacaattatccttttccccagcaatcttgaagctctgtaaagttaggcctattacaggtttggggataaacacaccttggagagctgtctcagagggctgcttacccatcttccaaaccagtatccccaagagaagatgatctcaggaactagggtcttatcatgatcattccttcttctccctggcttctaggaagctcagaaacaaatttggcatggagcattttttttctctacctttttatggccttggttttattatattttcagcttactataattctactgtataggtgaaatatgagtaaataaagagcatctatgatatttaaaaagatctacaaagtgaattccagacacctcactcacaggttattgctacattcccccagaaaatgctgctgctcaattctctctcagcagctgcaaaagccacaattaccaaggcaattttgcaatgctgttttatttccacttatcctctggggtgcgcaggagaatattttaccttcgatcaagaggcctcgccgctgcctgcctcacagccctgcagcacctcatctggtatgcagcaccacacaaattgttcatgtaatattttaaggccacagcagccccgtgcaagagcccagagctagacaaagaaaaaaatgggcctggaaatctttgggggattcactgtgagctacccaacttagataaagattatgagcagaaatttgatctgagagatcaacactaacagaactgaaaccagtcagccggcctaacttcaaatgaagaagagttgactttgaggttgctcttcagtttggggtactcagattttcagaacataaatccaggtcccagcagagacacagctgctgggggctgccagaggagagagcaacataagcacttttccagtatgggggctttgcaaatgagatacaactgtaaaatgctaggctgcactgtgctgatgttcaagatctcatggtagatttcaatggattattttagcacttggggataaacctcagctgaaaatctctgtagaggctggctcctccccaggatgccacttcacacctttgaaaagttacaaataagatattgacttcacatctggtttctgtgatgccttggaacccttctcactgctagattttcaagtgttatctgaaaatgggaagacataacaataccaatcaaaaacaaaaacatctaatcacagatgtgcagaattaatgcaaaagcaaaatgtatcttggttgtgggccatgggaacttaacaagtcagcaggccacagtgatacacgcataacagctgagcaggcaggactgtttaaactggccagctatcccaactggccaagcacctttcccctgctcatgtccagagaagcagttttcaaacatttctggctccagaaacaccctcactttcacagaaacatcatcattaaggacttaaaagagaccctgatgaggctgagtctaaaattagctaggccttcaaacgtgaatgtggtcctaaaattagacaggccttccagctgggcttgggcttgggcttgctggagcccacaaacaggaggggccgcctgacttccttcctgcctttccagttaattggccttgcagatcttcctgggactgacgctgcagcctctcaagggcagggaggcagagttaggaggctcctctgcacccaggtagggaagctggaggtgaggcctagctgtcttctcctcctacagtaatggggcagaccaaggagcaatcagagacttgctgagagaagcgggaccagcacccaggctggaaaatcataggatcaaggtataatcaaggagcacctttcatatgcctaaatttgggactgttcatctttgtcagtgtcttatgaggcttctgattgggtgtgaacattgtgttgtattagtgttgaaaagggcctctgatttactctaaccttctcatttaatcaagtagggtaaagaatacagttgacctgtgagcatgggtttaatctgtgcaggtccacttataggtggatttttttccaaccaaatgtgtatccaaaacacagcattcgagggatgtgaaacccacatatttggagggctgacttttcatatacatgagggttctgcaggatatacatggggcgggggcggggggtcctggaaccaatcctccaagtgtactgagggatgactgcagttttcttggtacagctgtgattagaagccaggtccccaggatagggttcttgagatagaaaaatccgtccttctttatcatcatcaggatatttgtgttaaaaacaaccatttcctgaatggtttctatgttgcaggtgccctgctaagcacttaatatccattatttgatttattcctcctcacagtcctacgaggtcatgctgttactatctttattttatagatgagaaaatggaggcaggctctaggccgtgaaacccagtgccacaaactcaccagaacccccgttgtctaacagcggattgtgtgttatgaaatgtcttcattctaggctttgtcttccttctccattttgtattgcttttagtttttattttctactttgtaaggttttactgaaataaggggttttaaagttctccatatcactgtctaccttaggaaagtctctgcagtattggaataacctcaagtcttctggagtttgcacagaatttcgtggcaatagaggtggactgcagaaattaagtaaaacctggcaggaatgctcagataggtccccctgcccctccccacccccacccgctactgttttcccacattcccccatcagctttgcctcaggaatagggaggtgaaatgcagagggacagactgaaaaatggaggtggggagtgtgagggaagggcagtgagttcagtctgagaatgtgtccttccaaagccagcccctaattcttgggtttggcaaaggccttgcggacagactccattcacttggcccaatacccacagatgggaaggcagcactaggcctaatctcagtatctgtaaaaatcgcctataaaaattgacaccagaggacaaggcttaatgaaccaccaacgaggcaatgatactgggccttctcctagggcccctaagctactttcctgcaaggaactgaccttgctttggtaccttggtgtccagaaagtgaatccacttccaaaaacctgaaattattctgagagagtactttactcctcctaaggattacatccagtaagaataatggtccttagtactcataatattgcttctcatctaataagcacttgagaacattaattagaaactcgatggaattcctaaagactggatggtgggaaattgctcctgcagtgaagtaccttcacaggcttagcgcagagcttctggcagccaaggaagaaggcagaattcctccttttccagccccaaactatgaagactttattttgcatgaaggccaaagggaataagctcatattaacatcacaaaacataacaaaatgcctagaaaactccttatgtaatgcaaagtaccagaaaggtaaatggctttatcaaccatgaattcctctgcaaagcgaatgtgacaaaaattcttcttgcttttccgaattgctgtaatatcaccgcactgttcaaagacttcttgaataatttcctcagtagcattttctggtaatcctccgacaaacacggtcttacacccaggaggtcgttctcttgtggaaggaggtggaagatctaataatcacaacaaaacagaaagttttatctttcatttatttgctttctctggttctcctggcaaaactaaagcttgcagagtaactttctccagactgagtgacggtaaatttctatgccaacttaacattgatcccaggctgtcttgtttctaagttcctctcccctcctgctcccaacctttactttctgtgttcattgctacacagagtggctatatgcttgtccatgaacaaagataaagcaaatgtttgcataatttcatttctcctttatactacagaagcccagaaaagggagggaaaaaacttcccaaagtacaaaacatgacgaaatgacaacatgatgaaaaacctcagcgtgttatctgctttgtcttgtttccagataaaggagcggcaaaacagaatacgggaagcataacctacaaaagcacgcacaatacttacttggctgtgaaacaccgggcctgaaaaaaaccactttgttattattcacatttaaatgagcaaactattaaattttgggaaggctgtataaaaagatacaatgtacactctcacaatattttacctagtttatatgtagattactaaagcaatctcctgaaaagtccacttaaaaaaggcaacactgattaatatgaatgacaaaaaaaaaaaaaagtcctagctcttttagcccataaacttagtatctgaggcaaaattaaaaaaataaaattctggcccatttacttcatcaaatgtatgtttccttcaagcaaatacaatttggtccagaaactctgagatgcaggcttccctctccccagcccccaaattgctaactgtcaaattaattccattttccatctagcaaaacatatttcagagtttttcacccacatttgtgaagatggatggaaatgctcacatatttcacactgtgttctccggcaaacactaggcttcactgcatgcaaaaagtcttaacgctggatacacatccctaaatcccacatactggctttatagtgtggattcagcttctggacagacacgtggccacatccctgtatatttattgtaacctagagacaaaaggccttctgtagaacggatccccactctgtgcatttacgtgtgagtcacatctgaaaatgactgcaatgccattttaaaatttaaaaagaaaaacatttaaaatgagcaaatatttctcataggcgttacttacttggattttgaggaaaaagagtacagcttttgcagtggattatttctttgacaacagccacttctgttggtggtgggggaggtaccagtccaaggcctggtatcattgggttaatgggggtgattccagtcatcatgttgaggcttggatcaaagcctgggacacagattgagtctgtaaagtatacaagataacattttgactggagattaaatccatttttgttgttgtttttgccattttcctgtggattatttgactttatactttctatttttcaggaatttctcctggcataagatataatattatagaaagctatgccagaagggtaaagagaaaaaaagtaaaagatgaacattaaactacatgaaaaggaaattatattacttaaaatattaacatggcagaaagaacacagcatattaaaatgtaaaagcatgcaccatgaagcttcactattactgtgaatgcaattttctatttcttaacgttggtgtattgtttataccaccttatgacccagaatatgggaagaatatcatttaacattgaagtgctctgtgaatctaattgtcaacgtggtttcatcaaaagagccttcttacccaagtgacctagatttaggaaagttcaatttatatgtgcatactttataatgatgtattcaggtcccacctaacctatttcccctggaataaaaaaaaaaaaaaaagcaaaacaaagagtgattacaattactatggctgggttagatacatgcaggcataaaattagctatatacatttctggcttctattggataattgcactttcttcctataatttagtcaacaaagaattgacccacccttttgaaatctttatgccctgtattacacacacacacacacacacacacacacacacacttgaaaatagaaagtgtgcaaaacaaatgggttttccagctttttttttttttagtgtgataatgaagcaagtgatttcaaaggtggcatacagacactaataagtaagacctttctaacagcaggggctatgaaaatactatactgagtagccacaaggggatcccgttcatgagggtttccctgttggcagaaaagtctcatgggtggcgtgaaaatgttcccagatagacaggccaggatagatcatggtgccctcctctactctgcaaggatgaaacttccttcttgtctcataccatcctatcttcttctccctcctcatcttacatcacttccagtcttccttcctgcccgccacccctgcccccgacaacccctttgtacagttctcctgtacagcctgtgccttaggcctccgcatggcctcactcttcgcttacctgtgctgaaaggctggaggagcccagaagcagatgtaagaataaccacacgctttgtttactaagaagctccagagaatacagaaggtctagcaaaagcgtttcctttctgggaaaaggtttacagattccgccagctactttggacatttccactcctcctctgggctgaacagaataaacaatgtgattctgatctataaccccaagaggactgctgtcccatttattaaaaactccatttaatttcatagtgtatcagtgtgacttcagtaaaaggaggatttttttttaaaagaaaagaaccctaaatataaatgacaaataagcattttctttcaaagtagtcaccctgacattctaggtacttcctctacaattatggctctcagtttcttcatctgtaatatggtactgtttgactggattatctcttggagtgctagaattccaagactccaggattccatgctgatgttgctcagtacaaactgacacacaaaagacttaaagttttataagtgacagagatgactctgtttattctgtcaatcatcagaaagtttcacaagtatgatttccattttacagaaaagaaagtaaggcttaaagtacttaagtaaaacttctaacattccaaatcaaacagatggcagagtcagaatgagggcccaggtctttgcctcagtatttaaacatgtattaaatgtgactatttcaaagtttccatctagaatgacccaacatgattactcatctaatacatgccactacttcttaaaatgtactttacccttaaaaaaatcaagatgggtcctgccgatcaattctaaagaagttccagaacagaatggttttcaacatcatcatcattaaaataacatattggcctccaaggtgaatatattagaaaaagaaatattggcaatgggaatattggcatgcttgtgcttttatttaatctcattccgtacatcggcttcatctgtttttttcctggcctggccctcgctattatttgccaacacaggatgatttaaggctgaaaccactcaggactgcaaaccctgaaatgagagccctgtgaattataatcagcagatgtttcccacaaatgagaagagaagcccagtgcttgcattctctttagttgttaacagacttctgttttctttctgaaggctaagtaaataaatatatgtccagaaatggggacagaagataccactcttgtacaacgtattttaatatacagcaagagttgctttgcttttttctgagacatcagtatgaggagactatgaggtttaatgaaatctgcatggcaagtgcagtagcttgaaaagagcttagaaaggaattaacacgtaaattatgttggacctgaaaggattggagattcagtatttgagaggagaaagtaaggaaggattagactttaagaaaaaaaaagaacccattacttttttaacaatatatgtaaagatggaaattgttttctctaacagcacaggagcatatgatgtactcgctcattaaagcaaacgcacaaactgaaaatcgaggaagacacaaacacaggaagacaaaggggagaaggcagcgcaacccgaagaatcagttccatgccctgttaggaaaagctgcccctgtgagcttcagagataatgagttgtaattctactcagcgcaaagaggaggactgcttaaatcacagcaagaaagaatccaattacgtatacagtagaactttatcacaactgtactgaaatgacaggaaggaagggttattcatcacagaccgtggccctgtctggctcctctctgtgttgccggctccaagcagagactggccacagccaaggctcggcaaaggtttctttttggttgtctgttcccagttggacgagatgaaaacaaacaaaaaaaaatcctgtttactgattcacaggccagtgttttatcaattggatgagcatttttcagaaggcaggttggggctttgtgttcaggattttagaggcatggcagttgaattaattaaagcactcattcatttgaattaaagatccattcagcatttcctgggcacgtatgactgccaggatctggagttacagaggtaacagtagtaagttccccacttgagtttgaggagaggataaaggatgggaaccaaactcagcaaaagagtcgggacacatgagctgaggctcagaggacacagagagagtccaggaagggaattgctgggagagagcctggtaggcctggggaattccaaacaatttttcatggctctttcatggtgtgcatctggcagtgtggccacaatgtctggagagactgcaggaattagatcagatcagagagaccctgctgttcaagctagtgaatttcaactttgctctccctggaactcagagtcagagatgcaccctgccaggccagggctccggtgcctgggccgcccttcctcacttcttctctctttgtctgctgcccgctagccatgccttgctccttttctgccctttctagtcaatgcctcagttaagagtctcatatttgagatgagaactagatttcatttgaaagaaaggcagttgaggcctcttgccaggcaaggctgggcatactaactaggttaggtgtgggcagggaggagggacagagagaagttgtcagtactaggaacaagtctggtctggaaggaagaacatagcgttttaagaaaataataagagaaagaggcagtaatcaggctaaatggctgcattacaggtgtagtcctgggctgagggtgtcctgacaaagtggctgaacacagagattattagcgcagataaaacacaggtccaggtggggcagctgcccagaggactctgtctacaggtcacagggcctgcaccccctggtccagggttcagacccagcccaggggaaataaagtttgcaggaacatcatggagtcataagttgagaaatactaggccaattggcaggttacctaagccaggattcaggcaggagaagcaagacaggattcagacaacaaaatagaagcctggggtttggggaaggagatagacccctcagttatcagatacggagcacaggtcacagcctgaccagcataaagcctgcttggatgctgagtcttagaatgcagggctccagagcccccttcctcccgcctgacgccagatggaccctcaagtccagggacagagtaagtgtgtggggccaggtcccaggacttgtgcagggcacagagacaggctggaagggctctaacaaacatgcaattgtgctgcttctttttccagaattactgggttaaaattactgacctatcatcactctgcagagaagccacgtgatacctgaagacattctgtttaccagaagtttccagtggagaaactttttcagaagtctcctattgcaattgacaagtcttgttgttctataatgtcattgaatttgtaaactattaaagtaatgctctttttcattccatgttttcttttttcaagcattcttaaaaaactgttttgtgaacagcagaggaaaagtgaacattttaaaaaaggtgatcttaaagtcaagggatctggcacagctggatgacctaaggctgaccagctttttttttttgacatgagtgttgcactgtcatccaggctggagtacaatggcacaatctcagctcactgcaagctccgcctcctgggttcatgccattctcctgcctcagcctcctgagtagctgggactacaggcgcccgccaccatgcctggctaattttttttgtatttttagtagagacggggtttcaccgtgttagccaggatggtctcgatctcctgacctcgtgatctgcctgccttggcctcccaaagtgctgggattacaggcataagccactgcacctggccagctgactggctttttaacctctctgggcttcagtgtcttcaccaggggaaggagaacatgaatactagatagacatactggtcttcatggtcatccaagaagaacacctgggtgaaggcagtatatcaaagtgtggagacctcaagtctgcagtcatgcactggctgtatgactttgggaaatttaactaatcattctaagcctcatttataatatctgtaaaatgaagagaataatatttaccttttaatgttcttgtgaggattaaatgggattaataaaacaaaaccaaagtgttcagcataatgtccagcacatggtaaatactcaataaatggtagcaattacatacagcattaataaacattaatattatatagaatatttacataaccttatataaatatgttagtaacatagcagacacacaatcataatgatgattacaaagtctttcatttgacaaacatatgagtgcctactaggtgttgagtgttttgctaggtactctgcattcaaagacattgcaatgttcttccttcacagatgtggaaatctagtgactgaaacaacttagcagaaaataccaatacagtaatgacacttattttgagacatttaaataaaaggtgctatgaaaacactgaaaaggggacatctaaacccgtctggcatagggtttgtaagagttgacttgtgtccccccaaaagatatgttaattattattatacttttaacataagtcctaatcccccatacctatgaatgtgactttatttagaaatactgtgtttgcagatgtaatcaagataagattaggtcatactggattagggtaggcatgatctaatatgactgctgtccttataagatgaggagaaaagacacagacacacagggagaatgcaatatgatgactggagagatgcacctgcaagtcaaggatcacccaggatagccggcaaacaccagaagctaagagaaagacatgaaactgattcttccctggatccttcagtgagaacaaggccctgccaacagcttaatttcagacttttggcccccagaactgcaagacaatatgtttctgttattttaattcacccagtgtgtggtactttgatacagcagccctacctagaaaacaaatggggttgagggtggggggtggggtgggtgccaggggagtgtcagggaaggaatcctggagggggtgacagctgaccaggttcttgaaaaggatgacatctgtatatgcaatgggcatgtaaaaaggtatccccaaaatacacttattgggatcctaaatacaaagatatttctaaatgttctcttaggagaaatgttcaaaaccagtctcctggaagcagaatagctcttaggttttccctttgtgaaataaacaaactctgaagatggttacatatttgttaagaacaaattaaccacacagattatgttaacataacagaatactttacaaggtgagtgaatgcctacaaaccagatctttaagaaagtgaaactgaaaatgcttttgtaatctttccaaagagtttcaaaggcagtgaggtatgtttttcatttaaacctaagatgtgtatccagagtgagttcctggtgcctgccgtgcacactttataaacaaagacttcattccatcaataaaaccctctgtctcctttgaccaggatgcaacgctggcagaactgaggaatgcagctgtcaacagctattctaagtattgttgacttgggtgaggagatttgtgtccatgtttgaaaatatgacatgacacgaagcaaagagaatttcaaaactcctgaccaaagctggtacagagaaaaactgactgctcaaagaactccatcagatctttccagcaatctgtgcatggagcgtgcacttgaaaagcaagtgtgttttgagtgagcaggaggtaagcgctcatcacaggttctgtaaaattcactcacactgtgggccaggaactcaagggcagagcggtttctgtgcagaggactgggctgacacagtcagagcaagctgctccatgttttctggacctgctgaaacacactcttaagacacagtgggcctcacagctgagccatgaaaaccatgctggcatatgacaaccaggtgtggaggggttcattttgacaagcaggcaatggacactggccctaaccaaagattaggaaatttcaaagcagaaagcaacctgggcattacctagtcctaccatcttgatttagagatgagaaagtggatgcccagagaagtgaagtgatttgcccaaagttacacagctagttaagaggagagctggaattagaatcaagagtcctgctgcatcttcactgtgcacctgagttctctgtctctccagcatgccttcctttggatgcctctagtgacactgcactcactagctcctgacattgcccattcttttttttttaacagttttcaaagtgagaaatttatccctaatatgttgacttcggacttgataacctgtagttaaatccattgtctttattcagtactcctgggttcctgtaacaagtctgattctctttcccactgttcctggtcaaatccataaagaaagcacacaacaatacctgaaccttctcccagtcagcctcagcaccctcttccttcagtccttccatgaactaaaatccaccttttctgacatctaaaaattctaaaaacccaccttttctgaggtccagggttatccacagaaagagaccaggaagaagctgatcaacctattaatggtggtctctatctttcttagttctgaacttgtatgtataaattttagtaagttgttacgttacgattaaaaagtaatggtcatgtttactccttgctttgtgacaggcctgtgctgaaagcttcatgtcatctcatgtcatctttttggcagtcccatcacaaagttgacaaatgctaagtgacctcattctactaaaacacacacgtcttgtctgtctgcagaaggatactctcatgcaactttgaagttgacattttgaaactaaatgaaatttgcattttccgttcagttttccaaaatctgtcttcttagttctcctcctgtcttgaatttctcctcccttgtcctcaatagctataatggctagacaaccctctcttaaagttcctgttccttctaattcaccagcaaatttcttcttgcaggacagattcagccacagagggcaaggagatcctcctgttgccacatttggaaggtgaaccattagctgccttcctggcagatgcctactgggggtctggagcttggaggtgacacatggagcatgtcctcctccacttcctccctctgtccaggtagttgttgttttgctctcaccacagcattatttctgttctttcccctctctaccttcaccccttggtgtgcaccaggttccctgcaccctcaggtttgtgaactgtagcacgtgcttacagaaatatcttcttgggccgggcgcggtggctcatgcctgtaatcccagcactttgggaggctgaggcaggtggatcacgaagtccagagatcgagaccaacctggctaacacggtgaaaccccatctctgctaaaagtacaaaaaattagctgggagtggtggcgggcacctgtagtcccagctactcgggaggctgaggcaggagaatggcatgaacctgggaggcggagcttgtagtgagccgagatcgcgccactgcagtccagcctgggcaacacagcgagactccatctcaagaaaaaaaaaaaatcttcttaagcaaatcttcttagactccctccccaacactgatttcttctgaatcctctgttgtaaatttccagttttacgggccattgccaggtctcagggatgtacacagggttaccgtcaattccttaggctggaagctcatgtgtactaagttattttccctgctccctctcactcatttctccatcttgtctgaatgtactccacagcaaactgcttacaggattctgggcatctggcctactctactcctgttagacacttttgggttaagtaactttagggcttggttgtttcttttaatggcaccactcctctcagtcctggtttaaaacctctataggtaaccacatctagtgacctgccaaaccctttcagatggagccactttagaaaggatttctatatcattgtcttttttgttcccattgctaatttaggtcctcattcgctctcatctggagtactgcaaaggactctttttgtccccacaaactgtagcttctatatcccccctgtccccaccccctcctgcccttcctccctccgcctcctccctgcatgcccttctcacacccctggaactgggatcagccagcgatgcacacgggggaaccatgagaacaggccctaattggggcctctaaattacttctttcagacttcttttcacatccctatctcattagccgatgattaattttctttctgtacgatgttatgtgactttgtacagcaggactgttatataatgatagggagggagaaaaggactgaattggctcttggtgttctctgctttgtcctagctgacaagcttatggtgcgggagcagacagtaggggcaaaaaattattaaatattgagaaatatttttgaacattcagtcaagcccctaagaagtcgctaatttttatacatctacttctatctttctgaggagtggggacactccaaatatatgttgaaagactaaataaattataatttctttctggcattcaatgcctccttgctctatagaacttcctctttatttgaagtcaggtaatagcctggtgacaccatatagatataaagcccactatagtcagtatttataacagcagagatggtaattcacagcatgtaaatgtctttataggaaacttccctttgaaacctgcatctttctgaggcaatatgcaagtgttaaccttttgattttatttatcaaccttcatttctgtttacaaaggcatgtgagagataggtaacgtctcataaattttaaaaagaacaaagaaaaacattcaatatttagtttcaaagaaaacattcacatcatattaaacaatttatgtaggtttcaatttaaacttactgcttgaagggactgaaacaacacagaactggtctgtttaaataatatcagtatatagctgtagactgggagagacaaaaatagagcctgttttaaaggtaaacacatcatgaatattcctaaagagaactgcaaattgtgtgtggtctgtaaatcatagactgatctaatattaatttaatttttctactagactgtgtgggcaaggagaacgggtaacataactatcacttatctcagggtccaacatggctcttggcatatagtatcctcttcaacaagtatcagttaaatgaaagaaagaaattataaaatttacagaatttacagagttcatcctaaagagacaagacaaagtagtatttggttgttgagtccacaatgtcacaacataaattcatatatgattctaagcaaatgacatgtggtattctttctatttgtcttattaagtgaatagtaagagccatgagggttcttgttagttattcctttattatagttggaaaattatggtgatgatgacttacatttcacagataatgaggctaagaggcacaaggaatgaaggtgtgttcacagaataaatggacagaattggtctttgaatgcttgttaatatggcatctggaaggcagacctcatgcttcccttcctttctagctacaagaaaccagacctgaaatcaaaggataacacagaggggcagtagggtaagtatggtctcatctaaatccacacaaggtcatctcataccacttagcttgggagtgcttgaaaaattcaggacaggaacagggacaggagaggacatcataatcccatgcctcaggggaatactacaacctaacaggaacataactgaaaggcaagctaaccaaaacaagtttacaaaagaggcaaaaataaaatttcactcatctgctattaaaattttaaataggaagcataaaccatatgaaataaactcaatcttcacttctatattatggtgaattagtgaattaagggaaaaaggaaatacaggaactgtagattctgagtagagattagaaataaaaggaagaaataaagttgaagatgaaaagaaaggaagtaagtcagagggagagacagcagcagacagatggagggaccgtccgagttctagttcaagggtagactaacagaaactgtgcctcggttcttcatctgcaaaaaaaaaaggactaaaaagagtatttaccctgacagcattgttctgaggattagtgttacgaattaaaatatgtacaaggcttcaaagactacctggtacagagtaagcactcaacacatattactatcactttgataaacattatatcatttgtgtgtgtgagtgtatgcatgtgtatattagagtgtacatgtgctacaagactgctttcatgtccttcctttaaaaaaaaaaagcatatcctacttctcggtggctttttaagttcatgttttattatctgtcctaacttctttgggtggaaaccagaaggccttctaggaaaacaactgaggagacagtgccatacagtttctctacaaaagaaacttctccaagggaaatcagaaacctcctctttcttctcccccaggacctaagatatttttcatgcctggaaatgagagttgcagcattgggacctgtttcctctctgctttttctgccaggaagattaggtgttgtacccgacacaccaactgcacttgttcctatgtttggcatacccactttccccttaaactgagttttccctttgtaattctattttattcatccaaatgattatgtctattttgagcttttttacccacacacatacacatacacacacgtgtgcataaacacacacacacgtgtctttttaataaattaaaactgagcagcaccagacttttaaaaatacttcattacatccgaggccctggccagatttacttatttacatgttgttttgcattttaatttagaaagcaccaatgccaacccatactcccccatagcttgtcatttctgacaacatcctgagtaattccaggggcgaatttttcagagggaataatttaactaacaaattgccatttaaaactaatttatccttttgagctgagtgcaatatacttggaggagcattccttaatgacttgtttggataatgtttttctccacagtgttgatccctcaacattagaaactcagagagttaattcctcacatgaaaaacataccccaaacttttcttctggaaaggtcaagatcaaaagcagagactatcccccagatttttcattttctcccttcccttcccctcccttgccttcccttcccttctctcccctcccttcccctcccttcccctcctttcctttcctttctttcgcagagactatcccccagatttttcattttctttccttccttcctccctccctccctttctttccttccttccttccttcttaatctttcttttatcttttcttttctttttttttttttggaaacagggtctcattctgtcacccaggctggagtgcagcagctccatcacagctcattgcagcctcaacctcctgggctggagtgattttcctgcctcagcctcccaaatagctgggactacaggtgtgtgccaccacacctggctaatctgtatattttttgtagagatggggtttcaccatgttgcccaggttggtctcaaactcctgggctcaagtgatcctcccgcctcagcctcccaaatgttgggattacaggcatgagccactgtgcccagaaaggatttttcattttcaattaagtattttctgcccagttataacttcaaagaacgttaggtacttcattcaggggtctatatttcattcttattcacagaagcatctagttttgaattgttactatgcttttatgcagtgctatgttttcaaaatccttttttagtcatttaaaaagctggtcctcattatatctccaccagattcttcctcctccacagatgaaaaaggaagttgaggtttggcagactgaagacatctgcccacagtgtcactggaatcacagggaaataggctgtggtttacactatcctgctggggatgaaaatctacttgtttgtagtctccagggtggtaaagagcagagggggaaaagcaggatgcacagtattcagggtttagctgaatgtcaagttcagcttcctcatctcagatgtgaggctgcaacctgcctatttacttcacgttgttattatgagtgccaaactgtatgatggacgtttatgtgccagcaatttacaaacaagcaatcaatacacaaatgtaaattatagtcagcattttttcctattttggtggcttctgagactctacaatggtgctaagtgcccaccttgtccagaaagagaattcaatatattcagtgtattactgtgttttaacaagtatacagaagtgtgacaggtgagagggacagagggagaaaaagaacggggcggggggtgagtgagagagagagagatagtgtctatgtatgtgtctatcctcgatgcttgcaatccatggttctcagcagaactatgccattctccatgttagggtcagccagtttttatagttggaaaaactgagaagcagagtggcatactgccctaggtccttctgagatatttgctcattcaacatgtattaattacgtacaagtttgctaggcaagacgctgggggcatagaggtaagtcaggatccctggccctaaggtgcccccagtccgtggtgatgcagatacctgggcacatagctgtgttagaaagtggcagtgttattagcaaggcacacaaagtacctatatcatcatcctgaaaaaagcctgaccatactctgaatagtatgtggacttcctcagtgaaagtatctatctagctaagccactgtatccccaaagccaagcacagagcattttgtaaatacatacccaggtcagagagtggctaccccatgggccccagccacactttcaatagcagtcatttttcctgcatttatcaaaagacattttggaggcagaggattgtttggtgttgtattatttatctttatctatattattatttacctttctcctcttcctaacacaggaacattccagatcggtaggcctcttgcaagctgagtctataccaaaagtgcacacgttgtggaagactgaggttataaaggataaatctgtcacagagacagagtacaagggctggctaatctatatttgcttgttgtaactgaacagggaatttacatttgccagaatagcagaaaagaaatattagcttggacattcatgcccttattcaattatttttttttactataaccaaaacagatcttcatgttttttcaaatacatttggtcagtcagtcaaaagaatttgaaaagcatatcacaagtatttaacttccttctatcagagagtgatgggacagagacatgagggaagtgaatcatttcagcataaagcttttgttaaacagagctaagttaaactgaactaaaatagaataaattggatgtatgaagtgtgtattatgggaacttatcctgagacctcttctgttcagtgtcttttcttgatgtcttgaacaaagattgctataatacactcactaaatactcaccatcatcaagttacttgtgttgaaggcatgtcaggtgctaagaacacagaaaggttgaagacaagtgtttaggcttcacgcttcaagagggacaggaactttcagagtaaattaaagtgacaaaaaagtactttaagttattgaaaaccttgctaaaatgaaattaaagagctgaaactctacccagagttatatgactgacacagtcacagcagattataacagaaagtcatacatgtaagaggtaaatcctaattccacaggataatgtcagagaaatcaggtcctatgaagcatccctcacactgttccccttggccaccatctgtcaagaagtggtaccaggccagctcttgttattaccataagaagcagagagatatgagttgggaggatccaggtcagatggactcctaccaacctcttccaattgaaatccgggcacttctaccctggcctcacccctccacaccttgcttggctggcctgccttgcactggcctcacctgtgaccatgcactccagctacctcttggacagactttataccagcctgaccagaaggttttcttagctatgatgttcactgcccaatttttccttttgtccctgctatagtctgtattataaatttcatggttagaaatttaatgttgccaagcattaagaggtgaggcttttcaaaggtgactaggctatgagggaggttatgccctcatgaagggattaatgcttttaccatgggagtggattagttattgtaggattgggttagttattgtgagagcgggctcctgataaaaagataaggtcagtccccactctctctctgtctcacatgcttacttgcttttctgctttctaccatggaatgatgcaacaagaaggccctcaccagatggctgagcagatgctggcaccatgcccttggacttcccaatctctagaaccatgagccaaataaatctcttttctttataaattacccagtctgtggtactctgttatagcagcataaatgaactaagatactccccacctcacatttgtgattgttttggatcgttttcccacgaacaaaactcctagatatgatccttttttttcttgagtgaattaccctctgagtaaaaatctagcctttgggactccagatgaattgtggaagaaggtatgggaaaaggtagagtaattattttaaccaagtattataggcgccaggcaaggtgctaggcatttttgcataccttatttaattttatcttcagtacaacaaagcaagggaagttaagatatggagaaagtcaagtgtcagctagaagcagaagagtaggaactcacactcaggtcagttctattgcaaagctttttttgtctcaccagagctgtcaatgataaaaccctaaattggatggattatagggtctggccagaacacaggacaagatggatctttagctggtaaacaccagtatggccatatcactgttttaggccagcatctgttctgcttggtcagtgcccaagacctatcatttgttaaatatttaggcatcattgttgcccatctcaaaatgaaatgtttgccaaataccaaatgtttgacttttactctggcaaggagagagtaacagtgactggatatggtctcccacctgaaacaactaaaaagccagataaagtatatgaaacatggttttcagatactgggcatgaggtaatgcaagacaatgattcatgaaagaagtaaaacaaagtgagccatatgattgccccagcttattgccaggagagtttccgggctacagcacagggaagaggaactctggaaaagtctgacagtctctctgagtaaagaaatagttggtagtttaggatggcagcttagagttcatagggtaaagtaccagagagaagagaatagcacacatgtgtgcacacaaacacatctctccctggagatataaagcaagtcttgagttgagaactaatcagtgtatgtgtgtgataaaactacactaagctaaagaaagaaacacccaaaaggtttagaaggaataatccataaagattacaaaagactattctcatcagttagagtagaaaagcctcataattcatgatgttattgggtagaatactcagaatggtatcacctttgtagtaggacaaaactagccctagacaaaaagctgctgtgatctctcataacaaaacttaaaagcaagcctcaaaaggttcaactgcttcccagtaacttaaatgggtcctaaaataaacttcacggatatgagaatacaaaaatacccagcacctagcaaggtaaaattcacaatgtctggtaaccaattaaaaattaccaggtatgacaggataattccaaaacctctgaatatattattttacatgtcaaaggaattaaggatacagatgacattaagattgctaatcagctaactttatgacagattattctggattattgatgggggcacaatataatcacaagagtcctaaaaaggggaagagggaggcagaagagaaggttggagtaatttgatgtatgaagaattcaaccctccattaccagttttgaagatggaagacagcaatgagccaaaaaacataggcaacatctagaggatggaaaaggcaaaaaaacagattctcctctggagcctccagaaagaaatgcagccccgatgacatattgattttagcccagtgagatttgcatgagatttccaaccacagtactacaagataataaatttgtgttgtttttaagccactaagtttgtggctacctgttatagcaatagtaaaaaatgaataaaaagagaaattacataccaggcatacaaagaagcaggaaaatgtgaccaataataatgagaaaaataaaacagtagaacaaaaaaataaataacacatagatgacagaattcgtagacaaaaatattaaatattcataactgtgttccatgtgttcaagaaggcagaagggagatttaacatattaaatagagagatggaagattaaaaacagactcagaatgtacttgtagggatgagaagtacaatgtatgagataaaaaatatactgtatgaaattaacagcagatttgatgatttatttaaaaagttagtaaactcaaagaaaagcaatagaaactattcaaatgaaacgtggagaaaaaagacaacaacaaaatgaacagaacataaaagggctgtgggacaactgcaaggagtctaagatatttgtaattaaattacttgatgagggtggggcaagaacaaatatttgaacaaataatggctgaagattatccaaatttgatagaaactataagctcacagatctaagaaactcgagaatagaaggcacaagaaacatgataaaagtatatgagggaacatcataatgaagttacttaaaatcaatgataaagacaaactcttaagagcatccaggaaaaaaagacatattacatacagaggaactaagataaaaataagagtatatttcttgttggaaacaatgtaagccagaagacactagaatagcacctttaaagaactgaaattaaaaaaaaatcttttctttaactttttctttacccagtaaaaatacctttcaaaatgaaagtgacagaaaaactttttctgacataataagctgaaacaatccatcaccagcagatctatactataagaaatattaaaaaggaattcctctaggcagagaaaaatgatgagctgtaaatcttgatctacacaatggaataaagaatatcggaaatggcaaatatatggttgaatagaaaaaaaaaatttttacttatttttgaactctttaaaaaataattgcctgaaaagagcaaaaatactcacaatgtattctgggtttatgatatatatagaagtaaaatataagacagcaaacataatacaaaagtatatagttcttacaatatatatgaagagataagccaacaaaggagataaaattgaaatcataaagatactaagtccaaaaggtggcagacaaatagaaaattggaataaaaaacagaataaataaaatcaattattaagattgattttaacccaatcacactgataatcatattaaatataaacagtctaaataaatatccaaaggcagagatcaatccaatatatcagattggatataaaaactatatgctacttataagaaactcacttttaatacgaagtcataaataagttaaaaataaaaggactgaaaaaaatacaccatgctaacattaatgaaaagaaagctggaaagggggcatgctaatattaggaaaagtgaatttcagataaaaaatataattatggataaatgagtcatttcataatgataaagaggtcaatttaacaagaaaatataacaatcccaaatatttattcactgaataacagaacttcaacatatatgaaataaaaactaataaaatggaaagctgaagtagatgaatccacaattaacagtcagaaatttcaacaaccctctcttaataattgctagaacaagtacatagaaaatcagtaaggatataaaaatctaaataatatcaaccaatttgacctaactgacatctatggagtacttcacccaacaaaaccagaaaacacattcttctcaagattacatgggtatatttatcaagattggccatattctgggcataaaccaaaccttaataaaattacaaaaacacaaatcatataaagtgtattctgagaccacaatagtattaaattataaaatagtgatgaaaaatatctagagagtcaccaaataattagaaaataaataacacatttctgaatagcctgtaggtcaaacaagaaaccaaaagggaaatttagaagtactgtgaattaaaataaaatttcatgatatgcagctaaaacagtactttaaaaatgtttaaggcactaaatgcttatattagaaaagaagaaaggtcttacatcaatgaccatggcttctatcttataaaaaaaaaaaaccttaaaaaaaaaagagcaaattgagcctgaaataagcagaaaaaaaaattaagaacaggaattagtgacatagaaaaactatagagaaaatcaatgaaaccaaatgctagttctttgtgaagatcaatgaaattgataaaactccagccagccttaggcaggaaagcagagaagatacaaactgctaatattagacataaggaatgtaacataactacagttcccatacataaatatcaaggcatattacaaaaattgtatgtcaataaatttaacaacttggaatagatttcttgaaaaacacaaattaccaaagctcattgaaagaaaaacaaataatctatatagctctgtatctattaaagaagtagactttgtagttacaattattcccacaaggaaacttcatgcctagatgactttgctagagaatcctactctagtagaggttaaatcttaaggaaaaaataatactaattctacacaaactcttccagaaaattaaagggtataccttccaatttgctttatgattccagcattacttttgttacttaaatcagataaaaacattagaagaaagaaaaactatagacaatattcagcatgaactttgatgcaaattctaaacaaaattttagcaaattgaatatagtataatgaataatacatcatgactgagtagtttatcccagagatacaaggttggtttaacattaaaaagtaattcacgtaatttaccaaagtagtagactaaaaaagagaaacacacacacacgatcatctcaatagatgcagaaaaagcgtctgatgaaaatctgacatccattctctcagtaaactaaaaatcaaaggaaatttcctcagtaaaggttatgtactttaaaactacacatatgatcatacttaaaatggtatttcttcataaggtcagaaacaaggcaaggatatccactctatttctattcagccatcaggatatatgacaacatgcgtgactttcagaataactatattgagtgaaagaaaccagaaactgagtacattctataggtttcatttacataaaattctggaaaatgcaaaataatttgtagagacagaagatcagtggttgtctcaggatggggatgagtaagaaagggggtctgagtaggtaggaggaagagataacaaagggaacaggaaatgttttggtgtggctgatatgtccattattttgattgtgatgatttcacaagtatatacatatgtcaaaacttatgaaattgtagaatttaaatatgtacaatttattgtatgtcaattcattaaagctataaaatataacagatactttaggtcataggtaaaaacgaaaacactgccacagtgaaccaagctatatccagccaaggtcttggtttcaactagggaatgcatgataggagggcatggttgtcctccctggcagcaacttaaaagcatcagatatgcatatataaagctttttagtttcctaacaagagatacttaatagatctcaaattaaacaaacacagccagttatatgccaattctatagttttagaagtcagcaagcagcatattggggattatggatgaactgaacaaaatctagcataaaacatggtaccagacctcaaagggttttgaagactgtcgatgatttggtagagtgatgctaattctcactctcaacacaatccaagcgaggaaatttctccaaaataagataaaaacttgcagggttttaggtgtcattgtatatctgaatttactccacagaaattcttctcccaacttgttaaatttcaagacttctccttggagccatgagcagaataagaaaaacacagatggctcaacttcacggtaataatgattcaaggcaagcaaaccttcagctgtttatatttcagattaaaatagaattgaggagagaaacatcattctgggtgctaaaatgaatattaagataaagctagtgtaagtattattaatattgcactattattattttgggtttgcaatccataggaaatccatgtatgcttctgtttgcttcccttacaactggtattttaaataaattctgcatgctcaataaatagggtctatttactcaaaggcgacagaccccatggtactctccacaaagacttccctcatggcctcctgctgctgttgtttatagggctgcaattacagaaaggattctcagcagaacgagcaatgacaccattaccatcaacaggaattctcctggcactgtggagattctttattgaaagaaatacaaagccagtatgttgctagtagaatgcatgaatttgttgggcaatggctttctccttctggacaccaccctgcaggttaatgactctcaattctgagcatccttcttctctccttccagcaggtgttttcacacctttctaagttaagtgtcccagaatgtaaaggctgccactacagggaggcagcaggacacaatgcatgagactgatcggcagtgaagccggactgcctgtgttcacatcccggctgcaccactcactaacagtgtgacttcaaacagattacttagcttctctgtgccctggtgtgcttattcctaaaaatgaagtaataacagcactgatttcactgggtgaggattagataaggactgagatgcttagaaaaatgcctggcacatacacaataaatgcaagcaattattattattaacacagctttgttgacacaataacatttgtagagaatgaatgacagcagctactctaagctgcctccttatggcaagcacagtaggaacaagaaatagaaatacttcctctaacaatgcagcaaaatcttctgggagagagaaccatacaagaccagcctattaaataacaataattatattaataccacccattactgagtaccttctacacactgcagtgtgtaaaatgcatctatatattatcttattcattcccataaccccatgaattagatgatataacttccattttccagataacaaaactgggactcagagaaattaaataatttccctcagttcacgtggctgagacaaacatttctgaatagaactacctggctcttagccaggtttttccgctatgccatgcaccttttcaacccaaaaggtagtggtgtgttctgagcaaaggcattcaggagaaaacaaacctgtcaggaggcagagtttccaacagcacactgtctttgaaactattaaaagaatagtcttaagtgctgctgggtgaaacaattaaaaggatagtcttaagtactgctgggtgaaacttgtcacacctgaacacagagatagcaatcctcattgctgggtcatctctcagtggcaggataatatacttgaaaggatgatcagttgtttcctggttttttccttggcccctactaggtaccctgattcaaacaaggctgttcattggttagtttctcagagaaggatattgtgtagaaagctcagggaaaaaaaagtgtgtggtatgttggcatcatggcactactggaactggaaggactgtggcactgggatctagtggtgggtgccccgctttctggatggcagggaaaggttctctgatgcttaaatgagtccttttttctgtacatttgggatatttcataattaaaaattaaaaagtaattatctataagcaggagaaaattttatcttataatatcaataaataactcttagaatactctcaagattaattttgagaggaaacttataatcattaacttttatattgagcaacaattctataaaaacacaacagcctaaatcaattcaaaccttaaagtaaaaatgtttgcaacatatatgacctattttgtaaaggggcagaatccacaacaaagaaccctagtaaatcaacaagaaaaaaaaatgtttcaacagataataagtaaaaaacaaaagggaaatttaaaagagaagaaatagatatggtaaattaagatttggaaaagttcaaataaaaacaagatatttttcacacattagcaaacatttaaagaaacaataatagtagttttggtgagaatttgagggctgggctaacaatatgtgtagctagcattcaaaaggtatttatttacatgagaaaattttgccattttttcttcactggtaagaaaaaatgataaacaaccatatatttggaatgatatcaactttttaggattaaacacattcgtttatacatttgtagaaaaagaaattggaaggaaatacatcaagacacatgtagtggttatttctgcatcttcaaatgacaatttttgctcatttatacctttgtgtattcaaatttttataataaaattacattattaaaactttccttggggccgggcaccgtggcccatacctgtaatcccagcactttgggaggccgaggcaggcagatcacttgaggtcaggagtttgagacgagcctggccaacatggtgaaaccccatctctactaaaaatacaaaaattagctgagtgtgggagccggtgcctgtaatcccagctactctggagcctgaggcaggagaatcaattgagccttggagatggaggatgcagtgagctgagactgttccactgcattccagcctgggcgacagaacaagattctgtctcaaaaacaaaacaaacaaacaaaactttccttggtacattctaggttctttaaacaacaacaacaaaaactctttgatggcaaatggaagagacaggattcatgttacacatccctctgtgtccttacagggatgtgctgaggatgtatgaaatttctttgtaataatgtcgttgttttcccaagagcattatttaaggagaatggacaggtctatgggaaaatttaactttgtatagaatgatttttaggtctaaaaagtctagttcagcctgggaacactcttctatgataaaggaatgaaaacaacacaaatcacaatatcatattaaggtgattttcctaaggaaataatgtgtttgacagctgctccccattcagtgtatctgtaagtgaagagagtcaattgaaactaatgttcaccaaagaccacttttagccacccattgttgacttggatgtaaaatggtaagcattgtgtttgaacgattaaaaaatcagaaataaaattactttttgatattagaatctaaatggtccaagaatatgattgtcttggggattctttttgagaaattaattttgacacttcactcactttataaatagaaatttctccttggttgttttcttaacatgtttagaattgatgctaacacactttagtttattcattgcagccaacttttgacaacaagctttcaaattctggagtttaaatatcaaaacttgacgtggtaacattatagaaaaaagctagtggaacacctttaaaaaaatggaatgttgaaaaacaactccaatgaatttagaaatggcagaggaaaattatatgagaagatttagagtcctctaaagcaaatgatttattgaaatattttttcccccagcaagtattaataagtaccttccatatgccaggcattgttttaggaactggagacgcaactttgaacaggacagacttgcttcttactttctggaagcttacctcccagtgaggattgatagacataatcaaaaggtaaagaaagaagttactttcagattgtgctaagtgccatttacagggatgtaggagagttacctggggtgagagaggagggaggaagccgtttgattggttaagatggtctgtctggaaaagaacttttgagttcagttcctaaaaacaaggagctggcctgtggtgggaagatatggaggacgagattataggcagagggaagagagggagcaaaggcctgaaggcaagagcaaacctagcatgtttcagaagtaaaaggaggccagtgtggacagagcctggtgggtaaggggtacagtgacagatatgagattcaacaggggattcccaagggcctcctcatccccactactcaactggataactactgtcttttatgcctattgactttctgcttgaacagtcatttaaaagtgttgaaaggtgaaaaagaaaggtttaaaaatctctgtagttttaattttattctgattgctagaggagatatataaacatacacatgcacacacacacatatataaacatatatacacatatatgcataaacatataaatatgtaaatgcacacatatatacatatgtaaatacatatatatacatatataaacatttatagatacatatgcaaaaacatagacagacatatacataactggtgttttcgaacatttgacaaggattcatactagagaatcagtggcatagaaattgcagtataggaggtaaaattggatattaatgtttggaagtacttcagactgctcaggaaaagttaaccataggtgggtggaagcttttccccagctggagaagctcagtatgtcaatgaaaccggaggttactaataaaaacacatgaatgacatgaacaggtctattctgaaaatagcagagttggaaaatgctaacgttagagacagagtcagtaacaacaatgaagcctgccagattggtgtcacttaagagacatgatctaaatagaaagaaactcaacccattgcatgaggatgcttaagttattttgtttgaagagaaatttatcttgctcagtggaataagccagaagactaaacaggaaaagaccattagggaaagatacccaacgagcaaatcagaacaatatgaaaaaagtaatatcttaaagccacctatattaataaatttggtttgcctgttcagagttctaaaaatgacttgtgaggggagagtacagtgtttctttgtactccattactctttggggtaaaacctgtttgacaactcagttcaacatgactgacagtattaatcatgcacctatatgtggctagcactgcactaggaagtgtctctgctcataaacagtgaaacctactaaagagaaaaggcatgatgttaacaccacctgggatgtggagtgtatccatttcacaaaatcctatcagcagagcaaataatgggaacaaattgactacaggccagggtcaaatcctaaggtaaaagcagtaactgccctcgggtgggtaggagagagcatctctgaaattggccagagctaccagggaaggctattagaatgaagtgggacttgaggctgcccttggaggagctggtaaaattttgataggtggagaggcagaggaaggtgtctctgaatcattaacagctgaacaagagctgttcaatcttatccaactgtgagtctggaaacactgcctaattattaactagcaggtgaaaagaacagaaaaaaaaccactggtgccactgccaggcttccatctggctgtggtatcatcaggaggcccttaaagttatagttcttgggcaataagaaggcagcatcttttactaaattaacaaaattaacttactaaataacaaaagtaattttaattacacccagatttagcagggaaactaaatagcaaacattcaagtaagtgtctctgttgataagcatataactagaaacactcttttggaagtaattttgtgatgtctcaacagtaactaaacgaccatgtcatctgttgacctggcaattgaccttaaagaaatagtccaaatgggaaataagaagtcaaagatactaactgcagagttattgatactattgaaaaactggaaacagctcaaagactaccaacagagtagtcaaagtaatggaagcagatgtgtgatatcattcacccatggagttagtaaaagttaaaattattttaaatagcccctgttggtgtgagtgtaaaatgggtttaaattttatacagggcaattttggaaatatcaaaatttaaaatatgcattcctctgaatcagctccagaaacgctgagaagggatcaacagttaaaatacttaatccacgtagagggctttactgactccaaaacatctccttatttccttttttaaaaatgacattatccacaatacatatgatctttgaaagaaaaggaagaaagaaagatagatattattgatagtcccattttctaatgaggaaactgaaggtcaaagaggtaaaggaatttaactttctctagccctaagttcatatgcctgaaaaatcatgatgcaactggttggaatttcacaaggctaaatacagtcatcttgtttaagtgaaaatatctcttgatttagatatagaaccccatttcatggagccaagacagtagggtctacggaaacaatggctgtcctattcttccctggagatgataacactgcttctactacacttgacagagggggagaaggggagaacaaaaaaaattttttggtcttctgacctagcctgtatgaaagaacaaataacttatgtgcaaatataagatacagtgtgagtgctgaaaacgaggtaaggattatgagaggtctattatctacatgtgttgtatatacttggagaacacgtttgaatgggggaggtgcggcattatttcacagcaggagaaataatcattctcatcatttctaaaagccaagcagccttcagtcagtttcacaataatcaattaattagctaaagtaaatatttagaatgagttacggcacaaagatatgaaatcatggcatataaatgagctttagacatgtaaactgactctttaggaggagaaattactcaagagggagaagtggtattgcaccagatggctgtgtctaataataacttcaatggacacatatgatacttgtttaattatttatcaaggagaatgcctgcaaaaatttagtaagtttataaaatttttggcaagtacaagactgtgtcagccaataatgcattttgagtttaaaatgctccctcttggtggcttatgataatacttaatcctagaccaaggattcaccatttttctgtctcagtttcaccatctgtattaagaactgaaaaacctttacccaaatcagggagtttgggactctttaggactttactttttatattatcccctgaatcaaatacttcttcctacttaaaccatttccaaaagtgtactgtcatatcctaattgtcttaattctgtctcattgccatttcccccttaagttgcctcacaatctatctgcctgacttctagacaaataacttcaaagagttgtctatagaaggtttctagttttctttttcatttctcattattctctttcatttctttctccctgcctcccttccctttttcggttttgtttttgcttttcgaaggagggccaatttaaaaacaaaatgaaaaaagcacatccattactatctgaaggcactggctactacgaatcccttttctttgtgcagcccttttggctttttgcaagacctccctatgtaccatctcacccgtttcttatgatattgttcaacctttaacccactgacctgacttctatccccacagctcccccagaacggcccttgtgaaggtcaccaatgaacccggcccccattgcagtcttttaactttgcccctcagaagaaatcaatcatgccggctactacttggctgaatatgtgacttggatcccgtaacgttgcacacttctctttttcttctaattttctgactactcatttcctctcaaccccctttgctggcttatcaccttcttcctaaactataactgctggaagttttcaaagcctactgctgttccctctattctctttatgccatttccctcatgcccatggtgccagtcatgctgatgaacacagatctctctggatgtgattatcactggcccacccatctcttactccagacccatatatccctgtgtctactcaatatcaccacttaagatatcccacaggagctccaacccgggaagtaccaatctgagtgcatgatttctccctctatttgttcctcctgtgtttctcacttcataaacccatttacccagttgcttaagctagaaacttggcattcatcttgattctctctctctcactcccctgtcatctaatccatcacaaaatcctaaggcttctaccacaaaagcttattccaatttgtccttatctctccaacttcactatcatgccccaagtcaaagccctactcacctgggacctggacatgtgtggcctcttaactgattctcttgcttctattcctaccccacttcccaaatccattctcttttaacattaaattcaatcatagaatccctctgtttcagggaatgaataaataaatcaccttcaatcaattaattttagaattaagatcaaaccctttcccaggacctgcagggcctctaacaaccactttgagctcttcacataaccagttccacctcaaccaccaagctggttgtccaggacttctccaagcgagtcaagctccttctgcctctggggtcctcttctatgctcttccttctccactttccagagctggctccttctcatacctcagaatctcagtttaaatttagtctccacaaagacactgttcgtggttacctgaagattcatggtaagttcccccttatggtctattattgcagcattgtattatttcctttatagtaatcattaccatttctaatgatacgttcatcaatcagtttacttgtttactacctgtctccacaatcagaatatgagctccatgacagcaggaataactttaggtattcacaataaaacatggttaataaatatgggagtgaaggagggatactactaaactatgacattaaaactagtatgaggccgggtgcactggctcacgcctgtaatcccagcactttgggagggcgaggcgggtggatcccctgaggtcaggagttcaagaccagcctggccaatgtggtgaaacactgtctctactaaaaatacaaaaaatataaataaaaaaaattagccaggcgcagtggcaggtgcctgtagtcccagctactcaggaggctgaggcaggagaatcatttgaacccaggaggtggaggttgcagtgagccaagatcacgccattgcactccagcctgggcaacaagagctaaactctggagggggaatgtaatattaattcaaacacccattttttttcttgagaataaaattttagtttcaatattttctatatattttggtttcatgtttacaaacacatttaaaatcattaatatgtttttctttaaaagctactgatttccttatgaatttgtttttttcattcaaagtgtaaaatgaatgactctcattagatgtgttttgaagaaatatctttgctgtgttcttttctctgtgttcagccacgagaaattggtgtgaggctgctggagtgggatgggtccctatcctgacaattataagtcagtataaaaaagtctgaggcaaaagcaggcatagctctgtgggcatttctgatattttacgttagtcattagaaataattcatataaaaaaggaagatgaccaataataagagaaaataatgtgaagcattgtattttttaattgctgcttgaagagagttcattttcagccaaaacacaatagtactttgctcctttggctagaagtacaagtgattccaagaaacttaagtattctcagagctacctgctatgggtatttaggcctaagtcctgataaaaggtaatcacaagcttttaagaaaggtattttttaatttcttcttttcaaattggaaagaaagtgggcaaatggtttgtagtgttctaataaaatagattagataaaaggggcaagaaatcacaggctgaagtttttttattcaatacatatttattgaatatcaatgcataacaagaatggttccaggaggcataagaaacacaaagatgaataaaatatagttcttcccattaagaggctcatcattaggcagaacatacagattagatagatggatggatggatggactaacgacaggtgggtggatggatggatggatggatgggtgaaaggacaaatagatacagcataaagagaggatgaatgattaagcatggtcttctagcacaaagaaagttacaagaattatacatgaaacaaggaataattgagactctatgaatgtaaagaaatgaatgtagttcattaatttgatccatatctcagttgccttactgatatggtttggatgtgtgtcccctccaaatctcatgtcgaaatatgatctccagtgttggaggtggggcctggtgggaggtgtttgggtcatgggagttgatccctcatggatagccccttcctgtggtaatgaatgagttctcactgttattcacaggagagttggttgtttaaaagatcttggcaccacctcctctctctcttgttccctctcttgctatgtgggcatacctactgctttctaccatgattgtaagcttcctgagacctcatcacaagcctagaagatgcaggtgctgtgcttgtatagcctgaagaactgagacaaatgaacatcttttctttataaactgcctagtctcagggattcttttacagcaatacataatgaactaatacacttgtgcaatatcaataggcttttcctttaatatctacaaaattcttacagagaatgaatgaaaaatgaagtctcctcttgaacagcccaaggttaggctgctcctgtatgactagccaatttcattgagtgaaaattcaatggcatcccgaacttggcatgttcttcattaggcaaggaaaggaataagcaagagtgcctggagtatttctctcaaatctatcaaaagcagagaaaccagtcaagacacactgttctgtagaactaaacaagataatctccagacctctgtctccttgtccataatatgaaagtgctgtggcagccaatgatgagcagcagccatggctctgcattactccggggccctgggcctcaaacaagggccacgaggtgaccaagaacacaagcaagccgaggcatagccgctggcacgaacatcccaccaagcacaccaagttcatgggagatgtgatctgagaggtatgtggctttgccccacgcaacatgccatggagctgccacaggtctccaaagacaaacaggccctcaaattcatcaagaaaaggccaaggaggaggaagagagaggagctgagcaacattctggtcatggcttccatgaggaaagtggctgccaagaaggacgaattcctcccctccccacataataaaacctttacaggaaaaaaaaaaaaatgcaagggctggaccagatcagtgttagcagaaagattagcagatagatttcttcacatatgaattggtgttggctccttggagtgctatgttgcaatggaagcacacattctacctcagtagcaagaaggccctctgatggactagcaacatctgccatgagcatgggaatagcgtgacacattcactactgtggggcagatcactaaggtttaacatttaaaccttaatctacctcagtagcaagaaggccctctgatggactagcaacatctgccatgagcatgggaatagcgtgacacattcactactgtggggcagatcactaacatttaaatgaaatgttatctccagggccgggtgcagtggctcacacctataatcctggaactttgggaggccaaggcgggcagaccacttaagctcaggagttcaagaccagcctggcaacatggtggaaccccatctctactaaaaatataaaaattagtcaagtgtggtcgtgtgtgtttgtagtcccagttactcaggagactgaggtaggaggatcacttggatagcttgagcctgggaggtcaagactgcagtgagccgagattgcaccactgcactccagcctgggcaccagagtaagactttgcctccaaacaaaacaaaaccagcgtgagatattattatctaaagtcctttcaaactctcaaatcttatgatttccactaacattgagttggtgtgattatcttcctatatagtggacaacatatcacaataaattcttaattatccatactttcgttatttttgccccaatgttgctttcattctcatgaatgtgatccgaagaaacacagccttatccacaagcatggagcccagcaggaagctgtttaaagcagaatacttcgtttactcattcaaagaagcccatgccacgtaggctgcgatgggctcaggaatagcaagaggtttgccaaggtgatgcaggtgagaaaatacgcatttcttgttctttcctgctcatatttccacaaagtttctttacagaactgtaaattcagaaatcagatagagccatgatgaaaacaattacaaataaaaacaaacgatggccacttatttgagatttcagatagcatgtaccccggttacctcttactgataagaaaatctctacttgtgctgctcttttccaaagattgcttgaactgagaccatctaatcgctagcatctaaattactattcattttcgtgtttatcctctggtactggttactcagcagatgccactgctacgtcaaaagcccggaaactggcaggagaatgtccttccttttcttgctccttgtttcttcaaagtctagcaagatttgagttccttacaatgattctcctgcatcactcacatggctgtatgtgtgactgactcggtaggagctctctgcatccattaaagaccagatatacaaacaaacaacatcatctccaccaaaaagattaccttaatttttttcttttttgagacagttttgctcttgtagcccaggctggagggcagtggcaccatctcggctcactgcaacctccgccttccgggttcaagtgattctcctgtgtcagcctcctgagtagctgggattacagacacgcaccaccatgcctggctaattttttgtatttttagtagagacacggtttcaccatgttggccaggctggtctcgaactcctgacctcaggggatctgcccacctcagcctcccaaagtgctgggattacaggcatgagccaccagtcccggccaagattaccttaaccacaggagatactcttcctgtggttcctgtcaaaagttaccatgttgctttattccttccagatattaaccagatgttagtcattttagcattgtgcatattaatgtcttatgttcttgatttttaagattttccctctaagtcttagaaagtcagagctttaagggagcctgaatacctgcctttgacagctaggcaccacaagggcctcgaaatctgtgcaacttgcccatggccactttgccaccgtgtgatagagcagggtaggagcaataccacctctccagggcccatggccctgtgctttcctcttgccatactgagtggcttttcctgcactttcatgcccttcccagtcttctccggtgggtgaggcctgcggcacactgggctcttctggtgcccctgcagaatctctggcatgcccctctcttggcgaagccccagcaaggatgacatagaaaattcagacaaggatgaaatcatcgttttcctctattatttttctaaattgcctttttcctacccatgactaggcagtatttcctcacagctggggatgaacaaattcaaaaagatgttctcaaatacatggtttccaagagaggccactaagtgttgaaagtataaaatgaacatttttgagtgattgcacagttcatgaaaatgtctctggttagaacctcatcagcagtgattcactctgtgcatagggtccccatggagactggagtcacctcacattagggtattgaggctcatttttcctgctgagatggaataaatggctaggatgcattaactgatggcggtcacaatggtcccatccagtgaagtgaggaatatttctttaaagatgcccttgtggtcagaaagacttactgaactttaagactaccatatttctccttccctttaaagaaaaagagtacttttgccctataggcataaacattcagaagtaaagcctcaaggtcaaaattatatcttctatgatagatagcaagataatgtccctgttaaagaggaaaatatagtttattacagttcaatcatgtttttcttgatgcccaaaacatctttttcaagataataaccaattaaatgagattatatactgtgtgtcttagtctatggggagcttctgtaacaaatactacagactaggtagcttataaacaacagaagcttatgttttggaggctaagaagtccaagaccaaggcacttggaagatgtgccatctggtgaggacccactttctggttcaaagacagcctcttctcatttcgtctttacatggtggaagcagtgagggggctctcttgggtctcatttaaaagggcactgatctcactcatgaaggctctgcctttatgacttaattaccacccaaagtccccatgtcctaatatcatcaccttgggggttaggatttcaacatatgaatttgggggtatgcaaacattcagaccacagcacagtgctggagcatagcagatactcaatacacgagttttaatttgtatatgcaactatgttttaggtactttacagctcagctacttttatttaaaaatttttcagttttaaaactgcatcgtaagtaagaccacagaaatgtagcatcagacaagcttccctacccattccaaggccaaatgaggatttttttgtttgtttctccaccagccaagaacctggggtgcttcagggactcaaactttagttgcagtttccaggcctcatggtttagaaggtctaaaataggcccagaaatctactttccagaggatgctgaaacagatgacctgcagcaaatactctaatgtaattgactcttgaagaacatgtgtttgaattttgaaggtccacttatcaccaattttcttcaataaaagttatactaagtatgcctgcctctcctgcctccccttccatctccttcatttcttccacctctgacacccctgagacagcaagatcaactttgccttttcctcctcctcccagcctacccaacgtgaagacgaggagcatggagacctttatgatgatccacttctgcttgatgaatagtaaatgtattttcccttatcatttcttcttcttttttttttttttgagacagggtctctgtcacccaggctggagtacactagcacgatcatggttcactgtagcctcaatctcccaggctcaagtgattcacctgcctcagcctcctgagtagctgggactacaggtgcatgccaccatgcccccactaattttttttttcagaggtaggttttaccaccatgttggttagactgatttcaaactcctggactcaagcaatccacctgtctcggcctcccaaagtgctgggattgtaggcactgggcccagccccttccttatcatttcttaataacatttatttttcttctagcttactttactgtgagaatatagcatataatacacataaatataaaatatatgttaatcaactgtttacgctattataaggcttttggataacatcaggctactggtagttaagtcttgggggagtcaaaacttatatgtaagttttttactgtgtgggggtgagcagctctaatcctggctttgtccaagggtcagctatagtgtcacagagctatgatttgtgggtgtgcattgggtacatgtgggtgcttccacgtggcttgcagagaatggttgtcacttctcctccaataggagatgtcaggacaaggggatcattttctacaggggccaagtcttctcttttcattcccttaaaatagaaagtcatccaaggtcactcttctccccttccccgtgccttcctaaactgctctccaatgagggtaacacaaactaacacatttgatccctataatatgtaccacacttcaccgattctagaaaaggtaacaattctctgatgatgattattccctccttctttacagacaaactcagagaagttaactaacttgcccaagtttacgcagctaagggaacaagcctggattcaaacctaagacctcaggctctaaagccaccatctgtctcttgcagagacagttcctcaatgttgaaggaaaaattttttctcctgaaagaccacagaaaggatccccacatactgctgtaataggctaacgcccctctgtccttgcactttcccatctttccaaccctctgcttgccatcctcagctctgcccatccagccacccctccactttcttgcctcatcagcccaccccttttttcatggctccactgccactcttgtaggagtgtgtagtccagctctgaaattactctcctgaaaatgctcatgccttctttgtgcccttgtcctttcattctcaccacctgttaaaatccaaccttggataaacccacagagaacttccttctctgtgcctgcctactgggaggacacaacagtgctggagaaaaccacgcagggctctcaaagagtgtccagacattttaccatatttttctggtcagcttcctgtctctcccccagtgaaaccttcaagggttctcccttctcttccaaccttccattcctcatcagcccacttatcctcagcagatgcctgtccttttctgagaaatggaatccattagccaggaactccctccacctgagttaccaaatcagcaatcccacctgctctgcattctggacttcccatgcaggatgtacataggttgactcaagtccatctcatttgtgttaaactttaaaaattccaagtttctgttttctttgagagagtgttacttgctttcagactgcaatgtatatattctctcccatactgatgatcactttttggttattgtcataaacctgagtgcatgaccaccatagtgttattcatagaagtctacttgatgttactaagttgttcctggttcaactttagtacaatatctagatcacaggacccaggttcgaaaatggaaatctgcagcattcaaggacaacaaaaagtgatgtgcataataattacataattgaaatctttaaatttcaatgtaatacaaataaatctctatgattctcccctacccccaccacgaatgatgtctttccacccaaggtatttatttttaaaaacaaaagtgtaaagatagagctggccttaggcaaaaaacgtaggagactttgctttaatcatttgcccccaaatcctaatacagtagaaacactttaggcagatagacctggttatcaattccagcactgtttccttccagctgagtaaccttgggtgagttaactcacatcacctaaactcagttccctcatctataaaatggggttaataatatttagctagcagaggattcaatgatgcaagatattagagtatttggcacatattaggtgccaaataattataggttttattattattctttttagtgttcctagtaaagtcactcatatcatagccccagatctttaacttcttatatccctaggcaatacatacattcactttaaaaagactttgtctgtaaacttctgcttccagccaccagaaagtaacaaggatagaatttattctcctactttaaacaactcaaaaatcaaacaaaatatatgaaatgacggttttcagatactgtacaacaaaaagtacaggatagtgatcattgagagacgggaaataaatgaagtgaaacttatgatagtcccagccactgtctagaaggtttccagggcttaatgcaaggaagagaaaccagaacagagcctgaggtctgtctgaattagacatctggggaaaccaatgcccctggaaatttcagggcagagtacaagagaggaaggagccaatcagagagagagagctttggagatcttcagaggtcccctcagagtctgtggctgcatgttgattaggagagacggagagggaagtgcaaaggctggggcaaaagccacagatggaacctttctgaagctcacaaaggacagggagtagctcaagttctcgagatccagagagaagcaacctcgcaatatgccaggaaagagttcccagaagtgttttgcctcagaaaccggatgaaattatctccagtctaaaggctgcttagatccattaacccaagtataaaatcaaagccttgagagaatcaaactgtttccaaggaacttgactgcatctcaaaacaaacaaacaaacaaacaaaaacttaaaaatattttaaagaagacaaaaaaggaaagaaaaaaaaatccagcacctgacaacataaaattcacaacgtctggcaaccaataataaattagtaggcatgcaaagaaacagaaaaataagacctatcataaagataaaaatcaatcaagacagagattcagaaatgtcacagataatagaatcagtagataagcacactaaaacagctattataaatatactccatctgtgcaagaaggtagatgaaagcataaccatgataaagaaagacagggaagatacatttttaaaaaagaaggaatctgaaaatataatgctcaattatgagaaaaataaatcatggatgtcaaataagggggctggaggtcatagttactcttcatatctaactgattgaagacagaaaatctatagtttagacagtctaaggaccaagtataaaagtgacttttccaggtattatgcattttatgtaattatttatataaatgaaccaaattacatattcattcaactatatagttaccaagcacccagctttaatgatagaggaaatacaaagatgattagctacagttctttcccatagaagaagtccagcacagtctgttagacagatgatagaataattatattagcacataaatgacatgtgcttacaattcaagaatgcagtatgtaacacactgtaaactagaaggcaggctgcagaataataaaaggaaataaaagcaaacagtggatctggagcagaagtcccctacgcaattaatccatagttacaaataaaagactttgacattaacccaatgcaaaaatccaatatacaataattcacatgcatgcacacacatatatacacacacttatatcagtatagaaacactcaaactcattctaatatgggaatttaattgtctggcttttctttctactctctgctgaattagaatgtccactctgagcagaggatgcatttcctagtgtggaatgcaaatattttccctcagcttattgggctgttaaagatactgaagcttctctactccagaggaaatcaagaaaattagggaatgtatgtatttgtgatatatacacatacaaaaattatatattatagattatatatttaatacatgtacatatgtcaatatgcatgcaattatttaaaaatatttctctagttttagtctagtgagtaagaatgtggccaccatagttctaaaggctaatgagtggtacatataccagagtacaacagagcaaataaagattaagctaatcaagaggtgcaaactggaataaaatttaaatatatatgtatttgttgtagtatacataggatgaaaaaatttttatattaataattcagaagaggtcgatctaatgctaagcaagtaaatttatcttattcattccatggaatagaaaagtgactatattatattaagcatttaacaaaagtttgtaacatctctagctaacaaggatataggcttttgtcatttgtggagaacaatctttgatttgctttaagtgatgtcagttaccttatatagtacatgggataggccaaagcaaatcttttttggaaacagattttacacattctcttatctctagaaatactgtagacaggctgggtgcagtggctcacacctgtaatcctaccactttgggaggctgaggcgggcagattgcttgatcaagcccaggagttagagcccagcctgggcaacatggtgtgaattcccatctttcctaaacatacaaaaaattagctggcacacatctgtggtcccagctactcgagaagctgaggtggagaatcacctgagcccgggaagttgaagctgtagtgagctgtgatcaggccattgcactctggcctggatgacagagtaaaatcttgtctcaaaaaaaaaaataaataaataaaaagaaagaaaaagaaacaaaagaaatattgtagacacacacacatcagcttagcactaggatgcaagttgcaggacagcatgtgtagcgtctatggcagtgcctgcacatggcaggtgctccatattccagtcccattggatgtatctaggccatctacctctgccccatctacctctgccatccctttttggacagcagccttctagatacaaacccagcctccctcccctcttgccattcttcaatgcagtctctataaaacaagtcagatgcttttttgttagcagaaataaagaaacaaaacacacgagtcacaggtcacttatctccttaaaacttcagtagtttgcacttcaaataaagtctgtactccaagctttggaaggcatggtctggccccagcctatcctaccagacttgagttaagcaccaacctgccaatcccactccatcccaaccaccacctctggcccacatacacccacttttctcttctttgaagaggataagctcctttcatctcaggtctttgaacaggacattttctgcttttagaactttctcatcttttcaaattctccatttctttctgctcttccttcctgctaactagataagtctaatttatcctttaggtcttagtttgaatattactactttaggggaaccttttctgaagcttctccaatacctccaaacaaagttagcctcccaattcctctttgtaacatcccacaattataattagtcatttgtataattatttgataacatcttctttagagatacgtgttctccataagagcatcactggtcggtcaggccaattgctgttcctctagtgccttgtaaaaaatgctgtaatactgtggtgagtaaataaatataccaatgtaatgtcctaatgtcctggggaagaaagggtaagtaaatgcatagagtgtaacagaactgtcacaagtacatgaaatcaggtacataaattgtgaaacataagtcaagggcctatttgttttctgacacttgatagtgagaaatctttcaacaagatggaaaataaaaacaaaagagaactctgagcatcatcctttagagacccccactggtacccgccaggctgtctgtatccccttcatcatggctgtgtcagagaatgccaccattaatatctgaagggactaaagaaagaaactttgctggtataagtatgattttcattttaaaaacaagcatgtggggtggtttatcaacagacagtcctgagtgtatttgtaagctgaagagacagtttcaggcaggatttccagattctatttttttatctctgaccacttctctcatttcaaatcttggagccctgaaatagtaggaatgtagtgggacacaagagagggatctggagacctggctgcagggtaggctgaaacttgaaggagcatctgagagcttcttcctaatttcacagcagaggtgcgtctgggcgttacggtccccagggcgtcaacaaccatccctatgttgtggccaccaaagccatacctccatcaggccttccttcctgcttgccaggcccataaatctccctgctcaacacaggttttctttcaacaggttcctcaaactcaacatatccaaaaggaaatgagccatcttacccatccttctctttcagccttccccaccttctaagcaaatggctctatggttaaccccacttgcaagtctagaagcctaggagtcactgttgattcttcactctccttatgttccatgtggtcttagtcatccattcctgtggtttctacaatgaaatgtctcatgaatcccttcaggttactccatctgtactgctcaggataatcgctggcattactgccatcactgtctcttatctgggtaactcctgtctggttgccaacctttccacacccccatcagtcctctataggggttacaaacatgctctgtaaaaatataattctgatcctgctactcccctgcttaactttcttcagtgacatcctatagcaccctttatctattagtagcataaccacttatcatgttaatttgtttttgtgtatttactcttttctgtttctcccgccactctaaagcatgacagtaaggtctatgtcctgtattcccagtatttagcataacatctggctcaataaatctcagttaaaagagtgatgcttgaggagatgaaaggatttaacaaatccctcttcatatctgggcatattaaagaggataaaggtgttcctgtgaggattaaacaacccaagaaggaaattagaaaaaagtactctgaggaagcagagaagaatgaaaataagtggaaacaccagtgaatgggagagggtagtgaaggggacggagaaggacttgcaacctatcttggcgttccatgagatagaaagctaagttcttctcagaatggcaggaaacagaagcagtgacagtgaacccagagcttctgaaaaagaaacagcaaggtatgagccaaggaacacttaagggtgctgatagacccttacaagtgtgaagaagtcttttgttggctccaaattagtcactgataaaggatgtggctctatgtagttaattgggaagtatgttgtcttttttttttttttttttgagacagagtctcactctgtcacccaggctggagtgcagtggcgccatctcggctcactgcaagctccgcctcccgggttcacgccattctcctgcctcagcctcccgagtagctgggactacaggtgcccgccaccatgccctgctaatttttttgtatttttagtagagatggggtttcaccgtgttagccaggatagtctcaatctcctgacctcttgatccgcctgcctcagcctcccaaagtgctgggattacaggagtgagccaccgcgcccggccaagtatgatgtctttttggaacatgtgtttaaaatagcacaaatggcatgctaagaagcttggagtaaaagatgtgcatcaccccagagtcaataatggctaaagaaatattgttgacaataggaaaggagatttcaaaaagtttatagaaaagcaaggtattatctcacggccagagaatatccagaaagcactattagttcccatgcaggcctgggcaagaaacttaaaacctgggtactcagctcctgcttttcagctctccttccagttgatgattataactttggaaaagaaattaagttatacaggaagagagcagctggtcacacaagaggtgccaaagcttgggatttgatattctagatttcaacttgtgacaccagaggtggggccttctgaaaagggacaacgtgtgccacagaaaactgagaagaaggtttcaggcaacacctgacccaaattttgaaatttgagattagggagtgacactgttcagcacaaacataaacaaaattgtgaactagatcatgcagaggatatcatatgaggcatagaaggatggatggtagtggagaaggatctccacagtgaatattctagcgtctcacgagaggctcacaggtttgttttttaattaatttttaaattttactttaagttctgggatacagaatgtacaggtttgttacataggtatacatgtgcgatggtggtttgctgtacctatcaacccatcatctaggttttaagccccgcatgcattaggtatttgtcctaatgcaggcattttttaaaggctaaattaagttaggaattgtacgtagtagatcccactctttgagaactacttattgcacattagcatagtaaaggccttgggaaaacctacaaagaaagcaatttatctacgtttaacccagagtttgccaccattgttaggccacctaagtataatacttatgtgacctccactctaccttacaacagtggaacacgaatgttccaacagattggtttaaaaaacctagatctacaccaatgcacaaagtattgacaacaaacacaaatcaaaggcaacaaaaaaacttcacaaaaccaaaacaaagtatggggaataaaacaaacaagaaacaataatggaggtaagtatcatctcacagaacagccaggactttggagtatgggatttaggattggggtataactgtgtaatggtatatttgggataaaaggaacaaattcaatgtaatgatctcaagtagcacttcctgtgaagaaggtaaacagagaagttcataaaggtgggagcagaatcacggtgagaggaacatttggtgatgatgaaaggggagggaagtggaagaggcgtcactgtggaagtgcacgacagcacatctgaaaggtgtgctaccacagtaatgagggatttgatttcctgggaaatccttttgataaaatcagaggatataaaaatcttacgccttgctttactgataattttaatctctcaataaattgaagaagcagtgaggaaagggatttagtgtcagtttaatttcaacaaatatgggaagagtggttggtcatttagaaatatcagaaactttgggagaaagccaagtactcataaaatccagcctctccataatcctgtcagaaatgttttaaagaggatttcttggaaggaaggttacactaaataatctttaagtcccttctgaaacattaaaggctgcctctaacattctgcattcacagttgaagaactccagaggtggccagcatgacacctgagcaagcagtggcatccgtggctctatggctacgtggaaaagaaacatagtgctgcacaccaggtacagtaaaaagggcatcagatatgtcatgtaaacataccatagaaccataagaactgaaacaatgtggtcttggaataaaaatagataaatcagtagtaaagaatagatatttcagaaatagacaaaaatatgcataagaatttaatttccaataaaaggcagaattaagtcactgggggcatggaaaatagggaatataacaacttccagagtgggcaaacctttctgcatttagaaatggaataaagaactcataaatgaaaaattaaatataaaaaccataaaaaagaaccaacattaagaggcaaaacatggagtagataaatatttttaggaaatatgaagtccaaggattaaaatgtttaacaaatgcccaaatataaaccaaaaaaaaaaaaaaaaaattaccaggaaccctatttgataaatggatacagtgtgagaataattatttacaaaagagaaaatgtgaatagaaaatgaaggagaataaggaaataaacaagggtagttatagaataatttaagataaaataataggatgccatttttgcatatcaaattagtaaatattaagtccatatgtatagtttgggaattaattgaccagtacttaacaagaaacttgaaaatgctcatttcttttgatgtactagttccacatgtaggagtctatccaatggaaataattctaacagctaaaaagccccatgcataaaaatgtccactgcaatgttttaaagcaaaatattatttgctttaaaaaaagcagaaaggagaaagaaagaaataagaacaaaggagtaagaagaatatttaatgtatgcttaccatatggaggttatataaattatcccatttaaatctcacagcagttccatgaagtagatatgatcaccattttatagaaaaggtaagatgtttttgcatgctcagggagactaagttctttaaagaaacttggctagtaacagtgaaaaaatggaaacagcctaaatgtaaatagtagaatggttaagtaatctagagatttgatgaattatttttaaatttttaatataaaagaatacaatggaaaaatagtttaggataagatgttaaaaatgcataatagaaaatgttatattcagtatgattgaaatacacagaaaaaagactggaataaaataaataagcactaaccaaacacaacagaacctgaccctgagattgtatcaaggaatgtagtcggctggtggccctgagaacaaagcaaagtgcagttaaattatcaggccgtgtaaatgatgaagggaagcccagaaagaccctgaaaggctcaaaaacagtttaagcaatttggctaacacaggagatagaaaaagtaatttggggcagatacggtaaatcttctataacgcgtagggctgtaattcttttcatggcaagttgctgggaaaatcataaattggtcatggttaaaacgtcagaagactcaaaattacaagaaaaaataatgaattatgaaggttttggcttactctagaagtcgtactacattttctgagagaagtaggaggtgagacgagagtaagtaacttctgctctctgaatatttcaattaggcagctggggaaatgtgggtggaaaaatagaaatctttactttcaagttattagaagaaagtatctgtctatgtaagctttagggaaaaggggcctgggataaacacatgttcaagccatagaaaatgtcatttatgtacacctacctccctagagcagactaatcttcaattgtatgaatttgatagcattttgaagaacttaataaatatcctaaatataatgttttaaaactcagcctttgtatttcctttgtctcctactttccctggtctcttatccattttcatattctttcttattatattaaaaaagaaaccatatatattatatatatgtgtatacacatatacacatacacacatgtacacacacacacacacacacacacacatattactacagttaatttggaatttttcatttatggccactattgaccaaaaagaaacacaacaaaaaacaaatgcttggtcaactcagcatgaagtgcacaggtatgtgggagtagaacttagcacattccaaatgcgattggtttctatttaatgaacaccatctaccctcacctactttgatggccaaaaagtgaatttttcttctgccactgtaacaatgactactgcataatacctggttgtcacctctccactataaattctgagagggcagaccatacttgtcttgtttactgcgggagcccctgcaccagacagcggctcaatgagtatttgttgaatgaatgaatgagtgagtgaatatacaaatcctactcatctctccagacttagctcaagccccaccttcctgataacatctttcctcaaagccccagtgaccgatctgattattatattaccagtgtgcaccactacttaacacacctgactctacacatcatttttatcattgtttttcaggtgttggtgttttgttttgtttttttcaatttagagagaaaggctcttcaaagacacttatatacatatatatttattctatttctcaaagcactttttacaggacacatgtaaaatcctcagcaaacacctgttaaattcaatggttaaatcttttagatgacttttgactttgtggtatttctaaacattttctctgctgaatgcatgcattgtattaggatttcaccacgtggtggacagaaaacagggaatttagtgtcagctgagctgagtttatagctctgccatttcaatgctggaaaagtcaccgaaactctgctcttctgtttctctatttgtaaaatggaaacattaacaagagcaataacaaaaagaaatatctacctatcataaagggaagacagtgcaatcaaatgggataatgtaggtgaatgagttttgcaaattggaaagcaaatattagccattctatttaccaattttaaaaaacgcaattgatgttgcaagactgtgtatagcaataacagttagtgtggctttttctgagaacaaggctattaggcagaagagaaaggtgatgaggaaaagaatctcaagtacaacttgccaaacatgccccagtcataaataaaagactgtgtccaacactcgcggtacagagagattaccaggcacctgtcacctacacccttcggcactgctgcaagcatctctgaaaccaggagaaagcttaccagacacgagctgctgtccaggcaaccctacgggaaccatgcccaggttattcatggctgtagcccaggctgtgggatctgtcacggacatgttgagctgggtcgtgtctatcgctatactccccaaaccatcggctgctgtggggaaaaacaaaccatgatttagagtccataggcaagggtgtttgttttaaagaaaatcacatttctagatatgtgaggcttcatttagcacattcccaaactacaaaaaaaaaataaagaactataatctgcagcaatgttttctctagacataaacacaaagtgtttccaaatactttctgggagaaaacttaatgacatgtagtttatattatacacagcatgctattaaggaggtacccctggaaaaaaatcgaagaattgtttccttctcccagtgaaacaacgttagttaagtcacaaggctgagaggcaaagcagtaatactctcttggtaaaacaagttaattggcttactgtttctaggtgtaattcttgagcaggcaggccttctatctaataagaaaatagttgtcaagcagtagaactggtcctgactgaatttattaagtgttacctcgtaatctattccttcctttacaaacttttacattattacactaagaaaatacaggtgtctacctaacgtgacttttctgaaggatttctaaataaataaatcaaatttaaaaacaggtagcacaaagcttaagaaaacacaaaacaaaacagaagaatgtgtcaaatttgacttagtgctctttcattttcactagttctacagactgatttctttatgggcccaggctcctggttcaatgcatatttttcaaggtggggcaagcttttccactaagaactcaaaaaatccttgtttgtgtcctgtgctggccactggcatttacctgcagccatcatctgaggaagctcctggggaagctgggtgatgttctcaactccacctgcatctaccattgaattatgagtgtccagaggggcaggaacactttgatggctgagtgcagggtcccctcggaggtcatcagattctgcaaaacgggacagaagtgtggtgagaaaccttaatagttaactgagataaaacgtcaaggaacaaactgttatctattcaaaatcaaaaacaaagaccgatttccagtctcaggcacagaagaaatgctgcttcccatcgctcagcggctgtcttgtggctcagttaaaaccttagagccctgtgagatgtgtgggtcaactcatcgactcaccaggagcctgggctggctgaataaacagccccatttgtgagtacctcaaaggccttgcttcctactgaagcaccttcacaaatgggggcttatcagtccctgcacagccttttccacacacactacacatcaatggagagggcagagtcagggctaaagaagatttttttaagttaaaaaattaattgatgctgttactttggaagatggtcgtctgtggaatgtattcagagagggaaaaaagttgggaggaggaaggaaaaaggaagaacccattcaccatgcagctggaaaaggagggtacctaaattacaatagtcaggaaaggcagaagagaagaatggcatgctgtccataaaggaagatctagagggtgttagggaggcaaaggaagagcatttggttttttcagctcattggaaagataatttaactggccacaactttttggtttgaattttccttagaattgcccagcttatatatatatatatttttatatatttatatatatttatatatatatatttatatatagtcttttaatgcacttatctaataaatataacaattaaacattaaagttacaaagttcttctcaatctcacactatttataaaatgctatgccttctctccacccttagaaatgcaaaaacagagctttcacatgtattttaagtgcactttcaccatttcaaaactcagatgagtggcatgacaagtttgatcttaagtagattagatataacaactaagtctaaatatttatttttattttagtataaatttagaagtttttctaaaccatgttcctgttaatgatgattttagaattagatcttatggtttgacagtgtatctaatgtgaagttcgaaccttttatggcatgtctttttgtttctttcattcttaggtataagaatcagtaattccttgagcactgcactgtcaaaaagaacttctgatcagttgagcagaagtttaattcaaatggaagctaagggttcaattctcaacaacaggtgaataatgagcaaatagtttttatggtctcaacaaatccctagccctcaactagaggggtatgtaagatagtgtggaatttttttccaattgtctgtcaggaagatgaatcatcatcatcatccaacagtgaatgattctaactttggaagcaaattgtactgagaataaatattttattccttcccactatactatccaaatgaactcagaacctgcatgtgtattgtgcatcaattatcttaggctatgggtgccatcagacaaagagattctcaccatagaaaataaattcaacagcataagaaatgcatagctaacctaaatgtctggtctattcaccaacgatctttctacgatgaaatctcaaagcacttctctctccacttccaaccatttcagagtagcaaggcagagtcaggctagaatgtgttcattcttttgttcaaatggccctgtagcagagctgtttcagatctttgcaacgtcactatttgtcttacttatctccccaaatgaagtttagtggctagcctccttctacctcagattcttcccaaatgggcattaatcacacatttttttctcgagtctgcagttctggaacactatatcagagaacatccctctactttgtaggctcatgacttgtgcctgacccaccacatttcaccttgactttttgctacactgttttagggatggctttagttttccttggctctgtaacagtctgctccaatggcagttctcactttagtggttacagtcgtataaaggggcatcaagtgtcctggagacccatcgtttctacctaatactttcatggccatcttaacagactgcaagtgtttcattgaaaacagtaagcaactgctactgttccactgaaaaaaagcattgttctgttggcaagatgtggtgtataaacctagatttatcccccaatgaaactcttgtgacattcaatgtattacatctcttcagtctcccaatccaatgtttttttttttttttttttttttttttagtatttattgatcattcttgggtgtttctcggagagggggatgtggcagggtcacaggataatagtggagagaaggtcagcagataaacacatgaacaaaggtctctggttttcctaggcagaggtccctgcggccttccgcagtgtttgtgtccctgggtacttgagattagggagtggtgatgactcttaacgaacatgctgccttcaagcatctgtttaacaaagcacatcttgcaccacccttaatccatttaaccctgagttgacacagcacatgtttcagagagcacagggttgggggtaaggttatagattaacagcatcccaaggcagaagaatttttcttagttcagaacaaaatggagcctcctatgtctaattctttctacacagacatagtaacaatctgatctctctttcttttcctcacatttcccccttttctttttgacaaaaccgccattgtcatcatggcccattctcgatggtcgctatctcttcggagctgttgggtacacctcccagatggggcggccgggcagaagcgctcctcacttcccagacggggtggccgggcagagacgctccccacttcccagacggggcggccgggcagagatgctccccacttcccagacggggcggccgggcagaggcgctcctcagttcccagatggggtggccggacagaagcgctcctcacaccccagacagggcggccaggcagaggcgctccccatctcccagacggggcagccgggcagaggcgctcctcacttcccagatgatgggtggccgggcagaggcgctccccatctcccagacggggcggatgggcagagatgctccccacttcccagacggggtggccaggcagaggcgctcctcagttcccagatggggcagccggacagaagcgctcctcacatcccagacggggcggctgggcagaggcgctcctcacttcccagatgatgggtggccgggcagaggtgctccccatctcccagacggggcggccgggcagagatgctccccacttcccagacggggcggccgggcagaggcgctcctcagttcccagatggggcggccggacagaagcgctcctcacatcccagacggggcggccggacagaagcgctcctcacatcccagacggggcggccgggcagaggcgctcctcacatcccagatggggtggccgggcagaggcgctcctcacttcccagatgatgggtggccgggcagaggcgctcctcacttcccagacagggcggccaggtagcagcgatcctcacttcccagacagggcagccgggcagaggcgctcctcacttcctagacggggtggccaggcagagacgctcctcacatcccagaccgggtggtggcggggcagaggcactcctcacttcccagatggggtggcggccaggcagaggcgctcctcacttcccagacagggcggccgggcagaggggctcctcacatcccagacaatgggcagccaggcagagacgctccccacttcctagatggggtggcggccgggcagaggctgtaatcttagcacttttggaggccaaggcaggccgctgggaggtggaggttgtagcaagccgagatcacgccactgcactccagcctgggcaacattgagcattgagtgagtgagactccgtcttcaatcccagcacctcgggaggccggggcgggcagatcactcgaggtcaagagctggagaccagcccggtcaacagggtgaaaccctgtctccaccaaaaatacaaaaaccagtcaggcgtggtggcgtgcgcctgcaatcccaggcactcggcaggccgaggcaggagaatcaggggagcccgaggcagggaggttgcagcgagctgagatcacagcagtacagtccagcctcagcaacagagggagacgggagacgggagacgggagacgggagacgggagacgggagacgggagagggagagggagagggagagggccaatctaatggttttaatgacatacaacttactgtggctaccatgtgcctgggatggtgattctaaagtaagctctgtcacatcttaggaatttccaatagtctcaaggctgccgtgacattgttcacaaaatttaagttgattcggtcactcattttggaagaaaggtaatacttttaattaattaccaactagtaatttatgaatagttgcaagaatgattttggtactttgttagcatctattgttcctattgaatacctgcctctttaaatgattcaagaccataatgcctaatttatcattcacatcaatttctctgccttagttttattatttctaaactatagaaaagattaatcttcttagcgatgtttatttacacacagagatgtggggagttaaaaattatagctaataaagcactctgaatacagtaggtgataattattactattttatttggaaatgtagtgtttccattaagataccctgggatctttgtgttctggtagataattatgtaattaattctaaaacagtgagtaacacttgatatttctaaaagtaagtgttgccctagttttctgtgccacacctcagttggagcacaatatttcattttccaccattcctttataaaattatatgaggtaggccaggtgcggtgactcacacctgtaatcccagcactttgggaggccgaggcgggtggatcatctgaggtcaggaatttgagaccagcctgaccaaaatggtgaaaccctgtctctactaaaaatacaaaaattagccagcaatggtggcgcatgcctgtagtcccagctactcaggaggctacgacaggagaattgcttgaacccgggaggcagaggttgtagagccgagatcacaccactgcactccagcctagttgccagagtgagactccatctctaaaaaagtaaatacataaaataatataatgtaatttaaggctgggcgcagtggctcaagcctgtaatcccagcactttgggaggtggaggcgggccaatcacctgaggtcaggtgttcgagactggcctggccaacgtggtgaaaccctatctctactaaaaatataaaaattagctgggtgtggtggtgcatgcttgtaatcccagctacttgggaagctgaggcaggagaatcgcttgaacccagaaggcagaggttgcagtgagctgagattgtgccactgcactccagcctgggcaacagcaagactctgtctcaaaaaaataaaaataaataaaaataaataatacgatgtaacttaaaagatgtataaatattttctctctaggttttttctgcctatgcaactacaaaaactttcaagagattcatgaccaattatgaaattggcagtttctacttacagctttaatgaagtatgagcaccacaaaacaatctgatacacaaaatgccaaggataaaagtacagctttgtttggccttaacagatatctaacttgtttcctgttaagatatattcaagtataaaatctcataccaatttcataactgttcaacaaaatatatttatgttcagtatttcattgggctagataatggggcaaatattttttgaaacttatcaagtctatgaaaatactatttggcttaaaaaatggcacaggtttgggaggctgaggtggcaggatcacaagatcaggaatttgagaccagcctggccaatatagtgaaaccccgtctctactaaaaatacaaaacttagctgggtatggtggcgggtgcctgtagtcccagctacacgggaggctgaggcaggagaatcgcttgaacaatttctataggtatcagcgatgcacacatcatgaataataaaacctacctgtaattgtccacaaaacacagattcctgttaaaggagggtagagatcagctaggtattgaaaaatccttcttattgaaaaaaagaaaaaggctgggtgtggtggctcatatctacaaccccagataggagctaatatctataatccactttgggagaccaaggtgggaggattggttgaacccaggagtttgagaccaggctgggcaacatagggcgatttcatctctacaataaccttaaacagttagtcaagcatggtagtgccctcctgtcgtcccagctgctcaggacgctggggtgggaggattgcttgagctggggagtgaggggtgcagaggttccagtgagctgagattgtgccactgcactctagcctgggcaacagattgagtccctgtcttaaaaaaagacaaaacaaaaccaaaaaaaagcatgattttgtttggtctaagtccttaggtttatacctacttcaataacaaaataattgtggtgaaagaatcagatttcttaatgtcttgtaaacagttgataccaggccaggcacggtggctcatgcctgtaatgccagcactttgggaggccgaggtgggtggatcacttgaggccaggatttgagaccaacctggccaacatggtaaaacctcatctctactgaaaatacaagaattagccgggcgtggtgacgtgcacctgtagtcccagctacctgggaggctgaggcaggagaatggcttgaacctgggaggcaaaggttgcagtgagccaagaccaagccactgcactacagcctaggcaacagagtgaaactccatctcaaaaagaaaagagctgataccaaaggaagcttatttcatatggtatcagcaaatttcttattttataagaactctccattagcattatcatggtatatatttacagtaaaaagaaagatacatttccttccaaagttcactctccttttccatcactaaggaaatacctaacttcgatcttcacatagtcagtgccatactctcgaggttatggaaatgttccacggtttaaaacaatatagataattgtgaagtaggtatgcttatgtattaactctttgattctttaagcaattatgaatagtaggggagatacttctgcttcctgtaatgataaactatgtaactgtagatcaatcttcccactgaggaacaactaaaaatcttaatatcttccatcagttttgtaaaattctcactatcatcttttcatatacaaaagcagttcaaaggacattctctgattattgtagtgggttactaatctggcttctaaggagaatgggtcctgttaactactgggtgtttcatcttattgttaagggaggtgagtggaatctgcaagtttaggggcagagtaggaattgctctgtaaagtgtggtaaaagaaaacataaaagctgaatgttctgaggggaaagaaaggagggatctttggtgcccacccatgaagaaaagatgactacagagaagatcaatgacttaagcagaatttcaggtggtttcactgggaagcatacagtgtaaatctctcctcagcccctccccagaaatgtcagctaaatctgttactccttatttcttagataggagtaagttttggggtattggggagcacttagaggagagtttcaagaaaagaatgaaaaggtagctaatgggattatataacatcctacatgataacgcatgataaagactcaaatctgttaaatatagaggatggtgattatttgttaatgatcaatgtcagctgattaatgggaaataataggattaaggttttgaggaatagatttagattaggcatatcatggggaatttctgatgagatgactgtaaagtaggagtattatatcaaataacacttaaaagctctttctcagtgatggagagaaaagccatttcttggaaacagtatgggcagaaaatggagttggacaaagatcaattcagataggggagaaccctatagcacttagtgtcaaacccatgaaatcaaaaggtcttctttagtatctaactagttattcatatacagatgctcctcaatttatgataaggttacattctgataaatccattaagttgaaaaaatagtaagatgaaaatgtatttaatgctggcaatacaacagacagtcctcaaatgacgatggtttaatttacaattttttaactttacgatggtgagaaagcactgtgcattcagtagaaaccataaccccatcacaagttgtaaggagcttcttgacttggagttacatcccaatggagttatgtcccaaaagcataagttgaaccatcctaaatcagggaccatctgtgtttataaaatcactgaactttttcctgaagtgtcacatcacactacattgcacctaaggagagatgccactcctactctttttccagttttctgttaaggcagaaagataaaggagatatatactctttctcccatgctctcatagcactctgtaccttgctctatcccagcactttcactcatattctagttagtttatctctatcatgtctctaataaactataagcttaggatgatcaaggaaactagtcatctgtgcataccctgcagctagcaagcaaagtacctgaaatgtggtaggtgttaaatatatatataatatagttataaatttataaaatatattttacgttttatataaaatataaatattttacatgtaatttcaaatgaattcatgcaaggaggaaagaagagaggaaagtaaaaaatgaagaaaaaaaaggaaaagaaggaaataataaaggaaccaagaaaaaaaaaaatctcagttccagaatttagtcccaaagcttggaagtttaaagctaaagaacacaatgagggtggagggatttttcttgtatactagaatacagatgaattcaaagtgtcaaagaatgacaattaaaaaaaaatctgtcagatctttcaagataagctttagatgcacttaacaagtcaccctctaagctttaagattccacacctccctggcaaccaatgtaggatcacaagcaggttacagtgatgttctccttttgtgagacttcttgcagctgctctttgaatgagctgaaatctataaataactgcatctccagacccattaagcagtacattagtgtaacaaaggcatatatgtacagtactaaagaagtgaaattgttggaagaaaggaaaagtttccatttggcatgcaccacagaggatgaaaagcagacccaaccatttctcaaacatgaaattccattattggtttgtgattacatcctccacttttctactttgtatagcagccaattttaaactacaaatcatcatctttccatcttagagaggacatggtttctaaatgggtaaggttttacccacagcatgtctatctttgaagaactctatattgagagaaagagacagaaagagagatgacctgaaggcccccctctaaaaacatgcaatcaaacaaaatgaccaaatttgccaaggagacaactcaactagcatgtgcaggacagcagagaagaacaattttcttttggcacaaagaaaaatatcactcggcattacaaatataagtgtagagacatgacaagtaaaattatttttctcaggaaaactttgcttttggaaaaaaatatgctttatatatctaaattgaacaaataacaaaaaaaatcttgagaccttatgtataaagtgcccctctttccattaaaaacagaaaagaaaagaaaacaggccttgatgctactatggtaatatgtagggattggtaccatcggaggtttccagaagccactggagatcttgccacatatcctctgtggggaagggaggctactgtatgcagttttaaagtctttgtataggcaggttttaaagtgtaggacctttcacatttagacttctagagattttctgaaaagggcaacattagacttgaagacagtttatgaaatacgtaatggctcaactccttcccctcattcatggatatcaatcaaccacatacacaacctgctgtcatatgttgttgttttctactttccaaaatacacagaccataaaaaaaaaagtgatcaccgctagactttgctggtgagtaaattattcaagaaagcaatattatcagtaaacataagcctggatccattaaagctagaagagtcccattttacgcaaagcttttctaagcccctgggattcagggcaaacacatacaggttcatagagtaattcatcaaggtttgaagaatcaggtaaaacctgagtttatcaattcctacttctcccagataaacatgtctccaaaatgtttctgacaggcaactatccagcctcagctagtgatgggtgtggcagctcactgtgccagatagtcctaagagttcaccgttctctctcctgagcacctatctgaagaacaggagatctaaatctaaattctgtcctcaaaccctacctctgcagtgatatgtggtcttggaaagtgactcttctatccctggaatagggatactgaggcttaactaccatcttacctagccacagataaatttatgaaagtaactaaggacatatcagataattcttgcctccccctggtcaaattttttctgtgtttgcactcttgtgttcttttcacattcacattctaaaagttctaaagagtagacaatgtaaacagaatgttgtaactaaataaaagcctcaattaaaatggcaaagctatggactcctgagacagagcaagagagacaggaaagagtcgtcttgaggaagggataaggcctctgggacaagatttcaggtggatgtcaggcttcaaagatatagccatcaaaagaggtgaattctataaaccatacacatggcaacaaatcaaagcataattttgtatgcatacacagtacagaaaggcaatgttggtcacatcccggcctcttcagctgcactgatacacagaaagcaatttctgtaaacattattgtcttcttacataaaggaaatcagacaatatataattctataatttgtgctgttttgtgctcagctttttcattatgtactcattttacaccttgacccaaccgtggaaaacatattaagctagaaagtggaacattttaattgtagtggataaataactgacccttaaatggtggcaaactggcaaattagttatctattttccaaaaagccctggttagagccctttaatttatggaaatctacctgcaataaaacccagatcagaccaagaccagcctgagccagttgctcatcctgtttaacatttctcccagtagggtgacaaataacatattagttactctttaaacaaatgtgctcttaatgatgccactgccgcatgatgaataaagcattagccctgcagtcatgatcgccctgggacagggagcgttagcagaacacacccaccttgcatggattgccctgggtgagagactttgctttatctttctctaaatgaccacccatagcccttgctcatgctctgtaaccagtgagcaagaacagtggagccttgggtcccctgtgatggtcctttttgcttctcagggcctcataaatggtatggctatatcactgggagtaacccagaaggcatgatggggtagttaggggagggctatgggggcacaggagcctgatgcaaatgactgcacagcagcacatccagttggaaagttccagttcagcagtgagcattctgaggaaatgggtcaaacctttagtgctgctggttatatccagcaagatttaaatgaaggtgctcagaagagaaaaaggcctgagtgtccaaaaggtattcaggctcctgaggctagaggcagattagggggcacagaaaggtggttccaacctccaggaacatacatgattcagaagctgaatcctggttatttcttggtaaaaggtctttatgttctagctgcttttggaggtcaggcatcatcaaaagcaggaattggctacacctggttatctcagcaggccctcataacccagaaaacctccatggaggctcccacccccatcaaaagagatgagagaataaatgctgatggaaaggctccagctctgaaggcaaagttgaagggcactacaaaacactgttgctacagacccaaggcctttaccctctgtctgtcttggtcacagatttgcattaaaatgtcctccacccctaccgtcccccattaacacattctccttttcaataggaggagatatttgcctcttaagaatgccacataaaaatccttccttacaaggagatggcatttggaggactatgttcctcaaatagtctctttttctactacagtcttacagaccaaaggacccatctgcctctgagcaactagtctatttttttaactagggctgtgttctcaactaggcactagaggcataaggtctacaataatgatgaagacctgaaaatattttgtgtcaacatgcaatgaaaagcacactatctaaaacaaatatttaactaaatgtttataaattccatattatgacaattctaattatcaaatttagtattcacatgaaagtcattatagttgaaaaccatttgtaactgggctatctcactttgcagaaattactgagtgtgcaccattatggagaaattagagctggttttaaatgaaagaaataacttgcaggcaaataatttcaaaagcaaaatgatttaaaaaatcatctccaaagttcctataaacaaacttatactaaacatcagatgtgaacacacttgttatgtttgatctgatatggagtaagtaaatctgctgctgcctagaaaggttttaaatggttgtgttctgaggcactgtctccttcctgcctactgtgtgtaagataaagctatacttcctctcaaatttgccaaactcagttcaggatcgaatgccattccgttatttattcatggattacataaataattgtggaaaagaagaaggaggcatgagcaaaaattgaccttaaagaatacagatgagagagaaaaatatctggctcatggtaccgaatgcaatttcatgttagcttagagtcatcgtatgtatttaggttttattatttataaaaaagaaatcgtgctgaatgttctttgtgggaactgcaatatattgctattgctacgatggtttactattttcacagctagatggcttaaacccaaactaaacaaatattttaaaagaattcccaccagcattattacttttttttcgtttctagtgttaatgaaaaagatcttctgcttttcaagtcctctgatatctttactcttgagcaattctcaattttatggcttatgatgagataatgtttattgaaaaataacaacttaagaaaataaccagcaactagtggtggttaagcagtgcagtgtctgaagtgagggcatttgagaactgcagtggctgtcaactccaaatattcaccaggtcttgactattacggcaattaggatgatgattttattacttgcacactgaagtagacatatttttgtgtactcatccaagatatcaacttgacagtgtctactacacacagaattttgctaataagataaaaataaggtagatgtgacagtgagacacataatcaacataaaacaaaatgcaccatcatgtccagacttctcactgtatgaccaaacccttactttaataggggtcaccaccttcattcaaatgcactccccaaactcttgctatcattcttaactactggctaattcaccatccttttctctagggataaaatttgcacagaaatgcaatgacacagttctcttcaatctgagagtaaatatcaatatacactagagaggtggggatttttttgttttaaaaatattattgctgatacatgtaatgagttcaaacaaagctaaagtctataaagtaaaaggggaatgccattccgttactccttatctgccagccaacacactccccagatggaaccgctgggaaaatagctccctatacagcagtcactgtggcaagaaactcacatcctcgatctcatgaaaaagactcacaacaacctatgagatagatgttattccaactttttacaaaagaaaataaactaaggtccagaaggctattcctttggatttttacccaaggtcagaaagccaatgaatggcagagcccaggactcaatgtaccctagcctggatgtctgttgttacagatttggggaactccaactttctcccacaaagagtcagactagaaggttcctctgggtttaactggctctaaagagagaaagaagtctagggtaaaggttagttccatccctgggggtagatttatttatgcaacatatctttataagatgttgactgtatgtagcactgtgcttgataccaagaacgtaatagtgaacaagacatagaccctgtcttcaaaaagtttgcaataatacagtcaggtaactaaacaaactaaaaagtaccagcagacatgaacttgctatagcatggcaaattagatattcttaggaacatgcctcttataagaaaacaacaactagattctggataagaccacttatttatgtattactaggctttctactaggcttggtaaaggaaaccctgctagacatctgcttctaaaaagaaagaaaacaaaaaaagttggctgaaaccagaaggatgagccaggagtagtaagttgcttggagggaaagtgccaacatcagcaatgcaccaggagatagcctgtcatggcaaggtcaagccctggtctgaggtttccatggcaatcaggacctgaagatttgttgcacctttacatggcccttaccccagtcagccttctcaaactctcgacttcagttttagaagtaggcaagtgaaagaatctgggcaaaccagcagaaatcactgctgaaagacaactcaagacccatgctttattgagaggcacatttttcttaaataagtcagaataataattgtgtacttagagaaagagagagagagaacaaacatataaagtttctacctagggttgatctgtaatccaaattgggcttaactcagtccaaatatatatattgagggcaaactgatggtttaagctgagagcttgggataaagaaggtataaacatcatcattatcaaggactgtccaggtccattctccccatgtcaacagcttctatttgcaatctctaaatcatccacaccctcaccacaactgtactgcctgatagaatgcactagtgagtgaggcggatggcaaagtagaaaggctggtcccagctttatatatagaaaggctgggaggtggagtcaggttactattactttttcttacctcatcccctttctgccagaaccttcttctgttctacttctcttacttgtaccaaatacactctctctaacacgagctatctcatcatgttggcagctagctacaaggaagaggcctggaatgcagttctcctttctacctgtcattgggaataggagctacagaaactagggttggtgaggcgggtggggggtactgtggaggtgggtaaagccacaagctggataaaccagaaaacccaacttctaactcctattccaagggatagctgacattctagaggtgctgaaagagtgaggatctatgtcagttatcatgtgggacactgaaatcaaagtccctctgcatgctgattagaatcatcacccattgtggcggctattttttcattctcagtagagacaaactgaaaccctgagaactgatctgggcaagtcgctttctctgactctcctaagaaacgtgcacagcagtttggcagcacaatttgcataccagaggagagctcctgtcacaagtaccctgtgggccagtttcctgagcttttccacttgatgctttcaagcctcatctcacgagtcattggagaggctaacgtataatgccttttggaggagctgaaaggaataaaacattactagcaaaacggtcatatattttgagagttaaaatctagatccctttagataggccctctgaaagaaatgctttcgactacgatggcagcagcaaaaactctgttaaggacagcttcatgagcacaacttcccagccactattcccacctgaaaagtacatattctggtctgcatttttttttctacaagtattttgctttgattcattgttgatacacatgacagcagaataataaactaggtagtttgagcctgtgtgtgactgggattcggcataagcatcacaattttggtttgtaaattcctttggttcagtagatcaaatggggaaagacttgtgtaatgtgaaattcaatgaccagcaatggcagggatcttttggatatgtaatctgctgttggagccatgcttggggaccaaatagatgagcaggccatgttaggaagggcagcaaggaaaagagaaaacatgaattaatattaaaaatgtgatgcaaaataaaatggaggttatagtcatatccttccaattgtattgagctgaaattgtttctggatttggaagctccttgctaagctaaattgcaaaaataagattatatgaggagaaaaggtaatttccaaaatataataaacataatacaattactgcacacttatatatgaaatccagaaaggtatatttctttcacgccatgtgatcacagttttgttacagttttatgttcttattttatgctttccactagttttcttgactttgcatattcttgatgcaaatcagtgaatgcatataaagtgtaaacaataggctctcaacatggagcctacccaaatgatttaactgtgtagcattgattatcttgtccactgtgtgagcaacgtgcacaaaatatgcattttgtatgttacggaggtcttgctgatgtggatgaagaagtgtgagaactaggatggagaagaagctaacttcaacagtctactctttagtgtcctccctttacataaaacaaaacaaacaactgatcagctactagtaatcaacaaacttaaatttgctgagaggaagtagttaaatagcaataccaagatgtagaggttagggaaggttgttttgcccctgcctattgacctacatatactgaagcaaaattggaaaactgcagcatatttggtcacaaggtctttctatttccattcataatttcttttctttattccctctttttttttgttcttcagagaacacctttcttgatatgggtgttttaaaattctgatcagaactggcagtgggaaaagagctgaggaaataacggagactcatacttatgtgacacattcacaaaccctatgaatttttaatgaaggcacaatgtccacaattagatttgaaatgaggttttctttgtaggcgctcttacagtaagtggagtgcaagcgaattttactttatattcagtaaatgataccaagtgcaaaaaacactacaatttaatagaaaataaaaacaaattgttgattgttcatagctcctttttcatctcttagatttacaaaagtgtagcagttaaaaaaattgcatttcgttttatttaaataccacatggatgccaaggcaactcaaaggtatagaaagtcattttcagtcatgacctgaagctgtccttttgcattgtgtggagaagtttttgtttgttttaaactgtaaaaatgacttctaaatgtagatctttggggagaaagatattaagcttccctatttgcaaactaagccatttcaaatgaacataaaaaaaaaatctaatagtgtagaaaataaggaaatagagtgggctgatggctacttcgtttgcattttgattttaaagcttaactcttgtcttcatagggcttaggttttcagcttcgcagaaacagacacagtttcccatccttcttaggtggtttccaaagtccttcagtttctggctcctggtcaccttggcaacatcatttcctaaagctgcttcttctcttggagctcccgcaacacagatgcttttactcttccttgagcctagcaagtgtgatcttctcttagtgactctgcacttgtggttcctccaggtaactgcgcaaccaccctgctccctcacctgggcccttctctgacgaaatgtcatccctgacctctacctaaaatagcaactgcgtcaccttctgtccttctactagccttattttctttctctctaggatttcttggcatctgaggttatattacatagttatttctttgataaattagtcatccatgagggcacacttatttttaaccttttaaaaatgtttttcttggtaaattgccatcagccaaaacagtgcctagtacttagtagacacacacccttccctcccacatacgcaaattcattgattaaatattatgagtgggtgtatatatacatacacacataaatatgtataaacacaccgtattaatcattactgtttgattttctatattcctgatgctttgacatatgggtccttgctgacattggagggatctcccctcccagggctagccaatccaagagagcaaacgcctcacctgggagcacacacgtcataggcaaaccaaccaatccagatcccagaccctcgaacacctcctttactggctctcagatgctgaaccactattcctctggcctaatcaccccggagccaagtataggccttataccccagagcttaaattattcaaactagcccatcctacgcctgtttattccaccttgccttgcctcctgttttgcagaaatcacaataaaggcgctctcacttcctctcccttctgactgaccctggcgcctccctgtgtggctcctcgttgtgtggtgtggcaagcttccttctctttggaactgtgaataacaaactatcttttctatggcagtcgtctcctgatctgttggccttaccacaccctataataataaaaactgcattttcaaatgcaaacaaataaacactcaaataaaattcactgtattttcaaggacaatgaaatatagtaatcgccagaagttatgatttttctggactcataagaaataaaatcaggcagggtacagtggctaacacctgtaatcccagcactttgggaggccgaggcaggtggatcaatttgacgccagttcgagaccagcctggccaacatggtgaaaccccatctctactaaaaatagaaaaaaaaatgaggtgggcgtggtggcgcatgtttgtaatcccagctccttgggaggctgaggcacgagaattgcttgagcctgggaggcagaggttgcagtgagctgagattgtaccactgcactccagcctgggcaacagagtgagactctgtctcaaaaaatgaataaatacataaataaaaatagaaagaaagaaaatgactttgacattttaaagatctgtgtacagtttcaactccgtctcagccctgagattcatttatgaattgcttttgtggttattattgttgctttctactttcgccctttaagtttttttgtttatttatttcttttttttaagggggattcagacactattacctcaaaggagcagcgctgccttattctttttgctagatacaaatcgttaaccctattcaccaaacagcaattaattgtcaataaaacacatccacactgtgaactctggtgtcaacgtaggcttatcaattgtaacaactctgagggggatgttgatatgggggagaccatgcatgtctgaggtctggggctatctcttagtctgtttagggttgctataacagaatacccgaggccaagtactttataaagatttagctcatggttctgcaggctgtacaaaaggcatggtgccaacatctgcttggcttctggtgaggccgtttcatgctgcatcatagcatggcagagaaaatcaagggggaagtgaacatgtgtgaagaggcaaaacctcaggggcatcctttttataataacccactctcatgagaacattcctcagtgaactaatccagtcttccttgagcgagaactcactcgctacttcaagaacaacaccaagccattcatgagggatctaatcccatgacccaaacacctcctattagacccacctcccaacactgtcacactggggatcaagtttcaacatgagtgttggtggggacaaactcaaaccatagcagatatatgggaaatttctgtaccttctgctcaaaattgctgtgaatctaatagtgctctaaaagaattgtcttaaaaaaatacatacacatatatgtttattctctttaaatataagaaaataataaatcctatccataatttcctaaattatagttagctctaaatgtaataagaacacatttctatgacgtgatgcactctgagttttttcaacacatttgttccttttttattccaaaaactatggttcatgttgttccatggccaatttgccagatgcttcaacattccctgctggaacgcacctcagacagggctaagtcagggccttccaggggcatggcaaccatgaaaactgatcctgggaaactgacctttaatatattttcatagtaagctcagaggaatgtgctgggtgattacccattacttgtacctggtaaggacacaggcctgaagctagagtctttgcacagtagagatgggccagcaagatataaagatgtccacagaagtggccaaggaaaccactagaatgcactggagggagcctcaatccagtcagttgctaacactggcagtagggccttccctgggatttgatagcctatgcagctgtcttcatgcagttcagattcatgcctcctttacttaccttacagagctcttgccaacatggtcaccctggtgacaaccatgtgctctctaacagaaatacctgaccctgctcaaggtattagaaacaataagagaataatttttaggagacttgagagaggtcttaaaactgtgctcatatgctttttttgaaaacatggttttcaaataaaagcaagggttgagacatccaaggagctagtcgctctccctctagtccttcggccttcctttctgcctggtgttgcacattgcctcccacacgccagtgctcacagctgctccactgtgggtgtggctgttccttctcttctctatgcttctctctttttaggctcatataaaggcccacctcctccaagacaccatgtaagatcaattttctacaaccacttgctcctctgaaccccagagttccccaagggtggtatgtcagaggatttaatgtgggacccaacaccattattttaatttttaatagctatatttgctttgagtcatgtgaaattgatgtttctgtggatttaaaaaatggtcaaatattggcagtttcatgtagttcaacctaatatgtgtcagggaaaaaatattaaaagaaaaccagacatcattgtttaggatgaggctaaaatgagtactttattgaactgtgtaaaaatgaataagtaaataaacgttttgatggtacagatacagcaaaaattattaagcttgtatccactactgaaccactgaccaaatgtattttgacaatcactgttctacgtgtccttttaacgtgtcttattattgtgtgtgtgtggtttttttttttttttttttttttttgtatatctatgtatttgtgttttctcttccattagtttcctggatatttgtacacaagaggcaaggagagattacaaacctcttagcataatacccggcacgcagaagacggacttgacatagggatttgtctggtcacttatgatgagatcttaccaggaaacaccatttgttttccttatggtcattctaaaactggaaactgatgggccacgcaatggagtatgccattccagccaggaaacctacaacctggagcaaatgaaaacacaggactcctatggagcactccacgctgggagctaacctcaccactgggaagcattaaggggtagtgtggcctgttggtcagaacatgaccatctggactcattctcagcagtgtgattgtacattacatcctccacttctccattccaactgacaatgccaccaatagctgagaaagtggaggccatgggaagctggtacctactaggatatcctattggctcctgtcctctctgcccagttactgaccacggcaccaagcttcagattctgtttaatactgtcctttacacaatggtgcctgggtcttttgaaatggatagggataattatgattcatatgcttcaagaaataaaccacggtactcacacaacctacatatttcatttctattttaaaaacacaaaatacttacatgctgttggtgttttgaaagcttttgccacttatgcttttttaaatataatggttcagaaacaaaattctgcctgctaatcagtctttatttccattcataaaaaattatgtctccataatacctaagaggtcaataactagatgttgaaacaaataatattaaagaaaaatatttattgtagaagtctgtggttgaggcagaagaaaggtgttattttcatctggggtatcaagaaaacaccatgaatggagaagaatatggtctgagtctcaaaggattaaaaaaaaaaaaaaaccaacctatgtgggaagagagacagagagaaagtgcgcaggcagctcaggcaggaaatggtaaactcaaatgtgtgaaatcgggagcgttggaggctgctgaaaggacatagctgcctctttactattttacatttaagtcaagttattcagattatattggtctctgtatgtatataatgacaatagtagttttattctctaaaaagttgctttgagaaaaatgtcaagggatttaaatgcatgcttccaaagtacaatgttttcctacataaagatgctggtttatcaactagaaaactaaagtgggcttctttataaaagatagactgaaaagattaggaaagtcttgacaatataaacatacatttactcaccaactcatgaaatactaaaactaggttttactgctcaaagaaagcataaaatagatcatttcagtagaaagaaaataaagcacattttttacaacatagaaagtaatctcagaattcattaaccaagagaccaaaaacaatacctaaaatattatatatgttaagggagctttaaataaagtcatggagagcagatttacaatgctttaattgaaccaggataggaatggcaggagtctgttcacaacctttcatggcagagaagagttatataacagccttgatattggccagctgcaaaaaaagtcaataacaatatgaagatgacaggacttttggaagaaagttactatacagcttggagttcataatattatgtgaggatagagaacattaattctaatcagatccacatcattatttacagaaaacttttttttttaaggttcagagaaaatacaagtgtgatataaacacacaggtatcagggctaataagtgtaagagagatttagaaaaataaaattttgattctataactggatagtcataatcctagtgaaacaaaaagagatgccactgtagaaatcactatggcttacaataatttctctgatgaattttgattctaaaatgacaagtaataaatggaaccaaggacacgagggtaaagacaaacaccagtgtgtgggaataattcctagaagaatgctgaagaggcctaaatacaggactgggatcgaacattttgaaaaaacataccaaagggatgtttatagaacatattttttaaagtcttcaaaagaagaacaaggaaaaatagcaatacttttggggaaggccattaacaataaatagcaaagatgacagaactgttcaactcccattttgtgaatccacccctgcaagcaaaataatccgcacattgggaagggtagaataaacaaaatacgcatggaatttcagcctgacgtggtgatggggggatttactcaccaacccagagctagcatcagacattcacagaacaagccagtaagacccaatcctgcaaccaacataatatgacactaggttaaatgcttccactttcctttcccgaaaatctgagcttgtggcaactttatcgggattcaatcatttgaccttgagaacttagtgcaactatggaaatgacccataatgactaccggaattccaaagagttggtgccagttttagaatgacaacttactaggtttgtgacctggggcaaaagatacaggatgagactgattttcacatattagaagtaaagcggatatagaaggtgaactagattagttaagcaatacgccaaagaatggacttagtgccaatggttagggtttatggcggaccgatttcagggtcatccattctttttcccattcattcagtgaatatttagtaacttccactgtgtgcagcaccattttaaattctaggtgaacaagaaactcactccaaagaagggagacctggaaaaataggtcagtataaagcagataaatgggtaaatgcattaaaacgcaggttaacagaaacaacacagaagaaaaaacaattaactttgaaggtaattttagattttctccaaggttaaatagaggaaaaaattggtggggagggataataaaacaccttaaaatgtgtttcaggcatgacaacactatgatcaaaaatacttctgtgtgaaaagtatgtggcatgatacagaaaatgagtatttttgtttggctgtagtttaaagggaacatggtgaaaaagtggagaacgatgctaacaatgtaggcaggggtcatgctaaggagtttaattcctacaggcaatggagaccaaatggaatattttaaatggggagtgacagggtcaaatttgtaatttagagcaataattcttagagaagtacagagtaagctctacaggaagacaagcctgaggagggtaaatctatttggaggtaattatgggagaccagacaagatgaggcagtggcagcggagatgaagagagggaacagatttaagaggtacttctggagacagaagagatagcaattggaatgtggaagtgagagggagtgagtgacatgtgtgagggcccaagaaggtaacattcaaaaatgaatcccaggtttccacctcaaaggaattgttggataaaaatagggatttccatggcacaagaacacttaaaggattagtttagttcaggaggaaaatgtaagttttccacagagcaatcaaatgcttcaatattaaacttacaaaccatacaaaaatgtatctgtcccctggatggctatttgcttccctcagtagccacaaagctatgttgtatgcctggcacacagtggctctcaacctctgatgggcattggacttgaatcaaattgcctgaggagacttttccaaatgcatatgcttggtcttcacccccaggagattctgatttagtggatctgatgtgaggtgcaggcattttttaaaacagctccaaaggagattctgatatgcatccaaatctgacagccactgtagtatacagtcgatccatagctctttgagtgattagttaaaaggaggaagggaaggagagggcttcttgaaatttttgaagaagcagctggttgactttctatgctcaacagtgtattattgtgtgagaaatttactaaatgaactttcctgtcttttaatctttttttttttttttttttgagcggagtttcatgcttattgcccaagctggagtgcagtggtgcaatctcggctcattgcaacctctgcctcccacctcccgggttcaagcaattctcctgcctcagcctcccgagtagctgggattacaggcacccgtgggtcacacctggctaatttttttgtattttttttttcacttttttttttgagacggagtctcactctgtcacccaggctggagtgcaatggtgagatcttggctcactgcaacctctgcctcccaggttcaagtgattctctgacctcagccaccacgcctggctaatttttgtatttttaatagagacagggtttcaccatgctcgtcaggctggtctcgagctcctgacctcgtgatctgcccacctcagcctcgcaaagtgctgggattacaggcgtgagccaccgtccctggccttcctatcttctaatcttaagggtccacaaatgtgatgttatagtgttcctggcttcaacttgcagacagaacactggctgagagattactggactcactcaaattcaatcttttcttatatttttttacattattgatgaacatcccttcttatagcaactcgttctttaacattttttgtgtgcttttacatatttttcatttacttttttctcaatgtctattcctcctactagactgatgttctatgaaagcaagcattctgtttcttttgttcactatcgtgtatgtaagcactgacctagcaaaacacacacgttcagtcaataaatgagcaacgagccagatttttctggtgaaacatttgaagccacaatgcattattttcaatatgcctataggtacatccatgagtgtattatagattcagaaaatggtttcagaaataatcaaaagcatacagctataggcaaaacatgtttatatatatgtatattttttacctcgaggaaacctttgactcccaaaatttttatgttatgtaagacagccccttacatcagcaaataaaattaaaaatagggaataaatatctaaaagggtgaattaggcacagaggtgtagcctgagaaatagaagctaaacctcgttcctgttccttatctattaatagatctcagaagcctgaaccttgaagtctgataaatctagagctttcctgtcatttatatctaatgatcaattctaacagttagacaaaaaaccactaaatgaatgaaaagatgaattattgagaaacttagagggtcttttagcatggcaattaaagaagtagaaacaagtggctaacttgaagagccagaaatgttaaaaatctctgtattaatagtgattactgaagtgtttttaggttccaagttaaacatttgctgacactgcttactacaatatgtaggtaactcacgacatttttaaagacattttactgccctgagattgaatgtgagtttttttaacaaaaaaattatcaaaatcagaattctactttacctaaaatttgccaagcaactactatctgctactactttcgcatgtatcatctcatgtagtttccataaaaactgtactttaccaatcagaaaactaaaaataagagcaaccttagatgaatgcctaaaactagaatgctataaaaagtgttaattataatacaaatcactgaagtatcattttatccaggtaaatttatacatatgtataaaagtgtatttttaaaaatactaaatatgaacctcaatcataagaatgatacaagaatactatgttttgattaatgataaatttggctaactggagaaaacattgtttcaactgatgttatcaaacaggttttgaaagcagtaataagacacattgacatgatatgcttgatacacttgagaaggttacaccacctctgtggtattcttgccaaaattttataacctcaatttaatcatgaaagaacatcacacaaacccaaatcaaggatattctataagataaccagtacgcttcaaaaatttcacagccatgaaagacaaaaaaagactgaagatctgtcctactgatttctgatatttctaatgtaagatcagtagtcattacatactattggttgtataaatataggcctaagaaattggaatgattccatgttgcatccagcgtattaactaagtgttatgatgcaaagttgtttgtatattagctgcaatttcccccatgacttataagaaaaaaaattccttattaactaatgactccagttaactgattgaaattacattctactaagctaaatatacatgtcatttcttacaagggctgtatgtttttataaatcagtatctcagctcgaattgttggaattatcatggttacttccattgttcagacaggaaaaaagacaggagtagtaaaacaaagggagaggggccatttgcagcaaggagaaaggaaacacgattctaaaacacattcattaacccagggctactactagatgctctaggctagaaatgaccaggctgcttctaaacagattttaatttttaattcagtagaataggtcagatacagctctcccacctggaggtcctgccctagaacctacctgcccgaaggcggcactgcgggtctgctggtaatcatcatctttgggcaaatgaaatctccagtcagctacacccgctctgtatgttgtgatcccaagaaccagtaataaaagttggacaagatctcacaatgaagtggaggttttctccttcgattttttttttttaggagcaagaaagaacacttttttttttaagccattagaaatgtttttaaaggtagaggtagaaggagggatgttggtgtttgaaataaaattctaataaataaagatcagttttactacttaattaaaattgggtagaggcatatatgtgggtccaaatttgatgctcaccatacaaatgcccagacacgagagagatctcctgggaaattaaaacgcctacacgtagggagaattgaacagaccagggccccagagcctccgcacatggagctaaaacaagcatagaggagccgagtcggactgattccccagctcttcacagcccccagattagctgggtattagtgcaggctggtctcagctgcccatgaaaatgagaacacattttaaaacctgcatttgaattttaaaggtactcaacatttctagtattgtttactgaaaaaggtcaacactcaagtgttttatttatgcacggcagaacctcagtctaaaagcactaggctttccatatggcatagcctgagaatgtgttaaatatgtagttccagagccaagaatattatttttcaacttagcgaatgcattattaaaagacctctgctgtgcccaccactgggagatagggcaagaggcagcagtgaccctgcattctgaatgcacagagacactgacagtcactcactctaaataccaatgacaatatccccaaacccacaccaccctaacccatgccttgctctgaatttgggcagtctggaaaaaatgaaaatggaaacctttaaataaaactcataaaacttcagttccaagcacaatatttttggttctttggacaataagtgtttcactgagatttatgcctagggtccttttccatatcccggctctgtgtcagcgttcacatcagccctcagttcttcttgcaaatcaagggtataatatactgattccttcaaataatatttgtgttaaaatcattaaatgcccatgcaagtaattttttattaatgggatgagaaataatacataatacataccaattttatgacagcgagaggagttattaactttagaatatctgttgtataaattaaaaatcttaagaataagtccagtgttttaaatatactatggaaaaacaaaattaatgccaggagaattttgactggaatatagaaatgcctttatcattctgggaaaaatactaccctataaaagccacatcctctgataagttcagaaattatcctttttatataaatattattcacttggaaaaatgttttctataaacagctcccttagtgcattttaacacatacttttatttacagacattagatttacacatgtttccagtataaatctttcgtatatagcaaagagaatctgtgaccaaaaattctgttcaattcggatgtggggagcaaataaatgaccaatgttcccatatacatagtaatatatggctaattttatataacatgttcacattaaaaataagaacataaaaatttttaaatcttcaggaactgtcttcaggaaatttcagaagactatgacttttaaattacgcttttacttgatccaccttccaaaagctcagaatccttatattaaaagagctggcactgacataatttgatttaatcctgtaaatatgcatggaagtcccgatgtacatcatctactatgctctgcctgcgtgatgcaaggtgaatcaggcaccatccactgtccctcttgttaaggagtccacaactgtgctggcaggacagacacgtatataactgattataatgtacttgagataactggtatatcccggtggtgggaataagaggctttggcagcacacggagtaaagagcgaggatcctggaaggcaacctgcatgtagggagagtggaagctcacccgaggaggtgacatttgagctggttgtaaaggaagaataggatcagaccaggcgaaggagaggcattccaagtgaagaaaaaacaattatccacacatgccaagtttttcagatttgacttttagaagcgttttacttcaaaaaggtttaagtgtgcaatgtctaacaagaagcaaaaattacaatctagattgtttctttatgactagcctgctcttctcccacggatcctagctgtttaggaagtacaggtagtaagaagaggatgtgaagtactttggtagccacagagaaagtgagaacgctgcagtaactgaactaaagattagaattagcactgtaggcctgtgagtggggtcgggggagctaccagtgaattgaggaaaagcaaaagtgttttaagcagactgcaatagcaccccttttcagtctgcttaaaacataagccttaaccttcttaagaaagagtctgctaaaacacagtctgccaggcctatcaactacagggtctgcgaggaatttgctctgagctgggacctgttagtcatcagcaaggagagcaaggagagcggatcattttctttcaataatttaatcacactggtgtgagtggaggtgaaggctgagctgcaggcttcatattctacttctttcacagacggcaaaggaagagtagaaaagcaaggtcccctgggtggacctggagagagaaaaaagttctgggacatcccttgtcttcagctgggttctaggaaaaggccaggggtgacaatagctcaaatgaagatggccggtaaatggctgagaagaccaagaagacagactgtgacccgtttcacagtgcctaactaaaccagaatttcaaattcttaagttagctagaaacatatttcatttattcacattttaaaaaaatcaagttaattcattcatattggcatttaaaaaacgtgtataagagaggtacaaaaactgaattgtgttcattgttcacctttctttgagttctacatacagagtcaagttgtaggagggatgtattcaggaggacaagccttggggatttcactcttttattattctctgtataaaagaagatggtttgttggatccacgtgccacccgtacctcttccctgggcatgtggccacgaggcagggggcagaagctgccctgggctagggagacctgggttctggcttccagttctgggtctgccactgacccactatgtgaactcgggctggtcacagttttctcaagtaagaatgagaagcaaggactggactggactcttttcctggctgttttctgctccagtgctttctgattctatagaacaatactatgttctagagaaatgtttccttctttctgggttttttttttttttttgatacggagtcttgctttgttgcccaggctggggcacagtggcacgatctcggctcactgcaagctccacctcctgggttcacaccattctcctgcctcagcctcccaagtagctgggactacaggcacccaccaccacgcctggctaattttttgtatttttagtagagatggggtttcaccgtgttagccaggatggtcttgatctcctgacctcgtgatctgcccgccttggcctcccaaagtgctgggattacaggtgtgagccactgcccccggcccactttctgggtcttatacatttcttttttttaaaaaagccactgcaataacaacaatgtcccatctagtgttaaaacagggaacatggtccaggactgcagaatgaggaatggcgctcaggtctttcctggcttgggggttctgaatggcgattgaagggcatggatcctgctcaggtggtttttgttggatctcaatgacccaactttttcaaagagggcattttttaaaagactgtgttttacaacttttatgtgtgatgtacaacaccagcataataggaccattaccaagggcacatggaacaatctttcctattatttttactggcagctatcaccaaaagcaaaagagcctcctgggatgcaggtcatcaggcagccccttcctgggagataagaagagattctgggtgtgacgcaagcaattcagctaagctctggctcctcactgaaatcttcacagacataaacctgggagttctgcagggtttaatcagttcagccttcccttttcattgctttctttctgaaagctcccacgaggaaaacatctccaatctgggtaatagctaaccacacactcagaactttccaggttccacagtagtctgtctcccttcttcctaaatgccaacccacaagaaaagaaatcaagggagggaacaaatgtaaatactgagacaatgcaggtatctttgaaacaaatgatcatcttccttcttgtgggtttgtcctgtgccttgttttttttttttcattaagtgccaagacaatttaatttgtaaactgccatataaaaatggcctcattttggaatctgcctcccttttggaacccaggtcagttccgtggaatatttgtggagtgactacagcatgccagacactgtcttaatgatgtctgggctgagagaacaaaatgagcctggactcagaaattctccatctcactgcctattgctcagagctttgtggcccagattaccagaattttcagtggcaaggatttcctttttttttttcttcttaaacctgagtttcttgatggttgaatacatcccagtggctccttatcttctagaatgcttaaatgcctactgggctgatggctctaactcacccgcttgttaacctgcgttgatctctcctaactggctacctctctatgccctccatggctattctgccttctgggcttaccttctagtcaaatacttggaattctcctgtttataagccccatctaacttctgcccaaccttcagccttggcttgccagtttaatctgtctctactgtgatccacatccccaaatcagcttggttctcatgtgccccaaattgtccttaactccctcatccaacaatcccatattcctattccacagtctccatgcccatcctgggggcacagtactctttgactaaagtttagaatgatagtctctggtcagtcctgtcctaccagtcaaaccctaatctcaatccaggtctggaagctgcgataatcttgagtacaatacgaactggtaatcagcaagtggggtagctcaaacagaatactggcaaatgaaatttgccttagagggccatgagaacatagtggcctctgattaataccaaagaaagaaaacatctagaatatttcttgaacacctagagtaatgcctggtacaaaataggagctcaaaaaattggcaaattatagaaagatgtcttttaaataacacattgcaaatgttgaggatatgactgtctattgtaagattcttctggataaactgtctgattcgtgtgtatatcccaagggcccagcacagtgcctgacatatagtaggcttgataaatatttgctgaactgaaatgactttgttgagaaaagtatgtcgatgtcacttggtggaggatatctacttttccagcagtgtggatgagcaggacatcttaggatgtctaaactaaaggatcagcttggttgggcccctaaatttacatgccaaggtgttcttaaggcactagagtatggaagtctatcagatggacagggaccacaataggagaggggtaggaaccctgcaagatagtctgtgccctgacttacattccctgtctactggaattctctggacctttgggttttatccagaatgcaggagatctttttgacacctttttcactcattcatatgcaaaagcagaaatctgggtctggccaagcatctctgatgcatacatgaaatgtacatgagcataaaacagccagctatagcccttctaatggagaccttcatagctgccataacagctgatggattggtgtaaggctagtagttttgaagttatattttgtatttattgttgaagctatcagaaatgtagagaacactgaggtcaatcaagagtatatgattttccaagtatattaaaatgtgtttgtgttcctttcatacaaaacataaagcatccatctttaaaatgttcacagcaatcaatgcctttaattgagcagaaaagcatatacagatatagaaatgtttagtcctagccgtggttcctgacaatcatcttcagagataaatttccacaatggatgtttcaattaagacagtaatatttattgaaaggtaaaccataaatgtatagccactggaaacattattgaacagaagtaatttatgctgcagctggtgcactgcatttttgcactgctttgattttatcagcatttgtcaattaatcaacatgaaccttgtaaaacatgttctcttattagttggaacaggcaattgcttgcaaactttgcaggagaggtcatttaataatttgctaattgtgcaaagacagatttaaaataaaaataaaaaaggttaactctcattaccattgtacctaaataggactttgtttaagcttaggcttgccaatttaaatattgtcaatggtttaatttttaaaaaaacttcaaacggcaaataaagattaagatgaagatcaacttagctctaggtttttaaaatttaagagcattttttgtttgcatctttgccatttcaaagagttactagccttgaggctatagttataagacaaattgactatattttattgggagaaaagtgaagagaaaaaagaaaaagcaaaagaaacaggaaatgcagcagcacaaagagcaatccagtagtacagttcttttttttctcccccttttttgcctcaactcattcttcattgatctagatgagatgtcacctccctacttttgactgctggttcattttcagttcagtaagtgagaaagaagctgagtcaagccctctctttgggtaattcatgcatcagcacactcgccaactctcctggcaaccaagaaagcactttaactcagagcggcatcgccaccaacaagcattctgcagccatctaaaaggacgcaactgagtttaaaacgggtaacataccttggagagcaatttctacactggggtctgcagggctgaatcgagaaatccgcaccatcttagaagtgtaagtgaaacttaaaatgaaatggcatgccttaaggcatttataagagtaagaattttgcacagagttcacagagacaatgtttgttgaatgaagatgggccttgccagatacagtctaggcaaagtgctttgctgcagagctccttttataagagtttagaggcccaagttgctctctgcctgttcaaactggcttatcaatccattccattccattctgttctcagttctaaataagtcattatttcacgcacatttccctaagcagacgcaaacactgttttccagtgtgagactcccttgggcaaattaggtttcttggaaaagggtcaaggagcgatcaaacaaaatacctcctagaaacaagtggtttcaggggacattgtgatttatgcaggctacaagtcaaattttagacactggttgggcagtaatgttgaatctgatagggctagttatggggagcaaaatcctgctacctgcagtttctttttaaggtaataataaatgggcgtatttcttatggaaacaaaactgatgatcataaaacaatcaatagaaagtttccttttctaatattttgaattaaaaggtgttaaacaaattttaatttcttaataaaattgtagtaaagtaactttcataaggcaaaagttcatatcttctattctcacagtcttacctaacaaacatgaaatacttctaaaatagatacttcttattgttttttttttgtttgtttgagtcacagggagaaaagtcccttttatgttcttttaatacttgcttttattaacctcagcttcagttagctcacttccatatatcaagattctttctacaaccgaagagacaagaggtaaatgcaaatgtgggaagggaagctgcttggtaacacactagctgctccctggcagcagttatttctatctaaagcatatataccatattaagaggccatagtgaaaaatgaaaggatggaacggcaggttttcatttgtttttaacattttagaatgctgtaaataagtttgtgtgtttcaattcaaatggttccattacctcggaggccttaatcatttgtaatagcaatttcggaagcgtccaaagcttgtgcttaaggagtattattggcattcaatatagtcatatgatattaagcagatttacaacgttctatgtggttatccctgatcatctttatttaaaagtaagttctggctgatgaggtggcttagtatcctcatggattttggcttgttagccgtcccctgccagaaaatctggctctgctggacaccctcacacctctccaaataaaccttaaatttgcaaggtgaagtggggggcagcagatggcaggaagagttcaactaagaaagaagtttacaaaggcagctttttaagaaaatgtacctggggttttggttttattcaagtacgacgaggccaacagatcaggaggtgactgtcattgagaggatagtttgtcacagttccaagaagagcaggcatgccagaccacactgggctacctggggaggcaccagggtcagtaggaggcagaggaaatacggggaaaatgtggggaagggcctttattatggtttccatggaaagaacaggcaagacagagtaagcagctttaggatagctaatttaaataatttcagcaggctctgtggtatagggacggttcctagttatgcagtacctggccctggagtgattcagggcaggtaaatagtgttctggattgcaggagcctgataaaaggaagcaggtagtggcgtggactcaggattggttggtttgaatatcaaaggcgagctcatgggcaagatgtttgctatctctaggtatcagctgacccaggaaggtttagcatcccaagtccacaaggccccaagatgtcaaagcactgtaaaatacagaaaatttttaaaaacaacaacataattaatagaagcctgtctgaaacactgctataagaaacatgaaaacagagcttctgaaacttcactgtccacagggatcacccgggtattttgttaaactgcagattttgattcattaaatcaggtaaacgttgagaccttgcatttctcataaacttcttggtgatgttgggaccacattttgagtagttagaagtaaaaatatcatgaagggtcttctctctggctcatcttcggtcaggaaaggggaaggaccttacataccgagtcttaccttggaccagacgctgcaaggcactgaatatatatacttggtcttattttgctttaagagcaaactttgctagtgggaaaattatcccaattttataggtaagggaactcaggctggttaagtaacctgctctaggtcatttagttaaaaggtagtagatataaatgtatctggcctaaaaatccatttttctcccaccacaatgtaagtacacagggcactcctctgatggaaaatgaaaagtctgttggtaaaggcttcataaaatataaagcccatgaacttcaatagtggcccatttacaacttgacttatggaaagaagagaaatcagaatggtacttattgtctcacaattagaaataaatggtgtttattaataagtgattattttatcatagccttcacaaaacactttaaatgggagtccctataaaactagtgtttttattaaaaaagatacgtacatgtacatggtaagatatatacaataaaaagttagtcttgctcctagtctcctacttctactgctcacaggtaactactgtgaagtttgtatagccttgcagtactgtttctatgcaaataataaacctttctcatataaattcattcatttggttattctaggtacttggggaaaagcagtaaataaaacagacaaaatcccttatgtaggttatattccagtatgaagatagatcacaaataaacaaataagttatagattatatcagatggggataaatgctaacagagaaaaaggggagagcagacaaaacgttttcaagtacgaattcagtggttaaggaaggcctcattggaaaggtgacagttgagtagagacctgaaggaggtaatcttattccacacttactttttcctttaacagtacgtattaaatgcttcaccacagcagggcttacagatctacctctttctttcttttttttattatactttaagttctggggtacatgtgcagaatgtgcaggtttgttacacaggtatacacgtgccacggtggtttgctgcatccatcatcccatcatctacattaggtatttctcctaatgctatccctcctcctgccccacaccccttgacgggccctggtgtgtgatattcccctccctgtgtccatgtgttctcattgttcaactcccacttatgagtaaaaacatgcagtgtttggttttctgttcttgtgttagttcactgagaatgatactttccagcttcatccatgtccctgcaaagaacatgaactcatcctttttatggctgcattgtattccatggtgtatatgtgccacattttctttatcctgtccatcattgtatctaactatttattttgagacggagtctctctctgtcacccaggatggtgtgcagtggcatgatctcagctcactgcaacctctgtctcctgggttcaagccatttttctgcctcagcctcccaagtagctgggattacaggtgcccgccaccacacctggctaatttttgtattcttagtagagattgggtttccctatgttgaccaggctggtctcaaactcctgacctcaagtgatccgcctgcctaattctcccaaagtgctgggattacaggcatgagccaccaacctggcctaccttattctttttaaagactccattgtaccccattgtttgcatgtatcataatattgctgggcttttgttattgccacaggtggatgttttagattaatcctgttatagtctgttagatgatcatttgaatggttataaaagagacttggggcttgtggtataaagcctgattaaatagaaagaaacctgaactaagcatgggaagctatgaatgcaagtccaagctgtgctatgcttgctatatcattatttgtggacttccttttttattttcctgttctggcctcatgacagggtttccattttcctggcatgtcttgggctgttcaccagccccagggtcatgtctaggtgattcttcagttggagacctaactgacatccttcccacagcaacatcagtgccaggctacctgtaaccctgcagagtcaaattaaaacttacaagctttccacattccccacgaaggaagtactagcaaacttttagggagcagtacctctgggctctgtgcacactctccgtgcttaggaggaaagcacatgagcttccttaaaacaaaaacaaaaacaaaaagccatacattctagtgatgtttatttttgcagatagagatgtttagcactgggtcatgacagagtggatttcacctttaatggaagattaatttgcccatttgattaatatctgcggcaatccctggaatatgccagcactctgcctggcactataggaggaacaaataccagtgtaatatggttcctgtcctctggtgttaaaggcaatacagcaggaatgaaaagaaaggggagaacactattatccggggtccctcaaagatccctcagagagctttttgagctaatatgtaaacaggtagggaagtgttcaagggatggaggtgctgcaaggggaccttggtaagggataagtgtatgtgagtgtgtgtgttaggaatatgtgtgaatggaaggtgaacaataattgcactacaagcaaaggaacagataaaggaaaatataggtgttgtacaggaaacatgaagtagctctgtttagtttaaagaaagaatgtggggagtaggtgtagatgatgggaaatgttggttagagtaagactggcagagggtcctgagttctactttgctattagacatgagatagataaatgagttttgaaagattaaaaaatcaccatcagcttcttcctctcttgtttttgctttatttggggtgtgggagcattgtccatgttggttttataatttctacttcttattccagtaatttttaaaaatcagcttagtatttattaaagtaatatatgcctatagtttaaaaaggtgaatagtattataaggcctataattaaaaagagtactcccttcccccactttgcctaccactcctccttcctgcttctcaggggaaactattttttttttttgcttttattatgaaagatgtttattttccagagtgtgtaacctcatatataggtaagacttttgctgcaatcaattgttcttggtttggttaatctatagtcttgtccagcgcaggaaaactagcactgtccagcaactgtaaccagggagattgaatttcaccatgggagaggaaaccacttttaactatgctatttacatccctatacttaagtactgtgtatatactgatatttattaacttattcttagagattatctgccttactactatgcaaaataaggaaaatttagcactctgatactatcacacgctcccaagttttctttcctgatctttccagtgggttaaatggcaacttggggttaaattgatattccagtttaccttactatgaccatgtaatattgtttactaccaagacaagtagtaaaagagtatgcgttcgatgttgttcaacatcttatttttcctggtgttgtcttttattttgctcacctcttttgtgtatctatcattaaccattcatgaactacccaaaagaactatagaacttatattgaaaccatttttttttttttttttacacaattagcccactggttagtctactggatctctttttccctggaggagcctcccgtccagcccctctggtctaggggttttccaggccagctgcccacctgttgtcctggggcttctttttaacaccattttgtgaaatccctatgcctctttcctgtgttggagcccccatttcctggatcccatgatttcctctttgttggtttacatcctcatttttgtagagcacattctctagtagcttcctgagaaaaggtacatgggaggtgaatttgttgagacctcatgtgtctgaaaatgtcttaattctactctcatactgagttaaacttgtaattgaattttaagtaaaatgtaattttccctcataatgtttaggctgtacttcattgtcttctagcttccagtattgcagtctcaggccactactattccttttaccaggtatgatcttttacatgtgacctgtgttactcctctggaaggttttggaatcttctttttaatcctggtattctgaagtcttagagtaaagaaccctaatgagctaatgagaatcttttcttacccatcattttgggcactttatggtctctgaaaatctggaaaatagcattgttccattttgacaattcttcttctattattctttagtacttgtctctgaatcatttttttcttgttttctccttctggcatgcttatggtaaaatatggaacctcatggattaatccactatatttctcacctccacctcaccccacgtccgtctgatatggttggctgtgttcccatccaaaactcatcttaaattgtagctcccataattcccattgttgtgggagggacccagtgggagacacttgaatcatggggggtggtttcctccatactgttctcatgggaatggataagtctcatgagatctgacggttttataaggggaaaccccgtttgcttgcttctcattctgtctttgcctgccaccctgtaagatgtgactttgttctttccttgccttctgccatgattgtgaggtctccccagccatgtgaaactgtgagtccattaaacttctttttttaagtaaattactcaatcttgggtgtgtctttatcagcagtgtgaaaacgtttggactatctactttctagaaagtttgacttctatacctctgaatcattttatattcttctataagtttaatttccaatacctccttcttattttctaattgttcctgttctatagaatgctttttattttatagatataacagtatctctcatctttctgaagttactataggtttttaaaggctttcatttgcttcctgaaatatctatatcttctctgagctcctttagcccctttctctgttttgatctctatattttattctatattttatgtcagtggatatcctcaaatatctgatggcccttcattactcatttatatttaagaaatatatatgtttatttcatatatatacattatatatgaaacaaacgattcatttatatttaaaaacagtgggtctagtttccaagggaaaccctgagtgtagacagggtgtgctttttccttgactggcatccctccgaggtaacagagtggggaatctaaccatttcaacagggactctgccaatcagtcattttttggactgagtttctgcagataagaatctccaaacccctgcctaaggagccagtccctagctgtaggttccctgggagctatgtcagggaatagtccaggagggtttcacctgttctctctgtggagtttcatcctctctcctgggcccaatccctgagtctagagtatctctgattcaatgtagcctaagactatccctgatacctcacatagggttggggaattggtagagtcagtgtgagctagggagggcagggcctaactactccatatactctgttggtctgaagctcctggcaatcaattctcctttttccagtctcatgactcctaagcctccacagcatcccgtgcatgaatctgaaggctttgctcagtgcacctcagctattcctcctccatcactctgctgtcttccacaaattgcctgatatctcacattcagtagcctctcctctgttctctcatttgctttgtgtccctgctttgtggtttttaaaattctttactaatttcagtgagatttattttttgttctttactaattttaatgagatttattttttattctttactaattttagtgagatttctggaacaggaagatatgaaagcatgtgttcaatctaataaaaccagaagtttctagtgttatacattttactttgtagttatatgtacttatgtattttgttttggtctagtttgtttgtccagagaactttatgagttacttggacaaactagtaaccacctcacaactactgttaaggagggtattgacaaaatcattttacttctttgttattttttagggattatcaggcaaggtcaagttgactttccataaatgttatctttatccagataacagcattttgttatcttggctccagaagtttggacaaataatcaatttgaggtagacgcatatcaatttatcaataagaaggaaggaagactataaggaggagggaagaaagaaagcagaaagggagggagggggaaggagaaaaaggaaacagacataaaagattttaaaacagaacagcaggaagactggcccaactaaataactatactaagaaaagctatgtatgttcactaaataagaagataaatttcggaaaatcatctggctttaagataattccaaacaatgatcactgacttggaaggcagttaagcaatttatgtcactgaatgttaatggtcaaactacgttttatcagtcaacaaaatgtacccaaaatgcatatgaaaagcagtatagcctgcaacagaacctatcacataatgatttttcacaattacatgtccagaccaacttctaactatatactgactcttaccactctgaaatatatctattttttggctcaagaatatatgtgtatatgtatgtaccaaggtatatatgtgtgtattcctcccctcatctcccaaagaaatttatgttagcttgcaggtaatccttttacttgaatatatgtttattttcctgcttatatttcttataaatttgtctagctcaaattatgtagtcctctatcctctgtcatactcaattatggaccaataacttttttaaaaaagttaactatgttgtcaacaacatcacttccaatgtagccatcatcatatctttgagcttaacaaaaagcttgactttacagtcagattgaccttattttaaatcccctgtcttccatttactaaataaactccccgataggaaaatggacatattctctattttgcaggattttatgagaattaaatcatacaatgcatataaagcacctggcatactgtaggtacccaattaaaaaaagctattcaagtcagaatatgagatgatattgaaaccttaagctgtctaaaagtacatcttttccaactgactaatttttcatttccattttttaggcatcgcatcactggtaagctggtcacctggaagcaacgcatcagttagccactgaaaaggggtgtgcagagctcttacagaaaattgagaaaatcattatattgatatattgattatattaagaaaatcattatattgctatctacttttatataagtaggggaaagggaggactggacaaaaacaataaaggaaaatatttggcccagcatcagtttcttgacccctttagaattctatttaactacaaaattaggaggttatatgaagtccctccaagtgttcaggacaaagagttctgtggttagatgattttgaaacacacctcgatcgtctcacacctccccctccccattcttgaagctttgaaacacatatgagtttattcaaggtatctgtcccattttgttttaccttccgttatacaaacttacttgactacagactctcccccttttttcttttctttcaggtaatatttattgacatactttggaaaagactggatgagttgctctgcgacttcccactctaacatatgtttctctgagtttctacaacttcagctaaatgttttaaggaagaaaagaacaacagaatatgtgctaattttgattgattgatgctccctcctatagcagcatacaaattttagagtgggagaaaaatctattacgatttcaatgaaatgagctattttatcttgtccctatgtggtaccatcaacattttagacagatgaacaccaaaccattgactgaattgctgcatagtggatttgccttgattataaagacagttgaatgaccagggtacctctggcaattttggcaatcaataagtaacatgaatcaactatgtagtggtcagactggctacccagtgctcaatcaaaacagaaaataacagagataagttaatccttaggttgcaggactataccatgataccagcataaaactcaaatggacattcatgatgaaaaaatgttaatgctatcattatacaataaactgctaaaagtatttttattagtaaaatactttcatttttctatcaatctaacaacacttatttttatctgaaaggagggtactatgctaaacgtcactgggactaaaaggatgtagagtaggaaaagggccaaagatcctaccagaaaatgatctaggagccatatgttagttctgtcagtaattttctatgtagctgtcaataatcctttgttttctctttgtaaaaataactatcctctgctgggtgcggtggctcccacctgtaatcccagcactttgggaggctgagacgggtggatcacgaggtcaggagtctgaggccagcctgaccaacatcgtgaaaccccatctctactaacactacaaaaaaattagctgggtgtggtggcacgcgcctgtagtcccagctactcaggatgctgaggcaggagaattgcttgaatctgggaggcagaggttgcagtgagccgagattgcaccatcgcactccagcctgggtgacaaagcgagactctgtctcaaaaaacaaacaacgacaacaacaacaaaaaaccaaaaccaaaaaataacaacaagaaaaaactatcctcaaggggcttattgtttagttaattatatttacaagtttgggatttttgctccatgccttcttttgttacaaaattatccttaatttacctacataacagagacaaaagtgagtgaatattttgatgttctttaattaattacatgccataatacccctccttcatcttaactgcagaaattctgtgagaacctattgcaatgttttccctttttctcttgatatgtctctttcccctcaaggctgctaaggttttaaagtgttctgtttctatttttttcattaaaaattctatcagaaaccccacttcctctcaagaggaaatttatccaaaaccacctctgtggtatccaagtcataagtgtgttggtagtaggatggccaactgtcctggtttgcccagtaataaggagtttcctactatgtggaactttctgtgttaaaaagtgggatagctgccgggctcagtggctcacgcctgtaatcctagcactttgggaggctgagggatcacgaggtcaggagatcgacaccatcccggctaacacggtaaaaccctgtctctactaaaaatacaaaaaattagctgggcatggtggcgggcacctgtagttccagctactcgggaggctgaggcaggagaatggcgtgaacccgggaagcggagcttgcagtgggcagagatcgcaccactgcactccagcccgggcgacagagcgagactccatctcaaaaaaaaaaaaaaaaaaaaaaaaaaaaaaaaaaaaatagggatagctctctacaaaccaagggagtaggtcgccttgggtgttagcttgagagaaggattggatatggcacggaaacctgcaccagagagctgcaattttgatcctattagaaacactcttctttcactgctaagcagctatgtacaacaatcaaacaccagatggatatatgaatttaatgacctttaagtttcctttacactggtggttctcaattctggtttcttactaaaatcatctggttagctttttaaaaagtgctccctgatttaactgatttgaaggtgagtctttgccatgggcatacatgtttgaagttccccagccaattctcatgtaagtcagagttaagaaacactactttatacacattctgagattcaaactataggcctagcaagagctgtttaaagcaaggagaaatctactttgtgatctctgacttgttaattattacatgcaagtttctacttcaactttaaaacaaatgagaacctgcaaactgactttatgtattcatctacattcatttattcacctagggttcatgatctataagcatctcccttgtcatgtttgtattctgaacatcaatcaccaccatctattgatatatatatttttttcttacaagaaactgtattaggcaccgtggggtataatgatttaaattgcaaggtctctgtcctcacggactctataagtagaatatatgaaaggtgactacatgatcaaggcaaatgaccccaccgccaaccaaggaggacgtggtcatggcctgggatggttaggaaatcttcatagagcaggtatgatttttaaggggctttgaggactgggtggaattttaattagagagccataaataaaaactacaaaaagggagaaaagcagtttgagaatgagtagggaggaatcagtttaccaaagttaagtatgtatacaaataatacagttcaccttttgagccatgcaaactgtatctaaggaggcacagaaccttgtatgagaccaactgctgagcaaggaaatgtaattagcgcaatcacttttttggtgctaattacttaagacattgaaaaagaggattagactgaccaatgaaacaattggttctggataaacatacaaagcttggtctgtaatgtggagaacaagccactgaatagcaatagccaagccccttccctctggtgctgggcccactcaagagacctgatcacacagacagtgaggcaggtgctgcatagatcactgcaagaaccccgagggacccactctatctgatccagtgagatgatttagggttgaagaaataaatttagaacacaagtcatgtaaaaagtacatgttactttatatgtgatgttatgtgattatcagtcattgattttcaattacttttataatgcaagagcttttcttctggatttcagaatttaagaatttctgcgccatttgtctttgcctacgaaaatagttaattctcatatttattccaatagctggtcttcatgtaagatattaactaaatgcccattaatagtctgggtatgcaactcaggaagtcagttggcaaaattaacatttagaagtaggcaccactggttatttcacacattattaacttatattacaattcaaataagcttacagctggcaaaaaaatctcttctgtaaagcgatctcaaacataataggcttaatcagagataaattaaattaggcagccatgcatactacagcatattaattctgagtagttattactacattttctgttatcactggtgtgaacaacattatgtgcaaacaaattcttcgagagggtagcaaataaagtttatgtttgggatgccatgtgcctagcattttcccatgttttcttaaaatgttaaataatcttttctgctaataatggcactaggttaagtccccataaacgagtcaacctcactcccaggaaattaaacaaatgaacatcagacgaaactgctaagtgtggtttggatttttccaaagggaacttctcaactttctctggcaattaaaaaaaaatttgttaatgagtcatagctagagcaaaattgtccaaaatgtaaggtagtgcatagtcgttacgttaaaaatcggtgcctctcattctctgttttggatgaactatgttgccttagaatactcaaagaagaaaattattcaggtagaatgctattttctaaataagatcctgccattatctctctctttctttaaacggtagtaatctaagccagcaaactagcactcagatcccacacgctagcaaatgatgcttttgtgaaagaaaatgaaaagatgcatctaacctttatacacacacacactcatgttgccttttttgatgcacttttgtcagattatctgattctttgttaatgaaccaggccctttaatttctgtatccaggagtaattcaagttactaggcatgacagccactaccgcccccaagtctgagaaacatgtttcacattctttgcgctttgcacatttaaaactcaatgtaaggtgacaagaacattaagctgcccagtgagtaaaatgtgaaactaatcactatctgttctacagatagtgggtacaataattggcaaattaaagtgcctgggaagagctgggccacctgcatcaaaaagcatcaccttggaatggctaatgaagataaatgtatgcagctagctttactgacaactacttcaaacaccagcagactgaaaaagcaacactacagtacttatttcatttactgtaaagtacgcaccatgtgaaatttttgttatttaaaggaaaaaatacccaacccctctcaatatgttgtacacatgccggctgaatcgaggctagtacttactcctaaaaagccaatgcttttcttttaaactggcaaactgggatcaatttgcttattaaaacgttgaatttgtattttcatgacaactagattcaaataaattagaagactacaaaaaagaaaataatccaatttcaataaaattgctactcttattcatccattcatttatttgacagttattgaatacctactatgtgcaggtactgtgcttgacatttggcagagagagacgaatgacatctccttaaggaggttgtggactatttgcaggcaagaggcatgcttacaggcacacacacaggcaactagaaccatgtgctattgtagaaacatttcagaaaggtgtccctttcccttagagtctttcaagagaaggctcactcttaagctgaattctaagatgatttctgaagagtttttgagggtgagtaagcttgagaatggtcttccaagctgaaaaaagtagcatgttcaaaatcaacaagaaggtcaggatctgcttgaggaaaaaaagtgccttcaaaatatatgaaggaaataaatacagaaataaatataggaggcaagaggtcaacagatgatgaagatgaaagctagacaagggtaagaatatgaagggccccagaagatatgttgaggagcttgcatttagttctgcagggcagtacttttcagaatatgtgacagagaaccctggggacctggggaaggagggaggcagcctggaagggagtgaggagtgagaagaggctgagcagtcaggactcaggccctgtacctctactcataccacaagagctttgccaatatctgtttcaccttttgggccttcttattattagtgtttttgacaattttttatactggaataatcttaaatttgcagaaaaaattgcaaagataatagaaagagttcctacatactcctcccccactttcccccactgttaacatctcacattaccatggcctggtacgtttgtgacaactaagaagccaacattggtgcatcactactaactcaactccagacttcatttggattttaccagtctttctattaatgtcctttctctgttccaggatccagtccagtctaggatatcacattgcattgtgtcatcatgtctcttcagtcttttttggtctgtgacagtttctcagttttttcttgcttcccatgacattgacggtcttgatgtgtattagccaagtatttttaaagcatgccctcacttttggctgattagggttattgggaagaatatcaccgaggtaaggtaaacttctcatcacatcacatcagggggcaggcaaatgacatcagcctgatttatcatggtgatgttaaccttgatcacctggttaagataatgtttaccaggctttttcactgtgaagttactatttcccctctttggaagccagtcataaatccagcccacatttaagggggagggtaagcttcactatctgaaggtggatatatctacctgtactatttggaattcttttagaagaaagactctatttatttatttgttcgattgtttatttatattaggatgaactcagacatttattttatactttcggttataatcaaataccatgttatttattttgtggctcaaattgttccagctttggtctctgggagctctattaaattggttcctgtatgcctttcacatgcctacatctttttgttttttgagcacttatttttttagggcataccatgtgctccaagatcttgtatttttactgtcccagccacaaactcagtcatttctctgaggatccctagttcctattattggaggataatatttagaaaccacggtctgggcactgcatgtgcttgatgctactgaggtatcactgctcccaggccccctcagcagaaagagccaagaagtataaatacatattcaaacccagttatatgcacatgtctataattgtttctgtgtctgtccgtatgcatatttatcaaattaaatagtagttaagctaacatgaagttagctgatatgtccaactctaatccagcattacagggtttgttgcagccccctctcctagcttatggaaattgtcctgacaatgagaaacctggcttgcaccacctaccatccattcatttatttgttcagcctcagtatttgggtcttcttttgaagagatttctgttactttaaaataataatatataaaagggctttatttttattcattaccatcactccaattgctctgttttcatcaaatcatttcatgtttctcctaggcacccaggaagactataattctcatgatcccttgtatttaggtccagttccagttaaaggaatgtgggtagaagtgatactgaccacttgtagccctaggctctataatctgttgtgggattctctacatatattgtctatttttttgataccaggtataagacacagtggaaaattccaataataaaagagaaaaactatatgacgattcaatggaaacagaaaaaaatcttgaaaaaagtaaaaatccactaaggatttaaaaacaaacactcatcaattagaaatgaaagagaacttccctaatacaataaaatgcatctctgaaaattctacagtgaaaattatacttgattgttaatataataaaaaattcctcataaaatcaggatcaagacaaagatgtccactctcaccacttgtactcagcatttactcctcaaatgggaagtctgagtcattataataaagaaaaagaacaactacaaaaaatagaaaggaacaaaactttctgaatggtatattttgtataaaaaatcccattaaacctaccaaacaactatcagaactagtaagtagatttacaaaaattatagagtacaactttatttttttattggagatataatttatataatgtatagttcactcttttaaggtgtacagttcaatgctttctagtacattcacaaagttgtgtgaccattcttcttatctaattccggaaactttcatcacacaaaatgaagtcttgtacccattaacagtcactccccattccccccagcccagtcccttataaccactactcaactttctgtccctgtgaagttgcccattctggacttttcatataaatggaatcagacaatatgtagtctgtgtgtctggcttaatgtgctcaaggtttatccattttgtagcatgtaaatgtattccattctgattttaggttgaataatattctgctgcatgcgtatatcacattttgttcatccattcatcagctgatggctatttgggttgtctattattttggttattaggaataaaattgctatgaacactcacatacaatttttgtgtgaatgtatgttttcagttctcttaggtctatacctaggagcgagataactctatgattaactttttaagaaaatgtcaaggtgttttatcaaagtggttacagcactttacaatcccatcaaaatgcatgaaggctccaaatttaccacatctctgtcaacactgttattgtctgtcaattttagacaattactacattactatatactatattactatatttactgtctaaaaatgatagactatagtaattcgacagacagttaaaatagtaacccaagtgggtatgaagtggtaccacgttgtggttttgatttacatgtcttaagggctaataatgttgggcatttcttcatgtgcttattggccatttatagtatcttctttggacaaatgttattttaaaattttaaaattttaaattttaaaatttctttatatatctggtatactctttatcaaatataaaatttgcaaatattttcttccatctttgagttctcttttcactttcttgctagtgtcctttgaagcacaaaagtttaaaattttgataaagtctgatttatctatatttttcttttgctgtacatgcttttggtgtttcactcaagaaactattgcctaatccaaggtcataaagatttatacctatgtttccttataagaatttcatagttttagcttttacatttaaatcttggatcatttttaatttttgtatatggtgtgacacaagcatccaaattcataattttgtattattaatacatgtggaaatccagttgtcccagaaccatttgttgaaaagactattctttcttccattgaattgctctggaacccttttgaaaatcaactggccacagatataaggtttattcatggattctctattccattccatttatctatctgtctatccttctgccagtaccaaagactcttgattactctagctttgtaataagttttgaaattgggagctgtgagtcctctaacattgttctttttcaagattgttttggctattttgggtctttatatttccatatgaagttcaggatcataaattcctttttttttctttttttgagacagagtttcactctgtcgccagctggagtgcagtggtgtgatctcggctcactgcaacctccgcctcctgggttcaagcaattctcctgcctcagtctcctaaatagctgggactacaggcgcatgccaccacacccagctaattttttatatttttagtagagatggggtttcaccatgctggccagcatggtctcgacctcttgacctcgtgatctgcccgcctcggcctcccaaagtgctgggattacaggtgtgggtcaccatggctgccctataaatttcttttaaaaagccagtcaaagcaggcgcagtggctcacatctgtaatcctagctcttagggaggcagaatcaggaggatagcttgagcccaggagttcaagatctgcctgggcaatatagtgagaccccattctccacaaaaaagaaaaaaaaaaaaaaacaaagccagataagattttcatagggatggcactgaatctgtagatatatttggggagtactgacattttgctaacttaagctttctatgattatggtgtgtttcaccattatttaggtcatgattaatctctttcaatgatgctttgcagttttcagcgtgcatgtcttacactgcttttgttaagtttattcctaagcattttttattgatgctattatgaataaaattgttttcttaatttcattttaaattgctccttgctagtgtatacaaatataactggtctttgtatattgattttatacgttgcaacctcacagaactcatttattagctcatagtcaatagtacattattgactagaagtgggtagagtagaaatgtttgtcttgttcctaatcttaggtggaaaactttcagtctttcactaataactgtaatgttagttgtgggttttccatagatgttctttagctggttaaaaagtttccttatattcctagtttgttgagcatatttatcatgaaacggattttgtcaaatattatttctaagtttactaagatgattgtatgtttttcttttattctattaatatggagtttataccgattaattttcaaatgtttaagtaaccttttattagtgggataaattatatttggttctggtgtatagtcttttttatatgttgctgtatacaatttgctagtatcttgctgagaatttttctacctgtattaataaagaatagtggtctacagtttcctttcctcttatgtatttgtcaggttttgctatcagggtaatattacaattgtagtttcatctattaacaggaaactttgaaaaataaaaattttaaattctatctgaaatatttaaaaataaaattctgagtaataaatataatagtaggtatttaagatgtttatataaaatattactgagaggttttaaagaagatctatataaatgcagagatagtgtatgttcatatattggaaggcttgatattggtgagaagtcaattcttcccaaactgatccctagaataaatatattcccaatcataatcccatttggctaatttcttagaaaccaggaacataattctaagataaatctaaaattttacaggaactaggatatacaaaccaattttgtaaaaaacaaaaaaagaacaaagatggaaggcttataccatctgacttgaagacttactataaagctacagaaatcagtgtagtctggtacactgatatataaagagctacaaaaccaatggaacagagcagagagctcagaaatagatgcatatttatgtggtcatttgatctttaagaataacattaagaaattccagtgggggaaaggaacgtcttcaagtagtgctggaagaattaaatatccatacagaaaataaaaaactctacactgacctcacacaacaaataaaaattaatttaatatggataataaatctaaacataaaaagctacaactgtactataaagttttcaaactatatgtgtgtgtgtatatatatatgtgtatatatatatgtgtgtgtatgtgtgtgtgtgtatatatatacatatatatatacatatatatacacatatatatacatatatatatacacatatatatacatatatatacacatatatatatgtatatatatacgtatatatatatgtatatatatacgtatatatatacatatatatacgtatatatatgtgtatatatatatatatataacagagataaccttgttttagacaggatacagaaaataattaaccatgaaagaaaaagaaagccctgataaattagacctcaaaatttaaacttctgctcatcaaaagacatcactaagagaataaattagcaaggctcagattggaaggaaatacttgcaaaatatacctaataaaatacttgtttatatatttacatacatatatatttttatatatggctcatacatataaagaacttctatacttcaataagaaaaacacaaataatccaatttaaaaatgggaaaataactgcaatgaacactttacagagaaaattatataaatgaccggtgagcatatgaaaatgatttcgacatattagtcatcaaggaaaaggcatattagattactattaaacatcaccacaaacccaccaaaatggctaaacctaaaaagtcagactgcaccaaatatgggtgaggatgtagaacactaaaactctcacattttgttggtgggaatataaacaattactttggaaaagatctggcaatttcttcaaaaattaagagtacacctatctatgaccagaatcctacttttagatgttgacctactataaatgaagacctatgccctcaaaaacatctgcacaagaatgtttatagaagctcattcatactagtcgaaatgtggaagaatggataaacaaattggtaaaatggaatacaactcagcaatagagaactaccaatgaactcaagaacagactgatctcaaaaacattatgctatatgaaaggagcctgacacgaaagagtatatagagtatggttccatttatataaagccctgaaagaagtgatttactcttggtggggtagggatactgggaggggcctgcaggaactttctggggtaatatagattcgggtgcaacaggcagatacatttgtcagaactcacggaaattcactcataaaagttgtgtgtcttatcatatgtaaattttacctcaaaagaaaaaacaaagaatcgtaaaatttaaattctggtaataatgcacacgttcaagtatttaggaggatatgtactaatgtctataacttgctttgaaatgtgtccaagccagaagtggtggctcacacctgtaatcccagcgctttgggaggtcaaggtgggaggatcacagggtcaggagatcgagaccattctggctaacatggtgaaagcccatctctattaaaaatacaaaaaattagcctggcgtggtggcaggcgcctgtagtcccagctactcaggaagctgaggcaggagaatggtgtaagcccaggaggcggaggttgcagtgagcagagattgtgccactgtgctccagcctgggtgacagagcgagactccgtctcaaaaaaaaaaaaaaaaaaaagaaagaaagaaatgtgtccaaaaataagattcatgaatgatgaatggacagagggatagaatgatgcacagtggtgggtatatgagtatttactgtaaacttctttaaactatttggaatagttaaacatttgaatataaaatgtttaaataaaaaaattctttaaaactaagactttcacaaaaaaaaagaaaagaaaaattaaaagaaaaaaagagaaagcaatcccagctttgtaagttactagccatgcttcataaatagtctaagcataatttcctcatttataaaatataaaaaataatatctactatacaggactgttaaaggactatacttgccaatatatgtaaaaaacagttcctggtataaataagcactgaataaatgttttagctactatttttagtaagcatagaacgtctgtagccataaacccacaaaaataaaacttcctgagaaagaagacaatgtttgcacactttgttaaaacaattgttatgtttgttgcatagaaaaaaatcagattcaccgtgatttttttctacatgtgaataccatttattaggctccctaagtgaatgagctagtagaaaggaaatattatatttaaaaaaccccataaggcatatttttagaaacggtatttccttgactttcattccaggaaaattctaacacacggcacggtgcatgtggagcccagaaaagaaagcctgccagatgccacagcaataaatagagtagggccttggagacgaagcataaaaggaaaatgtggagcatcatatctgcagcacccttctccatctggtatttagcccactgaggttatgggatttttggaaattcacctttgtaggctacctttaattatttttcttgtttatttgtccagtaaacatttaaattgtagcctaatatgagccaagttctatgaaggtcttccaggacctttggaaaatgaagctgggtacggaaatttcaggaaaaaaatgttctaagtacagagtaatgaaaggttaatactatttacgtcttgccatctctttttacaatattaatttcacaaatacaattttagcatttccaaccaataaattaagcaacagcatattttctcaaatggcaggaattctcagacaggaataaaagggagtagaatttcttaagtgggttatgtctcactttgctaagaagggcagaaatgaaaataggttttcataaattatattttctatgggtcttgtattatcatttttataaacagatattttccaagcaagtggaatttcttcacatcgtctctcaatttagtaatctttctgatgagcaaactgagctgtagaatgttgaacattgtttcatcctactatgactgtcatcctttggcttgttgaatatatattcttgtgataattctaagaaactatgactaatggatttttatccagaattttaaaacaacaaaaagttattttaaattaaatgaaaaatacattctattcccttaacttttcttttttggggggattacacattctctgctaaaatttaggatggaatttctaacagtgatggcattgttcggtaactaacagtcttttgtgtgtgtgaaaaattctaaatgagtggaaatgatctcagaaattttatcttgaaaatgtttgcctatagtatttattcaagtgttgtccacattttaggaaagaacttcaaaaatgtccttttcataaaaatatgcagttctcttgtgtctatttaaaagggaagtccctctcctaactccagcatacgcactcatctctgggctatcaatagaagctaaagaaaaaattaaagaaacactggctgcatgccaaattttgggttaatagggaagagaaagctggttggcaatctcccttcctagtccttatcttttcctccccttatctctcctgtgctaggggtgctgggatgtctgtactctgtaacctctttctctgaatggagacagaagcaggaagtcaggtgccctgcactttaatgtcttattattcttctccttgagtaaatcctaactgttaacgggaaataaaatgctatatgtaaatgaacatcgtcacttggaaatcatcattctgggctacagcaccaatacacctgtaatcttaaaacatccttttaatagtaatgaatttgtcaaaaaagtatattaggacatctatattcaaattaagtttaccactggcttaggtttttaaaattaatacaagttgcttaagatggtgaaaggccaaactgttgtgattccttccactatgtatcatcctggagcaaaactcataggggaaaattagatattcgtgaagcaagatagcgagggtttttgttgttgttgaggttcccatcaggaacaagcttatattattggatttacttgagagtgtacaactgcccttgaaatgaaacatcacctacttccaacaagtgtgctctctccctagttcaccctaattaaggaggcttccctatattaattttgtctcttatacaagcatccttgagactctttgtgcttaattatttatgtctatgtctcaagtattaagagcacacttgaaatttaagatttttctaagtttctaacacttactagctttgttttttgcttagacctgttaatctaattttgtcttctcaacacttttgggaataatgcattgcttatccttaaattttgctttgcagtttctgtatgaaagattccaaattcaggtttcaatgtatttgaaacgaagttgctgattcctctcactggaattaagacctacacttacttttctcactcttctttattctatttcaaagtttgatgaatattttctcaaactgtatttgaaaaatttagaatccaataccatgaccaatcttcctcctgctaagccattggtggtctaactattactttttaagaaaaattaatatggaccctgatgtaaaaagaaaagaaaaacaaatatagagtgatttcagcaggtctattactagacatgttttctcatgtttctcggtagcttgaccctcttgtctggtattcctgagagaatgggcctacccacagagaaagggagaaggaggtaaagaagttgcaggtttgctggtgatttgagatgaatcctcatgcaacaacttgaaggcagacagattggaagagcagtgagttgattttctaaagtaaaatccaccagaaagagtttacacggtgttggaattctaccacatttacaaattaatgtgccagatgccatcagcagatctatcattatgatggctattgataaatatcaaaatttgaccattaagaaaatagtactactaatctcatactggggatatcagtaccactacagaaaaattctacttaaaaacatatgtgagctaaaagtgaaaagcatttccctgctgattccacatgtccacaacagcctaagcagtgtggagatggccagcggagcagcaatagggaacgtgtgccaacatttctgataggaactctattttctgaggatttaggctcaattatgaaagtctgctgaaaatgaaacttggcataaatactgtagcttagtagaattccatcaaatacaacaaaaatgaagattaaggagagggaaatcctataaactcaactttcagaaaagaccagagcattgctaaggaaaatcaaaggaagttctcaatacttattaattaatcttttcataaacgaaatcatatttgagaagtggtgagatcatttacagcctaataatttccagatatggaagggaataaataatttaaaggggtaatgattgaacctaggaagggctgtgtcagttctagaaatagtggcttttactcttgaatttttaaaagttccattttcttagtggtggcattggcccaggccacaatcatatacaaaaacataactgaccaaaaaaaaaaaaaaaaaaaaagaaaggctttaatctcttagaatagcaaaacagaatttgagaagagcctaaactctaagatatacagctcttaaaattttaccataaaggacacttttttagagccctaaataaggtgggaaccttaaacacagaccttaattttaataactcttgggaatggatggtctcagttaactctaatcttatatttgtttatagacctcagttttcaattacaggaggtctaagcattgaagtgttagagtgtttcaatagatgaaagatgattaatagaaactttaatatctctccaagtcaaatgaccatgtaacctctacaaatattactgtaatcgctacaaatatttgttactttgtttattcattcagtaattcaaaaaaagatttattgagcacatgctaggtataacgctccataaaacaagcctaaaatctaccaaaaatacaaatatgtattcacttgagaatttctgatagctctcatttagtgaaggtaccagacactaaacaacatttaacttgagatacatctggaacctttaacaacatactaaactttaaaaaaaagtgcatatttttctaatgtggttctgaaacaaagagacaaaaagaaattttttatttgtctaatggaagagaaaaggcctcaaaaactagctgacctcccagataatgaagtgtaaaagaatgtgcaaatgtacttcaaaaagtaactctcctggacaccaactgaacccttagaagctaaaggcgggaaataaccccttcttccttcttttactctctctagtttgtctttgttctgtttcccttgtcatttcccactcttcagacacaattatagttgattgagatataacgagtaaagctacattagaaactactcatggaaaaatcaatagaaaaggatagaggcacattcaacagaaacaacaaaacagaagcactgttaggaagaaggaagtgagaggtttttgtagcagaatgtacggaacagatatttcccaagtgcctcttctatggtaggtgggacatagcagcatcatacagtcacctcatatatccactgtaaaagaggagatgggtgggtgcaggcaggtaattgtccagaaaaagcaacagactggttctattatgagaaagtgaacatacttcatttgtggaaaactatacaacaattaaccactatgaatgaaacagatctccatatattaagagagagattctaaaaaaataaaaaaaaaattgagaaaaaacaagttccaaaggtatatattcagtatgatcccatctatgtaaacttaaaaaatattgcacatatatatgtgtgtatacatatatatacacatacatatatatatatagtatacacacatatatatagagagattaattataactatatatgtgataaatggtataatatacaacaaccttattatcatgatagtacctctgggaaaggagaagtagatatctgaagaacattttaaaatttttaaatatgggggtgaatacatacgctttgctcttttctgtaggtttaagctacttgacaataaaaattaacatttttttgaaatttgttgtctaaaaaaagaaagctgtagaaattgagacaattagaaggagctgttctagtaagtctaactttcttatttctgagctgagctgagaatatacaaggctgattattttccatcttcagaaagagaaacaatggagacttactgtagaagaaaagactatccttgcaatgagaagtcagtggcacttttggcaaatgaatggtcattttcaggtggaagtgaattatctgaatgtagttatattgagtcctccagctttaaaagaatgtttcaactcatacactatttatttgagttactcttttttttctttatggggtgtgaatatgaggtttaagggacacagttaatagatgccaagttttcattgtttctacaaatgtttatagagtctggattttggaataacaatttgcacacttacaagtgttgattagctgggcaacattgcaattaatattacttttttaagctcctcgcaaagacttccttttctttcaaaattgccaataaacattttcaaacataatccccaaggagctcattcactgggtgctgggggactccagcaggaaggaaacctactaacattttattaattttggatcatgtgtaattcttaggattaatggcaaggagccagagaggttttttttttttttttttttttttttcattttttaaatcacagtggaaaataagcctgaaacatttcactagtaaggcaagagtcacttaagatatattattaaatatgaggggtagaaataaatcacagacacaagtggtattatacagtgggcatttttctgaaaaaacagactccgtgcatgaggattagatatacgcccacaataagagggcatattgatctataattttcagtattacatccttgtattttttattatatgctatttttcaactagtagaggaacgtgttctcataaagctaatatttattcttccatgtttatacagctagtagtgcatttcaggaaatgagaaattctgagaagccaaatataacttgatgtcgtatgcaaaaaagaagacaagacagaaaaatccccatattttaaaaacctgactcaggaactcactcataaagctttaaataattaaataacacaacataatgaaagtcttttgatattattttttctattcccataaatgtagccttttcatagatgatacatcttatcatgtagtattcctcattttactagaaatcaaagaaaaggaccctttagtccagttctcattttcaacactgtactcactgtgtgtattttgtggaagctgaggcagatactcactgtaatcccactataaaaattgagatacccctactggaaactgtattgttaattcatgaattcttctcattttattattaagtaacctgtgtactggggaattcaatgatttcttaaacccaaagaaaatagtagtgaatgataatttggtttttcatggagaggctgtattcatattatattacggtaaaagcctcaagaggtcagagccatttcgggggagaaattccccaagcctttggaggagaaactccccaaaggtcaattgtttctatgtcctctccttttagtttataactttacttgagcccttggagaaatcaggagaaacagaagttgtcaagtcatttccccatactccgcatgcataaagatggaactgggtgttggcaacagtaagtaagtgaggcagaaggcagaagtgttgagggggatggcaggaggtgaggccaaggatgttgggactaaagggagagagcagttaggctgtaatcaagggttctttgagctccccacaaaccgatccttgattttctgaggaagcttgtggcctagagcagacagctgaaactatggtgcttggtgaaaagcaagtgaaaaaaacaactactactttattacttaccttttcccagtcatcttgcagatttcagattttctaccctttccgttctcagtaactgaccggccacctttgtggcatcagccccaccacttctcctgaggtccaagcctgtctccatctccatatccaacagctgtcctctctctgccattttcctgtactgagttctaatattatctttccctcatccatgttcctatatcaagaaaaatgatctcctttaaacaccaaaccagaatttctcgttcttcgaaagagtctatccatccatttatgtatgttagtgtatttctaggcagctaaaaaataaatgtaatctcagagtagaagtgcaatagaatggaaagagaatggtacccggagttagaaaaagggggctacacccagctccatctttctgcccatttgggcactgtcagctctaagtgaagtttctgtagtctgggcagttgcagacctccactgctggacaagggaaagaaggtttgagtctggttattacaataactggggttgggggagatgttggcttttggttcctgagaaccgtggttactaaacattcttttatttatttttatttttatttttttttttttgagacagagctgttctcttgctgcccaggctggagtgcaatggcgtgatcttggctcactgcaacctccacctcccgggttcaagccattttcctgccatagcctcctgaagtagctgggattacaggcacccacgaccatgcccagctaatttttttgtatttttagttgagatgggatttcaccatgttggccaggctggccttgaactcctgacctcaggtgatccacccgcctcggcctcccaaagtgcttcaattctaggcatgagccactgcacctggctggttactaaacattctaaacatgcatgggacaaccttgcatcacaaagaactgtcccacttaaaatgccaatactgccctgatgaagaaacatcaatagatgattttcaatgttccttcaacctatttggcctctaaaacttaagtgaaatgtagggaacttaagagactcaggaaagaactgtgaggataattaaaattttggattatgcagatttataggaaaagttttaaaaatgggcttatctctcccaaagagaaaaaggatgatttaaaaactgagactaggatgatacaggggaagtctgaccaataaattttctttttcaatggaagcagaaataaattaacatgatatgagctcagaaattacattggctttcttgagaaagacttgaaatcataaatgaaagaggagacattacaactgatatcactgatatcacagaaataaaaaggattatgagagactacaaggaacaatgatatgccaaccagttagataacctagatgaaacagatacatttctagaaacacacaacctaccaagactaaatagagaaaaaatagaaagcctaaacagacccataactagtaaggagattgagtcagtagttagcaatcttccaacaaagaaaagtcctatatcagatagcttcaccagatcattctaccaaacatttaaagaactaatgctaatccttctcaaactcttctaaaaaattgaaaaggatggaacatttcctaactcattttataaagccagcataagcctgataccaaagtcaaccatgccacaagaaaactacaggccaatatccctgatgaatgtaagtgcaaaaattctcaacaaaatactagcaactttttgctagcaacaaatactagcaaaccaaattcaacagcagtatgcagtatgctgttgaatttggaagcctcatacttcccgatgtcgaaatgtaacaacaaactctctatatattatatacagagtttcagtcatgcaagatgaaaaaattgtaatatataaagctacaatagtcagaatggcatggtactgacataaaggcagatatatggaccaatggaagaggatagagagtccagaaataaacccatatatatatgggatcaaattatattcaacaagggttccaagactccacaaaagtgtaagaacttattcttcaataaattgtgctgggaaaactgtatatccacatgccacagaataaaactggatccttattttataccagacaccaaaaccaacccaaaatgaattaaagaattaaatataagatttgaaactacacaactagtagaagaaaacccagggaaaaagctccatatttggtcttggctgtgatttcttagatatcacaagaaaagaacaggtaacaaaacaaacacagacaagtagaattatatcaaattaaaaggcttccatgcagcaaaggaagcaatcaatagagtgaaaaggcaacttacagaatgggaaaaaatttgcaaaccatatatctgataaggggttaatatattaaatatgtaataaactcctacaactcaactgcaaaatatccaaataatataatttaaaaatgggcaaaggacttgaatagacatttctcccaagaagacatacaaatggtcaacagatacatgaaagatattcaaaatcactaattatcagggaaatacaaatcaaaaccacaacgaagtatcacctcaagatggttattatttaaaataatagacaagggttagcaaagttgtggagaaattggaacccttgtacactgagggtgagaatgcaaactggtacttctgctgtgcagtatgaagattcctccacaaattaaaaatagaactaccatatgatccagcaatttcacttctgggtacatatcaaaaaaactgaaaacaggatcttgtagagatatttacacactcatgttcactgcagcattattcgcaatagctaggatgtggaaagaacctaaatgcccactgacaaatgaatgagtaaatatggtctatatgtagaacagaagattattaagcctaacaaggaaaatcctgtcatatgtgacaacatggataaactaaggtcattatgctaagtgaaacaagccagtcaccgaaggacaagtactgcatgatttcattcatatgaggtacctaaagtagtcaaactcatagaataaggtaaaattgtagttgccagagctgaagggaggagaaacagggagttgctttacaacaggtatagcactttagttaagcaagatgaaaaaattgtaaggatttgctgtacaacatgcagagagttaacaacactaaagtatggacttaaaaatttgttaaagggtagatttcatattttgtgtgtgtgtgttttaaccacaataaatgaaaaaaaaaactaagaaaaaaaggaaattggatccctgggtatgaaggtttgaaaacaaatggatttttattggtttcagacagttcacgcagaatcttgcttgtagactagggaggagcatttaggtaacttctcacgtccttcccagcacttctgtttctatggatacagttattaggttccagcacactgtgatatcctactgaattgacaggctagagagctgaggatggaggcacaacttctcatctaccccataccctagtaaataccccctgcctcactgttcaatgggggttaatcatgaggcccaacagcgaagggtacagtgggaaaactggagtctagcccagcactacagtaacatctactttgattcttagtagaaataaaagaaataaaaaaagtagaaccacagtaaagggctactaagagagaaagcatttgtcaccgtggacagaataaaagtaccaccaaatgaaataaatgcctatgggaaaagatgtgtcatgctagaaagtactgtgttccttctcctttgctcttcatttagttttcatccactcaatgtaccaagccttatcctatatcctgtttccttttccagctttgaaagatgcatggactgaatttagcctttggttaggtctttgtcagaaagtaccttcaaaataaaagtgttttacttggtactatctcaatagcaaacatgtatttccaaaatgaaatgcttgctctactagcaagctttttccttgagtaagcaacaatattgttagtaatttttcaaactgttaatacacatacacacacacacacacaaaaccccaaacaagccctattctatcatttataaatcatagggtgaatatcctctggtagaactaaatgaaaacattcagggcactgagtttttataatttgaaaaatgataatactagttgatattgacaaattcagttttgattttcaacgtttcaaaatataatttatccacaaggtcttaaacaattgaaagtacttaactaaatctgatatatgtagatgcttggcataaatttattgaatctattcagttagaatttataaacacaaaaataaaatttgttttaagtcaatgtggggtatattttatttctaatatccttgttacattccacagggtatacataaataagtatgacaagatatttattttcatttaaatctaactttcaatgaaattaagaaatgaaaatctgtttaaaatctacccccagagttctaattgaaatagagtacaaatattttccattaaaaaatatccctcaaacttagtatcttcagtaagaaaaatgaaaaaattaacacaaacctcaaaactgccagcagctcagaagacaaatgtgttctctggggacttgattgaaaccatgtattcataaaagtcttttaaatggatgctcttcacaaaggaagtctcatggaagacagcatggttctgacatatcagaggcttctggaagcaaagaaaagcacaccgttaggatatgtctaaagtaccattactgcctgtaatggtattattatcacttatatgtgttatcagcatgatgttattaatttctattatcaattttgtaccctaaatcatcttattcatcaatggcagagtgggacactaacctttcaatatcgtatttagaaatttctaaaagtcaggagtatttataactaagcaaacctctgcttttcctcttatctaggctgggattgaataactgtgggcagggtatgagcacaagaacagtgacagtatttactgagtgtctaccagatataaggcactgtgcaagtggcttttaaatctgggatctttaatacaaacaacactgcaattgaaaagtattggctccattttacagatgagaaaaaaatgcacagattgctgacctcaggcttagaacctgtaaccatcaaagttcaaaggccttagggcaggtactttccctcatctcactctgtagccttggtgatttagaaaaatatttcccaaacagaactgacaagagaacagataatgctgcaacatactaaattaattcaaatattactaattaattaagaacttgtcttgcctaatttactttagttttatattaaatatcatcttattcagtcaggcccacataaatacaaatgcccagctttaagcagtatatttttttctaccaacttttcttccttagacaaagagagaacttgctggaaactgagaagctcctttgtgtttggtgtgggattacatgcagcgctacatcaaggctggcactgcaaacttctcatcttcctctggcccatccatgtgacccacagttcctccactgtcctgatgaatgagaacacttagttttcctgattgcatcaggaactgagcccacatcctctatggctattactgagtgatattactgtatctctttgtggctacattcaccttaatggctgagggtgacaaagcgagggctctagttggatttccattctcatttttagtcagctatctctatatttgtttctgatggttccagtgcaacacagagaccccctgcaacttacccaccaccagctgtcccagtacccactctcacactgtgttgcagggctactgctcaccaaataaatgcttcaacacatcccttgaaatgatagctttggatgccatagacttttgtctgtcctgaaccttttagctcatggccccactgcaggaccaaaagtcccttagagagactagaaaatgatggagccaggaaggtcatgcataacttttgaaatttttagtttattggatttttggccacaaaagcttcagtcatgaataaagaaacaagggaaaacgattgatggtattttcaaattctacagaaccagagcctaggattattacacaaagaaaaaggaaaaagaacagaggaaaacagagctagtttatctttgcatgacagaagaaaggtgagcttgacaaagaatgaagaaaaaagacttgaaccaatggatctaaactaagtgagaggaatgtgaaatgaatagcaactcttcttaaaacctcatacactagcattctgtttacttcataccactcagaaacacattttcaggcagggcacggtggcccacgcctataatcccagcactttgggaggccaaggcgggcagatcacttcagtccagaagttcaagaccagcctggccaatgtggtgaaaccctgtctttacaaaaaatacaaaaattggccaggtgcggtggctcatgcctgtaatcccagcactttgggaggccgaggtgggtggatcatgaggtcaggagatggaggccatcctggctaacactgtgaaagcccgtctctactaaaaacacaaaaaattagccgggcatggtggcgggtgcctgtagtcccagctccttgggaggctgaggcaggagaatggtgtgaacccgggaggcagagcttgcagtgatccaagatcgtaccactgcattccagcctgggtgacagagcgagacttcgtctcaaaaacaaaaacaaaaaacaaaaattagccaggtgtggtggtgcacacctattaatcctggctactcgggaggctgaggcataagaatcacttgaacccaggaggtggaggctgcagtgagccaagattgcaccactgcactcgggcctgggcaagtaagtgagactctctcaaaaaaaaaacaaagacaaaaacaaacaaacaaaaaaaccaacaaccaaattttcagattaaatgcctaaactagtaggcccagtttttataaaatcctaatgacaatttttaaacattcattcagccactattcattatatacttatgagccaaacaataagttggaaaattccaggaacactgcaataatcaagatagccttttagtcaagcatcttaactgtcttgtaaagagatacaactaggatgtcaaaaaccataagaaggtggtaccagtaggtgtttgtaataatggggtctgaaaccaaactggcgggggtgttcctgcttcattacttcctggctgtatgaccttgggcaaggtactaaaactgtataacttagcctccttatctgcaggatgtatttcccgcaaaggctgttcgaggattaagtaagagaagccacataaagtgctttgtgcactgagtaacatacaataagaactcatcaaaagttaggaaatgttggcgggatgcagtggctcacgcctataatcccagcactttgggaggccaaggcaggcagatcacctgaggtcaggagttcgagaccagcctggccaacatgatgaaaccccgtctctactaaatacaaaaattagccaggtatggtggtgcatgcctgtaatcccagctactcaggaggctgaggcagggagaattgcttgaacctgggaggtggaagttgcagtgggctgagatcgtgccactgcactccagcctgggtgacaaagtgagactctgtctcaaaaaaaaaaaaaaaagttaggaaatattagtagtattgttgtataacagatcatgggtggtatcagtgatggaaaacgtgctatgaagctcagaggaattggagatcctttctgttggggatgaatggaatcaagaaggcttcagtgaagaaagtagcatttaagatcaactataagtaaacagagagacatgattaggcatttacagaaattctattataattgaaaagccagaatatgatatactttagaaaaacataggttcatgaaattagacattattttccaggatttggtgtgaaagtagacacctaacctaacaacacagccaggtcatagtacaaagaaaatcaacgtactgctaccaagagaggtacacgatcccatggggtcctgttctatttaactgtaatccaaaatgacaccatggcttttaatggagcttggcaagctctagacgtgccaattataaacttagccttaaatttaaatcatagggcttgagactcaaatctccaatgtgacctttcctgggtgttgttcaagaaaacatgtctgtcactgtggacagaaaccacacacccttttactctggaaagtataatataaagatgtactgtattttacaagcacagagccacaaaatgatggtggctataattccctagaagcaataaaagcaaaggctgtttgatttgtaacattcatttagaaatgtcttattgcattaatgaacattcttatttcccgcatattcgggactttaattcaaaaaaagcttggcaggaatctcatcatttatagatttaacatatagttcctctggatacattcattttgcaagggctcactaagccacactactttgtccttgccagacccatacaatattgtactgaacagaggagctaaaagcccacagtggcttgaattctcctataccctccctgtttcctagccatggaaggtctaatcaaggagagttctatggttgaaatgtgttcaggtgttgccaatgtgatagtgtgaagaggtatagcctttaagagatgattaggccatgaggactcctccctcatgaatgtgatcaaggcccttataaaagagtcttcacacagcattcaggtagctggcccttctgccttccaccacgtgcaaacacagcaatattcccctccagagaaaccatcttggaagtggagagcagccagcaccacagacaacagaatcttctggtgctttaatcttgaactttctagcctccaggactgtgagaaaataaatttctattctttataaattacctaatcaatggtatttgttataggaacaacaaaggcagaaattggtgccagaagaatgggatgatgctgtaataaatacctaaaaatgtagaaacagctttggaattgggtaatgggtagaagctggaatggtaatgggtaaatgctggaaaaagcctgtaccgtcatgaacagaacattaagggcaattgtggtgagggctaagaagaagcagaagactagagaaagcctgacttccttatggattacttaagtgtttgtgaacagaatgttggtataagcatgaacagtaaagattattctgttgagatctcagatggacataaggaacagggtactggaagctagaggaagggccgtctttgttataaaatggcaaagaattatgctgaattctgtcctgtcctaggactctgtgaaatgcagaacttaagagcaattaactagactatttggtggagtaaattctgaattttccattaattcaaattgtgagcatttgggaaattttcagcttggacatgtggagaataaaaattaagtgcgtttagaagagaaaaccaagtgcatgaccaagtgactgtttggtaaggagattagtatggatagaagaaagccaggtgctttagaagaaagccaggagccattgacaatgcaccaatggctctaaacacattttgaagatctttgaggctgcccctcccatcatgggcccagagtgctagggctttgagggcagaatggttttgaggaaggggcccagggtgcctgggggatctggggactcactgcccagggcaatctcaagtctctgctccccacattctgttacggcattcctcagcctccccagctgtggcttgagtggacccagctgcagctgtaaaccctggcagcctccatatggtcgtaattctgaggcttacagagtgcaagagctgtgagacacagctgcttccgcctagatttcaaaggatgtctcaggcagccttgggacctaggcatgaacttgcttgccacagaggtaggaccatggcagagacccttcactagtgcaatgactagtggaactgtggggtcagagccactgcagagagtccccagtagggcaatccttagtgcagccatgggggcaggttcactcataaaatcccattattgtagagccacagcatgcaactccagcctgagagagctacaagggctgaactccagcccgcgagagctgcttcatgggctatgctcaacaatattgtcatagaagggtctcctggaggcttggagacccaacccagctgagtatgtcttgaagaagatatgaagtaaaagattactttcaagtcttaagatttaatgtttgccttgttgggttttagacttacttgggacctgttacccctttcttctttgctatttctcccttttggaatggaaatgtctatcctatgtctgtcccatcattgtattttactttatttttgagacagaatgtcgctctgtcacgcaggctggaatgcagtggcatgacgtcggctcaccacaacctccacctcctgggttcaagcgattctcctgcctcatcctcctgagtagctgagattacaagtgcctgcccccacgcccagccagatttttttctatttttggtagagacagggttttgtcatgttggccaggctggtctcgaactcctggcctcaagtgatacacctgcctcggcctcccaaagtgctgggattgcaggcataagccattgcgcccagtcccatcatcgtattaatattttagaagcgcataacttgtttaacttcacaggttcatagcaggagagcaatttgccttgacatgaattatgccttgagtctcacccatagaggatttagatgagactctggattttagactttgagttgatgctagaacaagtttagactgggctactgggatggaatcaatgtattttgcatgtgagaggacataaatttgggagaggggccagggtagaatattatggttaaaatgtgtccccttcaaaattcaggtgttggcaatgtgatattattaagaaattgggcttttaagaggtgattaggccataaggactcctcccaggtaaatgagattaaggaccttattaaaaaatgtttcacacagcatttggataattgctcttctgccttctgccatgtgagggcaaagggttcctcccctccggaataaccatcttggaagaaagcttccctttccagaaaactgaacctgccagtgcattcatcttgaacttttcagcctccagaactgtaagcaaacaaatttttatgctttataaattaccccatctattgtattttggtatagcagcacaaatagactaagagagtgagcctgcaataaatacagtatccttctttatccctttcactgaaaacctgttaacactattttccattcattccaactcataacatcacaatttatgcactaccattgtgtcaattcattcttagattgctataaagaaacatctgaggctgggtaattcataagcaaaaatttattttggcttatggttcttcagcctatacaggaagcatggcgctggtgtctgcttctggcgcatcctcaagaagcttactatcatggtggaaggcaaatgggagcaggtccatcacatgatgacagcaggggcaagagagaaaagggagaggtcccagactcttttaaacaaccagatcttgcatggacttagtgagaactcacctatcacaaaggacatggtgccaaaccattcatgagggatccacccgcatgatcccatcacctcctaccaggccccaccttcagcattgggaatcacatttcaacatgagatttggaggggacaaacatccaaatcatatcaaccataacttctagctagtatttattcttgtagttcatcctgaaaagagcccaaaatgggtcatcctcaggctatagtggtgataaacatttgaactaaagtaaataaggcagggcactgtggctcatgcctgtaatcccagcactctgggaggctgaggaggcagatcatttgaggtcaggagtttgagaccagcctggccaacatggtgaaaccctgtctctactaaaagtacaaaaatagccaggtatggtgatgtgtgcctgtagtcccagctacttgagaggcggaggcaggagaatggcttgaacccaggaggtggaggttgcagtgagctaacaccactgcactgcagcccgggcaacagagtgagactccatctcaaaaataaataaaataagtgaataaatgcatagatgagataattcttaaaatgtaactctaattatgtacatccactactaaagaacttacaagggctccctattttccaaagatcagacctaagttattcaccagaaatatctgttcccaccatcctctgtaatctcaaaacagactatttctgaccaaaacccttggatccagtagaaatggtctgctcactatgttatatagtgaatctcaactagaggtgcatcacaggtgcatggggtgtcgcctatgacaaaagtgataaatgacatctctcttgccctgtttctctgatcagctactactttgtgaaccaccctatggcgaggcccatttggaaagaaactgaaggatctttccaagacaacagccagtaagaaacttgggccctttatctattagcctatgagaaactaaatcctaccaacaaccaatgagcttggaaatatattctgccccagttgagcagagatgctgtagatgttgctctagttgagatgactacaggcctggccattgctttgactgaagccttgtgagagacccagagttggaggacccagctaaggcatgctcagattcctgactgttgtttaagcaattaaaatagggggtcaggcctgaaaaattcctgagcaaatacaaccagaggtcttaaaaatagccttaatcttgcttaaattgccaacataagcaaaacttaactcaggtcacttctgataaatgcttacattagaactaaaacttaaccccagtgcatcgtaagcagctaatgaacataattatgtgactggactttccaagaaagtaccaaagaaaaggccattttgtcattgcaaaccggtcaaataattttattttaccttagcattttcccaataaatacttgcctcattctgtcattgagacactaaacctcttgcaatctggtgttctccatccataaattgtttcttactcaaactctttaaaattttatgccttaaattttaatgcagtgatagttaattttatgttgttaacttggctaggccatggtacctagatatttgcaaacacaagtctagatgttactgtgaagatgttaaaattaacatttaattagtagacactgagtaaagcagattactttccataatgtgggtgggccttatctaatcagttgaagcacataaggcaaaacagactgaggtcccccaagaaagggaattctgcctccagactgtctttggatttgagcttcttccctagatctccagcctgctggcctaccctgcagattttagacttgccagtgtctataactacatgagctaattccttaaaatatcttaagattctctctctctctctctctcccccctcccactccctctcctgttggttctgtttatctggagaaccttgactgttgagatagaactgataggacctatagagagagagatgtataataagggatttattaggggaattggctcacttgattatggaggctgagaagttccatgataggccagccatctggaagttggagaacaagagaagctgatagcaaggctcaattcaagtctgaaggccttagaaccaagaaagtagtaactctcacaccaagcccaaaggcccaggagcctaggggcattgctggtgtaagtcttggagtccaaggacaacagagtctggacttctgatatccaacagcagaaggaaaaggccatcctggctcccagaaagagcgagaattcaccattcctttgccttctttttccatctgggaaccccagctgattggatagtaaccacccacattgaaggcagatcttccccattcagtccactgactcaagtgctaatctcttctggaaacaccttcacagattcccctgggggcaggcctatcattctaatcaaatgccaaaacagtccatctgggtttccctttcatcaggagaaggacaagctcagtgcctactgaagcactgagaataattaatgctttaccagctatctgggtatccctttgttttagtctattctcacgctgctacaaagaactgctcgaggctgggtaatttagaaaggaaacaggtttaactgactcacagttctgcatggctggggaggcatcaggaaacttacaatcatgacagaaggtaaaggggaagcaaggcatcttcttcacaaggtgcaggagggaaaataaatggaggaactaccaaatacttataaaaccatcagatctcgtgagaactcactatcatgagaatggcatgggaaaaactgcccttatgattcaattccctccatctggtctctcccttgacatgtggggattatggggattacaattcaagatgagattttgggtggggacacaaccaaaccatatcatccttagaccagtcacactgacacccaatcaaccatcacaataatcacaattaactaatacgaagacccacagatactgtgagactaatatgacagccctcccatcacatttatcacaatgaattataatttttggattcctctctaatatggtaagcttcatgttctgtcaagcagagaccacgtacatcatgtttgcaaacaaatattgtactgtgtccagcacagtgactacattcttgttaaacaaatgagtcaaaactaaagcttctccagcagtgtcttcatataacctaagaaaatgacggaacagtcccccaactaacttattgtttacgatttatttgtacctttactgaaggtacctttaatattgtaagaaggcacatatattcattctttcacaataataaacaaaatagtagagatgagacaaatcatgacacacgggagtgacacacagagtggagttttatggagttggagaataagatgattgtgaaattgagaataacaaatttgaaattttataggctgctttagagcagaagtatcagatttcaattaaaagtgtttttgaagatgaacgtggcatcaaagtttagaataggaaaaaaggctattgctatttgaataggtcagttagacagcagtggaaatataaaagtagggttggatggaagaaaaatgcagagaaaaaattccatcaattagatgaaatggataatgagaaaaaagatgcagtcaacaattataggaatattttgagcctaggtgtgggggagactgtaagaacactgacagaatgtggagattcaagaggggagctggtatatgtctgcatgcttagggagtataaaatgatagtgactttactttgagatatgccaagtttgagaaatgccacattccttcctatgttttatgaatacagaaaatctaagtttgataaatgtttcaccaaagatcaatagagactatcaaagactatctctaatttattgttcagcgagtataatatatggtaaaatgcactgattttaggtgtacagttcactaggctttgataaatataccttcccaagtaacctacacacaagtcaagatacaaaacatttccatcacccctgaaagtttccttctagtcaagccccactcaaatgtgaaatttcaatgtctatcaccataaatggctttgcctatacttgaactctgtatataatcatacggtataccagatagcatatgttcttttatgcctggttccttttgttcaatgtaatgattataattcttgttaaatcttccagtagttaattcataagtattcaattgtataaacgactaataacctactacatataatattacattatatgaatttaccataacttatccattctcctgtctatggtcatttggcttgatccagtatttggctattaataaacaaagctattacaaacattcttctcagggctttatgttcttatacaaagccatatatcctttcattcttaagtaaataggtgtgaggttgccagggcattaagtttataaggaaccactagttttcaaaaaaatcctgtaatatgttataccctcaggagcacggtacaagaatttcagtattaccacatcctcaccaatgtttggtgagctcagtccttttatttttatctttttcttgtggatgtgaagtggtacttaaatttacatttccatcatggctaatgatgtcattattatggcttcaaatgtttattaaacattcttatcttcttttgtgaaggttctgtttaagtaatttgccaattggaagaaaaatattttctttgtattttttgagttgtaaagctttgttaaatattctagattcaattccttttcatacatatgtattgcaaactattaatatttgccctttctgtggcttgcctattaaaaatgtttttttatagggagcctttaatgtttgtggagtatagttaactgatttttttctataatgtgagtgcttttagtatcctaagaaatagttatcatcttttgactttttctagaaatcttataaattttactttcatgtaaagatctaattcaaagtatatactttgaatcaatttttgtgtatggtctgaagaaggtgttaaggttcattctgtttcaataattgctctagcaattggctctttttctttttctatttttttttttaagagactgtgtcttactctggttgcccaggctggagtgcagtggaacaatcatagctgactgtaaccgagtacccctgggttcaagcaatcctgcctcagcttcccaagtagctggaactactgatgtgcaccaccatgctcagctactttgactatttatttagagatagggtctcgctatgttgcccaggctggtcttagactcctaggctcaagcagttctcccacctcggcctcccacagtgttgggattataggcatgagtcaccacacccagcctccatttcttaatgagcctttctcctatatgtaacaaaattgctttgttattaaatcaatttactgtataagtctgtgtctatttcatgataacatattctgttccattgatctatttgtctatctttgtctagtatcatattttcttaacacttttatagaagtcttgaaatcagaaagctagtcccccaacactgtcatctttttctaaaataatttgacactaataagtccttataattctgtataaattttagaaccaatttattaatttccaccaaaaaaacataaacttttgggactgtgttaaatatacacatattttgaaataaaaatcttaatatagagtcttccatttgcaatttcatttaccaaatgtttcttactgtatagaaatagcactgatactttacatttatcttgcatcctgaaaccttgtaaattcaagagatttttgctaagttcaaatagatcttttttagactccataggattttctatacaattttttaagtaaatttttgacttgctgtctccaaatatttttattattcttttccaatctatatactttttatttattttactggcctgactgcattggttaggacctccagtacaatgttgaactggtgagagtgaacacccacatctcttttcctgatttggagggaaagtattcactgttaacatccttagttgaaggtttttcacagattccctttaacagattaggaaagataccttttattcctagtctgagtttttatcatgattagaggttgaattttattaaatgctgtctctctaactagtaagataacctttttttctattaatgtggattgattttgaatattaaagaatgcatacatacttgaaattcatttttgtcaggatatattactgtatgttaatacataataacacatcactgcagtgattatgtgttatttcctaattgtatgttaaacatttttgtgtctatgatcataaggcatatcgatgtgtgacttttttaataatgtccttatcaggacttggtattagaattacaaagctctcaaacaatgactagaagtgttctccccacctctatttcccgtctttgtttaagactggtatttcttcttaaatgtttgaaggaattcattagtgaaagcatctggatctggagtgttctttgtgggaagcctctgaattataaattcaatttagttaacaaatacagagctattcccattttctgtttcttctaatataagatttagtaaattttatcttataaaaaaaacttgtccatttcatctaagataagtttgtttcttatggcttctcataccctataataataattccttcacttgactaaaccatatatatttcactggacctcctttcttggtacattaaactcgctggtactttttcctcttctgagagcttctccagcccttactgacataattttgcactgccatgtgttttcagtcatctttattagtttgttttacctttgaaaaacagattatagtgtcctcagaggcggaaatatcttaaactttcattgttctccatggaatttagcatagtctgttaacattttatatgtgtttctgagattatggatttgttcactgttggttagcttgatatctattacagatgtgcttggagcatcttatagtaataacaggaagcatgaaaatgttagaaaataatgataataataactaagattggacacatcaaagtaacagaagccaaccttaaagcgcttccaatggccaaactgcaacaatttgagaaacaataaataataatactggactatatacctcaaagaataaaataatgatccatgagttcataatattgtcaatagtcaactgaatgactgaatcaataaatgggtgagaaaagtatctttcttgcagaattctaaatttaaaaaaaaagatggaatgagagaaacaataattagaacatctagttagaactgctacaggcaaaactcaatgatgaatacaaaaaaatgagtggccaaaagccactcatttaacaaggagcaggacagttaaaatgactcaaagtagtatccctaacatattaattactatggtggcttttaacatgtgtctacaattcttttatattcttccatcaggagatggaacttaatttttttccccttgactggatgatagaattagtgacttgcttgaaactaatatggaagaggaaagtagtaattgtggagaaacctggcaagcaccaccttaatcaagtaatcaaggttcacacatcaccatttaaagtcatgttgatatcatgtacctttgatattatgataaatgtactttaccactgtggtatttttccctaatatccctaatgctcttctaactgtgataacatattaggaaactaattaatattctatgaaatatcagacctttactcttaaatattgtcaaggtcatgaaaatcaaggaaaacctaaaactgtcacagattggtggatactaaagaaatatgatctctgtggtatcctagactggatcctggaacaaaaaagggacacagttgaaaaactacttaaaaaaagagtaaagtatagactatagttaattgtattgtgtaaatgttaatttcttagtttgataaatatactatatttaggggcaagcaagagtaatttggaaacatctttggtaacagctataaccactacttccaaaaaagacacaggttgccaatagaaaaattaataataaaggtcaatatccacaatacaaagaccctggacacaaatccacttactcacagacactgacacccggcccacccacagccctcatcaacagggccacctgcagaccctgtcaaatgtcctgcccagaatctctttccaggatgacttgtggagggctttccctaccaaaaccagtctataaagatggagagaggtgactgcttcttcaagtgcacagacaccaacacaaagatacaaggatcacaaagaatcaggaaaatgacaccaccaaaaagacaaaataaagctccagtaaccaaccctaaagaaatggagacctataactgccagaaaaagaattcaaacaattatcttaaagaagctcagtgagctacaagagaacaaatcaggaaaataaatgaacaaaattagaagttcaacaaagagatagaaaccataaaaaagaaccaaatagaaattctggagctgcagttattatgactgaactaaaaaattaaacggtttcaacagcagattcaatcaagcagaagaaagaataaactcaaggatatgtcatttcgaattattaaagaagaaagaaaagtgtgaggaaattccactagacttaagagcaagcagactaatcagcaagtaagctaatatatggactagcaagcaacatcagcaagcaaactaatatatgcattatgggacactcagaagaagagaaaaaggaacagaaagcttatttaaagaaataatggctgaactttttaaaacctgaagacggaaatggacattcaaattcatgagagaactcaaataggtggaacctaaagagttctaggagaaattactattaaattgtcaaaagtcaaaggcaattttgaaagcaagagaaaaaggactcctcacatatataaatctccatacaactattagcagatttttcagcagaaatgttgcaggcaagatgagagtgggatgttatattcaaagtgctgaaagagaaaaaaagttgccatctagaaatactatatctggtaaaaatgtcctttaaaaatgcatgagagacaaagatgttccaagacaaatgaaaactaaggaagtatgtcaacactgggtcctccttataagaagtgtgaaagggagttcttcaagttgttacaaaaggatactaaacagcaacatgaaagtatatgaaaatataaatcttggctggtaaaggtaaatacacagactaatacataacaatgtatattgtaatgaagatgtataaattacttataatcctaatataaagtaaaaagattagttttaagaataactattaccaaaaatattaatgcacaatataaaaagtaaactatcacatcaataactgtgtaataaacatagtttttgtgtgttattgaagatatgttatcttaaaatagactgttataagaagttttatgtacacctcatggtaattacaaaagtatagtagatacaaaagatagaataaaagcttattactacaaaagctcacataataaaacagcaaaaaggaagaggaacaaaagaactataaaacaagacaactaacaatataacaatagtattttacttatcaataatttaagtggatcaaactcaccaaataaatataaaaataagattcaactatgtgttgtctacaagagaagaactttaaatttaaggacacacagactgaaagtaaaagaatgaaaaaaaaatactcaaagcaaacagtaaacaaaataaagcaggggtagctatttttgaaatatacaaaatgcttttaagtcaactgtcacaagagacaaagatcattatataggggaaaaaagagtcagtttaacaggaagataacagtagtagacttcaataactcatcttcaatatggattgatcacacagaaagttattaaggaaaacagcagtcttgaataacactatataccaaatggacctaacagaaatgtacagaacattctacccagcagcagtagagcaaacattgttctcaagtgcatatagaacattctctagggtagatcacatgcttggtcacaaaacaaatctttattttaaaaagattaaaatcataccaagtatctttctgaccacagtgaaatcaaacacaatatcaataacaaaaaaagagaaaattcacaaatacatggaaatttgaaaacacactcctaaacaactattggctcacaaaaagaaatgaaaaggaaatttaaaaagtatgttgagaaaaataaaaatgaaaaatatactaaaacttattggatgcatcaaaagaaataataagagggaattttatagtataaacacctaccttaacaaaaaaaaaaaagctaaatgaatgacctaattgtatgctttaaagaactagaaaaagaacaaaccaggccaaaagctaacagaagaaagaaaatattaaacgttagaacagaaataaatgaactagaaaacagaaaaacattagaaaataatataacaaagagttggttttttgaaaagataaaatacacaaattcttgcccagactaagaaaaaaagattcaaataagtcaaataaaagaggggccattataactgatgccacaaaaataaaaaatatcataataaactattatatgtgacaatatatacgaacacattggataacctaggagaaatgaatacattattagaaacacaggacctaccacactgaatcatgaagaaatagaaagcctaatcggatcaatgacaaataaggagagctaataagtaatcaaaaaccacctactaagtaaaagcccagtatcagatggttccacaggtgaattctatcaaacatttaaagaatgaatgccaatattcttaaactctcaaaaactagaagaggaaacactttcaaactcattttatgagtccagacaccccaatacaaaccaagacaaagattccatgagaaaagaaaataggccaatatctctgttgaacattaatgtaaaaattttcaacaaaatagcagcaaaccaaattcaatagtgcattaaaagggtcatacaccacgagcaaatgggatttattcctgggatgcaaggatggctcaacatatgaaaatcaatcaatgtgatacatcatagtaacagaataaaggataaaaatcacatgataatattaatagatgcagaaaagcactttataaaattaaacacgctttcataataaaaacttaacaaattaggtaaagaagaaacttaccttaacaaaataaaggccttacatgaaaagcccatatgtatcatcacactcaacggtgaaaaactgaaagatcttattgaatccagaacaagtaaggatatccactcttaccatttctattcaaatgagtactgaaattctagccagagcaatcaggcaataaaaagaaatatatatatattttttactttgtaaaggaaataattgggaagaaaaaataaaataatctgtttgctgatgacatgattttatatacagaaaactctaagaagtccatacacacagaaagtgttataaataataaatttagtaaagttacaggttgtaaaaatcaacatataaaaattagttctgtttctatacataaacaattagctatctgaaaaggaaattaaaacaatcccatgtacaactgcatcaaaaagaacgaagtactcaggaataatctttaccaaggaggtgaaagacttgtacacaaaaactgtaaaacaccgatgaaagaaattaaatcacacacaaataaataaaaatcccatgttcatggaaagacttgagatatcaaacaaaaatattttgatttgaagaatatcaaaatgttcacactatccaaagcaatctacagattcaatgaaacctctatcagaatcccagtggcatttttttacagaaacaaaaaatacaatcctaaaacgtatatgaaaccataaaagaccctgaatagccaaagcaattttgatcaaaggaaaatctggaagtatcacatttcctgacttcaaaatatagtacaaagctatagtaatcaaaagaggataacctggcataaaaacaggcatatggaacaatggagcaaagtagagaatccagaataaacccaggcatgtaagatccaatgatctgcaacaagggtgccaagactaaacaaatgatggtggaaaaagtggacatccatatacaacagaatgaaattttacccttactgttacactgtatacaataaaaactcaaaatggaataaagacttaaatggaagacccgaaaccacaaattttctagaagaaaagctccataatgttgacttcagcaatgatttattggatatgataccaaaggacaggcaacaagagcaagcaatagatatgtgggatcacatcaatctagaaaactacaccacaaaggaaataatcaacaaaatgaaaaggtaacttacaaaatgggagaaaacctttgcaaaatgggggaaaataatttatctaataaagggttaatgtcaaaaatatatcaggaattcctgcaactcaatagcaaaaaaatccaataaaaatgggtaaagaaactgagtagacatttctctgaagaagacatacaggtatatgaaaacatactcaacagtaccaatcatcagggaaattcaaatcaaaactgagataccacctcacacctgttaggctattataaaaaataaaaagataacaaatgttggtgaggacacagagaaaaaggaacctttataagctgttggtgggaatgtaaattggtgcaaccactgtggaaaactgtatggggattccttaaagaatcagaactaccactggatagtagaaatcccacttctgagtatataaccaaaggaatcaaagtctgggtcacaaagagatttctgcactatcatgctcactgaagcattattcacaataggcaagatatagaaacaacctaaatacctgttgacagatggacaaataaagaaaatgtggtatatacatacaatgggatattattcagccttgaaaaagaaaatcctgtcatttgcaacaacatggatgaatctggaagacattatgctcagtaaactaggccaggcacagaaggaaaaatgctacatgatactactaatatgaggaatctaaaataatcaaactcataaaagcagatagaatggtggttgccaagggccagaggaagggcaaaatgtggaggtattagtcaaagggtaaaaatgttcagttataaaagacaagtcctagggctctactgtacagtagagtgcctatagttaatattttgtaagacttaaaatttgcagtgacattatttgctcgatcttatgttaaatgttcttactgcaaaataatatgaaacttttggaggtgattaatatgtttatggcatagattatggtgatggtttcatggttatatacttatctctaactcaccaagttacatacattaaatatgtaaaaattttacattattcttacctcaaagtgatttctctttaaaaagatcaatatccaaaaccactctgacttcaaaagtcaggtagatagtactgacttttttaggaaataaaagaaacacctatcttttggtgaggtaatatccaattattttacattttaactttcaaacaactgtaaagagacatgagatttatacttgttctagatgcttccagttcaacatggtaatcggatcacatcaacttattccatgccttctcaggttcccaaatagccataaatctacaaagccaaagaaaattggagtgaatgaggaaatgctagaaaaattctagatgatagaattgaacaggactgagaaagctacagcctaagtacatgtgagaagaaaggatgatcaaaagaaggcagaaatttgagagaattctgtagggaaacaaccagatttctagactataccctaaaaagcaagatatcaggctataatctctgatacaaagtttgcagtcaaattttctttcttaaatataattgtataacacttactgacagacatttgaagaaagttggaaagataaagaagtctgcaatcaacaaacaaaaataacccttgagaagtgtctgtttatatccttcgcccactttttgatggggttgtttttttcttgtaaatttgtttgagttcgttgtagattctggatattagccctttgtcagatgagtatgttgcaaaaattttctcccattctgtaggttgcctgttcactctgatggtggtttattttgctgtgcagaagctctttagtttaattagatcccatttgtcaattgtggcttttgttgccgttgcttttggtgttttagacatgaagtccttgcccatgcctatgtcctgaatggtattgcctaggttttcttctagggtttttatggttttaggtctaacatgtaagtctttaatccatcttggattaatttttgtataaggtgtaaggaagggatccagtttcagctttctacatatggctagccagttttcccagcaccatttattaaacagggaatcttttccccattttttgtttttgtgaggtttgtcaaagatcagatagttgtagatatgcggcattatttctgacggctctgttctcttccattggtctatatctctgttttggtaccagtaccatgctgttttggttactgtagtcttgtagtatagtttgaagtcaggtagcatgatgcctccagctttgttcttcttatgcagccaaaaaacacctgaaaaaatgctcatcattactggccatcagagaaatgcaaatcaaaaccacaatgagataccatctcacaccagttagaatggcgatcattaaaaagtcaggaaacaacaggtgctggagaggatgtggagaaataggaacacttttacactgttagtgggactgtaaactagttcaaccattgtggaagtcggtgtggcgattcctcagggatctagaactagaaataccatttgacccagccatcccattactgggtatatacccaaaggattataaatcatgctgctataaagacacatgcacacatatgtttattgtggcactattcacaatagcaaagacttggaaccaacccaaatgtccaacaacgatagactggattaagaaaatgtggcacatatacaccatggaatactatgcagccataaaaaatgatgagttcatgtcctttgtagggacatggatgaagctggaaaccatcattctcagcaaactatcgcaaggacaaaaaacccaacaccgcatgttctcactcataggtgggaattgaacaatgagaacacatggacacaggaaggggaacatcacacaacggggaatgttgtggggtggggggacgggggagggatagcattaggtgatatacctaatgctaaatgacgagttaatgggtgcagcacatcaacatggcacatgtatacatatgtaacaaacctgcacattgtgcacatgtaccctaaaacttaaagtataataaaaaaaaacccttgagggaatttgagtgattgacagaatagaacttttaaaactctaaaaacataaagaagattttattaaagaaataatcagacaattatcaattttacaaaaatcaatataaagaaaattgtgtttaataattcttccagaaagcttttaaaaactgaaagagaaatgaaaaacagaagacaaaagacaaaggatatagagaatccaaccagaagacccaactactaagaatgccaaggagaattcccagtaagaaaagcaaaggagaggaattcaaaagaaatttccacaagtgaaggtcaggtgttttcaaaattaaagggctcatcaagaggtaaacataatcaatgaagaaaagaatcataaccagatatgtttttgtaagagttcctacagataagtttctaaaaactgaggaggaaaaaattagtaacttacaaaggggcaggaatcgaatttcttgtcagcaatactggatactaaaaaatagagcaatgccttcaaatttccaagggaaaattgtttttaacttatatgtcttaatctagccaaatctagccaaaataataagtcactttcagatatacaaagattcggagtatttacttcccacatgtcctttctggaaaaattcttgaggatgtgcttcagcagtaaataaaattaaagtaagaaaaggcatgaatccaagcaagagcaaggcaagatgcctgtgtaccagttaccccaacctgggacagagggaggtatctaggaaaaaggggatttctaaatattttattctatttcctgaggtgaaagtacttaaaaatgcaataaaggcagattacacaaagaaaagtaaaagcaattagaaactctaggaaaaacaaatacaatcatagtatacaacttagatcagtagttataactacatattcatacctatatattgatttttaaccattagaatcaacctaacaatattacaactagagttgtaatatatttgaaaaacattatatcaaccttaataatttaaaattaaaagcacatatgagagaaactggaaggcattaaagggaggagttatagaaagaatgattgttatggtctgaacttgtccaaaatttgaaactcaatcctcattgtgctgttattaagaggtggatggaagctttggggaagtgacaaagtcacgagagctccatcctcatgaatggatcagtgccttatagatgggctggagggaactggcgtaggtccttttagctcttctgctatgtgaggatatggcattttcttcttttgctcttcctcctcttctatgtgaggatgcttccatgaaaacacactatggatagaacaggcctacactagacacagaaactgccagcaccatgatcttgtgctttccaacctctaaacttagaagaaacaaatttctgttctttatatatcacctagtgtcaggtatttttgttacagcaacacagactaagtaatagtctcatcttaaaaaggaatcatttggtactgtatatgattgagatagaaatgaaagaataagtatattattcaaaggtatacaggtaacgagaacttctgggttttcctctctaaaatatttagaggttttactctctaaaataggagggtattttagcaatggggagctgctagatcattatgtatcacagtgattaagtcaacagataatattgaaattttataaatcaagaaattgtgatcacatacacatgcaatacttgattcagccaatattacacagttagaactaaaaaggaactaacaaaaatataaacatagaaacagctaaaaaaaattattagtttttctttgggcagtaagtctagaggtgggatccaggactatagtttttcattataagccctcctatactctttaatttttaaaagcatatatatgcatttattgatcaaataaatgtgaaacatttattaatgtttaaaaatccatctggaaatcatccagctagactaatgcttcatcataatgcagctctcagcatttaaataaggtcttgttggtaattcagaaattactacattttaaagctcaaatagcaatgtcttctacacattctactctgtggtaggaaatatcacagcaatattttagaacagatgacaaaatagcctatatcagggatattaggtgttaaagaaataaaactggttaaaatatttgttaaaaatatgaggtgaataaatgcctgtcctaatgagtctccccactagtatctaacacatgttagagaaagaggaacactggtctctctgctcactagtacaacaatggatgactgcttaaattgcagccatcctgaaataccttgagtctgtcatttattccctctgatttcctatgagaaagattacaaattgcccactagaatcagggtctgtgagccacatcctccactttcatttctaggacataatacctctgccgtcaatcacagcacagctcaaattttttgaagcatagtgggatacaacagaattgtcacttaaaatttggaatacatctgatgtagcacgaactggactttctaagtgtgttaactactctgcaatatagatttggaaaatgtgaaaatgaagtggaaaaccttaaaaagacaaatgtccaaataagaaagattacagtctgtggatggtattctcattcatcttcaaatttcctttgctttgtgtttaaaccaaatgaagaggttttccaatgtcatttgacacaggcaaacatctgaaattcaacagcaaagtccccttcttgcagaagccttaaaaatgaaagctggtttgcttttcctaaagaaagaaaaaaaaaatgtctccccaacccccaacacccaccctttcctgaaagagaattttccagcagctggaagtttccagacctatgttctcagtgttggacagccttatatttacccatttttagcaaaattagggctcagaaagtttcatgagtagtggtacacatcagacgtctgttggaagtcattgtggaaagggtttctctgtacatatgtatagatctaagtaggagatggaagtcaccaaaataattttgtaacagaacagcaacaacaaaaagaataatctataaatattataggactttcttggtgtggataaaatcagagctcaaaaagagcctccagatcaatccatgtgagattttacaggccttctagaattggtaacagacaaggttttgctctcctgccagccggcactcctatttctgatgcattcatacagagtgatggttgttactaacattgtaattacttatacaatccttttaagaatgtaagttccatgagagcaagaatgttatatcatccactactgtattcaatcatttagaagagtgtctgacatataataggtattctgtaaaatttttaaatgaataaacaccttgtaaatttactgtaaagagcaaaggaataagtacaggtgaaagtgctttgcaaattaaattctaaaaggtgagcagttgttactctgcataatccaattcctgttggggcccgctcctaaaggctctgacaaagccattgcccgcattttgattccttctactgggccataattagactcatctacgtgggagaggcaggataatgcagttgttcaaagtgtaaaccctgaaactggacttcctgagttcaaatcccacctctatgactgactgactagctatatgatcttgagaaagttatttaacctctctatgcttaatttccttatatgtaatttgggagatgataatgatgcctaacttatagggttgtgataattaaatagattactatctgtaactcattgaaaacgggctggtacaaagtaagcattaagtacggctgctagtgttgttgctaccactcctattactatagggatgcagaaaaaatataaggaaattcagcaatgtccatactgcgaactttttctactaatgccacgtgcaagtttaaggctatattttacattgctgaattcctctgaagtttcaacttcatgaactattcttctacatatttagttccttaaagagctcaatggagctacagctcagtaagttatgtgttttggataaaataaggatatgagctgaggcatttaatcatagaagcagcctcaggctctctatccattcttggcttgtttttcaaagcacattgctaaatgtgttttctctttcataaagttttttaaaagttacttggacatgacaagcttctttaaatataaaacagtttcaatttttattgagatttgcttcaggaacattcttagtgttggtaatatttttagacaataattttattcagaagaccttattttatagattaactgcacaatagagttcatgcagttacatttacatggactttgtgctccatagtactgaaatccaaatatcagtttacttcagtataagcatatcagattgacctgaaatgctctagaacttttaaaaggcaaacgccaaaatgaaacaacacaccacctctcaagcatgtattctgtgctatgagcaagatctttcagttagaacttactaaattaggtcaagaggttctcctgggataaaggagtttgccaaagtaattctaaaattcccaaaataaggcacacagcactataacatttcactgattcttactcgttcttttatagtgctttgggaaatgttagaccattggtctgcatcatttcacctccttgtaggggaaaaactgtcaccagcaactgctgcttcaaactgtaataatcttccaggttcattctagggaatccaaaaggcgagcaccacatatttcctttcctttccacaggcgatcatgcaaattccctagcttaaggctgagaagtgcgtatgtgtgtatacttatgtatattatgtatatacagcctatggatattatatatatatacactatggacaatatatatagtatctatggatattatacatatgccatccatggatattatatgtgcataatctacgaatactgtatgtagatgcatatctaatatacatacatatacatgtattcattattttatagaatcaagttgagcttttcaattactggcagatctacaaaggctgttgagatttaaaccattacaaacaattacatgagagttgtcccggagtcacagagcccagaaagctaattctaacctgctttccttcttatgtactatatacttctaattacccagcacggttaggttctcataccattttgcatattttcatccaaaaattcaaacctactccatcctgagaacaaaagctggcaagaagcactcaagtgatgggtgaacaaatgtattaaaaaaagcaacattctgacatggaaatgtcatgtgagctgccgaatggcacacagctccaaagtctaccataatattttgaaacactttgccaatgagcatataattgactgaaaaacttgccagcactattccagagatgtttaaatactacataataaaacaatttacagaaaagaattaaatgttagaagtacatttttagaaagcttccaaaaccaatgtgtgtgggttttttttttttttttttcccattttggagccaaagaaataactctgatattctcagttctcacactttgccttccatatttgacctgctgcctatcacttgcatttttgcatagcagtcacatcagtcagtaataaacctgtatttattgagaactttagaagtacagatatcttggcgcaaattgctataagatcctgcctcatgaggtcagcatctgtgcttttttatgagcatttttccatccatctatctttctaacaagtatttattaagcacctaagatatgtcaagtattgggttagatgccagagagataatgatgggcaatataatgtgactgccaccatggagtttatagcctatctgggaagggtcacagttaaaggaataataatcataatttgtggctgggcgcagtggctcacgcctgcaatctcagcactttgggaggccaaggcaagcagatcacataaggccaggagttcaagagcagcatggtcaacatggcgaaaccctgtctctattaaaaatacaaaaattagctgggtgtgctggtgcaagtttctaatcccagctactagggaggctgaggaagtagaatggctcgaacccatggggcagaggttgtagtgagctgagatcacgccactgcactccagcctgggtgatagagcaggggaagaaagggtgtaaaacattaaaaaaattgttttcagaaaaacaatggctggtatgtagagaaaacaaggggcaaagcggtaagaaaaaagaccggagaggtgagcacaggctgggactattactgtttttctaagatccattctttgcccttggtcactcttctatgatcatttatagttttaataaatactggactgggtaactaacaacacatcctgaagtaataatacacaataaaactattattccattattcttaacacagacttctccttgtaacccagtgaatcatctgtaacaaaacccaaagcaactatatatctattccacaaggaaatttttagtttttttattaatagatgataggtcaggctttatgaccatatctgcatttgtgactgacatttcctttatgagatttattataatgaggacaaataatacaaaagcaatacatttaaaatcaataaaaaaggagaaaaatcataagtactcctttacctttcaggaaaagttaacccttagctattaatcacatagtttaaaaaacaatataggtttcaaagaaatataaggatctcaaaactatgattctgcattaatttattgtataaatgttttcatagaaaacatcaatatttaacagtgaaatgtatatattaatgcaatgtttgtttatgttcaggtacatttatatacatatttgcatgtgcatttatttctgtcaataggcagttacaggagcagtaataattagcttttattcttgtgggttaagtagaacaataatatctatctacttcatgttcacttcttgagacaaagaggcaattttttatttcagctcttttctttttgttggattctattaaagttgaggtagaataaaatacaattcaaaccagttttacatatctttaatgtgtaattgagagttttttgtttttagtcctaaatactttggctccatcacagtaagtccctatgggtagctgctaaattcttaaaccagaagcaattatatttcaggaaagagtcatttaaatgtttgtatctagcaccaaatgtatttttgtcttaataaattataaaatgtctttcctctcccttattttttctaagtccaccctttcttctctcttgactttggcatatgaacttgtacttgtagccaaacacatcagttgagctgggagtattatcttaaacagctggaagggaatgatgaagatgcttggccagcccatcacccagccagccttcctctgtttcctccccacccaagttctagattttggcttcacccaatccaaccagcctcttctaattaactcttccatactcagttgtctaaagcgatatggcaaaacttactgccagtcctattttggattagtttgtagaatatttgtgtctttacaagtcatacctttacaacagctcttgttatatgaatattctacaaattaactcccatcacctatgtctgctgagcattggaatattagttggactgtcaagatgccatagaggagacaggtggtttctatggagaaaagcagctagctgccagaggtccagctccaactgtagcccccccttcctaaaataaccttgtcaccaggattgaggctttctatatgccagattgtaggttgaggcacccacagtttcaacaagactacttagctatggtagcttcatcagtaactttcagatacacattttgtttcattttcatgggaatgcaacaatattaaccccacagaaagaaatggatgctcagagcattaactgatttgttcaagtcacgcaaccagtacacggcagaggtgggaccaaaacacaggacttctgagtgcctgtgtgtcatgtactccaaaacagcaaagtctttggcaatgtctctcaaaaattctcagactgtatctgcataaaatcgctgtgggtgatttttaaaatgcacgttcctggatgcagtcaagacctaagaattacattctctgagagtggggccaagaatctgcattttaatgaggtccctaggtaattttcattcatagtagagttacagaaaggctaagtcttttcttctattcctaaactttggagtatccgtttttcatcagaaatgcttctgggatctttaaattaattgcctgggttgtcttaggaacaagtcaaatacttatataatattttctacatcctaggtcttgttaattgattaaattctcacaacaaccttacaaggtagataatagtattacaatactcatgttatagataaggagacttaggcacagaaaagctaaagggacttccctcaaattacacacaagatgtgatcctgggccatctggctccagagtccatttgtcaaccactacactatgctagtgctacagcttcaaacaaagaatcacagtcactgaaaagtgctggagagcaactgctcgtggaaatctttgctctgagcttcatggaacagatcagagttcctccaggatgtcctgctccatactccaatgccttcacagctgttctccctgctaacatgccatgtatgccctcctaatctgacaaaacctggacacttcctggatgtccagagtgagcctgatgtccctcatttttgttcccagggcctagtgcacacaagcctcctggcactaattatactaacctatacctgcaaatctaagcctattttccacaggaaactagaacttcctaagggtagatattgagccttatttattttctgccctaagtatctagcagtcagcgggaactccatagatgcttgtggaataagtgaatggtggaatatacagtaaagaatggttattccctttataacagaatttaccaaaagtttctgaatccctgtgttcattgacatatcattaatgtcttgacagaaagcctaaaggactgaaaggtaaagccactgccaactggagatcaatccagtatcagataaaacatctttgaagtcatgatgtaagtcagtgggaaagcttctacgggatctaaaaatgtgaattagacacagcttttcaaggacactcctgttgcacaaaagggagtgtacacgttagagaaggtttgcctcagtgctatcaacatgtaagcagatggggacatgaaacagcttgtgaattcagtccttttctctccagctggcagaagcaaggattttgagaactctgctctcctgtctactgaaggatcatgtttccctgctctgcaatgaccatcaaagccatctgggaaaaacaaaattcttttgcacaagaacatagggagcaacagggaagaacaaagctgcagtactttggttctttggctcccgcttctggaaaactctagttggtattttatctagcttgttctctcagtggtgtagtaaatcaaacaggatagttgcaaaatgttctacagtgttggggaagaagaatttcttacatgcctagaaagccaccagggttgtaaattaaattcctcaaacaaagcagccccaaacacacagaatattagcttccccattttgtgtagttttctaagctcttgagattgtgtacatgttaaacacattcactgccattttcttccttgaaaaagattttgagttttctgtcacatcaaagaatgtatatcaaagaaatacaaaatggaatttgtgattagtagaaacagagcatattaatttttccttctaaacaataccctaagatgaaaacaggctaaagccattatgctaatccagtgatggaaggcacagattaccacacaaataaacaatgtgtgttacagaatacagactagagtgtgcctcacaattatattttatggtggaatatatgtttacggagcttttggcctggtcatttaagaaaaatgtccttaggctgggtgtggtggctgaagcctgtaatcccagcactttgggaggccgaggcgggtggatcaccttgaggtcaggagttcaagaccagcctggccaacatggtgaaacccggtctctactaaaaatacaaaaattagctgggcgtggtggtaggtgcctgtaaccccagctatttgggaagctgaggcagaagaatcacttgaacctagcagttggaggttgcaatgagcccagatcgcgccattgcactccagcctgggcaacaagagtgaaaccctgtctcataaaaaatgcccttaagtttgtaggtctctacaagtttcatgtgaaatatggagttctgtgaaagccatatctcatggaataaatcccaatcaatgtctttgaccagaagttcaggagtgagtgccctctgcctatggtcacaggtttaatcaactccagtatgggccagttatctctgctactatggtctgaatgtgtgtgtctccccaaaattcatatgttgaaatcctaacctccaaggtgatgttattcagtggtgcgggcctttgggaggtgactacatcactagaatgggattagtgctcttatgaaagaagcccaaaagagaaccctcattccttccaccatgcaaggacacaactagaagctgccatctatgaacaacaaagttggccttatctagacattaaatctgctggcaccttgatcttgaactgtggaaaattcagttgttcataagccacatggtttatggtattttgttatagcagcctgaacagactaagatgtctgctctgcccaacagtcaaagaatgtactattatttccttttaacatggatcctatgggacaattaggcaggaaacatagatgcttgttcaaagaaacagcatccccaaaacaaaaccaatctaagaagtgcattcctcatgaagaagaatttatcaaccatattaacatgttgttctctcttttaaactcctattttttgcttctttttattcagttcattctcaggaagtgtgttgtgagaacagatctaagccaatgtaatcatcaatattatcaatattaggttccttctggtaggtgagatacgtgggtctcctctcccataccttactaccaaatttgtcatacgttcaaatgtctattagcaagcagacacagcacaggtaatcagttccatgataattcactgtctctgttcttttcagtgccccccagcagtttgcatcaagagctcaggggaggcagatgcgttgatgttctagtgcaatactcagcattattttagttactatagaacaatcctgcaagcagaatggtctaggctataaacctacagtgatattagaaaggtgaccagatttccagacttgtatcactagattcccaaattttgttcatgcaatagtacagaatccacaaatcttaaactccatttaaccattgtaaaaaaaaatacatttctaagtcttctttgttgatcagatatgttgataattgaaatgtttatggtaactacctcatgcatctttgaaatactaaacactctgaattgaatatcctcaattaggtgcttcagatattggtttaccatctctgagagatagaataattcatgtgtaatacacacactccacagtgtccacatggaagaatttaaaagtaaattacagaaagtaaaaacaagtggaacctctatttttaacattctttcattaaattcagcatcaaaatgagtgattccaggaagtacatgacaaaactctccccacccatgtcaagagtccttagcaaatcttgtttcctttctacagtatgtgaaagcctggggatccagagagcatggatagagaacaacaacaacaaccctgagcattagttccaggtaggcaaataaccatacaagtccatttagtttggaatttttgtgctaaagtttccctaagaggtattgtcagaccaactgagatacatattagttcttcctcagacaagtgcaacaggttcaattcggttgagttaaataacattatggaatacatgcttgtgtttctcccaatctcaccatcaaccttatatgccagctttgaactattggcttacaggactgcattaatcacatgcctgcttaaaaaaagtatttgcctactaataagaaacaaattctttagcctaaaaacaaaacttcaacctacctctatagcctggttggcgactgctttgaccatttcttcccattccattgagaatgtcagtgtgagctagtctcaataaccaaaatgacttttcacacctctccaaggatccacccttagctagctctgaggatgtggtaaattaatctgtctcaccacagcacgtggcagaaagcttatactggatgttggtctggcagccagacaaactgggccacccaaagaccaggagaccccagaccccaggagtaggcctgaggtagacaaagtagctagtcagcaagagaaggcagcaccaagcaaagaaagtccaaggaactctgaatcccctgcgatcctctctgacttaccccgtgaagcctgaaatgtcttgtgccataagcaaccttcttggcagtcccagactcatattcaaagccctcgtcaagtttcctctgctctctatgcccttgatttagactgcagaattggtctggacttgcagtgggtttagtgtccctcccaggtccccagtgacatgtattacatctccctccttgaatgctttaccttgctttttaagtatttactaacgtaactgactcctcactgggctatacatttcctaaatgagcctgggccccattcatcttagtgttcccagaacctagcaaagtgcttagctcatagtaaatgcttttaaaaatgttcatcaaataagtgaataaataagtgcactctagtttagaaatgtaacagcacttcctcattactgcatagcttgttgatctagattctcattatcatgaccctggatagtacccattctcaaactcttccatagtggatcagaagcaagcccttgagccccttccccaacaaactttactggaatgtacttcattatccctggttttcattatccttggtaagtacaacagtcaatctgcacacacacacggtatcttgatgttttaattatcttactaataaattccctgaagtaaaaggcatgtttgtttgtttttcaattttatgacaatgttttatttaaattcttaaaaactctccggtatcactaataaataccatatgcaagaaactaggctagctgggtggggcccaaaaatgatatgatatcatctttcttttcacagatctttttatctacatggggaacaggatatagacccatgaactgaatcaccatcacacgaaccatgcagacagaggattagggaggctttgccggggggcggccactggtcaggtagagatggcatgtgaggatttgaaaagaaagtggtactgagacagaagacataatttaagcacttaaggtcaggaaagtggcagcaagcaagtctaggctctaaaatgctttgcagcaaccccagcagtgagcaagaagaggccgggatcaggcccagtggaaaggctgggtcgaaacaggctctatttaagatcagtggtggtcacccaccatatccaaacaatatgattcttccaacttagctaagggaagggagtaagggaagcagggagggaatgagggaagctcttagtgtaattacttgtagaaatttggtaatatatgtacactatgcaggaaacaatggtttttccttaatatagcaatgcatgaggacatatcactatttttcaaacaaaacccagaacagcatactcaaccctactctcttatttggagctgtgtgaaaaagtaaacttaacttttgtccagaccttctgaataaggtaaactgactcatgtctagaaacaggtttttttctatagtaagagaataattaaattttatattttatgaatatattattaaaaacaccaatcaataaactccaaaggatgagttcaagtttagaccaatgagatagccaccataagatgtatctgggtacaacccgatgtgatgacacatattgtgcagggtactataggcccctagagagcagcagccagtattatccaaagactgatatcagaggctcatgtcaggctgcttaacaaccactgagctgggctgggtattcccgctctcatcaagggggactgtgtccaaatcccacataaggagggctgcaaagtctcccctataccttagacagactgcacacaagtcaagtcctttgatgccaaagtaattttgttactgagccctataagaccactctcatgtccttccccctaaaaagtaagagatataaaatatactttgccctggaaggtccttgcttggagtgaatgtaaatagaaggctttgagtgcaaagacctactgaaaatataaatgttctaataatgatttatttgtaagcctaactcttctactggactgggagctccctgaggtctggtctgaatggtgtctccaaggcttcattcagtgctcagtggacggtgtaggctcagtacatgcttttttgagtatacaaaaaataaatgctacaaggcaggagagtggccctaaatgaaaatttgagttttaaagttgctatggcatataagtacttaagagacactgcagaaactgtatagaatcatgtatagaatcatgaatagaatcaatcctacatgtataacaatttatttgtagacaagatcataggagcagcattgtggatatcaaggtgggctcactttctaatgtcagaggctggtgctcattggagtgtgcctctcagtcacatctagttcttgaaatctgaggaaaaactctatttaaaagtagagagactgaaaaaaatgagtcttggattagctagattcagataattcaatatttttactactaaaccacagagatctagattactagggaacagaaattgccttgaattaaataccactctgggtaagctagtattggcttaatgagctttttgtgtactgggcttaataaaaaattgtattagtcattttatacaaatatagtggagctgatgaattactcataataaagaaaaataacccctaatccattttaataattcccatatttcaaaatacagaaatttgtcctcaagcacacagaatcctagatgataatacaggcccagagaaatgaagtgagttgctaaagtcacataactaattaatgaaggagataagattggaaccaaggtctcgcaacgccttgtctggcacacttctaccacatcagtgatttccaaacagtgccctgtagaagcccttcgaggatcctgggacagcaggtgagggggcctggcaggcacagttcccctctttgcatcatgctgtcttttcatgcagacccttgtgctttagtgcactggtacccagatttgtggatttcatgctactgtaaaaaaataaagaatgactacatacaattactatcatgtcataaaagaagggatattttaaaactcaaaacatttggaggagagaatcttggaataaatagaaattatttataaaacacagcatggttccacatttttctcatttcactaagaataacaggaaaaaatcctcaatgtggaaagtcactgttctgtagaccttcatttgggaagcagtggttttgtggcaagaacatagaatttggatttcaaccacatcacagtagcagtgcatcttgaatgactcattttaatttctaagttttgtttcttatgtataaagttcaatagtaattcctgacacacaccacagtccctcactcccatcctctgcaagagttgctcctttcaaagatatctacttctgttattctcaaaaggtgggctcaggactacttgcatcagaataatctgaggtgcatattaaaaacccaagttccttgaacctaacccagatgaggtttccaagaaatggggttggttttaagtggtttagtttagaaggcacaaagcctgagttgttattttttaatgatagtttacaacatctgctctaattaccagaggctgatggtaagattatgcagataaaattcctttggaaaactgcagcaactataaaaatagaaaacagagaataagggaaaggaagacaagaataaggactaaagagaagatgcgaggagggcaaaccatttattcttaaattagttttcttacctgatgaacaaggactgtgaacgggatcaatgactttttaaccaccccattagcagctaaactattttcaaagaaaatcttttaaggaaataaatcttttaagaaagcaatgtcttctgacaaaggcagagttgctctagtagaagtggcccagagttctgtcccgtcaatgccctatctcattccctccatcctcctggtagcctctgaggccccctatgctagaagataatagaatgacctgcttgctctctgaggtattgttctgattccagagaaggtaggtctaaccattaactaatgctatgtattttaatataatcaacacagaaaatgtagccacccaatcaccagattctccctgaaaagtgattcacgtgcaggacatcttaagcagcatggcacaccacaaacatgatcaataagaaggtaccacacttaattttttagtccattactgttcttcacctaacacagaggttctcaccaagtaatctgctccctttctttcctcaccggacccatggaatctgttgcttcctttccatcctccatggctacagccatcgtacaagtttcaggaaggccacccaaccaccttcttcacatcatcctagccttcagacccctttagtccatctaatatcttcttgccaactcattgtcttgatagtgacatctgaaaacaagttctcaccccatggtcttcatagagacaattccaactcattaaccccagacactcacatttcttagctcctctcattaaaaagcacactggtctaggggtctttttgagtcatcagggtccaagctcctgctccacacctcacacacgtgttcctctccaggctcctatctcaggagatgacagattccaccactcaccaaggtgttgagatcaaatccttatagtcactcttgacatgtttacttctctcaaatccccatcctacccacatgtatgaaacaaggcccctcctcacgccctccaccctggccaccatcatgcctccctggcttgctctctgctcccatcttcttctacttttcttcttgctcagctcactctgctccagctccctagccttcttgctgtcctccaatacaccaagcacattccagtttctgggcctttgtacatgcctgttcctctgcctggaatgctcttccccaagatgtctgcatggatatagccctcttttcattgaggttctgcttcaatatcactgcttcagagaggtcttccctaagcaccttatttcaaagagtgcttctacaactctatctttaccctgcttaatttttcttcataacatcaccacctgaaattcaattatatatgcatcagttgacacatttattatctgattccactctcatttgttgtggagcagcatgaagtctgagtggtaactttgtttctgacccagtgtcaccgatgtctagaatgatatagggcactctgaaggttttcaataagtcaatcactcaattaaacaaaaatctaactcatctttaaatccctcattttatcaactactccttcacatttaatattaaataatgtatatttttaaattttttaaattgtggtaaaacacacttaacaaaatttaccatcttaaccatttttaaatgtaccgtgcagtagcagtcattgcattcacattgtgcaagcatcatcaccatccatccacggaactctcttcatcttgcaaaatggaaactccacatccatgagacaataactccccattcttccttctctagcccctggcaaccaccattctactttctgtctctatgaatgtgactactctaggtacttcatataaatggaatcctataaactacaaatcattatatgcaaaacttgaataattctctttaaaccttgcatcaactcaattcaatttttgactggcttatttcacttaacataatattctcaaggttcatccatgttggttctttggcctatattcccaaaagtagaactgctggatcatatggcaattctatttttgtttttttgaggaactgtcctaccgtttcccacagcagctgcatcattttgcattcctattaacaatgcacaagggttccaatttctgtacatcctaaccaacacttatttggttttttttgatagtagtcatcctaacaggtgtgaaatggtatctccatgtggttttgatttgcatttccctagtcattagtgatgctgagtatctttccttgtgcttattagccatttgtatatcttctttggagaaatgtcttttccagtcctttgcccattttttaatcaggctgcttgggtttttgttgttgttgggttgtagaggtttttagatattctgggtattaaccccttatcaaatatatgatttgcaaatattttctcccatccagtggggttactaaataatttatattcttcattttttaagttggttggttctcttaatctatccataacggtttctactttggacagtgtactcacagagaacagagatggtgcctgttgatttgatccatgcaatgcttaacaaacaatgctctatgcaggctggatggttaaagttttttgaagattatacaacaatatagtgtactatttggtatcacttttctttcaatagtggcagacaaatggaagtacaactgttaattaaaagcacataatgttgcctgattatgagtaaaatgtcccagctcactacagcacaattcctacagcattagtggagaattaactagctttattaaagatttggaggactagtcactttttcatcatcctttaattaaaacctccacatcttccacttaaaagcctttgtttcgtacccattattttcattctttattctggccttgaaaaaccaggatgaaaaacagtaaaagcaaaaacgtttctaaatgagcttttcatgctgtaataataaaaaggcatagctttctaaaatactgaaaaaaaataaaattttaatgttctttgaactagaaggccaggaaaagaaacagagaaaagcagtgtttagcagaacattttggagttcaatgttcttttatattctaaaatgaattaatgctactatataatttctctctaccttcccactcacactaactgaaagataccacagttgaggggtaccagttcaaggtcctaaagtggaaagctattgttatactctagcctactttacttttttcttaacttggaatcattatttattttgaagtaaatggcatgatgcagtggtttgaatgtgccccctccaaaattcaggtattgaaacttaatggccaatgtgataggattaagaggtgacatggtcatacgggcttgttcctcatgaatgggattacggcccatatgaaacaggcattacacagcattcggccctcttgcccttctgccgtgtgaagacacagcattcctcccctctggaggatgcagaaacaatgcactctattggaagcagagtgcagccctacagacatcaaacttgccagagccttgttcttgaaattcccaacctccagaactgtgagaaatgaatttatgttcttcataaattacccagtttcaggtattttgttacagcaacactaatgaactaagacacacggcaagacagaacctccctcaacctcagctccctcctcccgaagatccacgcataagggtgcccagcacagaccctcacaaatatcagacacttaataataaattaataatttaaaaaccattagctagaatttggtggatgttctgggccaaacctcatactgtgtgcttcatattcacaatgtcacaacaactacataggcagctgtggtcacttgatgaccactatacaatgttacacttaactgcatatttctccccataacttgcccaacccaagttacagactttctctcccctaaaaatactagaatatgctacttagggaaaggagaacttgattttttaaaaaatatattgattttggagcctacatttctaaatctttgtatacagtttatagagttcattacatagctaatttcagctcagctgagaagaaatctaaaaataatatgctttttggtttcgtcactgaaacattcattctgtcattgaatttagcctgatgcatcttacaagaagaaaaatctgatataatgtgtgtggaaaagaatttgactgatggaaaggaataaaagtgagccagtgcaatgtctataccagaattattatttgtatgattaaaacataaagacacctgaatttatcttttctgcttctgctgtttcagtctcattaagactatgtttctgctttcttctaaatattgttttccatatttcaaacatctaattaagtaaacacaatacaaagtgagatgatatactgtttggaaaaccataaaattatagagtagatagacttccattataatccaattttcattctgtcataattttccaagagagtttcctttggggttaaaattttctaagcttgatttcagttcaaaattgaatgttttcattcacttgtatgtagaaaagactcaattcagtcttttctgttgatcatatgagtgtgtttcctttaaaagtagacaaggcttaattttgttgatgaaacctatgacagacttctagacccaccttactttcaacttcttgggcacttaaaataattacttaagtaatataaagggtacagaagccaacagagaatatgtttctttgccttagtcctccagtcctaccctatgtacaacgtgcccccagcatataccctttgtatacataggactgttgtcttaccacagaaactaagaactagaattgttggatcaaaaggaatgcactttttaaatagtaatatatgctgcccaactatcttccaaaaagccttcactacattattataatctcaccaaaagcacatagatgagaatacctattgcctatatttattaacactgaatgttattgatctattgaataaaaagttatcttaatataaaatttcaaaattatgagtattttattgtccatttaaaaaattgtatctcttatcttgcctttgaatatttatttttcattttgctgcagtagagctgtaagttattctttcatagaaggttttgtacctctaaaagtattttgcctttatgtttgagaatcctaggttcaaaaagttttccacgagaattttaaagtcttgtgcttcactgtattacagaatccagggcggccaaaaagaagtccactaacagaatcctctttctttcttaggtagattttttaatatataggttatttgtctttcatcatgctgggaaagtgattgacccacttaatctgaaggcacaaatctgtcttcgatttagagaaattatcttatttatttgataattgccttgtattttgagaggactgcttcaatttctcaagtaataatattaataatgataacagaagctaatatacgttaaacgtttctgcttgttttaaatattttacatgtattaggtcatttaatcctcatagaaaccgtgttacagtagcccctccatccttagtttcacttttttgcgctttagttacccacagtcaaccacagtctgaaagtattattgcatgctgttctgagtagcatgatgaaatcttgcaccgttccacccaatatgtgaatcctcctttcgtccagaggatccttgctgtaggcactcattcccagttagtcacttagtagccctctcagttgctaaatcaactgtccttgtatctcagtgctactgttaaagtaacccttatttgacttactaatgggcccaaagcacaaggtagtgatgctggcaatttggagatgccaaagagaaactagacagtgcttcctttaagtgaaaaagtgaaagttcttaatatggaaagaaaaatcatatgctgaggttgctaagatctatgctaagaatctgtttgtcaaattataaagaaggaaaaagaaatttgtgctagttttgctgtcacatctcttcaaactgcaaaagttatggcctcagtgtgtgataagtgcttacttaagatacaaaaggcattaaatttgtgtgtggacgacatgtacagaaatgagttccaattgacagcaattgggtttggtactgtccgtggctttaggcatccactgggagtctcagaacacatccccttggttaagggggcactactgtattcccattttacagatgaagacatcgacagaagctaagtaactttcctaaatgatactattagaagcagaagtgccaagtttactcctaggccaactgtctctaggccccaattatataagccaataactaaaaattgtttgcacagctattaaaacaacaaactatgaatgcagctgtcacactaacctgtccaatccaggtagtctgagtttaaatgccaagaatgcctctgactcaagatccttctgaatcagtgactaaagtcagatgactctcctgtgtacatatgctgtttcaatactcatctaatattttatgttgcctgtgagtgaaggttaccttggagagaaggggaagcaactaaacaaagcatccaatgttcatagtatttcaaacaatacctatcaactttcataaatggtcttattcaatggagatagcaagtttgacattgatattgttaagaactaaagtatatgatcagagcagacaatgtatttacaggatttatttcctgatagaaggagtagaatttttccaaaagaatcagagctgtacaaaggaaaggtgcttccatccaattatttcctacttgtcatctctgataggaacccacctgggggtgatctgcagagtctacctgtgttaaatttcttcacatagagctagctcatcatgcaagtggtactaagaaatgaaaattatatggcttagaaaatggtttagcagaatgccaacaagcagaactatctcatgtgcagatattatgcaaccccaggatttgaaaatagttacctttacccactagtcccatgctgtgtgtagaataaaccaggttgagaatgatcaaaagttaacagattatagcaacaatatagttatagcaacaattgtataaaacaaaactgtgtctaaattgaaagtacctctggctacttttaaatcttcaagaacaggaatttgccaaatcattaaaatcaaattagcataattaaggatctaaaattgttagagtattaatgtgattacatttatttaaacccagttaatgaaaaattactgttacacccttttaagaaaaaaattacattaaattatatcattgggtaccatttagattagccagttaatctcaatataaccaaaatctgtatcagtaataggagtgttagtaatttatatataattagaatgaaagctttttggccataaacaatctggggaagtccttataaaataataagtgggaaaacaaattgtcctactctataaaagacattatgcaaaatataatacaaaaaaactaaaataatataatacttttttttacaagaagtaaataatactttttttttacaagaagtaaaaatagtattattagggtaacagtactgtaggaggttttatactttccttaaatttttaatttaaaaagttttaatctacaatgaactcaaacaaatttacaagaaaaaaacaaacaaccccattgaaaagtgggtgaaggatatgaatagacacttctcaaaagaagacatttatgcagccaaaaacacatgaaaaaatgctcatcatcactggccatcagagaaatgcaaatcaaaaccacaatgagacaccatctcacaccagttagaatggtgatcattaaaaagtcaggaaacaacaggtgctggagagcatgtggagaaataggaacacttttacactgttggtgggactgtaaactagttcaaccattgtggaagtcagtgtggcaattcctcagggatctagaactagaaataccatttgacccagccatcccattactgggtatatacccaaaggattataaatcatgctgctataaagacacatgcacacatatgtttattgtggcactattcacaatagcaaagacttggaaccaacccaaatgtccaacaacgatagactggattaagaaaatgtggcacatatacaccatggaatactatgcagccataaaaaatgatgagttcatgtcctttgtagggacatggatgaagctggaaaccatcattctcagcaaactatcgcaaggacaaaaaacccaacaccgcatgttctcactcataggtgggaattgaacaatgagaacacacagacacaagaaggggaacatcacacactggggcctgttgtggggtgaggggaggggggagggatagcattaggagatatacctaatgctaaatgacgagttaatgggtgcagcacaccaacattgcacatgtatacatatgtagcaaacctgcacgttgtgcacatgtaccctaaaacttaaagtataataaaataaaatttaaaaaaagaaagttaaaaaagttttaatttttaacatgttaaagactgaataaatagctctgttaaaataaagaaaaagaagaaaataaaatggtattattttctatccagtttaacattttggtatatacttttccagtttttctctttattattcatatttttaatttaaaatctgtaactcttaaactataatgttaataacaattctgttcctttgtcacttaacaatgcactgtggactttttttacattttaaaatgttcttctatgacagtggttctcaaagtatggtccacagaaccctagatgtccctgatagatccttttttatggtctgggaggctaagtctattttcataatactaaaatgttttttgccttttttactgtgttgacatttgcaccgatggggcaaaagcaatggttggtaaaactgctataagattcaaaagaaacaaggcagattttgattgttgatgtagtatcaaagaacaatatccaaagttatctgaagaaattattaaaacactcctctatttacaactacttatatttctgaggctggattttctccattttcctcactgaagcatcgtaacaggttgaatagtaatgcagctacgaggatccaaatgtcttccatcaagccagagtaagacactaaaaagatctgcaaaaatgtgaaaggatactaaccttcttgttatatgttttgttttcaaaaatatatttttaaagagtatcttatgttaaacaatgtgttttatttttaaatgtgtaaatatatatacaaatatattaaatatatatattaaaattttctattttcatttctaatacagtattgatggatataaccacatgaacaaaagctttttgaagccccaaataatttttacgagtattaagaagtactgagaaaaagtctgagacgtgcagtttataacagcacttttacagaaagcacagtgatctttttcatggacatgccttaatttatttagccctggaatatacatacatttcttgaaaacgaggactactacgtaaatcctaaagggcctggtgagaaatgtgcacccggtgagtaatgacctgattttggagccacagttcatggtcatcatatcttcccccaggaggagggctgattgaagaagaggatctaggactagataaagccccctcagctatgggtgcctacattcattctcctgctgagtttttttctcccttctcaatattttgtgtcatttttctaggatttccacagaaaaacactgaaagaagttggaatacaatttatttcaataaatcgagtattttcctttagctctcatgaagtctctgatatattttttccatttctgattggcattctatcaggtagagtcctgggtacatgagttttgtcacccaactaccttcctgtcctcactacctctgagtccatcactggtgatgcacacggcccttaatgacatggcccagtttatacgttttctaactctagacttcttaaatcagattacttacactaattaatttttaaaattagtttagaaattaaaaaacatctgcccagagtttgaaagcatacaaattctataaaatgccattctctcatgccttatattacttaacaaattaaatatatacagagttagcctcattaaactcgaatggtctctgggagacctacctaagtaactctgaagcagactatattccctaaaatgtattctgaagtactgaggaattttcattgttatggaggcgtttgagcacccattttttagtaggccaggatatccttgccagaatgctaaagagagtagaactaaatgacagtacagccatgtaaggttctcaaactgtgaacattgatgctgtttattccgtaatttagtgtaaaatgagtgtgggaatctttattagtgattttcaagtgcaaaagttgaatttgtcctccaaaaatttgcactggcttttactgttgtaaaccaagccacagcctccttaatccaacataccctttccgttgtatgagtccaaccacaaacacactttagatcctcaagaaataatttctcaagaaaacatagtggagtaagtagcaacccacttgggtccttaaccaggctcctctgggcctaggataactgcacctgggctacaggcttgtgttctgaagaacaggctcagtgttgctggcaactgctgagttaaaatttccaaccaccacactcctcgtccacagccctgatgtctacccctttcctctcccagaatagttcagtgatttccacaccaggtacagagtctgatcagtttccagggataatattttaccttctctcactcctatgaaaaaaggaaaaaaaacaactgttcgctaccccatcccttaactcctagagggtaaagacaataatgctatcacagactgaagacggtaggtgtacctaggctaggtcttctagggattgtggaaaatgatgcttttagtctctttgcaaattacaatattccaagatgaccacagtaggaatgggtgctcctaaagcgcagatgcctaaggtggtctcttcagtccagtatttgtcaactggcaacaattttgctctccaggagacatgtggcaatttctggagacatttttggctatcacaatggggctggggggtgttgccactagcaactagtaagcagaagttaggggtgctgctaaatacccacaatgctcaggacagaccccaaaacaaggtattatttagcccaaaatgacaacaggttaagaaatcctgtcccagtctgatgtcaaatgcatgcttctggatccatggatttaaatgaaaatattgcttacattacttgatagttcattcaattatttgcattcatgtacagttttcattatcagagatctgagcctggctctaacatctactagttgtgtgacctttagcaaggagcttaaacactccacacctgatctatgaatagggaaaataactcctccacacaattgtcatagagattacactacagagtacatataaagtgcttagtgagtagaggttagctgctgctgctatcattatcatcatcattatcatgaaagacttaataactactaggtgcctgacactatgtttagaaatacaaacacattttcttatattctgaaaatacaagaaagaataaagacttagaacctatcactaaagaactcacagaaacacctagctgagcaaaaacatatgagaagacctatctgactatgtagcaagatccatcttttcatttgcctctagcatcccaggaagcaatgcttggccctcttgggtcttcttataccctgccttccagtacctctccccccatcgttaactcaatacactgtagtacttcaggcactttgtagcaaagagttactctcacaaaaagagaaaatagcaagctagtgaatgacttctcgtggacctcagaaaggacctcagaaatcttcaccaagttcacgattcaggtgttaaaagtttcagcccatgagcagcacacggtcagcacatatcatcaggctacttgctccccatggtatttttgggatttgtcaggtagaaactcttaatttagaagaactaagcatctttcaaggaaaaaaaaatccctgctaaaatattattcataatttattttccttattgtatcaagtgacttttacttatccttcttatatcacctgatacagttccactccttgttctgtgcaggaaagttttaatttgcacatacacattataatttgtaactgtaagaatgactgcagcgtcacattcactagaataatggcctgtagcataaataaataggggtcataagggaagtatatgccttaggagaatatcctttaagctgtgcagttcagaaatgaggttctgtcttgcaccgttctacacattcagcggcaggaaaaattacttggaaggtaaaagccctattaaatgccatctttttttgttgatttggattaaacccaaatgattatttttaagttaatgtaaaaacactgtggaaaaatgaatcatgttttaattgctataatgctgcatcatttacttaaactagaaatgattggtgaatctggtttggtggtatgtcccaaacaagccaattagtacagagattaacctctataatcactctctagccgattgctttccataattttttcataaaatttgtttgcattcatgtttttgaatgaagcaggtaactagccttgcattttagaattttagtcctgtttcatagaaaagtttacaatatttgctttggagaaatttattgctgatttacttgcatgtaatacaaaaatcccatactttgctgagaggcttcaaaccataaaaggacacaagataattactttttggactatttaggaagcagggagtttcacttaaaaaaaaaaactccatggtttctcaactctataaatgcttctttaagaaaaatatacattccaaaccagaatgataaaggaggcacagaagtgtctgcatgacagccttcttccttcaaaatacatcaccaccttccataacatctgctctatcattttggtcactcacaaccttatatgctcagaaagaaatatttgtaagatctaatgtaaaaagtgcccagctgttcacccttatgctggggcagtcctagtggtatatttgtcctgtatctaaatggatgctctatttgtatctgtctctatcaaatgtatcagatacatatggaggatataaggtggattatctttagaccaatttacataaaaaaccaaggagcttcctcagatggaatggaagaaaatggagtgccaaggaaacaatctgcttctaggacaagacacaatgatgtcagaaaaatgaagtaatggtgaaaaaaccacacataggtaaagtctttgaatactgagagactggttcagtgggcactcatgaatcctgggcagagaaactgcaataaatgcagagctaataattcagaatggtttatctgaaatctcagtggggcactagaaaggcatgacgttggcactcatccactgatgggagataatactcattactgagctacacataactgccactagatatggggctctgtcaccatggacgggttatcagttgaagtcacaactcccagctaccaatgacaagtgaaggcacagcaactggaaaccttcccagggtagaaggggaataacttgctggtgattagtggtaaataagaggcctcattcacagaatgtatgtgagacactcactggagtctccagagctatttgggaggaatctgagtgagcaagctgaagccaaagaaatgctgttttgtaactgttactgtgatttgtttttatccccaggatgaagtggcttgggaaatacaggaaacttgcagaagtaatgatgactgcgataatagctactttattttctatgtagttctctgcattgtttctgtgaagtaagacaactatatcaaaatatttcactgaaaattaataagctctcaagtgaaattataaaagatcttgtgatgtgagacacactatccaaaagtactgaaccaggtggaggaaactgctgaaaatcaatgtctcctctattttctcacgatataccacagacagagaacattacctagcttattactgattggaactaaggagtagaaaaagcactatctgatttccctggagtctcagggttgtatggggcaccccctgcatctgcccagccttctacccgggaggaacactcctcaaacatacctggaggcagaagacatcctacagggtacttagcctctgtcctgcaaccacacaatagtcctgcctctcagtgaactggcctttcctgggctaaggacccagcctctccagatctatgactgtcacagtgctcttagcgctagctgatctccctcagcctgtaccagggttcaacccatctgatcaggctgcctctgagcctagccctcctgccaggtgtgtgcacgctgatatagccactctctcaggtaatgcctaacttaacatcatgatatatttaatcctcccataaaatatttccttcatttctcttttatttcatcattttttaaaaaaccatagagaagatgagaaactaaatgtggaatggtatgtcacaggtctgaataaggctagaatgaccctaacgtgacacattttagattgtagacttggggtacacatatataaattattgtagactttggggtgggttaaataacattcagattaggaaaacttcctttcattgcttttatactaaaaattactgtatgaattaatgttgaattttaataaatactttatcatcatataatgaggtaatcatgtgctttttcttctttataaaattagtatgaaaaattacattgagtcaatcttgtgcccctggtttaattccaatttgctcatgtattaactatttaatatattacttgctaatgttttcatcaggattttgtacttatttgacataaagttgttaatatcctcttattatatttctaatgtctgcaaggaactataatgatgtcctcctcttttttcattcttaccacctggctatagttttagtctcttctttttccttgtttgaggttgaaaatgttaatagacttctcaagaaaacatttgcctttcctccccgcccctgcccttttggagacggggtctcactctcattcacactggagtgcagtggtgtgatcacagctcactgcagcctcaaactcctgggctcaagcaatcctctcacatcagactctcaagcagctgggactataggtgtatgtcatcatgcccagctaattttttcatttttcaaggatggtggtctcgctatgatgcccagggtggtcttgaactcctggcctcaagtgatcttcctgcctcggcctccatagtcactgggattacaggcatgaaccacaacacctggctcttggctttgatgatgatttctgctgtacatttatttcttgtttttgtttctaaattttcattattttctgctctcctcgttactttccttcttcctactttgctttagtttattttccctttttctaagtttttgagatgaatgttgtttaatttttagtcttcctttgaacatatgcacttaaggctatacattttcctcaaagatggcattagttgcattttatatattttgatatgtcgacatttcaatatcattcaggtcaaaatattttctaatttccactgtgatttctcctttaacccagtatttatacagaactatgtttcctaatttttaaacatagaaatattcaagattttgctgttgttttcaggattattgttactgtcttgtagcttaaataaattatgatcaacttttaattatttataagttttcaatcctttgaaataattttagatttgctttttggctcacaagtttttttatatgttctatgtatactagaaaaaaatgattttctgcacttgtgtattcaatatctttatgtgcccataaagtttgtcatattatttaaactttctaaatgcttactaatgttttgtgtgtactctcaattcctgaaagagatatattgcaatgtcttactctctgaattttcctgtttctcctcttagttctgtcaatctttgatctaaatagtttatattattaactaaaactttgagattattttaacttccaggtgtattaaagctttcacacttgtaaaatatcctctttgtatctagtaatttttttttatttaaggtcttattagtgttagtgtagctaccatcaccctttgctaggtggagagcattagtatttacaacttatccattcttgtatattttgactttcaacctttttacacactcatattttagatatatctcttgaatgtagcattaagttggaccttatccagtcttacagtcttgtcctttaattgaaacattacatctattgacaatgaatacaattacaaacatattcgagtttaagtctaccatcttagcatctactcagctattctgaaccaagtatcagatctggttcagaaaaacataatttgtttttttccctaacactattcagcatcaacttcaaacatgtattatgaggattaaacacatttatatgagatttgtacaagtgctttgaaaatcacaatgtcctaaagccaacttcgtgttactaaatatgcttctattaaagattttccaaagatctctgatgcaggctctcgaatgcagtttcagacaagttgaaaaaaagaaaaaaaactaaaaacaagtattggcagcatgataagactcccaagatgacccttttaaaagaaagagggctcatgacctttggcatagaaaagtatgttggaaggctctcaggaggcaagggcttggtgagtttaaggaatggtaaagatgccagtgtggtgagaagtggtgagactggtgagatggctatgagctaggtcctgcagagctttgtggggttgttgactttgttagaaatgcacttcccagtatgtagtgcaatatcatggtcaggtttacattttcaattgtttattcagtcagctgtggccaaaactaattagaggaggcaagaatgtaggggagtggacaaggtaaccattcagtcttctaaaggaccccccctcaaaaaaggtggtgcctttaacttgagaaacagaagcagatagctttgagatgcctctgagggtggaatcaacagcacataagaatctcatgtggggaataagagacagggtgatgtcaaggatgatgttggtaattctaaatcaatcaacaggctgatgagaggtgtttgcagtaaatttatatctacagtaaataaagtctaatacttatagaccatttatcaaatctactgcatatcactgttgtcttatttctgttctttaatatttacaaatatcacaagcttatgaaaacctctcatagttccacactctccaaccttacacttcttccctctgtttttttttttttttttttttttttgctaaaaatgatttcagggaccagatgctgtggctcacacctgtaatcctagcattttgggaggccagggcagggggattggttgaggtcaggagtttgaggccagcctgggcaagacagtgagacctcatctctacaaaaacaatttaaaaactagccaggcatggtgacatgcacctgtagtcccagctactcagaagactaaggtgggaagatcacttagggccagcaattcgaggctgcagtgagctatgactgcaccactgtactccagcctgggcaaaagtgcgagagctgtttctaaaaaataagaaacaaaaacgatttccaataaaactgaacagtgcaccacatactatattattcttttcacaaaaggcacaatgaacctcagaggttcagaccaggttgacactgtctctaaaaaaattaaaacatgaaagtttcatcgtattgcattttcacaagaaaataaattgaaataggcagtccttgcaaaacacaatttgtttcttccctaacacaatactcgagtaccgctgctttcaaaagaagcatttctattatacaaccatcatgtttgtaattgaaataataatgtcaaatcattattgggcctgcattccatttaggttttcaagttctgagctctctccaaaataaaaagataaagtttctaatggaatcataagactgttgagtaactgaacatttttcttctttttctagttataaaagttatgtcaaaagaatccctccgaaaaaaagagaacggtttctgaacactagaaaagcttcactcactgtcgggggttccagaaaatcccctcagcaatcaatctgcagaacgtcaataacaaatgatacacttccctcaactgcaaaaacaaacagtagagatgccagaggtccctggaatttaaagcataagtgtcttcttcttttttttctttttttccgagatgaaatcttgctctgtcgttctggctggagtgcagtggcgtgatctcggctcactgcaacctctgtctctcaggttcaagctattctcaggcctcagcctcccaagaagctggggctacaggcacgtgccaccacagccccggctaattttttgtagagacagggtttcaccgtgttagccaggatgttctccatctcctgaccttgtgatccacccacctcagactcccaaagtgctgggattataggcttaagccactgtgcccggcctttttttttttttttttttctaatgagacagtctcactctgtcgcccaggctggagtgcagtgccacgatcttggctcactgcaacctctgcctcccaggctcaagcaattctcaggcctcagcctccggagtagctgggattacaggcacctgccaccacacctgcctaattttttgtattttagtagagatggggtttcaccgtgttgcccagggtagtctcaaactattgagctcaggcaatctgcctgcctcagcctcccaaagtgatgggattacaggcgtgagccacggtgccagccataagtgtcatcattcattcagactgctgtaatacaatactgtacactgggtggcttataaacaacagaaatcaatttctcacagttccagaggctgggaagtccaagattcaattcctagtgagggctcgcttcctggttcatagacggctgtctccttgctgagttctcacatggtggaagggagctctctagggcctcttttataaaggtacttgtctccttgatgagggctccggctacgtgacccaatcacctcccaaaggccctaccacctaataccatcatcttaggggtgaagatatcaacttatgaatttgcaggggacaaactttcagtctgtaagaacgagtatgcatgagggctgagaggaggggagtatgtatgttacacatggggacatggaatggggaagggtgtgaaggaaggtgaaggttgttctttcttctactgtttgttatagtgatgcttctcctggggttgagtggtaaaaagaggaaggaataaagagaggaggggaaaaattgggggatcagatagagccctgttttccaaacatcatgttttgagctattagtgaatggatcagaaacataaattgttttggtaagctagaacagaagctatcggaatatactgtatgtaatagaggtaacatttcatgaaatattttgtttcacatatagatgagtgttattgtgtgggtatatgtaaatttttgtgtgttgatttatcatataaaatgcttttcatattacggtttgtagtaaaaaatgagtcactgaactagagtatttaaggttccctgcccctgcttcccacagtacaggactgttatgttaaagacctgatgttcattttttacttgtgttttatgcctttagaacaaaatagtaagttttttctttatttctgttacccataatgatgcaaagaaaaaaaaacccttgcttctgacttttcagaaatcctgtcttattgttctcatttcatgccatgcattgatttcctgttaaatagttttcaaatctcaagccatactagatcactgagcttttaaagattatgaaaatcatctttctcttttatctcttttgtagatggtttttaaaactggcatgtgatgtggctttatttaaaaatacattcccatctacattattgtcttttttctttttcttttttttttttttttttttggatatgtagtctcactctgtctcccaggctggagtgcagcagcacgatcttggctcatggcaacctccgcctccagggttcaagcaattctcctgcctcagcctcctaagtagctgggattacaggcatgagtcaccacacctggctaatgttggccaggctagtctcaaactgacctcaagtgatctgcctgcattggcctcccaaagtgttgggattacaggcatgagccatcgcgcccagcctaagctactgtctaccagaaaaaaaagtacacagtgaatcagaatcactttcttgctgtataaacttggaaagttattcattctctctgagtgccagtttcttgggctgtaaattaaagctaatattatctccttatctagattgttgtaaggagtggagatgattcatgttaagtgcctgaccaaagttaggcactcactaaatgatattttgaattataataaaatgagaacccaagcacacaactatttcttagtaacctcatatataagcaggcctcttgttgtctactgccttgaagagcccatttaatctcctctcaccccaccaagggccaaaacatggcccgacacacagttgatgcttgataaaagttgacagaattgaattaaggggcggtgctgttgtgttttcctgatagagtacacttattgccaaaataattatagaaatcaagttttatgcccaaattagctcattaattttaggctgggagcataatcacaagagaaccgcctatctcccaaatgatccaactacaaagagaacaaaagtcaagcttcatccagtaagcgtcaccttacctggcagaggtttagcgcatctctctgctctgggaagaagccaataattgaaagcatctgctggtcaagacaagcagaacatttaggctgaagagggagtgatatttttgcttatctttaaaaggaaagaacgagttgataagagagaacagtggttttgctctgaaaccagcctgacaaactatattgaacacagaggtccgtacttattttctttcaaaaacttcctttcttctgctcccatttatacataaacaacacatatccctaaactccatccattgttttatcctcgaaattcttagccccaattggcctcactggcagcacatgctctcctgaccacacagctgcgtccaagggaggtaggggcacaaccttcaatggtatctctgctatctcaaaggaatttcagatatcattaaaacaatgtgtctgcgcctctaaataaaacaggccagtcatgtttcagtaaactgacagtcttctctaaaggaccccgaggtgtacgaagttactgagttttcccatcctaccatcttcaaagtgataaagaaaatgcaattgttatgcaactagcctttccagctgaccctagggtggcatttgctgtctactcttaaactacctcacaaaaatcatctttttgtaaagattctttgtttcctctctcatacatgcataagagaccccggggtggaggcagtgttaggatggggagggatggaccgggctcctgggaatggcctccatcagaggcctggtctgtgggccccagtcaccgtgaggggtcggtggggagtgtggagcttcccaggatcctgcctctctccctgttttctgccaagcagcaggaacacacaattcattaaagcaaagccaaaggtcatggactgagaaatagcaagaaacttccagggacttgttgattttggaaacttaatgtccacattgtgtaacagtgtgcatgttccccagggggaagtagattgctatttatgtcagaaagatgtttcagaagaagatgtctcctccaagcaaatagtatatgtctagttgttggcatctactatcctctctcctcttttattcaataaagtgatccaccttatctgagctacacagacctctgataggtgcaggggaggatgttggagggggtgccatttcgataggttggcattttctctgtaatggcaggaggcaatagaactatttgtttatgtttcaaacataaaataatgaatcagcactcgaacaagtcttgaaagataaaacgttcagtgttaattgaatctctatattgtgccagataatatttaagtgctaggaatacggtgctgaataaggtccctgccctcatagacaggtgttctagtaggaagagacaaaacagacaagctaaaacaaattttcaaagagtgataagtgctatgaagatggttaaacatggatagagactgaatggctgtggagggggcagatttcagcagatttagggaaggcctctcagatgagttggcattaaaccaaaaagtaaaggaagagaaagagctgccaagccctatcaagagcatcccaggcagcaggagcaaatgccatgcagtgatgtggaggacagtttggctgtgtgcctggagcctggtcaactacaggcacgtgcatgagaagaggtcacagggcagagcagtagggccagaccccacaggagcctggggatggtgggaggagttcctatgtcactctaactgtaaagggaaacactgagactgcaatcaaataaatctcctttgccgcctcactgtcggagccctgcttaccacatctgaaggatccatatcttccagagctctgcagattttgacagcagagatatgctcctcacacccccagcttctgctttttcattatttgtgactatcaaaacagaattttgatgacaaattatttataaataaaccaatcattaaaatatgtaagatctctcacctatcaccatacatctcacttaaccattctcatgcatcccaatgacttgaacaaaaagaaacagaaccagaaaatagtcaaaacagtacaatttaatctaaattatccttctcacaacatcactgagattgacttgccaagtcctgttcattgtcagattggattctctggaagtgagtgccttctgcaaagtatctcagacatggataacgcaggcaggactaaactgcttttcttcccatttgagttgccaatacctccctctgggccaatcgaggattattgtttcaacaatacatgcaagctaattgtttgttaagccggcccagccaaccataaaatcacaggagagtcaggcctggcccatcctcttgcctctgaactggatcacagttaatatctctgagagttccaccccaggttcacagaccaactggggaagatggctcttgagcaaactctgaattttgtttccatgaagaaaggtttctccaacataatcaactacaatcacaatttttgaaacattcacattcttaagtctgtatctgctttggtttccttaaataaaaacaagccagagataaaagtatggaaataaaatagtttcaaacagagagccctgtggaagaatgcactaacttaatatgtacttccagataaatgacaagatacatgtataagagaagcaaacttctacaaacattcattaacaatgtgtgaagataaaagttatctttgatagaaaaaggtaactgataaagacatcaaagagaaagatctgaaagtgaactttctacatactcaccagataaaacatataaaggggcaattttggtttgttttattgttgtaggtctaaaggaatactttcattttcagtagtttgtcagcaaacagcacaggaaactttactatttgaaatgagtagtctgagttaacaatagtgaccagatattataaaaccgtgttctgcctaaatatatccacaaatcttcagatggcctacaaacccaatattgaggctaaaaaagacatgacctcttgagaggctcttctagaaagtgggactctctggtactagggatatagcactgtgaaccccaaaagggagacagctctgacccccagtgcaatcaggaaagacagatgcaagccctaacttagtttacaggtttgatgtccccactgctgtgggcattcctgtccagaaacccaagtcctccccaagagagtggctagagagtatatgcaaacacaataaacctttcacagaaaaacaatgactttctatgactagaatttggccaaaggctcttcttttgagtgttagtgatataaaattctgctctaaaataatagttttagaactaagcttaaattcctgattatttgaacacattagaaaaagaaaaggagtttctatttcagaaggcatagttatttggaaactgccacagtttctttttaagtcaaaaataacaaaatttcataaaagcaaaacaactaacatccctctccctgaccctccaaagaaacctttcttagaagtattctagttccacacaatagaaaccaaattcaatgtggctgaagtaaaaacagggatgtactggcacacttaatggaaagttcaagggataaagcattcaggtatgggtagaactaggtgcttagactatgaggacctttctccatctcttaattctgctgccctctgcattggcttcatttttaagtaggttatctttaactggaggcaaaatgactatcaggacttccagatttacgttacatcatgcagcaacctcagttttataaaacacaacgaaacttcttctgggagttcaacaaatgtctcaggattgggtctccttaatctggctgggtccacatgccatccctgtggtctgctattcctgtggtctgaatggccagccctggtggcctattcctacagatgtaccacttggattccataagctaagacgggacgacccaaggtgcggctggcaggaaaggaatacaggctgacagatatcactaatggaatgtccatgtctctccctccacttacctgtttcctcctctttcaatcaaaagcctatcaaaactgggttcagatattaccttctgcaaaagcgcttcccaaattccatggaattgtttacttgaaaatggttaatttaaaaaaaacaaccaaaaaaaaccctcttcctagagtctctccttttggtgtaaagccctttctgatcctcccacaaactctgtttccctctaacactgaatttattatactttttgaaactttctgtccatatgtttgtcttaagcataatttcccaaaagacattttatccttgccatgtaggaaagtctttggcacaaaatagtaaaaatttatggaattagactgttgttgttgacagagacagttcttctctctcagagtgtatcaatcagtccactgtaatatcagtcacattgaatttattctgaaatatcaatgaaacagtctctagcaaaactcccacctttaatgtctctatcttgtaaacagaaatctgaaaactcagcaactgagaaatgcatttttacctagtcaatagaattcaaactcagacaagaatagcaaaataacaactgctaaaagtactttaaaataactcattaggaagcacaagtccctctattcaacaaaaaaacgagtaaaataactaattcatctctaacttcatttatattttcagttcatcttctgacttcacaagaatggaagttttgtattctactatgatcaatacctcatgtaaaaatagttacggcacaaaaatgcatgacttttcagatgatgttatttttaacattgctgaaatttaccattacttaaaatatactaactgcatcagtagattctagaggatactcctctgtatcttgcaaatgtatatatgctctgagcctaatgctcttatggctcctcctcagtgtccaatgaaaatgaggtagatcctaaaagaacccagttccaacatgtctggtttcagaattatccacttcaagttgaactcctgtgatcaaggccttaaaagctgtactgaattccacattcaggtcccactggttcaggagacactagtatcaaggctctaagacagcggctgccaatctttttggcaccagggaccagttttgtggatgacaatttttccacagatggcagcagggggatggttttgggatgaaactgttctacctcagatcataaggcatcagaatctcataaggagtgtgcaacctagatccctcacaagcacacttcacaatagggctctcgcttctatgagaatctaatgccttcggtgatctgataggaggtggagctcaggtgataatgctcactcgcctgcctctcacctcctgctgtgcagccttgttcctaacaggccacaaactggtattggtttatgacctgggtgttggggacccctgctctagggtgcaggaaaaggtgaactaatattaataaagggaaggtaaactaatatgagctgtgtgaggcatggtgctgggtatcctacacacagttggagccccacaatatgctattgctcattcaacacggtgtcttcctccagtgtccatcagcagttgggtgtcatactggagggacaatgggctgtgaggacttcccaagagatggtataagtagggagagaaccacatttgctgttctttatgagaaattaggcacatgtcaagaatagttttgcctacacatctttctcatcttctacttgactgcagataaggtatatccaatccttgcttgagataagatgtgactgcactgctcagtgcctcagctatcacaaaaactctgagagggttaaattattactggcccaatttataggtgagaaaacagtgcctcaaaggggttaagtaattttcccatgataatgtgctcaaaaactacaaaaactctcctccttacaaagtttctaagacttatcttcagggtatgtggacatagcaaagaagttgtactttgtattgagttaaagaatcaatcatctctagccaatgagccttttgtgacattacgatagcaatttagatcagcagtttacgttattaaggaaaggagttcgtattacaaaacatgctgcttcttaactgtttaagagtttagaccataagtaacccatatttagagagcaaaaccctggtgtcattgtgctttttcccagtaacatctttcaaatattatcatatccaagagacaagtattttttttaagtaattttgcataactcttaaaaagatacacaatcctaaacttaacttcactgggatttttaaaataaaataaaaattacagatgctgtttcaagatatgctttctcaaatacttttccaagtatagcatacctaacacagaacatagtttacatttgtccatggtgaggcttcaaaatggagcaattagatcaagttcaggggataatttattttctaaaaattatgtggcctttctttttaattctatttatgtgatgtatcacatctattgacttgtatatgttaaatgatccctgcatccctgggatgaaaccaatttgatcacgatgtattatctttttgaggtgctgttgactcaaaagttgttggaagaaaaaataataataaagagagaaaaaaatgaaaattatgcagaatatttctgcttcaggaaactactgacccattttttatcttttaagataaaaacatttttatacaccaaaaacttttatcttaaaaggtacattataatttagtcaaatctgatagtcatgggcttcataagctgcaacaactgattattacatttgataatacgatgactgaaaagcaaaagaacatttggtatcttaatatcaatttaaatttcacccgatcatgatggcaaaattgcccacaaagctgttctagctgttccttacacctttcctcttctacagcacactcagccagtgcaggagaggatgggcccagcacaattgtgtccacacaccacctcagacaagatgaggttattttgacttaaagggtatgtggtaagcttaatgaaatgatttaaataatctttacgcaggccttaatttttttccatttgcttctttagtttagaaaacactggttttatgaggagctgggtttcgttctcagcttctctgtattttaatgtcctgctggcctgacctggtctctacctgataccctgatgtctgagtcatctccaacctctccaggaagaagcagggacctttcgccctgtcactctgagaggtttctgatctcttaccaaccctctttgagagccctgacttaagaaaaaaaatgcttgaaaataaaacaccgaagtattcattgacagtttcaacttcattgtgggagacattctctgatgtcatgaaaggagcatgccagggaggccacccatcaattgatttttgaaattcctagaagccatagaaaagggctcacctctgctctaggagataaacagtacttcataagatatttattaacctagaggctcttaactaaaaaaaaaaaaaaaaagaaaacaatgcagccttttagtatattcctagaaccctcctcattcccctttcattccttagcttattccctcccttcttctttctcatttacacagaatcttagggtcagaagaaaccttgctggttaaataatttagctcttctggctatacattctcctccctttttatttctctgcatctccatgtcccagcttgcttctcctctcctctctgcaactgttcttccccctctcatttgttctgaaattgctgctgcctacatggtaggcactcctgggtatacacagtaggaccaaaataagcctgacatgaatggttttgcctgggtcattaactgaggtccaggactgactacccaaaaagaactacctaaccttgtagtcctctgcctgtcttaatacatgaaggtaagactaggcaatcagttatttgttgagctaatgaatgaacaaatgattgcttatccaagcaaatagcatatcattttctgttaaagtgaaaatacagccctaggagaattagggaggagcttcactggtcacagatatcttattaccaattaatttaaggatattgctccttcctaatagaagtagtcatgataaaaaatgggagtttgtaataatattgaagaggaagaggaggtaattttggaacctgggatattctgtatggggaaatatggggagtggagatgggggttgggaaatctgagcagtcagaggcaacctagagacaccaccggtacctaaagacaggtgttaggaggcaccagaagttgggaatggcacacaaaaacgaaatacagcagcaaaattcaacatgaatactattatttaatgtaggtttaggtagctattgtcataacaccaattcatatgtgctgaattgggaaatcttgcattgagcagtcaataaataataactaaagttaatagtgaatgtaggaccatcaccattttgctactttacttctcaaaacaaaacaaacgagaaaaaaaatgctatcccataagacagactgggcttgacacttggttgctctgacaacgaaggcccaaagaaaaagttcctgttttactggtgtcaaagtactcaccgcttctttaaaactggctcacttaaatatatctgccttatccctttttgatgtcatttgtacgattcacttttgctttggtttctggttttgcaaattgttagttcctgcagataatgacaagtagagggattaaaggaagtgcaggataatgaacaaacaaaaagcatgatataaatcaggcacacagtgatgtttacttaaggctgatatgttggagaactgactgttgttgttctccattctagtcctagagtattgtgagaataaagtatctttctttctttctttctctttaaagagggagtttcacttttgttgcccaggctggagtgcagctgcgcgatctccgcttactgcagcctctgcctcccaggttcaagcgattctcctgcttcagcctcccgagcagctggggttacaggtgtgttgtcaccacgcccagctaatttttgtatttttagtagagacgggattttgccatgttagtcaggctggtctcgaacacctgagttcaagtgatccacacaccttggtctcccaaagtgctgggattacaggcatgagccactgcgcctggctgagaaatcacaaagtatctttctaagtgcactaatgctacttggggaaaacataaataattacaggtggatcctagataaggagacattccttgttacttccaaaaaaattccataatctttggagattccaaagagattttccatccctcccgaatcatatggaatgcgaaaggcaggtatacatgagaatccatgtacacattgaatcagaaggaaagactatggcaaaaatagggagccacattaggcacttaacagcagtctgggctaaaatcctatttctgcctacagttaccttgaaaggaatcctttgctgccctttatgtaaatgcaagtgatttaaaaacatagttagatctgtatagtgctatacaatttacaaagtacttgggcattcattatctcctttgatttttgtaattgttttgtatctccagttccaaaatgagaaaagtggtacccagaagacttgtgtagccagtacaaaaacatgcagtaactggtttcaaagctaggactccaatcaggttttgtttttatttttgagacagggtctcactctgtcacccaggctagagtgcagtggcaccatcttggttcactgcagccttgacctcctgggcacaagcgatcctcccacctctgccttctgagtagctgggaccacaggtgcacaccaccacactcagctaatttttgtattgtttgtagagacggagtttcaccatgttgctcaggagtctggtctcaaactcctgggctcaagcaatccatctgcttcagcctctcaaagtgctgggattaaaagtgtgagccacggtgcctggccctaaccaggttttttgacccctagcccaatattctcttaaactcttaagcaatgttttcttattttcaaaactgaactaattatatcttggatgagaatactttaaagacattctaaaaatacaaagtagctttaaaaataacaaagtgattcttgcattcttatcctgtctatctaagagctcaagtgtcaaatgatatcttcctttctattggtatcccaaaatagtaaattataaaaaaaattgggaacaacttgcaaacccgctaatatcccaaagctttcatgagtaaaaagatgttaggattaaggagaagctacagaggaaaagtgctatcagaaaacatcaccttagctgtgtcttaacaatcacacaaagacaactagcatcagccgtatatgtgtcctcaaccatctgtgttctcaacccttgcttttttgccttgtagcaaactttgctaatttcacagtactgtacgatacttcttggtattatgtgaagtactctatttagacatgttgacttcactaattagtctataaatacttgacttttagccactgctttggtaagtgagataattgctgaggaaaggccaaagcatttacggtcaatcagatgaggaaaaggggaatatggtctttgagctgagtaaaatgtaaaacattatgtggcaaggcagaagctattagcaggatcaatatctctcctagtaccttaataaatcatcacatcaaagccccgacagaggatggagaaaacctcagtctacctacatggaagcttccaaattggaaaataaaattccatttaaattacaaagacccaattcatgtacaatggaaatggcaagctacaaaactagtctccaaatcctggatgtgctaagagtttagaatcattagtgaagggagaaaagcagaaagacaaagaacactgctactctctgggttgcacattcataattcgcaagttgtaaatatgtatgaatctgcccactgcagctagggatgacatactgctttttagagatagcacagagcagagaaatcaaagtagaggaaggtttggccattataacttacctcctcccacatttaacagttctcaatcttctcaaatctccccttacttaaattgctgtcttttggggatggcttcctaaaatgaaaagaacttcgataccaatgaatgttcaatgtatagcaaaaagcatcccatggtgagctctcactgtaacatgggacgtaaataattgtattttttctaaatctttaatcgctcccattctctttgatgcttccaggaaaacaagcaagcaactaaaagaagttactaggctaacttgcccagtttttttttttttaactctagaactaattatttctcttttctaatatgtagtaaaagacaaaagaaacattttgcagagattcatattatagaacattaggctttcccttaaggatacgtatttcctcacttacagagatgatagtgaatactgacactattttgactccaccacagcttttgctttgcagtcatactgtttaattaaaaataggtttttttcttataagctcaaattactctactgtagatctctcaaacttcgtagtaagttgaagctgagaactaagaggtcacatcaggaaatttatttagataggtcataactggcaaatcagcaacaaaagaaagcagggcttctcaacatcttgaaacattcattcatgattaattatttctttcattccacaattatctattagacacttgagtatcatgcttgggcttgatgataattatatcaaagaaagttcccagaaggttctattctcaaaaaaaaaaaaaaagtctgaccatctaagtgggtacataagtcacccaatacttaaaatgttagctaacattagaagatgtaaattatataaaagctgattgtcacaagtgccatatatggctacgtgccaaagaagggctacagtaaacttttataaagaaacctctattggcagggattaccagggaagggactaggggagagggtaaaagacctgagctacatagaatttgaataagtgaaaaagaaaaggacacatgcttcaatcagtaggaaaagcctgggcaagccagtgcaggcacacagtgcagtgcgaagcaggagagagttcacagtgcagatcagtggtaggtcaggacattagagtcccaccccaacacgcaggaaagacagtggctggactgcatatcttaaggtaggaaagtttttacttcagatgggagaaaaatagagagtcaggagaattctgataccatgtccaagtccaagaccatttggggagtcaaaactgtacagaaagaaatatcttctctagaagcagcagatttcatgtatggccagaaggtggtaggggtttccataaagcggtctgaggctatcaggaagcctgtttcttatagaaaaggggtttcagaagacccagggacaagacacaatttcaggaaaggggcactgggaggatggttcttttagcagaaacctcctcacaggaacagggatgagtgcctaagggaggagctcctgcctgggagaggcaagaaaggcagaaatgagaagcagggtggctctgacttatcttcctggtctaaatggaacctagtgtcttgctggttcaggagcctcattctggcctagaaatagcaccccacttccacctcaccagccaggttccaaccgtataagtagttgagctgaaaacaggagattcattttgtgtggtgcatacccatagttccagctactcaggaggctgaggcaggaggatcatttgagcccaggcattcgaggttgcagtgagctatgatcatgccactgcccttcagactgggtgacacagtgagatcttgtctctaacagaagttttaaatttttaaaaaattcattttgtggttgtaagtacaaaaaaaacctcaataatgatgagaaaaaagatatacgaagatttgttggttaggagatcatagctgatagggtgtgtactacttactacaactgctattctcccacactcacactatctcctgtcttaagaagtttaagcaaatctaggcccagtgtcccactgagggaaatcacaagaggacttagaggggtcccatccatgagagctgcaccatgagtacatgctacttggaaggctgcttctgtggtcattctgagagctgggaaaccaacctggtgctgagctgtccagaaggcagcatctgctgattctggtaccactgggaagaacaggacacatctttactagggaaccagctgctagtcaacagctgccccttctgctccccaataagcacctttctgattactgtcagtttttcagcagaaaggccatcagctgttgtgttaatgatggggcttcactggttggaagaattttgcagtctccagtctgaactattcctctgggtgtccttattcaagcagcagttaatttgaaaacaattagctggttgttcacttccttaaggcaaagcaatactggatgggctaccaggttggactaagattccagcagaacactctgaaggagccaggatatttctaggatgggtctgctttgtgttggcttcaggaaaagtctagcatttctaaccctgatcattgggaattagtcactatttcccttagttgctctggcaggctttcatttatttttgcctgggtgacaaggagacacttctacatttcaacattaaacagactggacgattcatttgttttcttctttttttcactcttccaggtaaagggaaaatggatccttatggtgaattatagatgagaaatcaatgaaagatacagagactaaagagaagtagagttttataaaaagcaactggatttgttttataaagtagcagatttccttttacaggctggccaacataatctttgggactgaaatatctttctgataagagtatgtattttctgtcactgaatcctctacttatatcccctgccacacttcatcctgttaatgaggacaaaacaatatgaggaaagtttttctgttttcctcagtctcccaattcctcacctctcttctctgcaaaccactcggcttccataacaaaaaggatgacacaaacagagtaaaaatatgttaccagagactttctcagttcatggcaatattcagtcagctaaatctggcaaactcatacacatctggcctgctggcaagtctgactagaattcagctgtgcctgtacaaggaagcaggggaacagcatttagagttagacagccctatggcctgctgaatcctcaaatatgcaaggggcttattcacaaaatgcttcacaaaaaatggctcctccaaacacatgcatacttatttgatgtttttatacttttttcttttcagtgctaagccatcttctttagttagaactatttttatcctttgtcactttataaactgcaatggaattcagtattccatgtacaaccttaattttctgtatgacatggaaaacaatatgggaatcagagggacttaaaactaagtctatggagcccaattcccaaattgcagatttaggtcttactgtctctcaggcagattagatgacttctgaaaagaaatacttatttaaatatgcttattttattgttattgaggtatgcataaattatcccgttatagctatccaaaactgtgaacaacagaacaagaccccaaactgcagagaatatatcaactcagttgcaaaagataagacagtaggaaaggtgccatacagaacaatattgggagttagcatcatgaagaaggttagcaagatgtgtttataatacaactttcattccaacagaaattataacatgctaagagcatggacctcgaggaaaaaatatctattttggtgggctaagtaacttttggaaaagactaaaacacaaactcctttagtaaaatgctttaatatactctaggccttttctttaaaagtaaggtatgattaaactaaaactttcaagtagttcaatgaactaagcaagaactgttggcttccctccaaccatagtcccacttgctagagataataaccataaaagtttcatgtgcagcccacacataaacaagcatatacagctgcatatttacacacgtgtgtatttgctggtacaggcctaaaatatggaaacatttgctattttattaaaaagtgctcataccatatataatattcatgcaacattgttctgtatcattgacatagatgggtttgttctttttaatggctattttatgtactattgaacaggtatgctataatacctatattcctattggtatgcttttaggttacttctgagttttaacaattaaaaaatacgcaatatgtcttcttacaattataactttctaacttgtatagatagaactaaaacttctccaaaaattattattccaagctacactccttccaacagagtaacaatttctcaccaccactagatagcatcaactgtttaaattgtgtccaatggacaactgaaaaatactctcttattttaatttttgccatcattaatgaggccatctttgcttggctgttatatttttctttgaatagcccattcatattctctatttgttttcttccactgagttgttactttttactaattgagtcccttgtttcacagagaaattagcccatcatctgtcatgtgtactgcaaatataattcctaatttttcatttgtctattggctttggttttgttttggaatgaggagacagtcttctagaaaataagacatattaaataatatattggtaattgtaaagcacagattgtatggcgccagccatcatgtgctttgttcaggtgtcatgcttatcttaggtaacaaggtcaccaggattaattagtgaaaatcctgctgagtttcagatcatctcagtggccctctataaagtgttctcactcacctggcagcctcctttcttaatctcagttggaatctcaaccacaaagtggttgctccttgtatctagaagtcatttaaaagacagtaatcaaaatttctgttctcttttatttgttcctctgcttccctatcaataattctgggaggagtgggagagagaacagtgcgtaatcaaaaggcagacctagcaaattattattttattgataaaataattcagcaaattctcaatattcctgcttcacagtgattaccctagattttatattttagggttttgcacctacctcttatcatcaccccactaactagagtgtagtctgtgtaggacaccgattagactcacccctggtttggcaggcaaagaatgccaaggcaaaagcacagccgacaaagctccctgtacttgtgcagatagagaggcagagtataccccggagctgagctgcaaggtacaaatcctgaccctcctacttgataactgtgttactcggagtcagttaacctctcagagcctcagattcctaatacatatgatgcatataggaacagtgccatcagaataagaagagcagctacatcacaggactgctatagggtgaatggagttatgatgtaaagtagtgcctgggatacacatagcacattttaagtaaatgtggcatatcaatatagtaattacatatagcacaatagaaaagttagagtgtgatgaaatccaataggctttacaaaaatcaagtaagtattagtactacataaccacagaaaagggaggcccaaaggaacagtcaagaaatgcagcaagggccaggcacagtggctcatgcctgtaattccaacactttgagaggctgaggcgtgtgagcccaggagttcaagaccagcttgggctacatggtgaaatcccgtctctacaaaaatacaaaaattagccaggcgtgatggtgtacatctatagtaccaggtacttgggacactgaggtgaaaggatcactggctgaggctgcagtaagccataataacaccgctgcactccatcctggacaacagaatgagaccctgtcaaaaaaaaggaaggaaggaagagagagagggagggagggagggagggagggaaggatggagagagggaaatgcagcaaggagaagagatggggagcaacatggccaaatagaagcctccaccactcatcttcctcataggaacaccatatcttgagtagaaagatgaaaaaatgaaccaatgcaaaataatagttataacaacttttcaagatatagacagtacaataacatataaatagaaacaataaaaagttaaaaagttggggaatgaagtttaaagtgtagagttttttaatactcttctctttattagtttgtttatgcaattagtgtaagttgtcatcaatttaaaataatgggttataagatatttacaagccacatggtaacctcaaataaaaaaatacaatagatacataaaaattaaaaagcaagaaatcaaaatataccaccagaaaaaaatcgccttcattaaaaggaagacaggaaagaaggaagagaagaccacagaacaaccagaaaacaaataacaaaatggcagcagtaagtccttacttaccaataataacactgaatgtaaatgaactaacctctacaaccaaaaggcacagagtggctgaacagataaaacaaaactaaactaaacaaaaaacaagccccaatgatccactgcctgcaagaaacatgctccacctataaagacacacatagattgaaaataaagaactggaaagatactccatgcccatggaatccaaaaaaagaacaggagtggctatgctggtaccagacaaaacagatttcaagacaaaacctataaatggagacaaagaacttcattatataataatctatgggtcaattcagcaagaggatataacaattttaaatataacagtggagcacccaaatatagaaagcaaatgttactagagctaaagagagagacagaccacaatacaataatcactggagacttcaacaccccactttcagcattagacagatcatcaagacagaaaatcaacaaagaaacatcagatttaatctgcactatagactaaatggacctcatagataattccagaacgttttgtccaatggctgcaaaatatacactcttctcctcagcacatggatcattctcaaagacagaccatatggtaagccacaaaacaagtctggaaattttttaaaaaaaataaaatcacatcaagtatcttatctgaccacagtggaacaaaactagaaaccaaacaacaagaggaattttggaaagtatacaaacacatggaaattaaattatatgcttctgaataactagtgggtcaatgaaatgattaagaaggaaattgaacaatttcttgaaacaaatgataatagaaacacaacattccaaaacctatgggttacagagaaaacagttagaaaagggaagtttatagctacactataaaagaagaaaaacttcaaagaaacaacctagcaatgcatcttagttaactagaaaaggaagaacaaacctaacacaaaattagtagaagagaataaataatagagaccagagcagaagtaaatgaaattaaaatgaagacaatacaaatgactgatgaaatgaaaagttggtttttcgaaaagttaaacaaaattgacaaacctttacctagattaattgagaaaaacagggaaagacccagataaataaaaacagatgaaaaaggaggcaaaggactgttagaggctactatgagccactgtatgccaatacattgggaaacttaaaagaaatggataaagacacatacagtctaccaatattgaaccatgaagaaatccaaaacctcaaaagacaatcagcaagtaatgagaatggagccataataaaaggtctcgcagtaaagaaaagcccaggacctgagggcttcaccgctgaattctcccaaacatttaaagaagcatatcacttctatttaaattattctggaaaaaaaaaggaggaaggaatacttccaaactgaggaaggaatacttccaaactcattctacaatgccagtattaccctaataccaaaaccagacaaagactcattaaaaaataaaataaaaaactacagaccaatatccctgatgaatattgatgcaaaaacccttaacaaaatgccagcaaaatgaattcagaagtgaaagatctctacaatgaaaactataaatcattaatgaaattgaagaggtctcaaaaaatgaaaagatattccatgtttatggattagaagaattaatattgttaaaatatccatactacgcaaagcattctacagagtcaatacaatccctttcaaaatgccaattacattcttcacagaaatagaaaaaaaatcctaaaatttatatgtatcaaaatatctcatgtgccccataaatatatacactatgtacatacaaaaattcaaaataaaaaactataataaacagaaaagaaaaaagaaatgcaatgaggaatagacggaatttgaggaggaggcctaaaataaacaaaatcaagtattgtgtgtattctaaaagaggagaagagccttacaaaaacacttacctcagggacaatgaataaactagtgggagtgcagtgaaaggctgtgactggatagtaggagaggattactttaaaaatgcagattgccaacatctcaaactctgtttatttaaatgaaaatgtttacttattctttgctctcaattaataaactgaatcagctattatcagagtagtatttcaaatgtgaatctttagagcaaataattttaaaaaagaaacacctttcccacagaaatactgatgtccaggatggagggctttccaggctggtccctgcagcccctgactacaaatgggaaggcagagtaatgatattgtactatcatcagtcccattcattccttcactcagtaagcatctgctgaatgcctaccaccagtccatcactctcttaaaaaagaagtggtagtggtgaacaaagagaaacaaggtctctactctcgtgaggcttctactttagggtggggaaggggagaagcaatggatacagagcataaaaataaacagatgagtaagattaagattacttgagacagtggaaagagcaataaagcaaatcaaagcaggtgctgtcatggggtggaaggcccctctgaggaagtgatatctgagttgacagctgaatgatgaagcagaagataagtaccaggaagtccctggcagagggaacagcaagaacaaagacattatggctggaaagagcttgatgtgttcacagaacaaaagaaagggcagtgaggctggagtcaagtgccagagtcctaagcaaaaagtaattgtgaagtccaactttgaacgtcaagcacacatttctcccttcgttctgttgactgccagagctttagcagctcctcagctctggacacaaaatgcatggtgttgagctcctcagaagctccagtggcctggggttctctctcatggatccaggaggaagccttgggatcaagagcctgatgtgaggaaagggaaaggactaggggagggaaggataaccagggtggtcacagctccagtacccacaaagacgctctttagaaagtaggggatttcaatccatttgggagaatttcagttaagtttagttaattttttagataaggaaagattcttgccttttgtttccttagtttgtctgtgagcttccaaattagcagtttggacaaaatcaggaacagcaggaaatccaagggtgagctatgtataaatcaagaccaggaaaactaggacagttgctggtgcatcactaaccttttaagatttatgttaaaaaacaagcaagcaaaaaccccaccatgccatcctagtaaacatcccttaggatcattctgaaaaacaaaacagatccactgatggatagaaaatgaatctcactggttatggcagtttttaacgagatttttctatttgtttggcctaatttttaaattcttgatcctcgtaatcaccatgtgggttgcagtagcaaaataacttgtgactgatgataattaagaaaaggaaatttaagaaatgcatgttttcctgagccaagtttcaactaaatgtttttgctactaaaattatgctttcttacacaaatgttgaatataagtaagttgctctggggatgttagtgtttacattttttcccatttgttatttattagcatgaattaatatgccagtttgtatttgacacaagattttttttaattcttgcaataataagactacatttctctatgcagtcatattgctttcttgaaaaggatgattatctcacagtcaatgaacttggtgacaaattataggtattttgatattgcaggtatagtaattttaatgcaacccatcaatgcatagatcaatgaattttatatttattatatgatatatattctactgtactagtatttctaaggaagatgaacacccaggacaaataaatatattttatttctgagtttggaatatacaaattgttattttcagtggcaatagcatgtctatcttctgttggaatgttattttaaaaaatacttctatctgcagcaatacagaaggaacactggttatttgggagataattatttctgaaaaaaatagagcaaagactaaaagctaagaactttgagttatttgtactaaatgttatctagtatcatttgagagatgaatgattgtaagatattgtctccacgctcagaagagaaggtatagatcttcgaaaaatttaataatttactgaattatattctaaataagtttaaatgttcacacatgtgaaaatgctttgtgaattaaaagctaccacaaaatttaagggcatgccattattattttcggagttagtttatcatggcaattcttatagctaaagccccatcaattcttcttttttcagtgaccaggtccagatcatcaaaataagaatgagcagaacaatgagccctcccagaggaagagacagccaacagaaaatgttattccatccaagaaatcaatttgtttattcataatttgaacaaagtatttccatgccaattactgattggtctctccaaggtctttttgttttttaactcaccataacagatggaggaaaatatatatacaactaaaacctgatagcataattagtggactggaagttggggtaaaaaccacataaccaaatccttaacaggaaggtcaatatcaagacatattcattatactttgaatggttatcaaaatacatgtgttagtgcaaatcagtaccatgtgctttttccctgtcagtatttgttttttatctaatttacctatattattatttttaaaatgtgatcttcagcccagtgagttctatcactctcctctttatctagtcctcttataataattttcaatgtttaatatgctttaaaatgggacaaatcatatccaggaaataaactgtttaccaagaggaactttgttaaaaaaagataaactggctgaaatgattaactgtaaaagttcatttcatccctgtctacatgtggcttgataattaattaatcttatatttatgaaaaataggggaaagagaatcataaatgttcataatttagaggaaaggaaccgagacacagagaggtgagtaccttgcagatgagggatcagtgcttaatctacatgtctactctgttcccacagtctgcaaggaagagaaacagaatttataaagtagatttgtaaatcctgataacatgagtcaggatatgattatgtaacttcaaatatctttgcatttaacaagctagaaacccagagcttgatatttgttgaattgcatacatgccttttcctggtttcttgtttacaataaattttgtggcaggatatttagatttgtgaattctagccagactgctctctaatgagactacagcttgtttgggttttaaagctttatgacatttatagatgtttactttgcatctctaaaaaacacagaaatgctcccatactataaaaatactgatctctaaactttcaaagcataatgcaaaaaatccctaggtgacgaacctttgtgatagagtaatacttttttcaattctttgacaagtggcactattatttataaacttgagttacacaggatagtatataactacagcaacaatattttgataaaaggtgtcagataaatgctttgcctgaaaaggctaatccagaaaacttttttccccttcctcttgcatgaaacctcttaagcagttgacaggcacgagacacattgcccacagagagtggcacacactgagaacacacagtatctgacttaaaattccagcttttgccaaagaagagttgtcttcagcagccgtgtcagggtgccccgggaaaaaagacagagactcctctggtcttttctgtcattaagtgtgagaaaataatactttaaccaactagtgtggaggtgattacctcctccaagaaacattttgataaactggcccactccacttgagcttctaggggttaagccagatcacaagctgagaggagggagagcaatgcaaataagaaataacccaaaatgaggcatccctagcacagttaccaattctagcttcagcctttcttttatctagagcgggtcctacaactccagagtttttttttttttctgggtctgccaaaattcaagttcctacactaatttgttgatttgggtctattagtataattattattttcatccccacatttgaaactcattctatgagactaaacagaagaaggcaaatggatttcatttcaaaagccaatttttatctattactagtggctgtctttggggtctgatttgagcagaattctgaggctgagcatggtgagaaagtacaacttaatgatttcatgatatctgctagctacggggatagggtcagatccccagggcttgcagcatgtgtaggtaatcaaaaaaatgtttgttgaatctttggttttatgcaaaatggctgaggtctctttggaaaagaagctttaaaaacaaaagtaatagaaaatcaatggctgtatacccttagatagaaatgcagccatccgctcacttaccttttatctgaaatacttcaatagcccttcctcacctctttccaagctatactgatataaaaatgacctttctaaattggatcatggttgctttttccatccctggttccttattctcataaggctctcttaggaagcatatcacataagcatataaagatcacctagggcagacagatagatagataaattagacagagaggtgaatggatggtaggtaggtaggtaagtagagatagatagatagaactagggcactttcattaatcaatttgctggttattctctgcattctgttcccttgcatcaatacctcagactctttgctatggctcagagacctatgttctcttcttgaaacctttgacttcattgtagctcacagattaagataaaagagactcccagtgacactctcagaagaggaagggtcccctggcattactgcatgaagaggcagattgagacgacaactcatcctttattagaatcttttccttagaatataaagggcaagctccttagtggtttaaaaaaaaaactgtatttctccatctggtccctgctgttttgctcagcttcatacaaccaatcatcattctccaacaatgagccttttaaagctccttaactacaccacgatgtttctaaagttctgcttctcttcactggtgtttttgcttttttgtctgcttgacaaactctgacttggttttgaaaacccagttcataatcatcccacaccacaccctggaaaaagttaatcattcccttctctgggttagctctgcactgttcccataaatatttctatagttgcacgaatcaggtgctttgttagtttaaattagtatctgtgaactggttgagagcaggaactttgtcttaattttctgttttcttagcacccagcatagtttaggacacattcaatataactgaggatacctttaagattttccattagggagaaaaagggaatagtgataatattatccaagaaaggaaaatgaaaaacaggagcagactgcattgtgagatgccatttgtttcatttggagatagtcacgtttcaaagtcccagttagatgtaccacagaagaaattagagggtttgggaaatctgggcttagagttaggaaaggggtttggagctgaagatggtcatctgagagtcagcaacacataggcagtagcggaagccatagatgcacatagaaatgaaaaactagaaaaagtggcaagaaccctgtagttcactaaaaatttggccccaaatttaggagccaatgaagaacatgtggatagatgaagactgggaagaatgataaggaagaacctggaggacctcagaggccaaggacattaaaatttcaaataagaaggggtatcgatcatgttagcatctcataatggttaagtgggatgaaagctaaacagatgagatgaattttctaatatgaagaaaggggtgtgcagggcaaagcacgacatcgagagcaatttcagtggaggcaaaagcccgggatagaacaaactgcagtcagtcagagtgaatgagtgcctttcatccagactcattacagaaactgtggcttaagcaagaagccctcagtggccatctgggtgagaagtggaggggaagagggatggaaaggtgtggtgagaaggaatcagctaatgggcaaagcaggaaggattctactgtttgcacgacaacattttacatattgtatattttaggcaagatgtccctaggcaaatggttccataatcccttttgttgataaatgcctattccctcatttctcatgtttctataaaggggaaagaacatcaactccaccagaagatacagtctctggcttctcattcacttcttcttgggaaggaataatttatctgatttttgagtttgggagaagaaattgaacatgactagctcattatcttcctcccttaaattcataaaaggcacagaatctcctattctgttatgctttaagcagcctgccacagcagaggaggatgacggctgtctaccaatgcctgtaactgggggctcagtttacatagaagggagttgtattaagtccaagtggtcacagatgtaagtcacattctccaattcggtcatgctggtaataaagcttatggtatacactccatctgtctcactctcatgtttgcttctcaactagatgtgaactcaaggtgggaatcgggtgcttaattattattgccttaaaaccttaaaagtaggccgggcgcggtggcttacgcctgtaatcccagcactttgggaggccgaggtgggtggatcacctgaggtcaggagtttgagaccagcctgccaacatggagaaaccccacctctactaaaaaagaaaaaaaaaaatacaaaattagccgggcgtggtagtgcatgcctgtaatcccagctacttgggaggctgaggcaggagaatcgcttgaaccctggaggcagaggttgaagtgagctgagattgtgccagtgcactccagcctgggcaacaagaatgaaactctgtctcaaaaaacaaacaaacaaacaaacaaaaatcaaaccttaaaattacacttcaaggaggttgtttaaaaatagagaaatataagacctccaattcctcatctgtgaggtgaaggggctgaagtggataatctttaagtccttcccagcaatctctacacgtctgtttgctattgtgtgtgtgtatatatcagacaagcggtggggcggtgggggtggtgcatgcgcaaggagtcagacaatcttaggtaaaaggaagggaggattcaaagcaggagcaggcagtcaccggggtagtgagcagaaaggtctcctaggctgaagaaaaattaagagattagagggcaacttacttatgaagagcattttctgagacaaaaatgaaggttgctatatataaacaaaaatatatatatacacatacatatacattataatacatagagataaacaaaaagcaaaatactgaatcaggctggaaaaaaattctccccaattcaccagcccttccatgctcacataaaccccttccctcattagattataagattttgtacctttgcacctaaattttccaagagaaaaaatgaataggccacaaaatgcctaaaagcaaatgctaggaattgtttggctcaaataacaaaacagagacccttaactaagctgaggacagtggaatattattttgccttcttgcctgttggaagcactaagaagacatttccaattccaacgttccatagaccaaaaggcttaggtgaagagggtttccaggctcacagctcaatgaaaacaatgatgatccaggggagtcatggcactcatgtcttcaacactaatggatttcagctgattcatcagtgaacatttctcagaccaaagtggaaaaagcaatttttgtcttctgttaaacagaaatctcagtcagtcttgcactgaattctttcacagaaaatctctgctcttctgccttttcagacacacaaggtctccagcgggtgctctccagagatggaaggaaggtgtgttctgtgcagtgcatcagttgctatgtgttccattgtggcaattgtgattcacaagggcatagctgagccaccacagctttcagctgtaatcctcctggcatctatccctgctgttagagggataattatctggttatccctgaggccagttcttgccattttcacataaaaatcacctcttgcataagacatggaatttaaaatcatctcctcatacatatcattgagtcacttcattacctctgggacatatataaattatgcattcttcgattctctttaaatttttagaggctcatagggacagtgaaggatctcattggtactgaaaatataaggcattccagaaagaaacaataacttgtgtgacattaactgctactagtgttccaaaggctccctgcttggtcaaggaaatcacataaagcatggagaactaatagcaggcttgcatgctaatgactgccggtctgctagtgactgaatgtcactgcctcacatcctcatgctattcatttttcttatctcagtgacttctcccttcacaggactgatttacttctttaaattggcaccattctgagtgtctgcaaccaagaaggcactgaaaaattagaacccacatgcccttattcccatttatttctccaatcccatgcctcaatattaagagagttatttgtctgtaccatggaaatagtgttttatgaattctctggagcttgtttgattttacctttagatgcgtccaagactcactaccatacgtgcattctttaaattctttaaagagagggcgtgacattagcatgaataaaatgcagtggctgtcacggcaagaatgaagaaatgtgtgtgttctcatgccctgccattaagatgaattcacagatgtaagctggcaacacaacacagcacaacacaacactggcaacacagacatccatggagggctacacatttcattccatagttcccattcaatataaatatggctaacattccttaaagattcaaacccatagtatattgttcacctccaaactggaaaaaaacctagtcctgtcacagaagtgaattcagttgcttgatctttacagctgctgataaaagtttgaggagttcacagacttatgggaaaagtgagataaacttcagtatccagcattaaaggctttccaaggcaaaatacattgtgcaatattaatttttcaagttaaaaattggaggtatttgaaaaccattgcttccccaaacaggaaggaaaaccactgtttgggtggtaaaatgtgctaattctgtacaaaatgcctttaagcccttgacctaatgaggttagtgacagggatatggatgactagaacagaaaatgaaactcagaaagaattttgttcatgaactgccatatttctcctgtcatttagccaattttccctctcaaaattacaacatggactgcaaatcttcaaggctaatgctgcatatgacagactaagtgctatttaaaatgtaataatatatctgtcaatctgataggaaaaaacaagaggccacgcgaaggacttttcaggtagacatgggtcctaaaaggttataaagacggtaatcaggaaagcaagccaccacacagcttttcccgtccaattagtaaaagtgcagtattgtcagcgagttctacaaatgaaagaatcctttcagcctgagcactcaatggcgtatacccactctattaagtgaccttcattgtacaatacattaatttctactaaaattaatgttttgggttaaaatcaatgcttagaggacattaatggaaatgatttaatatgtgtgtcatgcatactgtttcaaaagtttttaatctttgtaatttgctacaaaccaaaattatatgagaggtggaagaacactcagaattctaaaactcccactgctgactaaaacataccacttttgttttccactttcatctcagtcagggcatctgtgctattttaatctgccatgcctgaattatcaggaaagagaaaccactggtttcctacaaacatactttatcttagtaggacactttccctctagactctctgtgtggatattttcaaggattcacagcgagacactgggtgtgtacgattgaggttatttaagattttcccacaatgactggcatccatgtggagagacaccaaatgtcatgcctcttcttaaccagttctgaggcggggaaggtagggaaggaaaagcagtgcgcctggggagatggcatgacaaaagagagagccacattctgcttaggagcttattgctttaaaagttcacctaagattgaatttaaaatttgctttaagcacctataatgaaagaacattttagatcttgggagaaaaggtacaagtgtccagcatggagtgaatcgcttggccctttaatatttaacttcactgaaaaagaaacctcgtgaagtcctcttaaaagaacgcaggggactgcacaggactttctcaattgatggcataatgagaaccattaggaagcttgactccattttacatcttaaatctccaagtcctccttgcaaaaggaagcaaacagtacctgcttcccaagtgagacttgagtggaaagtcggccaaaatgagacagttttcagaaaacaaatttcagttaagtctcaggaagctacactactactactttctctattctccatgccctgctcctgacagatgggaaatacatcaactacactctgggcagaggtaagtgacacagaagatttccataggtagtgttcaggtcacaccttcctgaacaacttgttttattaaactgttcctaagaagaacctctgccttcctgttgaccttaaaatcttctcaagaggattataacacaagatgcttttatattgtggttattaacagctaccatttatcccagaggctcaaaacaataggatgaggattgttaccagaagaataagacatagattcctcggtaatttagcaaatttccagctgtagtactccttgcccagtaaaatgcttggctagccctttggtattttactccaggttcctcttctgtaaagtcaaccaacacaagtggcctgacagtcatgatggtgacaagggatgatgttcactttgattgtattttggaggtaaatgcctgggcaaagaatataagaaaccacatcctagcaatatgttgtaatacataagtttctaaaaactaaaaaacaactaaaagaatgtacattccattgaaatgtactggcccttgtagtctaatgagaaacgtaatagaagacaatgaaacaaaaagtattttcttcaattaataacacaactcaggaagaaatgttaagaattaaggaaaaggactcataaaaagcaaccagagttaattgtttaagaagtgcatatctaaccccatcacttgcctacttagattggcaccaaatccttaacacagactgttgtaataggacaacagaagctattaaagggtttcaaactgggaggggagggaagcatgcaatcttcctacttctgtcttcctacttctaagactcaatccacttgccgctattttctgctttctctaggaaagcttcccacagctgacgaggaaattagattccctatagtataatcttgtaggactgtatactttttcttgacacttatcacacttagaattactttttcaatgtttctctttctcctcagacctgtgatgagcaatatggcagccacatgtagctattgagcatttaaaatgtgcctagttcacattaagatgtgctgtagtgtaaaacacatgccagatttgacaaacttagtacatactgctactgaaaaaaaaaatgtggccctgcagaaaccttgattttagcccatgagaccaattttagtcttcttagctttagtaacagaagagaataaatttaggttgtcttaagacactagtctatcgtaattgtaacagtagcaatagaaaactaataaatgtggcttccagaaagattaaattacatatatagatcacatagtatttctatggaacagcactaggttagattataaactccatgagggcaggaaaatgtctgttttctcagctgctccatgttctgcacccagcatgcttcctgacacatatagtcagtccaaaatactgtggattaaagaaagaaatttaaagaaggttttaccccctttataattcgtaattcaatcactattccaataaaaaattattaagcgtttactatgaaccacacattgtgtaaggcactgaagatacaagtataataagaagtggttgccagagaatgggagagaagggaataagtagtaactgcttaatgggtatggatgttccttttagagtgataaaaatatttttttttttctttttttttgagacagagtctcgctcagtcgcccaggctggagtgcaatggtgcgatgtcggctcactgcaacctctgcctcctgggttcaagtgattctcctgcctcactctcctgagtagctgggatcacaggcatgctccaccacacccgactaatttttgtatttttagtagagatggagtttcgccatgttggccaggctgatctcaaactcctgacctcaggtgatctgcctgccttagcctcccaaagtgctaggattacaggcatgagccaccatgcccggcctcaatattttcaaactagatagcaggaccagtgtctggagagggctgtctccacttccaagatggcaccttatggctgtattcccctaaggggaagaacactgtgtcctcatgtggcggaaaagacaaaagggcaaaagaaagaaaagaggaattccctccatcaagccattttataacagcactaacccattcatgagaatgaagccctcacaacccaaaatcctcccaaaggaccccacttcacaatactactgctctggggactcggtttccaacacatgaattttggaggagtcctccagaccacagcattaaccatgcagattgtagaaggaggaatattgcagacagaaagctcatttatagcatccctagatggctcttcaaactcttggccttctctattaactgacaactttctgcttccttgcccctatcctgattgacagttcttagagagtaaagcctgaatctttgaagtcatagtcaccataattacccagagtcacagagcccaaggagcaaaaagctgttcaaaatgggaaactatataaaaaaaaggagaatgggatccagaggcttgatcaactctatgggcaatcccacaaaatatgcatgtaatatataatcagagagaagaaaggaagaaaaaaactaggtttgcttagactttacctgacgacacacgacagccatttgaaacgatctggcttctaataaaaataagacatagagccctaaacacaatttgggaagaaaaccaagaggtcatcaaaatcacaggatatacatgacagtggatagggccacttggcttctcctgtggctgagaaagatttaaaaacaacctgggaatatcagtgaaatttatttcaactaagaattgatgcaaacaactgtacactagataaaaaagaagtggtaatttgaggaaaatgtattatatttgtgctctagaataattttgtttataaaattttttgacacatttgaaaacttttatctctaattcttaataatgaaatgctaataattcatacttaatatacttaatgacaaaatttacctaatacttaatataatgaaatttatcctcagttcatgtgttatcttctcagaaaggccttcccttcataagtagcgtcactcaagaggtacaatcaaatccccttgctttatttcctgcagattattatctgacacttttttgttcacaatgcatccacttttctgcttacatttgcctcctctctctagaatgtaagctctgttagagcacagctgatatggtcttattcactgctttgtctgcaaccacccttagcagagtgccaacccttagtaggtatctttgtagaatgaatcaatgaacacaaaatcaaaatattattgcttgacttaattccacctttgatctcctcccccaatgatatataaaactttataactggaaaatttgttaattttatttctattctagaagtcttactagatttaataggtattatagagttaattaagcaagtgggaccagaaatcatattcctagataggaattcttgttccttcattttttttttccttctgcttgtgtggccttgggtaagctacttaaccttcttatgacttagtctcatcattaaaatcaagggattaatattaatattagctatgtcatagggttgcttgaagactcaaagtgtagagaatagtgtctgggacctactaagcacacattaaatgtaaattccataatgggttgaagtagtaaatgaggaagaatggtggcttaacaaaatgtgggattttctatcctctcaaagaaacagatggttttaggagtaagttatctgtacccagaggtgttcaaacagaaataattatccacttgatggagatattagaaagaagatttatgtatcagaaatccaattacattagataacttttaacagctccctttctactcttgcagtgctaagctcccattgtgaactgaagctgagaagtacacagtacacttcccagatgcaaagacaatgagcatttcagtctccaatatccagcagatgcatttctactattttcacaagggattcagtgtcttctccatacttgcagaacttcctgtttatctttcactatccatgtctatgttattgatctccccatgagaccacaaggaatcagggtggaggaacatgggaaatggagcacaggcattctgggagacagaacactgagagctatgcttgctcagaaggctcatggtaaagaaaattgaaggcaaacctgaaggggaggaattgcaaagactttgagatcttcaaataagtcaaaaacaaaacaaaacaaaaacactacaattcttaattagaaaggaagaacttaaatttatccaaactcaaagcagcccatattctactgtaagtggagggatatgacactggaaaccaactgacatttcccaaagtggtcctacagtaggaaagagttcaaggtgttcttccagatgcccaccaatacagccagcaaggagggtaggggtagggtggtgagggctgtggaaaggggtgcacccacatgcaagcagatagtaatcatgcctttttaaaaaagaagagagacctgaaaaatctaaatccaggtgcagacttgagaatgagaatgagtcaatgggcttctacatgtacatcatcagaacattatctgggatattcatgtccttgacctgtacaaaaaattccaaaacacctgctataccagaaaagatcagttaaatgacattctactttaatatttatgttaactgggttttatcatattcacattgtctaaaaattagcaatttatgtgtacaaagttagttgacactcagccatttggggtttttttgtaaacagtggacacttttgtcgccaacaagtaatgttacgtagcattcacagacatagtatgacttaattctcaccagtcgtaaatttggagcagcttctctgtgaggtattttcaagtgccgaccagaatagctgcactaagaacagttcttgtatgctcaggtgaatacctaaaaatacacacttattcttctttctacagcagtgaaagccattttcacctcccctacaaaagactttgatgtcagtgtgtgtcagcctcagttaagctgttgcaaatcctatatacacatttggggcagttctttcaaattctgatgagctagccaaaaattgcttcaaaaatgttacagtccttcctcactgtttgcacgcaattattggtaagctcattctgagttcaaagaacttcaaagtttatttttataggtaaggttacagcctctcttaatagaattctcattttgtactgtatgtacagaaatttgcttgagtctttagaagtttattttagaaacttgagaagttttaaatttacacatatgttatttagtaagtcatatttaaattcaagaacttgtcaatttaatatagtttgtcctttaggagattaattgaagcaggtggtaatgaaagttaggaccttgtgttgaaatatgatagatgaatttattttaaggctattggaagagctagtttatttgctataccttgtattctcttatacctaaacatagagcaaaatggagagatactcaggtatctgacctaagttattttagcactacctgattctttttttttttttttttttttttttgagacggagtctcactctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcagcctcccaaagtgctgggattacaggcgtgagccaccgcgcccggcccactacctgattcttaatggcttcctctggcatcaatatttcatcagttttattccatccccaaggaggaaaagtccatttcttacatatacaattaaaaatcattttctaaaaagcttaagtcttagcacaagacaaagaattatcatacaagtgacacaaaaaagttttaaaaacattttccaaacatcagcggttattgattacgagtgatactttccctactctcctagtgggtatttttgattgtcaaaatgagctggaagactctgttggcctttactgtgcagaggagccagggatgcaaaacctcctgtaatgcacatggcagccatgaacaataaaggactgtgccaaccaaaatgtcaacatggggatacaagagaaaaatacagaaaccaattaatagcaggaattatttacctctttccatttgtgatcaatcaagtagatttaaaaaaaggaactatacagagtatccaaataacctaactaaaatggtaaatcatatatagtatgttctacatgcatgtatatatcatatctgcaccctggaaacacagaacacaccttcttttccaatatctacaaaacaggcacaaaatttgaaaatctattatgccacaaataaaacatcaataaattccccaaaaaagaaaagtatagaaaacattcttgtatcatgatacaataaaactatcaatatctaacaaaactagaaaaaatatgtcttatcttctgaaaattttaaacttccctcataattttgaggtcaaggaagaaaaaaattaataacatgcagaaaataacttttaaaaaaaatccacaggatagctaaagtcatgctgaaaggaaaattcatagatttaaacagttgattaataaacatgaaataataaaaactaaattaaacattccatccagggagttaaaggaaacaaaactacagaaagcagaaaaagtaataaatatacagaaatataaattaactgaaagtgtcttatttattttcaataaataaattgagaagctggtacctaattagttcaccaaatcaagggggataatgaaggaggctaaaacaattacacaaaataaaaataataagagccagataataccaacatggaagacattttatttctttttctttttttttggagacagggtctcactctgtcacccaggctggagtgcagtggtgccatcatggctcactgcacactcaacctcccaggctcatgggttgctcccacctcagcctcctaagcagctggaactacaggcgcacaccaccacacccagctaatttttaaattttcttggaagagacggggtcttgctatgttgcctaggctaaagacctttttaaaaattataattgattcctttgctcaactctgtgcaaataatttcaaaacatggataaaggagataattttctagaaattattgtatgtcaacctacttccagaagagagagaaatattacactaattatcacacaaataaagaagattgttagagttatcccccaaactggacacacatgcacagacagacagacagacagacacacacacacgcacgcacacacacagcctagatggtttcatagcacaacttgccaaacctttcaaataacaaaaaattccaatgccatttaaactccttcaaagcataagggaagaaaagactaggacagtttccaagttctttttacaaagcaatagtaacattgataccaaaacttgacagattgtaccaaaaagaaaattatggagcaaactcatcttggaatagcaatgctaaaattctaaattaaatattgacaaatagaatccaacagcaattaaagtaatacatcatgactgagtgaaatttattttattcaggaatgtaaaataaattttttaaaaagaccaaaaacttagaaataaatctatcaacaccaaattactcattatggcattcaaagccttttatagatgacacagttttctcttccacattaatcccactatttcaatgacagtcaaacactattactcactttttcttgtacttatgctatttcctatcccttaacctccgctaattttgtatctatgtttggaatgccatctgtctaaacttcctcccagttctaaatatcctatctacccataaaacccaatctaaatattaactcaaaaaagcttatttgattctccctacagacacctttcttctgctgaacaaccaaaatgctatctttcttgcagcactcattatatattttttaaaaacatcaggtcttctattgtcatcaagtaaacacttgttattttcagccatgtattacagatatttgtgtaaaggctctacatctcctatcagatataaacttttcttttttttttttttagggtaagggccatgtcttatgtacctttgtattctaatcactccaagcacaaatctttccatacttaaacattttgacgcacgagcacaaaaaaacccagattgtaaaagcaaactgaagacttgcgaagaatagtttccccttaaaatgtaactgcatgtgcacaggatgaagagttagaatctgaaaatcagctgggcactagccatgcctgccctgctacctttccatagccagaatcacagcagcatgaactgcactcaagctccagaccaagaaactctaattaccttcagcgagcaagtaaactgacagtaacagctattgcaggaggcaaaagcagctacaaccttcaattccaggcacggaggtgggaataaggaaagaagtcgggatggaactgttggtttcattaggttgttggtttggaagcaagtatttcacaaacacacccatccccccactatacacatccatccgcttcatattttcatttctcataatgccaaaatattaacttgtgttctaatatttcagggaagatgtataagctagtgagagtcataatgtcgagtttcaaaatgcatgtataatttgttatgcgtggcagggtgaacagtcctatcagaaatgcacctgaaggtttgctaggaacagaatattaaacagagcagagactatgggatctaacgtgataaactgacattaggttagaacagtacaaaaatgccacattccaaccactgttgatacacttctggagaagtggactttcaatataaagcagttattctaggtgcaattttaatagcaatgaaatacaatgaaatgacaaatctctggttcattctgaatacaagagttcctgcttattttgagaccatgtgaatcaaagaagtcgacatcaccagcactttgcttgtaggctaatctagtagtgacttttgatttcctgctccccctgttgatccatccatccacagctttaagaccagcctgactacaatcattcttcatgtcaccaaaatctccatccgcaggcaagaaggagatacccagctgtcccagtttgttaccccatcgcaagcacaaactgggatcactttctccaccccaactgtggtaggctgaataaaggcctcccaaagatgtgaacgtcctaatccccataatctttgaatatgctatctcataaggcaaaaaggattatgcagatgtgattaggttacagatcttgagatggggagattatcctggatgatcctatggactctatgtaatcacaagggtcctataaagagggaggcagaaaaatcagtgttacagtggcttaatgtgagaaagacttgactggcaattgcaagttttgaagatggaagggggccatgaagcaaagaatgtgaacagcctttaggagctagaagaggaaagaaaaggttctgccctagaagattgggaggcagggcagccctgctgacaccttaattcagcccattgaaaccggtttcagacttctgacttccagaattgtaagataacatatttatattgctttaaggcactatattggtggcaatttgttacagcagtaataggaaatttagacagacaattctgttcttggtctatagcaccacctcaaagcatccttattcattgatcgctcacagttaaccaccctgccacttgacttgccaagacctattgattctgtctcctaaattcttttaagttttgtttttctgtttttgttttttgagacggagtctcacactgtggcctgggctggagtgcaatggcgcgatctcagctcactgcaacctccgtctcctgggttcaagtgattctcctgcctcagcctcccaagtagctgggattacaggctcctgccaccacgccccattaattttttgtatttttagtagagacagggtttcactatgttggccaggctggtctcgaactcctgacctcatgatccgcccacgttggcctcccaaagtgctgggattacaggcgtgagccactgcacctggccaagttttgttttatttttattaacaaactaataacaattgtttatatttatgggttacaatgtgatgttttgatacatgtatacattgtgaaatgatcaaatcaggctaattagaatatgtatcatctgaaatatttatcatttctttacggtgagaatgtgtaaaagcctatcttttcctaaagcgtctatgttccatccatctttccttgtctccacagctactctctgagagaaaacttcagcctgtggctccttactgttctccctacgtctgctcaggccactcccttcgccaaccccaagctgggcaggccattcaccaaactgccccagagggtctttctaagacataaatctgaaatatctcaagacaaatggcttgccattgacagcagaatgaaaatcacctttctttacctgataaaatatctttcacagtttgacacctacctaggcatccaactgtaatgtctgcttcctggtcaaacttgctgcttgaccagcatgacattcatacctggtgcttcaacatgactctgtgcctttgtctgctgttctctcactgctcctctaactgacaaacccctaaatatctttcagtactaaaccaactgtgttggcgggctcttgacagtgagctccttgagggctgggacctctcttcatctctttgtctgcagtggctagctgaggcctccctctgaatgaagaggagggggcaagacttcctttctcataaccgctagcctaccttctttcctgccacattagcttacttttactttcagctcatatttggctttggaattactttcagaattagcagttgatacccgcccagtcagacaccatgtcctcacactcctgtgttttcagtgagcaggtgcaagatttaagaaatagtaaaagaggcggtggctcacgcctgtaatcccagcactttgggaggctgaggcaggtggatcacgagatcaggagatcgagaccctcctggacaacatggtgaaaccctgtctctactaaaaatacaaaaaaaaaaaaaaatttagctgggcgtggtggcacgtgcctgtaattccagctactcaggaggctgaggcaggagaatcacttgaaccagggagttggaggttgcagcaagccaagattgtgccactgcactccagtctggcgacagagcgagactatctcagaaaaaaaaaaaaaaaagaaatagtaaaagaacaatcagctctgatatcctggccacttcatctaatgctaagaccttcattttaaaagatagatttagggtaagaagcacttgtcagtctcaattttgctccagatgaggacccacgcaaaactacttctatgctttcctttcttggttataaagaattccactttctttcaattttcagcatagataagttttttactttcaaatcatccattacttttctctggcccatctccaatttcctaatattgtgtttaaaatatggagctcaaaattaggctctaacatagaccttatcaatggtgaacacagtgagtaaatttcatggttcttgtgtactacatacattctggttaatgcaatcccagatcatgttcaccttcttgataacagccctatattgctgacacatatccctgacaggtgagaatggctttttacctatagagtacttacatgtcaattccaatctttatgatggctaggatagtctatcagtatattttttctggaataataaaaacatcacctattgcaaagagctgtctaatgcactgacagtatagctcatcttgacttgatgttccacttcataattggaaccattagactgaaatcagagcttctgaaaattctctgagttttatttttaaacatgttatatatttatgtgggtacataacaatttcattcaaagtaaaaataaatacagttattcttcaactattagttgatacaacttcactttagaagccataaatatcagaaacaatgatttagataaaccatgtggaaatagttttaggaggtatcctccaattccatttatggaattctctttgcattttccaaaaaaaaaaatctataacaggaaagacagttgaaggcagagactgcattttaagttatctgcctttctaacaaagcaatggaaagggagacccaaattatgcttctgaagtgaaacgggataagcttagcaaaaaatttcatctctaattaactccttaaaaaatttcagtccagattaagtatatttctgttaattaacatatatagttaatttcattttctcatattgacctagtaaaattaaagcatacaaatacatctaaaattttttgacatactttcatgacagattgaacattatcttattaaagcaaaatgtatagataagtgctttggagtgaaaacatctggatcatagtcttagtgcattcaatcactataagatcaaaaaagtcacattactctttaagatctccatttcttttacatgataatgacaatcagtaatcgtcataacgcttacaacaatctactttttccctctgatgtgagtgtggctgagaaatccatataacccttaaaaaaataatgaataagattaaaatacaaccctgtaatgtggaccagtatgatctctaaaatacaatctgacacttcaatatagggaagttgaggttggaatttgaagttgaaagtcctactggagcctcattcccatacctcctagacatatggcctctgagccgtggtttcctcattactgtgtcagatagactacactagtttcaagtttttgttcttggaggtgaaattctgctcagatcctcaataaacaaatgatgaaaacagggctgctctggtgatgccaatgtggcagatgtggggcacttcgcatcctaacccttcattctatggccccagcaaaagttgcatggaacaaaattttaaaaccaatggaagcgatttagatatgattgttttcaattatcaagtcttggtgtctcttaaccatatgcacttgccagaggtggggtgagggagaagtggtattttaatggcaaagagcactggtacagatttggacttctaatccttggtaggctaaatattcaggaaagctctcctttcataaaacatttgcatgatggataaacagctaacttacagataaacacattgctgagctctccagaaaacaagggaagctaacaaaagatgaaacctacaaactaaaacaagaatgctaagcaaaccctgaagttgggccttccatgcaggaaaaaaatgaccaaaccaggaacccagagctttggacattaatggaaaaaaaaaaaaaaaaaaaaaaagcaaagggtctgcagaaagtagtgctgttaagtctgagaccctaaattcaacgggtactagaaacaacctcaccctcagtgaaagagagcaccaaaagccaatagcctgttgcagaggaaacagataggaagcctacctgtccctgcctactctcaggataaatatagcaagaaaataattgtctcccctcagaatctacaacagaagaccagatctcagatggtgtgaagtttatattacttggggtgtcaggaaaactctaggccaaataataactattatcaagatagggtgtcactctgtcacccaggctaaattgcaatgacacaatcatagctcactcagccttgaaaccctgggctcaagcaattctcccacctcgacctccaagtagccagactataggcgaatgccactatgcccaactaattttttatttttcatttttttggagagatgcagtctcactatgttgcccagtttagtcttgaactccaggcctcaagcaatcatcccatcttgtccccagtgcactgggatcacaggcatgagccaccatgcctggcccaggccaaataattaaataaaagctgcccttagttggctacttattgaagccctggtaccccaatgaagcacaggcaagtctattctgcaaaaaaaaaaaaaaaaaaaatccttaatatacatccctcataattcccacagattaagttcagccaagtatgagctcacaagcaaacattaatatatgtaggtgaggaactaagccaacagcaagctacaaatttgcttgatggcctcaggtattagcattaattgacatagaacagaaaatcgttatgctctaagtggctgaataaatgagaggaaaaattttttaatgatcagaaaatatccaatcagacaaaaaaataacaaaacagatgattttataaataaaaaagaaagcttttgaaacaaaaaactgaatgatgggttacaccacaaattagaactcacttgaaaaaaagattcagtgaactagaacaaagacttgaaggagcaaccccagattgcagcatagagtgacaaagaaaacagaaaatgtaaattagaggttatgaggcatgaatgatcgaaaatgagaaggaacacattacaattaaaattgtctttatccaaagacaccataaagaaaatgaagagttaatccacaaacatggtgaacataaaacccaaaaggatgttacatagaatacattgaaaaatgggccgggtgtggtggctcacgcctgtaacctcagcactttgggaggccaaggtgggcagatcaggaggtcaggagatcgagaccattgtggctaacatggtgaaaccttgtttctactaaaaaaacaaaaaaaattagctgggcacagtggcacgcgcctgtagtcccaactactcggaaggctgaggcaggagaatcacttgaacctgggaggtggaggttgcagtgagccgggatcacaccactgtgctctagcctgggcgaaaaagtgaaacttcatctcaaaaaaaaaaaaaaacattgaaaatgcctatgtatcaaaagataaagacaacccaacagagaaatgcgcaaatgtcagaaataggtatttcaaagaagaggaaacataagtggtcaaaaaaaagtatgagaaaatgttccaatagtaaccaggaaaacataaatttaaaccaggaggtatcatttgatactcaagattgggggaaattagaaaagttgtggtttccaaatgttgacaagagcacagagtattgaatacaggtgggaatttaaacttaacaaccactttacacagtaatttagcactgtatttgaagatacacatacccattggctaattatttcaatgactagatgtattatttcccagaaaaccatctgcacctatgtcttacagatatataaggtcttagcagcattatttgtagtagcaaaataaaaataaaaaacccaactatgaacaattcaaatgaatcaagagatcattaaaaacttctgaatagtcatacaatggaatatttcacagcagtgaaaattaattaagtgtagctacacaaattaatacagataaatctcagggataaaatgttgaataaaagaaaagccaaacagagtatgagtccctctatataaactcaaaaacacataaaacaatatattgtctacagatcacacatgtagaatacaaccataagacaacataaaaggcacagaaaggaggtttggtgggagagagatgaggggcagcaaactggagaaaagtacgtaggagacactccatttattggcaatggtctttagctgggcagtgcacacacaggtgttttgtctttctagtcttataatgtaagtacctgttacatgctttcttttatatgtatgtaatgttttgttaaaagtattaaaattctaaaaagagcattggagttgggaacgagcagcaaaccccagggaaaactggagctttggccagatttgtctcagacccctcccacctgcattttgtctcagccaattacagctcccatccacgaatactgccaaaggagtatgtgataatcctggtgttggcaaatagaagttggaggtaacttttcccatggaaactttgaaggcaaaagaccagcctggctttgacaccctccccaaaacagccctgtgccaggggacaccttctcacagcagcccacacacgactcagctccacaatgggggtgactggagggccagcctgtggaccacttacaagagcatcccagagcccctctagagggccagttacccctaatgatcacaatgctttctctatatttttcaccgtgtgtgctcaacaagctcctagtcattcaccttagttgaaaagacaaataatttgaccaactttttgactagatataaaatgtgaaaggagtccaacaatgcatacaagtcacacttcttatattactatttaaatgttagtgacttctgaatttaagaattgtgttactatttgtcaactaatcaatatgtttactgaaacactcagtccttataagcataacttagtgcatactgcaataaaaaatttaaaatcttgagcatctgggacatgtaaaatatgtgattaagtaatttatgggaacattcatgcagctttatttatagataatttaaaataccatcattgcattttttttaagtaaaaacaagtacacaaagaatagaacaaagaacagcttgatttattcttgtcagtaatagaatatcagtatctattagaatgtgatttaagttaattcctcaaaattagtttggttggattttcaatgtttttacatcagaatgcaaaacttattggtatagatttttctatgctgtaaatgctatcttaatgaaatatagaaggaagggaaggaaggaagaagaaattaagctttttctaaagacaggctatatgattcaactaagccaatttaacttaactgcattgatatttgccagattgctatcctcctctgcagaggaaggccctgaaaacactaatgttcatcacaaattctcctaaagtcacattaggatctgataaaatcaataattctttggcacattaaaaattgatctcaaggagatattgccttataattattcctttgccagatacccatacaaaaacactttcataaattgttaaggttttacttaatattctgcatccttgaagttctcaaaaatatcagtaactatcacgttagttattcagcagcaacgctgtgctagtatttcatatagtaacagaatacatgccaactaattccaagaactgcttgtataactggattaaaaatttcactaataattattgtagagaagaccagcagcctagagtctgacaaagattgttgtctggagtgacttctcatctgtttaccttcctacaggctttggagaccatttcactggcaatgaaggaattctactgattttgcccaaaatgcatcctcaggcctacctcctttcagggagaaggaaccaaacgaataaatgatcccatagcctacatcagagatcagaaataaaatggtttggaattgagggtgagtggggagagagtgaccttgagaagccactgcaggagggcccttctaggtctctgaggcaaccacaactcctccagctttgttttcttggttattctgtctgcagcgaaacccttaaaacaaaacaaaacaaaacaaagaagcccttcgaagctcacctgagaagtgactagaattaaggagaggttatggagtgttcgtactcagcaggaattcgaaaccatggaggtagccaacaagggcgccctcacccctgagggtccatttggatttgcaattctattcccccacccccaccctgccacccaatctctgtacacacacacacacacacacacacacacacacacacacacacacacacacacacaggcactccctttgaagcaatttatcaggctttcttctggggaaagtcttggagtaaatattagttttcttaacttatccttcttctattgacaatgacctgttttgtaccaaagaagctactgagtaatggagttatgaagcacgctaaaactgggagttcatccaggtaaagctatctgggattttgtgccagagtctaatcctcttgccctctaggtctggaggtatctctacaaggtcagggagatgtgctcctacctaagtgattgtctcttactgcgcccaacaacgccaggccccattgtgctcggaggagtgaagggattacaagagggcaaaataaactcttccaagatgcacagatacttcccttctaatatctctgcaccatccagagatactagcaaggaaggagaagttccctttacaatttggaatgcagtatccaggaatgtggtataattctttgatttgggtgataggtataaatagcagtggtaaaaacagcaagttacttctgtctacaaaccgaggtcaagtcatcccttcttaaaaaactgttagctggactgttcctgtctggtgtaatagtgtgaataaagattagtctgtacacatacatacaattcctcaaaatagtatcttcatataaggagagttatatttgtataaaagaacgtgtttgaaaattacaggcaatgtagcaacaattcctgaattattcttttgtttacttagcacttcagttcaaaaggctaattagttattttgtttaagctgaggaagaggggctgaggctgacatggaacccaaagtaactatctttggtttatatataggtggttaggatatatcaggcgctgtgtagccctccctttattatctcactgaattttcacaacaaccctgggaaagaggtattattatctccattttgtaagtgaaagaaacaaagagggagagaacttacttaatgtctcatgggctcatagctaactattagcaaagccaacattcaaacccaggcctaactccaaacctcacgaccgaagttgaaccaatacttattgggagatggtgcatgaggcagcagggagattcctggctcccattttccttcaagagactctgctgcaaggagcatgggtgatgaacagcctccagttgccatacctttgcatcaccacagctttcactccaagaccaagattttccagggcttctctcagcccatgtctaagcatgcgctaagaaggttgtcagaagtgaaaggctcaggcagtttatcagagaggcgggtggagatctggaaggacagtgctgtggatctcagatgcctcagagacaccagggctcccttggggtgaacccacagctagggagagatggtgccttagggagggaaagcggcatacctagatcagaaggagcttaatgtaccagattttaagaggctgttaagtgagaagggaaaccgggacccaaatgaggtatagatattgaatgaatagaagtttgtagagtaatagcaggtagaacgaattatttacattttctttttctttggtgtctcctgttttcttcttcctccttgattatctaactctaatctccttataaaaaacatactcttgtcctttttctttcatcctccagtcagcagaaaaacataccaatgaacattttatttcttttttttattatactttaagttctagggtacatgtgcacaacgtgcaggtctcttatgtattagactttatgttcgttgttctccatacagattaattgaacattaaaatttttctttctcaagaagagttaactgctcttttaacatgtatcatggccctcaattaacattctttcatagggtcatagggtcaatggtaagaagagggtacacttttcactttcatcagaggtattttcataggaaaatactggctaacaagatttatcctataaaattaaaacactagtgaaaatcaaattcacttagaaaatatctatatacaatttcacttactaaaagagctaaaataaaggctaaggtttttcttaaagcaatcaacttcaggagctacttgcaaattagtgtctgttcttttctttaccagtcattagcctgaattggtacccaagtcatgttacgagaaaataaagacttacacagaccattttaaattctgtagtctcaattaccatatatgctcttattaattgtttctaagaattcctcttcaaaatgtgtgcaagtaacgcatcatatggaaaggcaactgagttttcatatacggcttaaaaatacaaacttcagaaacacagatgttataccaaattctcacttgcttactcccagctaaactcaatctctgagctttaaaaagattttctaaactgctaaagattaaaaaaatgacattatacattcacatctggctctgtcaccatttagggcatgttaacatagattttaaacatctggggacaggggaaaagatctatcgggagcttttcactaccatgacaactgaagtgtactgttgctcaaatagttcagtctctgctcatctacatttaacaccaccacaggccttccatttttcaccacttaaaaacaacaattatcataggaaataatactcatatgtagaaagttcctagggagagtgtttctttcatttccatcctgctttaatcctgtgggtaggacagatccttcctctttgcagcaatgcagttaaaccagtttatattttctggcttttagacatggaagtccttcctatatttttgagtcactcaagagatggctcttaatgacaaagtcttaatggaaatggtgaaaataacctagcattatttttttctataaagcagcatcctttctgtgtgttcaaaatttaaccaacattctaaagagcatagaatatgggcaataaaaattataggtttcatgtgttaatgttttctgaatggcagatgtacaacatactttagacatactatttttcatttattcttcaaaactacctgtagttagtattattactttggaaaattaaactatggagagaggtacaacattcacacaaccatgtattaagtgcctatgcttgggcaagtgctgtgctaggcaacaggaatgtaatggtaaaaattacagcatgccccaccctcatggagtgtatcagtctgttctcacacggctctaaagaactacctgagactgagtaatttatgaagaaaagaagtttaattgcctcacagttccacacgcttaacaggaagcatggctgggagacctcaggaaacttacaatcacgtcagaaggcgaaggggaagaaagcatgtcttaccatggcagaacaggagacagagagagagagtgggggaagagctatacacttatcagataaccagatcttgtgagaactcactcactattatgagaagagcaaaggggaagtctgcccccatgagccaatcacctcccaccagggccctcctccgatacgtggggattacaattcaagatgggatttgggtggggacgcagagccaaatgatatcatggagcctaccatccatggccaagaaagggaaacaaagggccactgacaggtgggaatggaatctaaatctgacttcaaagcaaaaaccaaaacatcaggtctgactgacttctaaaccaaaagccttgaagtcacctttgactcacctcttcctgtcacacacaatacatccaatccatcagcaaatcaggctagctctggcacaaaatcaatccagattacaaccacatctaaccacccaggtcaaaatcacaaccatctctcacctggattattacctccattcctaactaatctctccatctctagccctttctctatttattctgttctcaagagacagccatctgggtcttgctaaaatgttttgtcagacatgtcactcttctgctcaaaaccctgcaaagtctcccatctcactcagagaaaaagctgagtccttacatcagcctgcagggccctatacaatgtactgggtcactgtatctcccactgctcactttcttgctcactcttttctggcccacagtcttctctattgttcctcaaacatatctggcctcttctcatatcaggagtctgtacttgctgttccctctgcctagaactctcatcccttccgaatggtaccagcttagcaaggcctatcctgcccatatttatgacagcaagcctcctccagcatgccctattctcccttccctgcctcatcactctctgcagtacaaatcaccatctgacatacactttacatgttgaaattgttcactggctgcctcttgtgtctcccggctctacagagctgactgtgctcatctcttcccagctcccatccattgataccatattgctagcctgaaatcagctgtgatcagcaaacactacaaaataggcctttaaagaaaaaaaaaaaagacagccaaattagtgtatagcactctcctcctaagaacacatagccccctccaacaagaaaatatgctgcatgaagcagagtttttgtccattttgctccatgctttctccacagaaccttagtgcttggcacatcataggaacaagataaatgtttgttaaatgagtgaacatttctcctatcctcaagcagattgaaagtactagtatcagaactccaaaccttcattttcagaactgctctaagcatgttctgtggtttagaaagcgtggccattttcctgaacctactccatctgttcctaacgggggctcctctccacttgcatggtctatgggcagaagacacaaggattgccagtgccctccagtctctgcacatgcctctaactcacagacggcaaagcagtaaattgggaaaagcctgacaaaactgttttttcatttttattgtaacttgttaaaacaaatattaaactacagatgatacagtgtgctatgttcaaaactgtagaaaaatgtgtgttaaaactatgggtcatgtttaagaagacccctttaaaaacacgttgtttagaaagtaaaaattttttttaggatccaaggagcagtttaacagaggctctaaaggaaagagcaaactgataaggatctgcagaggaaacatgttattctgtcacatacatggaggataactctttggtaagtaaaagagaaagaatgtcactgacccacgtaaatgtgttaacagtgccttaattcaattgaagtgggaattctagaatgttcgtgagcttggtgaacatgatggagggaagaggtctgaattctgtggtgcaggtgggagagtctgtgattaagataacaatcaaagtattgaactaggagaaaagagggaagaggtttaatagaaccctccaccaatcatgcttccttcaggaacacaaaattggacaactattcacacccaaaaagcacctttaaaagaaccaaaaatcacagtacctggttttaaatttatatcactgaaagaggcactgaagaggatataaaagacaatattgaattcctgatgccaccccttcctcattccatggcagtacatcccaccatcgctgcactctccctcccctaaacacacttgggaaagggagagtgcagtgatagtgggactttgcattgaaactcagtgctgccctgtcacagaggaaagcaacactaggcagaactcaactggcacctacagagggagcatttagaccagccctaaccagagaaaaatcattcaccccagtggtcagaacttgagttccagcaagcctcatcactgcagactaaagtgctctacagatctcaataaacttgaaggcagtctaggctaaaaggactacaattcctgggcaagttctggtgctttgttgggccaaaagtcagtggacttgagatgcatatgacctagtaagacaccagccagggcagccaaaggagtgcgagtaccgcccctccaccaaccccaggcagcacagctcacagctctgggaaagactccttacttctgcttgagatgagaataaggaagagtaaagactttgcaagtccaagttcaggacttgcaacttggatactagctcagccacagtagacaagggcaccaggcaaagtcctgaggcccccattccaggccctagcacctgaatgacatttctagacacattctgggccagaagaaaaggacccaatcttgggtaattcatcacatgctgactaaagagcactttgaccctgaataatcagcagtaggacccaggcactactcactgtgagctttgggtaagactcagagacatgctggcttcaggtgtgacccagcatattgccagctgaagtggctatggggaaggaccccttacgcttgagaaaaggaaagggaagagtaaaggagactttgtcttacagtttaggaaccagctccgtcacagtggcacagtgggatagagcatcatgctggctcttgtggttctcaattccaggtgttgactcttgcacggcatttctggaccagcactggccagagagaagttcactgccctgaagggagagttctaggctggctgtatccaccacaagttgaacgaagagcccttgggtcttgaaggaacaatggtggtagccaggcagtactcactgcagacttggggcagtggtaaccatgaggagagactcctctgctggtggaaaggagagggaagattcaggaggactttcccttgtggcttgggtgccagcttagctacagtagaatagagaatcaggtagattattaaggtttccaactctaggccctggctccaggacagcatctctaacctgggggggatctttctgccctaacaggaagaacacaaacttggctggctttaccacctgctgattgtagagccctaaggccttgagtgaacacaagtggtatccaggcactggttaccgcaggccttcggcaagacccagtgctgtgctggcttcaggtctcacacagcacaatcccaataatggtggccacagggatgcttatgtcacccctcttccagctccaggcagctcagcattgagagagagactctgtttgtctgggagaaagtaagggaagagaagaagagtctctgcctggtaatccagagaattcttccagatcttatccaagaccaacaaggtgatagctctctgagtctgcaagcgtcacagcttgggcttgggttaccctctaatgcagatatggctgcaaggaccaaaaacttataacactaacatcttttcaaatacctggaaaaccttcccaagaaagacgggtacaaacaagcccagactatgaggactacaataaacacctaactcttcaatgacaagactggacgaatacccacaagcattaagaccatccagaaaaacatgacctcaccaaatgaattaaataaggcaccagggttatatccaggggagagagagctatgtgactattcagacaaagaattcaaaacatctgatttaaggaaagtcaatgaaattcaagatagcacagagaaggaatttagaatactgtctaattaatttaacaaagagactgaaataattaaaaagaatcaagaagaaattctggagctgaaaaatgcagttgacacactgaagaatacattatagtctcttaacagcagcattgatcaagcagaagaaagaattagtgaccttggagacagacttattgggaaatacacaaaggagacaaaagaaaaaagaatcgaaaagaatgaagcatgcctacaaggtctggaaaatagcctcaaaagccaaaagcacaaacctaagagtcattggccttaaagaagaggtagagagaaagagagataggggtagcaagtttatccaaagggataataacacagaactttccaaacctaaagaaagatatcaatattcaagtacaagaaggttacagaacaccaagcagatgtaaccaagataaggtgaccaagacatttactaatcaaactcccaaacgtcagggataaggaaaggattctaaaagcatcaagaggaaagaaataacatataatggagctccaatacgtctgctggcaaacttctcagtggaaactttataggccagaagagtgtgaaatgacatatttaaagtgcttacagaaaaaaacttcttatcctagaatagtatatccagtgaaaatatccttcaaataggaaggagaaataaaggagaaataaactatacaaacacatggaaattagacaataagctcctaaatgactagtgggccaatgaagaattatgaaggaaatttaaaaatttattgaaacaaataatatttttagaggaataattttattgtagaagagtcttatgtaagcataagagcaaagaaagatcccaccaaataaataagcattatatatgattacataaaacataacatttcaaaatacatgcacacacacacatcacaatatacatgacagagaaaagactaatatctttactatatgaggatattttataaataataaaaaaggtaaatacatcaatagatcaatagaaaacctggcaaaagatataaacaggcaactcactgaagaagagctagaaataatatatggtaaaatggatggcaaatatatgaaataattttaaaaccttatttgtgatcaaatgaaaatttcaataattccaacacatttatcatatgatatatatacacacaatttccacatttatcttataaaactggccaacatttttatttttaatgaatatgcccagcacttaataaaaatgtaggaaaatgaacattcatgccagctcatggaaatataaattggactaaccattctaatccacaatttgacaataaatataaaagccttaaaatgtattctgtatgaagtaggatatacgttaggatatcagattctcctagggataataccaagggtttgaggagatgatattcactacagcatcatatgtaactgaaaaaaaaggatagggcaatctaagtatccagtagccaaaatgtccaaaccaatcatgaaatatgtgcacaggattggaataatatgaagatgacacaaattaagtagtagacaaacacagtgaactatggaaacaattgacagtgtatttctaagggaaaaagtatcaaaaagtacatgctatcattcatttagccaacacatcgagtgctgaacttaattatataaataataacagcttatgtgtatatgtaaagaaaatacagaacagacataaggataataatattacctttaagtgttgaatattataatgaagatgatggaaatcatccatcatctcactattgttcactgtaataaacgtgtaagactttggaaatcagaaagtaacaagttataaggaagttataaggtgtcatgctttaccatatcttacttttttaaacatgccatgctctttcaatatgtcatgctatattgtcatgcttttccccataagttataatatgtcatgctttttattttgcaaaatcccttctcctaagagtttaataataatgataccaatgggatggcaaaatggttccagctgcttttttttccttttatttattttatttatttatttattttattattattatactttaagttttaggatacatgtacacaatgtgcaggttagttacatatgtatagatgtgccatgctggtgtgctgcacccattaactcgtcattcagcattaggtatatctcctaatgctatccctcccccctccccccaccccacaacaggccctggtgtgtgatgttccccttcttgtgtccatgtgttctcattgttcaattcccacctatgagtgagaatatgcggtgtttggttttttgttcttgcaatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgctgcaataaacattcgtgtgcatgtgtctttatagcagcatgatttatagtcctttgggtatatacccagtaatgggatggctgggtcaaatggtatttctagttctagatccctgaggaattgccacactgacttccacaatggttgaactagtttacagtcccaccaatagtgtaaaagtgttcctatttctccacatcctctccagcacctgttgtttcctgacttcttaatgatcgccattctaactggtgtgagatggtatctcattgtggttttgatttgcacttctctgatggccagtgatggcgagcattttttcatgtgttttttggctgcataaatgtcttcttttgagaagtgtctgttcacgtcctttgcccaccttttgatggggttgtttttttcttgtaaatttgtttgagttcattgtagattctggatattagccctttgtcagatgagtaggttgcgaaaattttctcccattttgtgggttgcctgttcactctgatggtagtattgaaacaaataataaaagaaaaacaatacaccaaaacctcttggatacagcaaaagcagtactaaaaaatttttccccattcagtgcaatactagctgttggttggttatgacttttattgtattgaggtatattccttaatacctagatttttgagggtttttaacatgaagtgatgttgaactttatcaaatgcttattcagcatcaattgaaatgatcatatagtttttatccttcattctgttcatacgatgtgtcacattgattcatttgcctatgttgaactatctttacatcctggggataaatcccacttggtcatgatgaatgatcaagtttataagatctggaacatgacatcaatgcccactttcaccactgttattcaacacaactggaagtcctagccaaagcaatcagacaagaaaaagaaataaagggaatccaaattaggggggaataagtcaaattttttggttgcagatgatctgatatttggaaaaacctcaagactttaccaaaacactattagaaatgataaatttcagtaaagttgaagaatacaaaattaacattcaatgatcagtagtgtttctatatgccaacagcaaacaatctgaaaaagaaatctagaaagtaatcccatttacaacagctacagataaaatgaaatccacagaaattgtgtatttcacaaaaatgtgaaagatatctacaatgaaataaaatacataaaaatatgtattttacaaaaatatctacaatgaaaataataaaatactgatggaagaaattgaagagaacacaaaaaatggaaagatatttcatgtgcatgggctggaagaatcaatatggttaaaatgtccatactacacaaagcaatctacagattcaatgtaatccctgtcaaaataccaatgacattcttcacaaaaataggaaaaacaatcctaaaatttatatggaaccacaaaagatccaaaatagccaaagctataccaagcaaaaagaacaaaagtaaaagaatcacattatctgacttcaaattatactatagagttataataaccaaacagcatggtactggtataaaaacagacacatacaccaacagaacagaatagagaacccagaaacaaatccatacatctacagtaaacttttgacaaagatgtcaagaacataccttaggggaaagtacagtctcttcaataaatggtgctggaacaactggatatccatatacagaagaatgaaactagacccctattgctcatcatatacaaaaatcaaataacaatggattaaagactaaaatctaagagctcaaactgtgaaactactacaagaaaacactggggaaattcttcaggacattggactgggcaaagacttcttgagtaataccctataagcacaggcaaccaaagcaaaaatgaagaaataggatcacatcaagttaaaaagcttctgcacagcaaaggaaacaatcaacaaagtgaagagataacccaaagaatgggagaaaatatttgcaaactatctatctgacaagggattaataaccagaatacagaaggagctcaaacaactctctaggaagaaatctaataatccaattaaaaaatgggcaaaagatctgaatagacacttctcaaaagaagacatgccaatggcaaacatgtatatgaaaaagattctcaatatcattgaccatcagagaaatgcaaatcaaaagtactatgagatatcatgtcaccccagttaaaatgtcttttagccaaaagtcaggcaatagtagatgtttgcaaggatgtgaaaaaaagggaacacttgcacactgtttttaggaatgtaaattagtataaccactagggagaacaatttgggggctcctcaaaaaactaaaaatagaactaccatacgatttagcaatgccactgtgagttatatacccaaaagaaaggaaatcagtatttcaaagagatatctgcactctcatgtttattgcagcactattcgcaatagccatggtttggaagccctcaacagacaaatggataaagaaaatggggtacatctacacaaggagatactattcagccataagaaatgagatcctgtcatctgcaacaaaaatggatgcaaaggaggtcgttatattaggtgaaataagccaggaatggaaagacaaacttctcatgttcttacttatttgtgggagctaaaaattaaaacaattgtactaattgatatagagagtagaacaatgatcaccagagactgggaagaatagtaggagcagggggaaggggagtagttaatgggtacaaaaatataattagatagaatgaataagatctagtatttgatggcagggcatggtggctcaggcctgtagtcccagaactttgggaggctgaagtgggcgaatcattgagcacaggagttcgagaccagcctgggccacatgggaaaaccccatctctactaaaaaaaatagaaaaattagccgggtatggtggcatgtgcctgtagtcccagctacttagggggagtaccgcttgagcccaggaggcagaggttgcagtgagctgagatagtgccactgtgctccagcctgggtgacagagcgagaccctgtctcaaaaaatacatatatatccagtatttgacagcacaatagagtgactacagtcaacaataatttattatacattaaaaaataactaagaggataattggattgttcgtaacaaagaaatgataaatgcttgaagagatggataccccatttaccctgatgtgattattatgcattgtatgcatgtatcaaaatatttcatgtaccccttaaatgtgtacacttgctacgtaaccacaaaaattaaaaattaaaaaaaaaatcacagagtattggattaggccaaaagtgtgcatacagagtttgtgcttattgtgcatagagtttccttctttattaatgaagctttctgtttttcctttctttagagttatcaatataccctaagtaatttatttgtaaccgcatagtttgttggtaaaaagttccctacaattttccttattttcaaatattaccaatggcagtaagttaacacattcatgggagcaaagctacaaaaatgttaagtctggccatatagaaaaccctggcttgatgtgtgtttagtgcttaaaaatccccaaatatatgagatacattattacatatcatctgaccaacaattttgtagagcaaatattgcaaatcctgaatattataatactcattatatgcatgtagataagtataaaaactgaagctcacagaggttactgctcaccaattagggcaagtacagttgctgaagtcccagcctgcagactcaagaccctactgctctttctaatgcatgatgctgattctcttgaaggtaagtttggaatcttcagaggtatgtgttaggcatgggtagatataaggattctctgataaaacctctggtagagacatcctgtgaaatgtctgtggtctttgtctctgggtaatatctgtctaatcctctcttgagctcagggagttgcaatggcttaaggctggaagcaccaagtcactgagcagagaaacatccaggaacaggcatgcatgtatgatgcagaatggctgggaatcattccatcatgtgacaccactttacgatatcttcctttgttatgtgttcctgaaaaatactttagaaacatatcctcttcactaaagacatttcagtaattgactccttaattcaataaatgaaagcatcattattttgaggtctaagaatgggtacgagcatggggagggcaaagtgtcatttctggttgaatttcctgagaataagaacaccggactttaaacaatatgatatgactttttccccgaaactgaagttatttctatcctatttaatgtcacatatattttaactattatgtaaaaaacattgtgttagatgtcaaaggatataaagatgactgagatcatttcttccctcaaggaatcgccaatccaatgaaaagatgaaactcatctttctagaatacattttcccgtgtttatctttgaaagagtacactgaatattatacaacttcttcttgatgactgagggacatcattccaagccagctgatgttctgggccacaacaataagcacagctgcagctagaaatgagtgtgacaggagctcagggctactggtcataggagttaaccaagaactgccttctgccatctcaaattgggtggatgaggggctggatagataacagatataaataccctgatgtcatgattgctttttggtcttttccctttttcctcccatcctatatatgaaccaaagacctgcttcatgactaatgtgctttgaaccagcacaaaaccgccattagccatcagtgaggtatacaggtagcaacagctgaagacctttcctgtcgggcaccctgcagagtgtccaggtctgacctaaatgttactccttattgctgggcctcctctaacgtcagtgtcagctacccacctcctttcatcacttgaatttctaaaccaactggcatcaccccttctaagctctgccagttattctgctattcagaactctccgttctcaaattacaatgtgtataaaatgtccagcacagtgcctgacacagagcaggcactcagtaagtgctagagcccctttccttgtattttatagtctaatctttgatctgacatttttcctgtctctgtgtctttttacgatcaggtggatatacataggtacttctttatggttagcaaaccaaaaaatcacaatccattactttctatttgtatgtatctgtgaatgaagctttttttccttttacccctgcataagatacttcttaggttatctacaccttaataactcatttgcaactgtatagatagcttaaaggttcttttttattttcataaattttctccacccagtggttataatttaataaagtagtcactgtggctgtatttatattttgtaagtaatttatgttttggtacaatgaataattctggatgtgagttatgtgactgtgaatatacagtttgagctttctagaatctcttcactaccattctgatgctgcctcctctcatctaatgacaacaacctcatagaagagataaaagtctaagattcaaatctaaaaggcaaagcaattataaagtatagcacatgtagcatctaattatttttccacatataatgtcacacatgcaattggaaaaatgttcttttgttatttgtaacataaaccatgtcattttattttattttcacttccttgcagactctcattaaagcttgcacacatattattattccattgaaaagtaataacttcattattatggcataacaattaatgtaaggtgtatcaacacaaatatttaaaaggaccattacaaaagtaagaaaaacattaatctactactagggacttacttcattcatgtaagaaatttttccatcttctgtccatctggagaagagcaagataaattaatctttggttccaaacatttttagagttgttttatcaggaaataacttcctattttcccaagttttgaaattttgcaccttctcataagtataaaagaatctcagcatttcactttgacccatttcaaatttatatggcagatttccaaatgctgggaattgcaaagtgcctgttcttagcacatgatatctaccatctgccctggccatcaggatagggtccagatagttctccaacataatattgtaaagtcaaagtgctcttggcatttatgtaatatttttgcaacattttgcaggtgataaataaattgtaactttttcaaactgggactcatctaattacatgcatgggagcacttttcttgtgctgtgtattcaactgtgtatgcttgtacctgctcattcatcctccacacccaccccacacaatctgtccaactgagatttgatcatgtgaatgctgagaaaggctaaaggtttggtacccattcaaaatgatatttttaaagtacttattcaacatttattagatggagttggggaaaacttattttccattaagaaaagtatgtctctctttatgcttagttaacgaacaggattagttcacgcactaaatgaacatatcacttttatttgggtcagtctttcatttcacaattttgtggtttctcattaagggacagcattagttattcatattcaggagggcagaggtaactctcacagatatggttacaaagttacaaaatagatttcaaagttcttttatttactttcatgttgttaaaacatttcccatagttttttttttttttcagttcagttttatgacttaccgatccaggaaaatgcttggaaagcacagtaacaacttttaaacttaatattaaaaacaaataaaattgctcattgccaataaatatacctatgtaaaatactactcagtgtaagaatttcaactgacagtgacctgtcaaattcaggcaattctaaaataggatggtggtggttacactgtgcaaaatattcaatagagagagttcaggaatgccaataattttttgttattattatcaaaacattcaataaagatagttcaataatggcagcaactcttactgttatctccctcctatcccaccttgggggccttgtaataaattttgcttgcaaattgcctaagtgttatatgtggaaagctaagttaacaggtgtcatgtttcccatttataccactgatgttccaatgcaaggtgcccggggaaactgccatcccttaatccagctctgctcacccagacatacacatatacccatcaatccatctgttaggcattaagaattacaatagtataaagaacaatcctttggtgtacatatttaaatgttaaatatatactgaagggtttgaagcaaggatctggcaaacacgactgcatcacacatttggttcagccctgtctggatgtcagaatgcatccgtcattttggatttatgtataatgacagaaatcaagtcacgacccatgtagtctcaaaaggctacttagatgatgatgaagatccacaatactccctgaagtactgctgattcttcaactccattaagaatatacatctctgacattttaaatatcttaagtcagtgattttggccatctaggaaaaacaatgttgcagcatgtaatttaggtaatttcaacagagccagttcaatcttaaatcattatttctaatgcattctggcaatactttttttgtaaagtgaaattatacaacacttccagaaaccacagaatgtgacttaacaaccaattacttgtacagtttgcaaaacaagtaaacctcccagcagctgggagcttggctgagaggcctaggcttgcccttggcatggtaccttgctcttttctatgagttcacattgctttctagcctgctaatgcactggccttatgaacacagattccctaaatgctctccaagagtctgatatcacattcagggttaacacattttttcccttgttgcaattcagcagttttttacagtcattcatatccaaccaattgctgtcaacaggcatcttcacatatgaatgttaatagcatattattaaagagttcctggtaatttgttttgtgggtagagttgatgaggggtgactataggaagggaagccaaaggaaaaacatttcaactactctggaagctgacctctggaaagcagtcagagagaacagatgaaggagccaggcaagctctttttgaataagatggtgtgtattacagctaggaagagccaacagagtagatctcacagtgaccagcccagctaacagcagttgaaattgttagtcatgaaaatacagatgccccctgtatggattaccctcatattttctcagtcactagtttgagagtatcatatttgagagacagagtttttcttgataattgagaaagatcaaaaagggaactgaattttcattggcaaaaagactacataaatagaagcaacatctttgttggtgcctacttgtcatcagctagaaaggtccgattttttttgcaaaaaccttaggaacaggattcagggtaccttccaaaagcgaaaagtaaaggcagacttcagggctcctagaaagtttacatccaagaattccctataatgtaaacttgaaaattaatgctttttcctccacaagaacttgtttcaaaaagttagtctggtaactcattctcataaattgttcttagtatttttcttgcagattttcatgatatggttcccaaaataaatcagtagcaagcattatgatctgtgccttccacttcagcatagtactttgctccataaacataatataatgaacatttatgtatcactacctttcttacttttctttactcacttcatcatatcaacaaaatgtatttgatacacagttgcaaataaatattaagctttacattttgtaataaatatttctgagtaataaaaatgttccaactgatcaaaaaatttgatatttgatgatggcatttgaagagatgcatgtttattagctcaatttagccatttcacattgtatacatttttttaaaacgttgtacatgataaacacatacaatttttatcaattataaaaaattttgagtgttatatttgagtgataacaaatttagatgagttaacagaatacatacatacctccttaataaattttattgtttactagtccatcttcaaaagttcatcatattaactacagtcagaaattggttcccaaagttcattatatttattacagtcaaaaacagtttctaggaagtctattgtatttatacaattaaaaatgactcaactattgggtacaaggtttcttttaggatggtgaaaatgttctaaaatgatggttgtacaacctgaacgtaaatgaaaaaattatgtactgctgaactgtacactttaaatgagtgaattttatggtatgtaaattatatcccaataaagctatttttaaaatgggtcaatcaaggacactaagagttgtttatttgaaaagttcaaaaaaattgacaaaccattagctagatcaagaaaaaactcaaatcaaatcagaaatgaaagaggagggattataactgatgccacagaaattaaaaggataagaggctactatgaaaaattatatgccaacaaattagataatccaaaagaaatggattaattcctagaaacatacaacctaccaagactgaaccataaatagaaggtcttaacagacctataagtagtaagaagattaaatctactaaaataccaaaaattagccgggcatggtggtaggtgcctgtagtcccagctactcgggaggctgaggcacaataatcgcttgagccccggaggcggaggttgcagtgagccgccgagatcatgccactgcattccagcttgggctacaaaataagactctctcaaaaaaaaaataaataaataaataaaggaggtatatctcattttacccatttcattccacaataatgaaaaataaaagtgtcagctgtcctaggaatgcagaatataaaaggtggggcaacagggcatgtggtgctttccttagtttactttgacaataaaaactcctatctctgttgctgctggaatagcatttattggaaatcagcctctcaacagtcctcacccatcaggaacaggaatctgccattagcttgacagcatacagagcaccatatcagggttactatgggaagactctattgtggcatcagaaacacaaaaaacactggatacagttagtttctgttgacagtttcagaagaaaatcccacagattggacaggctgcctgctgaaagggttgtcactacacacagcatgccctgaaccctggaatgaagttacccctatctgtgtgatcaggaactgaacaactctgaggctctttttctaagctcttagattcctgcaagaacctcacacttacctcctcacctggctttggacctcaagctaaaagtgcaaacagtctgcctactttccccataaacatttccccaaaataaagggcttttttttttttttttagcacttgcttacttgtgttctcactttctctgtcttcctctccctccctccttctctccctgctcactgtcatcagctgggtcccaatccagtttctacacctacattcatgactaatgacccaccagcagcccctaagagccactaggctgtaatgaacattttcctaccagttacatgtggtaggtctgggaggagccccccatttccaatgagggtatgttaaatacagttagaatgatgcgggatgtggactctggagccttgctacatacaaaatgtggtctgaggaccagcaacaaggcatcatgtgagaacttgctaagtatgcagaaccttagaccccaccccagaactactgaatcagaacatgcattttaacaagatctcttggtgatctgaatgtacattaaagtttgaggagccttggtataaaatttgaatatattttgagagaagactgtggaatttggtgggggatggggaagtggtaggattcttatgtacagggctatttacagagaaaacaaataacattcattaaatactgaataatttactttctttaaaataagaggaataaataaatccaattactatatgtatagggccttgagacatcagtgagcttaaggaatcttcagcagtaaggcttaaatacctattcttattctttgtattttaataaatctgtttgcataagagctttaaattgtatcagtgacaagtaggtatgttttcataatggaataatagtgagcaataacgccccccaaaagaggcggagcaaggcataagtaaacaaaatgtatgtgtgtcgcatacatttcaacaggtgaatccagcatggcatgatggaaacttaagttccggggcccacacaggccccttccaaggaccaggaactaactttgcattcaaaattttgttctctcttcttacagacagcctcaaaaattacataatcttaaaacttcacaaaacctggaaccatgcctgatctaattaatcatgaaaactcttcttaagtttattattattattataatactttaagttctgggatacatgtgcatagaacgtgcagttttgttacataggtatacacgtgctatggtggtttgctgcacccatcaatccgtcatatgcatcaggcatttctcctaatgctatccctcccctagcccctcaccccccgacaggccctggtgtgtgatgttcccctccctgtgtccatgtgttctctttgttcaactcccacttatgagtgaggacatgcggtgttcagttttctgttcctgtgttagtttgctgagaatgatggtttccagctacatccatgtccctgcaaagtacatgaactcgtcctttttttgtggctgcatagtattccagggtgtatatgtgccacattttctttatccagtctatcactgataggcatttgggttggttccaagcctttgctattgtgaacagtgctgcaataaacatacgtgtgcttgtgtctttaagtttgacattatatatatatatctatatagatagatatctatagatctatagatatctatctatctagatatctatatagatagatatctatctatctatctatctatctatctatatatatatatatatattttttttttttttttaggacggagtcttactctgttgcccaggctggagtgcagtggtgtgatctcggctcactggaacctctaactcctgggttcaagcaatcctcccacctcagcctcccaagtagctgggagtacaggtgccgccaccacacctggttaatttttgtatttttagtagagatggggtttcgccatgttggccaggctggtctaaaactcctgatctcaggtgatcctcccgcctcagcctcccaaagtgctggggttacagacacgagccaccatacccagccgacatataatatttttaaatcctttcaatacactgggaaacatttagaattatatcactatcattcaaactacaaatgaaaataacaatttaattgacacatgacctaggaataattctgctcatgtgtaagaaaaactgtttgtaatgatatggttcatatcttactcttctttccatgttatcatttaacatgattaaatttaacaaatatatcgtttgttgacatttctctctcttcccttcttcttttcctcctattttaacttaaaaacctaactactgcagaggtggggaggtactagaggaaatatccaaaaatgttcctcaggaatttttgtttaattttgttttattattttcctcaggtttgaaactcatatctacttacattttttaaagaatgcaaaaggtaaaacaagtaaacacacacacacacatatacatacatacacatattaaaaagataaattctggtgacattttagtgactagtatttcaaactatttaggtaagatgttaacagtgtggttttgagagttacatgtgagtgtatgtatgaacatatacataactgtatgagagagagatctagaaattgctgtcctgcccaccaaaccactgatacacctttttcatacagttaaagtagctgtgcctcatcatgagctagaatgtattccgtatgtatggttatcaatataaacaatctgccaatgctgggcattccgtgtgtttctgattttcattttataaatgaagctgctatggatatccttatgcacgctccctcttgctctttccttattttgtcctgaggacaaatccctgttatgaaaattgcgggataaaactttggaacacaataccagtgtgccttctgaagagtttcatcaatttacagtacaatcaaaagacaatttcacttttaaaacatcatttgctaatttgagagacaaaaaagtctgtttttgtttatatgcttactttttaaacttttaaagtaaaatacacatacagaatagcacacagcttgatgagttgctgttaatttattcctttttatggctgcatagtattccatggtttatatataccacggtttctttatccacttgttgactgacaggtatttgggctggttccacaatttcgcaattgtgaattgtgccactataaacatgcatgtgcaagtgtctttttcaaataatgacttcttttcctctgggtagatacccagtagtgggattgctggatcaaatggtagttctacttctagttctttaaggaatctccacactgttttccatagcagctatgctagtttacattcccacaagaagtgtagaagtgttccctgttcactgcatccacgtcaacatctactggtttgttgttgttgttgttgttgttgttatggccattcttgcaggaatgagctggtatcccattgtggttttgatttacattcccctgctcattagtgatgttaggcattttttcatgtttcttggccatttgtatatcttcttttgagaattgtctattcatgtccttagcccactttttgatgggactgattttttcttattgttgagttcgttgtagattctggacatttgtcagaatgtatagactgtgaagtcctttgtcagatgtatagactgtgaagattttctcccactctgtggtttgtgtgtttactttgctaactgttccttttgtcatgcaaaagctcttcagtttaattaggtcccagctatttatctttgtttttattgatttgcttttgagttttggtcatgaaatccttgcctaaaccaatgtctagaagggtttttccaatgttatcttgtagaatttttatagtttcaggtatcaggtttaagtccttagtccatcttgagttttgtataaggtgagagatgaggaaccagtttcattctcctacatgtggctagccaattatcccagcaccatttgttgaaaagggtgtcctttccccactttatgtttttgtttgccttgtcaaagatcagttggctgttaagtatttgggtttatttctgggttctctattctgtttcattggtctatgtgcctatttttgtaccagtacaacactgttttggtgactatggccttatagtttgaaatcagatagtgtgatgcctccagatttgttctttttgcttagtcttgatttggttatgagggctctttttttggttccatatgaattctagaattgttttttctaattctgtgaagaatgatggtggtattttgatgggaattgcattgaatttgtagattgcttttggcagtatggtcattattcacaacattgattctactcatccatgaacatggaatgtgtttccatttgttcgtgtcatctattatttctttcagccatgttttgtagttttccttgtagaagtctttcaactccttggttaggtatagtcctaaattttttttttttttttttttgcagctattgtaaaagtggttgagttcttgatttgattttctagccactgttggtgtatggaagaactactgatttgtgtatattaatcttgtatctggaaacttcgctggattcttttatcagttctagaacctttctggaggagtccttagggttttcaaggtaaacaatcatatcatcagcaaacagtgacagtttgacttcttctttactgatttggatgccctttatttctttctcttgtctgattgctctggctaggacttccagtactatgttgaagagtggtggtgagagtgggcatccttgtcttgttctcatcttgtcagattctcagagagaatgctttcaagttttccccattcagtgttatgttggctgtgggtacgtcttagatggcttttattacattaaggtatgccccttgtatgctgattttgctgagaattctaatcataaaggggtgctggatttttttcaaatgcttttttttgcatctatttaaatgatcatgtaatttttgtcttaaattatgtttatgtggtgtatcacatttattgacttgtgtatgttaaaccatccctgcatccctggtatgaaacccacttgatgatggtggattatcttttcgatatgttgttggattcagttagctggtattttgttaaggattttggcatctatgttcatcaaggatatcggtctgtagttttcttttttggctatattctttcttggttttggtattagggtgatgctggcttcacagaatgaattagggagggttccttctttctctatcttgtgaaatagtgtcaaaaggattgggtatcaattcttctttgaatgcctggtagaattctgctgtgaatcgctctggtcctgggcttttttgttgttggtaatcttttaattacaatttgaatctcactgcttgctattggtctgttcagggtatctaactcttcctgatttaagctaggagggttgtatttttccaggaatttatccatctcttctaattttctagtttatgtgtgtaaaggtgttcacagtagccttgaatgatcttttgtatttctgtggtgtcagttgtaatatctcctgtttcctttcttagtgaggttatttggattttctctcttttcttgattaatcttgccaatggtctatcaactttatttatcttttcaaagaaccggcttttttttcctttatcttttatatttttttggtttctatttcatttaattctgctctgatcttggttatttcctttcttctgctgggtttgagcttggtttgttcttgtttctctagttccttaaagtatgaccttagaatgtcagtttgtgctctttcagtctttttgatgtaggggttttgggttatgctttccttttagcactgcttttgctgtatcccaaaggttttgataggttgtgtcattactgtcgttcagtttgaagaatttttaaatttccatcttgattttgtttctgacccaatgctcattcaggagctggttatttaatttccatgtatttgcatggttttgaaggttccttttggagttgatttccagttttattccactgtggtctgacagagtgcttgatataatttcgattttcttaaatttattaaggctcattttatggcctatcatatggtttaccttgaagaaagttccatgcactgttgaatagaatgtgtattctgcggttgtcggatgaacttttctgtatatatctgttaagtccatttattccaaggtatagtttaaatccattgtttctttgttgactttctgtcttgatgacctgcctagtgctgtcagtggagtattgaagtcccacactattattgtgttgttgtctatctcatttcttaggtctattagtcatagttttataaacttgggagctccagtgttaggtgcatgtatgtttaggattgtgatattttcctgttgaacaaggacttttaccattatataacatctctgtctcttttaactgttgttgctttaaagtttgttttgtcttatgtaagaattgctaccccagctcgtttttggtgtccatttgcatgaaatgcctttttccactcctttacttaagtttatgtgagtccttatgtgcgaggtgagtctcctgaaggcagcagatggttggtgagttcttatccattctgtggttctttcaagtggagcatttaggccatttatattcaatgttagtattgagatgtgaggtaccattgaattcatcatgctatctgttgcctgtgtactttgtttcgttttgtttttttgctttttaacttgtatttttgttttataggtcctgtgtgatttatgctttaaagaggtcctgttttgatgtgtttccagaatttgtttcaagatttagaggtccttttagcagttcctgtagtggtggtttggtaatggcaaattatttcagcatttgtttgtctgaaaaagactgtatctttccttcatatataatgcttagtttcactggatataaaattcttggctgataattgttttgtttgagaaggctgaagatagggtcccaatcccgtctagcttgtaaggtttctgctgagaaatctgctgttaatctgataggttttcctttataggttacctggtgctcctgtctcacagctcttaagattcgttccttcatcttaactttggataacctgatgacaatgtgcctagatgaatatctgtttgcaataaatttcctgggtgttctttgtgcttcttgtttttggatgtgtaggtctctagcaaggccagggaagtcttcttcaattattcccccgaatatgttttccaagatcttagaattctcttcttcctcaggaagaccaattattctcaggtttggtcatttaacataaccccagacttcttggatgctctgttcctattttcttattcttttttctttgtctttgttggattgggttaattcgaagaccctgtcttcgagctgtgagtttctttcttctacttgttcaattctattgctgagactttccagagcaaaaatgtgtccaaagcttcctgaatctttgattttgttttcctttaagctatctagttccttgaatattcctcccttcacttcttctatcatgttttggatttccttgcattgggcttcacctttctctggtccctccctaattagctttataactaacctcctgaattctttttcaggtaagtcagggatttctttttggtttggatccattgctggtgaactggtgtgatatttttggggggtgtcgaagagccttgttttgtcatattaccagggttgtttttctggttccttctcatttgggtaggctctgtcagagggaaggtctagggctgaaggccattgttcagattcttttgtctcatgtggtgttcccttgatgtagtactctcccccttttcctatggatgtggcttcctgtgagccaaactgcagtaactgttgtctgtcttctgagtctagccacccagcaagtctacctggctccaggctggtaatgggggttgtctgcacagagtcctgtgatgtgaaccatctatgggtctctcagctgggataccagtgcctgttctggtggaggtggcagggatggggatcagggatgcaatggactccatgagggtccttagctttggtggtttaatggtctatttttgtgctggttagcctcctgccaggaggtagcactttccagagagcgtcagctgtggtagtatgggaaggaatgggtggtggggtggggtcctagaattcctaagattatatgccctttatcttccgctactagggtgggtagggaaggaccattaggtcggggcagggctaggcatgtctgagctcagactttccttgggagggtcttgctgaggctactttcagggatgggggtgagactcccaggtcactggagttgtctacctagaaggattatggctgcctctgctgagtcattgcaggttgtcacggaagtggggaaagtcagtagtcacaggccttacccagctcccacacaaaccgaagggccagtctcactgccaccatgcccccctcaacagccccacgtctgtttccaggcagagagcaatacgagtctgaaaacctgccccaggatacctgcctccaactacgaaagaaaagggtttggttttttgcctgcctgtggagtctgcacaccggatttgcgccctcctttgaattctggccaggaggcttctcatcccgttcaaattgttacaaagttcagctagagatgtccttctccctgtgtggttttaccccctgctcctctcctgttggatccccatggtgccaggcaggaatggcctgctaggggacccagtgagttcccagggcccttctcactgtttcctctactcctgtattttgctcagctctccaaactgactcagctccaggtaaactcggaaacttcttccacgaacagaccttcagcttctccagtgggagtgtgtgttcgggagaggatggtctcactttcacggttggggcactcaacagttttgcggggtggtatcccgggtccacttccttcagagggtgtgtgggtcctcttgggatggctggtttgctcttgcggtcgatctggagctaaaattcacagtgtgagtccccgcacactgctctgtccagagatgcaatctagtcctgcctcccatctgccatgatgatcccgctcctccttttcattgttgaacactattctatgatatgtgtatatcataatttgtttaaccatttgcccattgaaagacatcagggttttttccaatttttgagtattgtaaataaagctgctatgaatatttgtgtacaaatttttgtgtaaatgtaagtattcatttctccaagataaatgcccaggaatgccattattggtctgtatgatagttgcgtgtttagttctttatgaaactgtcaaatcatttttcagggtggctgtaccattttacattcccaccagcaatgtagggatttagttcctctgcatcttgctagcatttgatgttgtcagtagtttttattttacttattctgattcatatatagtgatactcattgtgattttaacttgcattcttgtaatgactaatgatgttcagcatctcttaataggcttattggccatctctatatactcttcagtaaaatatttctttgtgtctttttcctattttttaactgaattgttttttactgttgacttttgagagttctttatatattctagggtactagtcctttctcagatatctgctttgcaaatattttctccgaatccatagcttatattttcatctactcaccaaggtcttttgcagagcaaaatttttaattttaatgaagtgaaatttttccttgctttgatatgaagtctaagaactttttctatttttagataccaaagattttttcgtatttttccaatagttttatagttttgtgattcacattaagtccataatccatttcgaatttttacataaggtgtgctactgagaatgaagttcatttttttgcccatggatatcaaattgctccagaaccatttatttaaagagcatcttgtctctagtgaattgaatttgcacctctgtcaaaaatcatgcaaatatgcacttctgttcatatttgtgtgggtctttacctgtgttctctattttcttacagtgatatatctctatccatcaccaaccacagtcttgattactgtatctacataatctcataaaattgcctagactaagtccttccactttttaaaaattgttcaaaatattccagttcctttgccaatccacaaaggacttagaataattttgttgacatcctcaaaaaatattcttgggattttgataggaattgctaccaatatctacatatcagcttggggagaagtgacatcttccactccataaacatggtatgtctctttgtttacttaaatcctttttatttctttcatcagtattgtatagtattcagcatgcatttcttatacatgttttgttatatttatgcctaagtaactctttttagagcaattgtaaatggtatcatatttttcaatttctgtgtcaatgtgttcattgccagtatatcaaaatacaactggcttttatatgttcagcttgtatcttgcaaccttgctgagctaactccaggatttttttatagattctttgatatattctatatacacaatcatgccatctgcagataaaaactttttttcttctttctcagtctattgctttttgctccttttcttgccttttggcactctgttgaataagagtagtgagattgaatatccttgccttgttctcaatcttgaagagaaagcattcagcctttcacctttaactaaaatgttatttctaggatttttgtttttgtagactgtcatatatcgagtttaagaaatcccactattccttctttttttccaagaattttcatcataaataagtgttgaatttaatcaaatgatttttctgcatcaatcgatatgatcacgtggcttctttcctctaacctgttaatgtggtggattgcatagattgattttcaaatattgaaccagcattgcatctacaaaataaataccactaggttatggtaaacaattcttttatatactgctgaattctatttgctaatatttgctaagtatttttacttctctatttatgattgatactggtagacagttttcttttttgtactgtttttgtctggttctagtatcaaggaaatactagcttaataaaataaattggaaagcgttgcttcctttcctattttctggaagagactctgtagaattagtattaattattcttcaaacatgtgatagaattctccagtaaaacaaatagggcctggatatttctttggggggagttttaaaattataaatcatatttccttagtaattacagtactattcaaattacaaacataatattgggtgagttgtggtagcctgtgtttttcaaggaattggcccatttcttctaagttgtcaaattcatgtcagtgaattgctcacagtattatcttaatttccttttgatgtctgcagggtcttcagtgacatatacaatatatttggtgatacagtaatttatgtatcctcccttttttgtcagtcttgctagaagctaattgatctttcaaataaagagcactttattccactgattttctctactatttttctgttttcaatttctttgacttctgctcttatctttatctccctttttctgcttcaagtttaacttgttttgttttagttttttggggtgataaattattaattcaagattatttcctcatttttaatgtatgaatttagtcctataaatttccctctcatcactgctttatctacctacaaattttatgttgtgtttccattttcatttagttcaatatatttttatgtccccgatactctgacccacgcattgactaaaagtatattatttagtttcaaagtgttggaaattgtcctcttatatttctgttatctctagcttgatttatttggatcagagaacatactctatacggtttcaatggccttatattaagggtttttaaaatcactcaagctattatcttttttgggatatagtccacaggcatttgaaaaaatatatatattctgctgttattgggtggactgttttataaatgtaaatttgatcctattagttgatggttttgtgagatattctatatccttactgattttctgtataactgtcctatcaacttttgagaaaggggtgttgaactctccacatataattgtagatttgcctgtttctcctttctattctatcagttttcacttcacgtattttgtagctgttgtctcgtgcattaacatttagaattgcaatatcttcctagtagattgacctttgcatcattatattatgtccagctctgtctctgacaattttctttgttctaaagtctactttatctgatattaacatagccactcttgaattccattgattaatgtttgtatatcttttctgcccttttattttcaatgtgcatatgtcattatatctgatgtttcttgtagatagcatacagttggttcatgtttttaatcaccctgacagcctccgtcttgatcgttttagactatctgcatttaatgcaattattgatatgttagggcttcagtctgttatcttttgtttttttgttctgcttttcatctctgttttttcttgtgttccaagtaagttaatcattttagaattccattttgattcacctatagtgttttaaatgtatttcttatattttaatggttgctctggttattacatatatatgtataattcagacagtctattagtatcattttatcagtttgagtgaactatagaaaccctatctactttgaagtctctttgccttcccccacttaaaatatagttgtcttaaatatttcctctgcatttatttacaacctacatcagacagggttataatttttacttcaactaccaaatatatttattaaattcaaaaggagaaggaaagcttaatgtttacccatgtttacacatgcttttgtttactgtgttctttcttcctttctaatttcccagagtcccttcttttattgtttcttttctatttagagaactttttcaaatcgcatttctagggcaggtttaaggtgactaaatcccttcgtcttccttatcctgagatggtctttatttctccttcattcctgaaggataattccactgggtttagaattatgagttgataatttttctttcagcacttgaaaaatattgtgccactttattctgggtttcattgtttctcaggagaaacacgctgtccttctaattgatttttcctgtgtcattttttttctcactttcaagaatttttcttgaatatagttttcagaagtttaattataatgcatcttagtgtaaacttttttgtgtttattctgtttggggtttcctcagcttcttgaatctgtaggtttatatcttttccaaatttgagaaattttcagccattatatcttcaggtacttttccagcactgctctctttctccttccttctgggacttcgatgccgtgaatgttagatgttttgttataatcccacaggtctgtgaggtgctgttcattatttgcttatcattattctctttactctcatcattgagattggaatttctattgttatgtcttccagttattgatgccttcctttctccccttcactatgctgttgagtctatctgctgagcatcttatttcagtttctgtattctcagttgtaaaatgttcatttagttcctcttcatatttccttggtgagactttctatttctttgctgagctttctatttttgcatttatttcaagtgtaattgctagtttaagcatttctaccatagctgctttcaaatccttttcagataattctgacagtcatcccaatgttggcagctattgactgtctcttttcatacaatttgaggtcctcctggttctttgtataaagagagattttcaattgaaagctgaacatttttatattatgctctgagaccttgaaccttatttaaaccttctgttttcactggcttttcctgaccttgctcccataggggaaggaagaatgccatctcatattgccaggtataaaggtccaggttccccacttggccttcgctgacacccaagtgggaatttattttaactgctggatatggttggggtttctagatctctctgtggcctcctcagacactgatgtgagggtagcaccatgaccactaggcaatggtaaaagtcccaagtctccattaggtctccaatatcacagccccagcaagaaggggcaggggtacataatttttgttaggtagaagtggaaatctaccatctgatactgcagcatgaatgaggagaggggacaagtcgttaccaaccagcagggatgaaagtcctcgctccctactttgtctctgatattaccccacaggagaatagttatagcctctggaaagtgaaagaaagtctagcttctgcactcaggcttccctggcacgggtaagagtggggccacaattatttctgttgtttggcaaagagattagtgtctaaaagtgttctgtcttgctgcaatgtccctttttctacatttctggctagagagagtaggcttcactgggggctttttgtctgtgcccattggtattcccagcttgctagcttcttcagtgtcaagtcttggatatgtaagataagaagacaacacagggaacttaccaccaggttattcctctgggtctcatgtccttaaccagtctacttcctcctctctgcctttcagaatcttgtgtttgttctatatggaatgtccaggagttttcattgtatttagtgggaggaataggaaaatcacatccactccaattactcgaaagtggaattctgtatttttaattcacatagctgttacctaattgccttccatacatgtatcaatttacatttacatttcagttgaaccaattacatttctgcagagttaacactggtttacaccactggttttcattccagaaattgctcttggccatctgtttttgccctcacatctgccattttagagtcaacttaagaactttttttatagaaaattcttcttacagggtagaaaagaagtaatggtattcaggagtgagcttctagtagatgccttcctttcacttgcctgcctcccacctagccctagttcatctaatttgaaggtgattagtggagcttttctaagcctcctccacttaacaaaagtgaacactacgcagagttctgagaagggaatttttattccagttcctggtgtcttctattttattctaaatcagattatattaaacaaaacttccctgaagtttgaggtattttattgggactattccctaatcccaccattctcaccatgtatgcttatttttgtatgttttagtcagtattttgggagaatgtggtggactgctatcattcaaataagcattaagtggacaccctttataggcagcttcttttcaggggcggaaataagccattgcatgtgtaagaactaaggttgagcaacagcaattttgccagatgagtatccactttcgctgtttagtccctcacacttgattacaccacatctttattttctgggcttgtttgtatggtagtccttaaaccctactttcaacactggtgtgaaaagagtattccaagaataagacagcagtaactaggaatccctatcatttaagatagaaatacaattaaaacactctcccctcaattaaagcttattgccattaatacacagtccccagaagggtttttgttggttttacttcaaaagctgaagctcctgccctttactacaaagaaacatatacacatgaagtaaaaggattaccttgtgagcctcaatgtagaatagagggtgtgtgtacagatatactgcaacttctcaaactaaaaaaaaaaaagatatgtaaatacttctgataaaatatttacttatactagaatatttcatacaaaaaatacataaaaatggaactccacataatactatctagctataaattactgtaaaatgttttttggaatattttattctagtctcttcctaggcatttatatatacatacaaccacacacacacatatatatatatatacacacacacacacatatatatacacatatatatacacgcatacatacgtgtgcgtatatgtgtgtgtgtgtttgtgtgtgtgtgtgtgtatgtaatacatataattagatgggctcataccgtaaataccactttgaactctgctttattcacttaacataatgtattttcccatttggttaagtggtctttaaaaacatgagtctttaatgactgcaataataatattctgccttctgaaggtgccataacttaaacattcttctatttgtgggtatttaagtttttacatttttgccacttttaataacactgcaatgcatgtccttttccataaatctttgagtttattttcctcagggtagactgctagaatttggattactgaattgcagctactagctgcactaggctccctcccacagcaggaaacctggttctgggttagggccaaattcactcttggcctcagcactgaaaagagattgcagattctgcacccctctggcaagacactgttgaggttctctttagaattcttatttcctgtcagtggtgcggccaggtaagcctggggctctttcagcttgcacaaagtgtatttgctgcttctgctccgagaagaactgctaggaatcgggaaactgagtcagatttgtatgtttcctctggtttgtactctgccagtttgagtcagtagaaaggtaagaaatttttttttgcaagaacccctgtctgctaattaattttagaacaaatataatagtttccataccacgaggaaacagtatctttaaaacaaaatcgggaacacaatatctacacgcaagtaggcttttattattttttcttttattcttttttctttggctaaaatttaggcactatattgttttaccacattatctgatcgtgatgcttcatctctgatcacatgttgctgtcattaaggcatttctgaggcttttctttcttaatctggaaagttattaaattgtaaaaacgtggcttgttgtatactaccttctaaaattattaaagaacacttttctttaaaacaagagtgttctccattgccgtcaagacaaacagcagtaactttacacaaaagaagcattcatctgtcaccctactttaaaacacccaatattcatcagctgtttgcccttcttggagcagcctgagcaggaaaggattaatgttttatccattcatgccctttgatcaattttctattgagatgttaggtttttttcttctgaatttgagaaagccctttaagtactgattatattaaccctatgtctatgtctgtcatatttgtttaaaataatttttcccacttttcattgccatctgatctcatagatggtgaatttttttttaccattcagaaatatttaaatttagtacattatataatgttgtctactttagcatttgttttaatttcaaaattaggacatcatctcaacctgaaaatcatatatattcatcaattatattttctttttttaatgtatttctttttctagtgtattatatatatagccttataagattataataatgtatttctattataatcttaattttttttttaaatggagttttgctcttgttgcccaggctggagtgcagtggtgtgatctcagctcactgcaacctctgccttccgtgttcaagcgattctcctgcctcagcctcccaattagctgggattacaggcgcctgccaccatgtccagctaattttttgtatttttagtagagatggagtttcaccatgttgggtaggttggtctcgaactcttgacctcaggtgatccacctgcctcggcttcccaaagtgctgggattacaggcgtgaaccacagtgcccggcctgatttttataattttaattgttttattataattttaaacagtaataaaataccatttttgagagatttgagttttcattggttttgattcaacttttatcatatactaaattatttcatacattaggtttttataccctgctagctgtaccactgtgatgtctgttgcttcttagactgttcactggaggtgtatcatatatttaatatcttgtaaaacaagtattttcttctgctatcatttactttttcttttcctcaaaattttaagtagctcaccctatttgttcttctaaatgactttcgatttgacaattcaagtttcaaaatttctaaatgaacttcagagtcaacaatttgagctagattccaatttcatgacaaatataatgtttatagcagtaaagatgtaaaaaggcattcaaactcactactaaccatggaattataaattatttgccatcaaataagtaaaacattttaaaggttgataatgttcaatgttgatataaatatgggtaaaataggcattttcatagaccattgatgagaaaataaattggtagagttattttagaggaaatttgccagtatctatcataatgcaaaatatgagtatcatttgatccaataattccccatctaggaatctgtctcatagatattcttacacatgtacacaaagatacaaggtagttcaccacagcactgtttgtaaaaatcccgcattgggatccacaaataagtccacgtgtaggggaatgataaaagtaaattattaagtatccataccaaggaatgttgtagagctattaaaaataatgaagtagatatatgtataataatatggggaaaatcttttaagatatattattatataaaaaaacaagtttcagagtaatgtgaccaacataatgctatttacattttaaaatgtgtgtatgtgtgtgtgtgtgtgtgtgtgtgtggataggtgggttgatagtgtatatatgtatacatatatttagaaggataagaacaaaaaggatagtagtatttacttttggggaggtgaggttagagagtaaaaagagcttataacttttaaatctaagtatttctatagtattgagtactatgtaggtatttctcttaaaagttttaatttcaaatatacaaattgcacataaatgtaatcttataatgagtaagtgaaaatttaaaatatatttgtatattttaaatttaaaaacttaaaagcaacacctacttactattaatatcacctttacctggatcaccactttgtgtgtctgtatgtttatttactgttgaactggcagaaagttattcatatttgaaccggccaacagataatatgtgtactctcctgctggcaaaaccccttgggtggtagcttctgaatctctttctgggttccatcctatagtgcaagttggtctgcacacttttaatgtttagcaagttttcatcctggactaacctaagcaactgggctgaggtgtattatttcctattgttgcatatttatttactccaaactcccatcaaagagtacaaggaaagccacaatacatgcacccagtgctagacaagctcttcctgcttccagttacatacttggatggtgtgttacagaggagagggagatttaccacctacgatggatttcattcttcttctccagcacgacctactaaacaaggatagtaaatttctgggagatgctgtctatgtagatattttaaaagggtgttgtagagaaggagctctgcaacaatatatggaacaggtcaaaaagcagtacccacaggagacggctgcccaggctttctaactgctacagaaatccagtgttggctaatgatagttattctcaattcagctccatccatcttgtaatcagcagaaattcctctagaaatcctgcaaaaggccatcagtcttattttctaccaatatgtttttatctttttatgtcatcatgggtatgtaagtggaaaggtgggagaggctgcctcagggtctatcagccaggtgatattataaacatgttcttttgtaattaaaagttcaaacataaaataacaatgttaatgggcaaaagaggtcataaacacagaagttgtaggtgggcacacaccactcttagaacatgtttctacatcatggtggctgtatctgctgcttactaatcaggcatggtggctctccagggtattaattcccccaaggaccaagaacccatttattgtgtatgtgtgcagggaacaggggaacgtttctatggcagctgcctggaagatcagaagcaaggggagagaaaggaatgaaggaaagcattaacgaacacagaaagcctgaaatctgggtagaaataaaggtagacagtaggggataaaaaggggattaatacctgtgaagtgataaaagagaacagactccaaaagggggtataagagaaaaactctgtaagtaatcagtgggaaatggaagctccactggaaaagtcattcagcttagttttattcagacttaaaaccgggatttggtgccaccagaagagagtaggtaagcatgaaagctgaagcaatttatcaaaattatcctttctactgatgagcatttctttcaacaaatgtccgttacaaaaagcaaagccacaattgtattaattactcagcacccggtgctgtttcctatgaagaaactaaggaaaaaaatataatataaaaagaataaatgtatgacttttttggtctttgacagagataaacgtgctagaaggaaatcttccactctatttgaaatgtaaaaatacatgttcagctcatatatttcctgtaatttccacatgtgagaagtgagaatgtctaaaattatccaatataaaatatgatgtatatcaggattttgttggatcttgtcagctactcataggcagataaggcaggaaaggaagggccacaacttgcattagacttgcagttaaagagacagagagataaaggagagggagagagagagagcgagcgagcacacacatgcactgaaatgggcaaaacataatgctcactctgacctcaatccaggggcaaaagaacagctagtttcaggaactagggcaagatgcagaaagggggccagcagttctcataagccctctcgcaccagtcagcacacaactatcaatcaatggggaagaagcagggccctatcatgggactgaccttctggggaaacgcagccccaacacagccagaattgctgtcagcacagctaggtagggcttcattcctagagtggggaccaaataactaagagagttctgtcctacaccacctcaggctgcctgaggttggagaactcgggcacagaagttttgctgtaactaagagacaacaagtgggcagagctgatgatgggtcaagagcactgggtcccatgctcatggtcacgcaaataatagtgacatacagcaaatactataaaagggcctcctgttattggtagtagcaggacatcacatccaatttcaaacgataacatcttcttgaaggtgaagtttttgcatttaaagtctggttaataactgtttcatggaaccatgggaagataactctggaagagccagcagattatctagtgtctgcccaggttccagtgtaacttgctgtttgtctttgagcattatcattaaaccttacagggtcttgattttctcatcccaatagtctccctggcctccctggaaaactctgtggcccacgaacttttgtcaggaagctcttcttacaaatattctcttagcaaaaattatcctatatttgacactttcaattattcaacaaatctagaggaaataatcacattacaaaatagatgtccagaacattccaccttgtttcacagaaatcctgtggaaagtagacatggcaacagcataaccaacggcacgggtggcagagatccaggaagacaagtcaggaaggaacagtgctaaggagaggaggaaatcagccactgaagaaattctgggacacagcaatcaatcactagcaaagaaggtgcagctttgagaatacactaaggaaaagggagggagggaagaagagacggtaggcaggcaagcgcatattctatgttccatagtgcactagggaaaacaggaccatgaatgaaaggtttggaacataagtcctgtcatagctcaccttgagatttcaatcaagttacaactctttgggctttgggttcttttctgtaaaatgagaaatcaggattggtgagatgacagttaaggataagtggacttcgtacacaatgagacaaatggagtagaaccacattctatgtggacctaattttatggagaaaactgtacctttcaaatggttctgactgggagtgctgctatgaaaagcccagcgtgttcagcccagagctccctactttttatggaattccaactctgacacaacactcatagcttagatttagtcagaatcaacttaccaagcctcaaaatgttccacagaagcttttgtttttattaatctattaagactttacaaagtttccttctctttggttagaaatgaaaaaagtgggttaatctcatgtcttgtttcaaccgggaagccatgacttaaggagagcagcctatctgccacagatgataccaaaaattaaggatactcaaaaacactggtcccaaatcaatggcatgtccacagcctttgttccctgaagatctgcagctcataaacatccaggggaggccaggtctcctctctgtccttcctagttgcagatactgatacagcagaaggcaaagttagaacatgtatggattagattgttctgatctcaggacaatctagttgccagaaagaattcaagacttaaagaatagcactctaacaaattctgattatctctgctttatccactgagattttcaaactaccttttcattgcccatgcctcccccactattaaaaacagctgtcccaaaattttacagtataagtctctaattgttccctaacaaataatttgaaaatgacagacacatttcaccttcaccctgccaggatttcacaaagttgagaatatgggtttaatttgaaatccatcattacaaaaccatcctcatccggcaataggaaagactcccattataattttctgctgggagtcattagaaaaagccaaagcaatagaagggaaaagggtccgagagcacctctaacttacaaaagtacaacccactttgttcaacaaataaaagcagagcctgctttgttcaactcgtcctctaagaggatatggactagaaaatctttattgctgcagcctcattctataaaataggactgtatttacccatctttctggatggccaagaaataatgatacatcttgtaaatataggttggttacttcaggaagggataggaattaatttcaaatctatcacatagtatcaagctatttcccatgagatttcataccaggccacagcactggaagccataatttccatatttattgaaaacagcatctcagccaaagtggtacattgtgtcctcatagtgaaacctcacccaaggaaatggaattaacttgcactatcatcataagtgtctagggtttttttttttccgaaaactgtaatatttgaccccctaattcagagaaagtttccttaactgcactgagctctagcaaagactgtaatttaagaaactgattcctaacctagtaaactttcttgccagcaaaccaaaaagtttaaatctgtgcagtgcatagtaaaaggtaacagaaccaaacagctggatttttaaaatatccatgtgtctcccagcagcattgcagggtcttcatttatttatggttacgtattttattctccaaggctgtttcacaatctgtttatataaattgtgtgtgttaatgcatgtgtttgagtggtggggggcagtgcacagattcatctaactttagactgtgatgaaataactgatgataaaggatgctatgcatgtgtaatatatctaaatattggattttaaaaccacttttgatggatggcattacatgattaatttttgagacttctggctcagattaaaacttcctacaaatctaaatattttgtttttgttttcctttcttctaggaatattaatacaattttgggaatgacagcacagaattggcatgaatattagtactttcaccacaaaacaaatgtgacatatacaggccgggcgtggtggctcacacctgtaatctcagcactttgggaagccaaggcgggcagatcacctgaggtcaggagttcgagaccagcctggccaacagggcaaaaccctgtctctactaaaaacacaaaaaattagctggccatggtgggcgcctgtaatcccagctactcaggaggctgaggcaggagaattgcttgaacccgggaggcggaggttgcagtgagctgagacggcgccactgcactccaacctgggcggcagagtgagaatccacctcaaaaataaaaaataaaaactgtgacatatacaaaccttttcactaagagaaaaaaattgggaaattaggcaaaattgattaatgagaacaaactgtttattgtacaaaactcttaagaacctagtattttcttaaaaagttttgccctgaagatacattgacggtctaagatcaccagtacctgattcaattcctatttatcaatagacctggattgaaataaaaggcactgatgcagatagcctcagttaggagcaggcacttaattattggagttgacaattatgccctcccataatgcatttttggtgtcactgaagagaccaccagcattcatgactctaagccaacatggtttttatgttttaaaaaacacatacttcacatgtatatgtgattcacttagaatttttttcaatgctattttaacaataaataaaaatcttggccgggcacagtggctcatgcctgtaatccagcagtttgggaggccgaggctggtggatcacttgaggccaggagttcgagattatcctggccaacatggcaaaacgctgtctctactaaaaatatgaacattagccaggcatggtggtgtgtgcctgtagtcccaactcctcagaaggctgaggcatgagaatcacttgaacccaggaggtagatgttgcaatgagctgagatcgcatcactgcactccagcctgggcaacagagcaagactctgtctcaaaactaaaaataaaaatatttacctattgttctcttgatattattatataagaaatacatattctggccaacttacaaaattagtcttacaatattttccctaaattattatggtaaaagtagattatatactccctaacaagggcatctgtttttaatctttgagtagttgaaaccatgtaataagtttatgcctattgaaaaatgtaatctttctaaggaaaaaattaaatttcagggtgttcattatcatctctaattccactgctcctcaattccaggatgcatgcttttttcacatttgaacatttttgaaaacaagatacatcttaaaatagtatctacattaaatgtggctctgttcttttttatcttctaaaatgctgttattgcatccagcaatccatggtgtatcagacatgagaaaatatgctattttctgcatgcctacaactcaccaggttcttctagatgctcggtacacagaaacctataaggagcaggctcacaacaataggccaatgtattttacagcactaaagtagttacttgagtaatatgcaccaatcaactcaaattttgttatataatcctttataactctcattctcaataggaaaagactgtgtcccctccacctccacccacctacacaaagagtacctacccagcatcacctgtctatctctgaataactcactaatactgtgtattaaaactgtaaaatcaaataagcatggctggtgctcactgactgaagaaagtgagatattttaattgttaagatttaaattatttaatatgcctcccaattacttgttttagaacacatacacacatgcacacacacacgcgcacacacacacgtacacacacacgcacgcacacatacacacacacacacacacgtaacctacagcaaaatcaaccttaagtaaaacatagaacaatctttcactatttttcctccagaacattgatcctgccttggaaagagaaagcaaatgatttagtgcatctattactatactacatttttattaactaaaaattgtttcccccacgcctccattaaataaatatacatcaaatatttaagtaatatagatttggaggggcatcaaggtatatctgatcaggaaaccccacataacttggaacagccctcagcaaagctggaacccaaacatcaggctttttggtttccaaacctggctttaggacctcaaaatcctgggttcagagaggtgacccaagaaagcccaaagcaggtaagaaacaagaaccaaatccaggcctctcaattccatgccccagagttttgtccacatttgttaagaacctaatctgaaacagtgctatccctatcttgagatacatacaagagtaaggtatgatcctgcccccaaggcccttgagtctctataaggaattgtgtgatttaaatcaatacaactgaaatcagagacacaaaagtaacagagtaacattaatttttaattttttttttttttttttttttttgagacagagtctcactctgtcgcccaggctggagtgcagtggcgccatcttggctaactgcaagctccgcctcccagtttgacaccattctccttcagcctcccgagtagctgggactacaggcacccgccaccatgtccggctaattttttgtgttttttagtagagatggggtttcaccgtgttagccaggatggtttgcatctcctgacctcgtgatccaactgcctcagcctcccaaagtgctgggattacaggcatgagccaccaagctgggccactttttaaatttttttaaaagaagtctcatgcgtctatcaagatatttcaaaacaaaaggaagttttcagtttgacaaagctataaaatacaaataatcaagatagaaacaacatgatgataatagtcatgttaacatttattgactacttactacgtaacactcactttgtaaggtgcttttcatcatttaatctacaacaagatcattagatattattatcatcctaattttacagaagagaaaacaaaaacactttgaaagttgcttaataacttacccaaatttacatatgctaataatcaattcagcctgcaatttcaaaggtcctgccaccatcctataagtagttctttaaaaagggataataaccctccaacacacaatcacacatacacatatgaacacccaggtccagttttatctgtctctctttatggtctgcttgctttgagtatctcaaaattcagccatatcaagaaagaaagctgggagctggaagctgagaaaaatactacccacactgagttggtcattggtaataaataaattaaccaataaggtgaagaataggaagagtttaaacaagaaagtttccaacatgttatgctttaactaactgtgagttgaagtaattattgggaaaaaaggacagtatttttagaaaagcaattaaatttagctgataggtgtcactgacactaaggtcatttcaacaaaaaggattttcaaagtaacagaagcagaacttagggcagaagcacccaagagatggcttcaacagaatcaaagaccaatttgccccaatgttcaaggagaggaaagtatagacttcatttccctcaagatcccactgggattggattcctttacttaattaactactcatccatgatactatctaaaaaatgctgatcctacagctttgtgtagacaacgtgctatagcctcaactactctatttaatggaatatcaattttcctgcctaatagagctcagaatttgaacttccttcacgtaagctgatattctctttcctcatttatactacagctatgtttgtactgaaaggcatgaaatattaatatttgtgtccatgatcatacagtccaatgtaaggaaaaatacaagtggaaaactaagaggaagaaacagtcatttcactgtctttcaaagtaaaacaattacaattatgtaggaaaaatattacttgtaaaaattaactcaaaacattttttatttataaagaaaaattgttattgatttacatgtttacaactgtcctgtcgcacaaatgtgcaagctcccctactgtatcataaggttcttgagggcaggggttagattcagaaacttcacctcttacattggatgccaaggaccgagggtaggtacatagtgtttgtgttcccccaccgtctacctcctggctgtgaatgaactaagaagacagactaatgatcgtgatcagtttagtcatgacagatccagcacagcaccctggccattcatgacagatgcctatttagtatgagctggacaacagggaagtaacatcagtgttatccagttatctctatgaaccaccaattgaaactagatttgatatatcttcccaattgtttagtttgatttcttcctttggaatagctactattttaaaagtttaggcatatggcaatacttagcaagaagtaaatatttaacccaatctccactaagtaaagcccttaacattttatatataatctgaagacatcctgtatgtatgtgcatgtatatgtatgtatgtgtgtgtgtatatatatatatatacacacacatatatatatacatgcacatacatataaatatccatatatacataaatatatatcaatataagctggcactgtgatatagtgctattttctacatagtagcagcaaatcaagattacataccaagagaaggcatttatcttccatcatgtgttaatgctgaaacacattaactttcctctcctcatctccctacctcttcagtcatgtctacctttacatgcaaaatacagtagctgcttattttaaggagtacataatttcactaaatattattctgctcattgtgctttctcattccattcctatcgcaaagcttttaagttgtttgtcaagtctaaaatctctcctacttttcactggagagattaatttggtaaaaatagaatcccaaactgccattgctcttttagtcatcttaattaattgtaattagttttaaaatattcagttcccgatttcccataaaactgagggcatcacacacacatgtgagttatcattatttcttagtaccagcacttgtgatagaaaggtaaccatccattctttcctgtggtctttcatactttcaaccctgattagtatgtgagtggctggtaaataattaattttatagtgagtgacatattttgaaatctgcaaagtattttattctgggaatttaaggcaacccttgcatttccctagatagctctgtgtacgcctacaattataagttgaagcagattcttgactttcccattagcatctaacaatttatgagcttttgatatccatgggatgatttttaaatgacgactttaattccccaatgcatctagataactagaaaaataatagacaataagtgaatgctttagcgaaggaatttaactaagaatttaaagcttcacccaagctgaaagtaatcaaataaactttataatggtcctgcactgacttcaatattctctttacatttttaaaggaaggtagcagcttcaaataacttatttcatgtggactgcataactatcctattatgtagtaatcattatatacaatttacagataagaaagctgaggctcatctattttagttaaattgcagaattaggaattggcagagttggagttcaatccagatccagctgcctttaaagccatattcacagtactacaccaacccaggcagaacatggatccttgctcttccaacatttacagtacctttcaggtcttataccaagtttaagcctaaaaaacatatctgggttttggttatctcatagattatacgagttacttgggttcaatttgtcactgaccacacactgggtaggcagtgataggtctgtaatattaaccataactaaagataacatattttggaaattaattaatttaaaaatcaaatataaagaaacatgtatcaaataatagttttcccattaagaatttggctaaaaaatcatgatggaaatcaaagaaaaatgtgtgtttttcttagccaaaatatttatttatttatatctttagagaagggtttcactctgtgcccaggctagactagcacggtggcataatcatcgctcatggcagtctctaatacctgaggctcaagtgatcctcccatctcaaactccttctgagtagctagaactacaggtgcatgccacgatgtccagttaattttttttttaagagaggtaagttctcactatattgcccagcacagcctagaattcttggcctcaactgatcctgccaccagagcctaccaaagtgctgggattacaggcatgagccactgtgctcggccacagaagtctttaataagattcaattggcatcatccattgtcaaagtacaaaatgtatactttcatttactactgtaactaaaggtgattaaagagacaaccaatcatatgccctttgcacattctatgtaaacaatctttcattacaatatcaattaatcaccaattcattggaagttctgaactccatggaaattgagtatttaagcaacaagtttggttgaatccctattccaaattatttagtagaactcagtaagtgaaaagaattagaaaatagttcttctcagaattcagattatataaattcacttgtaaaattttacatatttaaaaaacaccttttatggtcattattttagctaattatgcactagtttctattgggtgacaattctctaccctgtggtaccttttgtctcagactactattcaaggatgtctgtaaagcaaacagcctgggaggataaagattatgtcttcctcctccaggacagaggataattttgtttcctggcaagagtcaaagataatgccttcctccagggcaaaggctgggcaagtgtgccagaaacagtttataagactggttatttcctaaactctgtgttcctcagttgtgacacagatccaacaggtatgaagtaaccacctggccccctctgcattgccctcaagggaggttcccctcaagctctacaagatgagagcttgtagcccatgctgcctgctgtgcattgagcagtaacatcctttatgtctgatccaggagtttcgtgtcttctgcgagcatgtatgaatcaggcaggctaacttgttacttcacaggcaggttaaaatctcagactcctcactgctcttgacagctctatatgattgattaaataagtgtttgcagatgttggctaactccaaggtaaatttttactcctccctctaaagcccagaactcacagctgtcacttgtgctcacgcagttagggcaaaactaaggaataccatcttcatacatgaaattcttgggactgcctgacgactctgcagctactgaaatgaaggaagtgaagacaagcgcaggagtcttttccttctggtggccactgttgggttattagaatcgtcatctgtacaccaaagacaagctatccttctcatgcgctgattgattacatgctgtcacaggctaacctgtaaatccctgtcatcaatcaccctctctcacagaggatatgggaagatttcatgtctcaatcatgctctccagtttaccccagggtgacaaaagccagatagagtcttggggcactgaggtgatcatactcactttcccttctcgcctcatcatttagatggatacaacactagatagtaacgggcaacgtttacagagcacgtctcaataatcgttttatccttctcccacactagagatgcagacaagcaaaatttctattttctcttcacagaggctcaatgaattgaagtggcttgatccaggcccagatctggtaaccaaggaagcagaagcttcttaccattccatgttctctctacttcacaaaaccaaggaggccaatagatggtctcagcacccattctggccctctcagaggcgtctttggctactctctaatggaccttgtaaggggcagggaagtgcagtggttagggaacacagtcaagagctagattgcctgagattttaaatcctgtctcattcactcattagccagtcactcctggctcagtcacttaggcaatttatttaacctttgtgtgccttagtgtcatcatgtgtaaaatggggataataatagtgcttctattgtaggattattataaagattgaataaaataaataaactactgtatctgacaccaccattgctaccactacaactgctttgagtcccttttagacacactgatccctttctggttagaagcccaatttctgattgtcaggcttggttaggaattcaggtgaacttccccagggtctccatatccaaccctgcaaaacagcaatctaggctcactctgccatcaggaaccaaattatcaagaagaatgtgacaagttccacaaatatttcttgtggaatgaataaatgacttaggaagactctctgttctgcaatatacattctggaagagaaatgaggctttgggcttgactatccctataccccctttgtgaataaatccatgtgacaggcagaatgatgactaccaccaaacccccaaagatgtccagcgtctatttcctggaacccatgaatatgttaccttatatggcaaaatagattttgcagatgtgattatgattaatggcctggagatgggagattatcctgtattttccaagtaaactcaatctaatcacatcagtccttaaaaacgaagaacctttttcagctgtagagaaccagacagatggcagaatgagaaggtctcgacccaccattgctggctttgaagacagaaaggcatcacaaccaaggaatgtgtgtgacctgtagaaaatggaaaaggcaagagcatggatctcccccaaagtcttcagccatgctgacactttgatttgagcccagtgagaactgtgttggacttccgacctgcagaactgttaagactatacatctgtgttgttcaagccactgggtttgtggtaatttattagggcaacaatagaatctctggattcttccactagggaaagatcataacccagtactgggactattctgtagggttaagcaacaggaaagcatgtatttactcaccaattcattcattgattcatcttttttattcatattgagcacctaccacagcccagacactgttctttgggctacagaaaacaacagtgaaccagagagccatggtcagcttctgcaaccacgcagcttacaactcaaagctgacagatagagattaagcagccaattaataaattagataactgcaaacagtagaaagtgctgtgaagaaaataaaataagatgatgagatagagaacacagagggcagagctggggaaacagaaaccccagatttgggtggatggaaggctaagaaatgacatttgccagctaagcaaaggtccaagagagttcataagccactaactcgtggctgacctagccttcttatggatgctgtaagaggtgaaatacctgtttttgagaaattgatatgacttctcactccaaggaaaagtgtgctgtgtgaattgctactctaattttcctgtctccactcttcacaagcatgacttttaaggctttatttttaccatattttatgaacagtgtaaaggcagcattatcccagagtccctgcatatcattttcagtgagagtactcagcgttctccttatctgaatatggatgtggttagactccctgtgacggctacattgctgttactgtgatagatttccctgtgctggctgcaacctgtatcagcgacactggctctgaaaccaaatgcattgctcagggttagacccagacacagtgctagagcctacgcagaccacagctgtctctactgcacatttagttatgacaaaaatgtcaaagcgtgaaggtggcaaataaagtgtcatatcatgtaggaatgatggtctctgatatccaaatcatacacacacaaaacaggccactcaattcatttattgtaatgtcttgctctaatatctatgggaaaatagtacaaacaacttcaatttttattcaggttgtcatagtgtcaataattacatctcataattacccctttcataggttgtctataaaagtaaaactagaacatccaagtaatctgtctcaacccagagttcccagacacacgcaaacaatgcagggcaacgcaaattaccttcacaccctggttagtttgttctacagatgccttactgtgtgagaaggggctaagctgaggcataaaatgaatccaattctgaagctactctaaccatttctagtgttgtatatgttaatataatgaacttacaaataaacaatatctagtaagatggcttttgtgttgggggtgagaggtgcagagttcacactttgataattcactgattccaagaatggtgctcaggttttagagccagagtatctagatttgatttccaacttcatcatataataactctatgaccttgaagaagacatttccctgacatagcatcaatccattttttctctatgaattgaggtcaaaagtagcacacacactgcctggttcagagggttctcacaaaatgagaaagactttgtaaactatagaacacaagtgcaaaccaaaagtcccttggcctcctagcgctacagatatgttgtatttaaggcaacagcctaagtcccaatcctctgagctccaagcatggactaacaagtctgagcttttcctgggatcccctcctcagttactccctccaggattccctgacagtcagacttatggcctgctacctgacaaccctcctctcctactctcttgaacttttcctctgctccacatgccttcatcactctgccatccaccagtcaccatcaacacctctgacaacgttctcacggaagacaacttcttctacagcacaaagaatggggtgaagagggaagggaaggaacctcaaggcctcaccatcagggaagccatttccactcttgagccttgctttttcaaaacagggctgccaaagtaacaccgttaggtatcactgaccagttcttggcaggggctggcaaattttaccaataaagggccagatagtaaatattttagcttttgaagaccacatctgtctctgtagcatattcttctttgcttttttttctttttatgaccctttaaaaatgcataaacaatccagcaggccacaggctggattttcctcaagggccatagttcactgatccctgcgttatgacacagctatcgttcatgccatagtatacttgttttttgtgtgagcaggagtctgttgccagtagggggaattgaggggaggctcattaggtcaggggaggtacctagaaccactgcccctgggactttcaaacccaggagcttggccgcgcatggtggcctcactcctgtaatcccagcactttgggaggccaaggcgggtggatcatctgaggtcaggagttcgagaccatcctgggcaacatggtgaaacccgtctctactaaaaacacaaaaatcaaccaggcacggtggtgggcacctgtaattccagttaattgggaggctgaggcaggagaattgcttgaacgtgggaggcagaggttgcagtgagctgagatcacaccactgtactccagcctgggcgacaagcgcaagactccgtctcaaaagcaaaacaaaaccaaactcctataggtcggtctggtccacgttaacagacttcttcactcatggcttttgttcaggaacctcatcacgtccctcaatccaaccttttttggggaatcctaagctataagagagatcagtgcacgtctgaatgccaaaaatgagtcaagctccagttcttacactcagagcccctaagctctatgtaaatctagcatgtggcttccgtgtttctatgacagttagaaggctgctccacccacagcacatgggacctctgtggttagagtttccaatgatacaatcaagcctaggaaaaatgcatctcagccagtcagaatatgttatacatttattagctactatgattattatctaaaaaggaagaagaggaggaagaagaggaagaaaaaggaagagggggagggaaggaggagaagaggaacagggatgaagagggaagggaaggagaagaaactactgcagaaaattttgccaggatgcaataatggttacaaaattaaattatccttacctagtactttctccttgtgataaaagacttcactttgaggccgggcatgttggctcttgcctgtaatcccagcactttgggaggccaaggcaggcagatcacttgaggtcaggagttcaagatcagcctggccgacatggaaaaaccctgtctctactgaaaaatacaaaaattagctgagtgtggtggcaggaacctgtaatcccagctactcaggaggctatggcaggagaatcgcttggacccaggatgcggaggttgcagtgagctgagagcacaccacgacactccagcctgggcgacatagcgagactctgtctaaaaaaaaaaatcacacctataatcccagcactttgggaggccacggtgggcagatctcttgagaggtcaggagatcgagaccagcctgaccaacatagtaaaaccccatctctactaaaaatacaaaaattagccgggggtagtggcacatgcctgtaatcccagttacctgggaggctgaggcaggagaatcacttgaacccaggagtcggaggttgcggtgagatgagatcgtgccatcgcagcctgggcaacaagagtgaaacttcgtctcaaaaaaaaaaaaaaaaaaaaaaaacttcactttgaatctttttgattgttatatctattctgtaagtgaaggcctctataagcctataaagtacccagctgcaaattagtatataatgcctacttggcccaaaagtgaatcagaaaatgatgcctcttcaggtctataccttagcaccatttgactatctacaggtcacttttttggagggaacaggagtcaggggtggaggggtggaagtcaccggttaatcctggcagatccagccatctccaaggacataaatgaagagcagaaccaagatggattctcatccctacttgagcccttgaccaggcttcacaataacacagaggccctaacttaagttttgagtcaatgtccacaggcccattttctgtagctacttgtagtatgctaacatgctggcacagaagttagtgataatatttactgtcatggtggtggtgatggtgccaccaataaaacttgtcagctgagggcccttgctctggaccacttaaagagggctgatttttcacaagacgaaataacttagaaacatagaggataaagtggtccatagggttagtaaggtggaggagggtgactaagtcatgaaagatgtacagcacagacagaagagtttttaaaatgattccaaatagtgtgtgagagcagactactgaagttgaggatggatgtttgcaccctgcagagaatgctgcactctagagtttcacagtgcaagatgacctgactttcatagtgggcaggaaggtctgggaggccttgctttggactcaggaagaagtaagcaagctgagtagccggaatgccggtgatgagcattcattggtccaaaggagaaagacaaaaccaggaggtggcctggagatttccaagggagagaaaattcaaagctgcctgggagatgcatggcagaaccctaaacagattgtaaaggggaggagaaaaggtcatggcaaagtcaaggatgactggagctccctgcctggggaaaggatggatggctgtgttttagttgccaaggcaacaagcctcaatggcaggcagagaggctacagagtccctctctgggagtatcctgccctcagttgcgcagcacaggcaggtcttcttccacctggaagtacaatatgctgctctgctactggaggtgtgtttatcactgaaaagactcacccccaagtatactggactgcagtaggctgcaatcatgctacagaaacatgtatttctcagcattgttaatggaaacaaacatctgcaacacctaattgaaacccattcataggaaagatacataaaaacattctaacctttagcattatgcacaactttttaaatccagagaatgttacagcagagatctaccttcctggttgagagtgtactacatattttcctttggaaactaaagatactacaaacaaacttgaaaacatatatttcttcaaagtattaatttttaaagcggccaaaattgctaacaaccagggaaagtaccaatttataatttatgttcttggcacatagtatatattgtgaatttgcatgcatattacatgcaaataaccaaaagagcataacattaaggcttcaaatttgtatgtgcaaaagacagtaaattctaacattaaaattctttccagaaaatattaactccccatatcccctgtgactgtcacatagtcagctgagcaaactcactacagaacttgagtagtcaataaccttgttcaatgaaaatttgcatttcccatacctactcttcttagcaagcaaagaagacaagaccatttggcaccatgtgggacagggataaggtgctaacatggcccagcttttcaaacaaattatctaacaatttgacagaaaaaaaaagtgccagtaaaaatgccaccattgaaccactaacagaatctttactcccttataaagattacaacactggggaaatgaagcaaaatgcagctgactctgctctttccactatagtaaaaatatgagatttgtgatggcaaaatcatctgagtcaacctggctgggctagagtgctcagttcttaagtccaacactagtttagatgttactgtaaaagtatttgatagatgggattaacatctataatcagttgactttagctacaggaggttacccttgatcatgtggatgggcctcatctaatcaggtgaaggccttaagagcaaaaactgagtttccaagagaaggagctctccctcaagactgtaacatagacatcctgcctaagtttctagcctgctaacttgccctacgtatttcatactcaaggctataacatcaactcttgcctgagttttcagactgctgccctgccctgtgatttttggacttaccagcaccgcatttgcattagccaattccttaaaataaatctcttcataaatacatatttatgtatctaatgtatagatagacagattctgtctagtgaacactgatacaggattcaaagggattttcagtgtagaactaaaaaagtgctcagtattataatgcattctggtggatgggtaagtgctggttgatcttgattgcaatgtaaaaattaatgtattctttgtttaaataatgctactgctttgcagtgcagaatttactggaagatttccttcttgatatccatttaaagaatttccatagtcaaccctaagacaaataagggtgaattttatttgtaaaagaaaaggggctcatgataatctttctggtggctgagcccagaaggttttggggctcagcttgctgcatttatattctgaattctctgtggttcctaagtcttgagagatggaactatcccttcatttatgtatagtctgaaaacactaatcagactgtttaccccaatgaagcaagtatccacttaaatttagatcaaacaattccatgagtttaatgccactccaaccactctgtttctttttgttccttggccttttcatgaagtatctcacagtatttgctgccacacctctgctcctccctttcttcactctgtgacacagaatgctcatccatacactcagaccccactgctgtgttcactgatgatccccagacctatgcctccttccttgacctctaattcctaccgcgctccttatttattggtgtctggatgatcttctgggaatgggtggggcaaggactacagtcatagcacatccaaaagagaaatgattggtttagcaaagttctatgtttcgcaaactgttccatgtccaccattccatgatttttaagctgggaagagaaccgacctgttccacaaggcatttggacatttgctggataatcttctggtcactttgctttttgttttttttggactgttaaatatggaagttgttctccaaggcagcaatccagccttgacttacactgtctataacttacctttatcttctgtcttctctatcagtcctgtcatcaagtcaaattccttctccttctcactcttctgcagtcattcttagcatgcaccaactgtcttcctcctgtctgagctattttataacacagcaacaatcatctacccgaatgtcatgttgatcatgtcacttgttgccaaatgttccaaatgtttcttcttgaattaaatttcaaccccagttctacaagtccacagctgactcctttgattctcctcttcctggctgtggtctgcaacctgccccaccgctccccacactcccttgctctccaaggctcactgtaccctctctgttctccagatagcaggacaaactctttgctctcattacctctcctcttaatatgttcccgttctggaaaagttcaagagctggtgggtttccttgattccaccttccaaataactagttcaccatggttttccaccattcctgattcggggatcttaaggtttgggttcatatccagaatatcctggggcaaaacggtagtaacaatgtgagtaatcactgtcttgacctcatccaaaagacccctatttttgccttttctcataatgatgtctcaagtaagaaacctctcaaaaatttaaatttcttcttggcaaattagacatataaacttatccagcaagttttattatgcatgtgtatcagaatacatttcccattgtgatttatgcccatgttacatatagttatggatatatttttagaaaattgttttttaaatatttaatagccattaaaagggtaaaataattctctgctccttatggaacagttagatgccattctagtacttttgcaagtatttgcaattgtaatcagtaatgcaggcagaaagaatgccagtgtttttcaatcatcactggcaaaaatgtaaattttttaaaattaagactttaaagatcacctgcattaatcttctgctaatgcaagctgggactatttcctaggattctgagtggtttaacatcatcaagacatgtcacaggcttcatccaaattattcaattcctaccatacattacgctgagcctctcagaagatgaatcgggaagaggcaacctaagtgtttagagaacaaaagggaaaatgaagcacagagacctctggctaaaagtataaacctttgagagggttttaaggacatactataggactaaaaaatgagaacaaatcagcaggcccattagctgtgcagcaaattaaagcaccattgtttccagtttcagccttgaatctggagggcaccaaatagaccacgctgtcagtaccctctgtgaaagaagtgtgttctctgctatgtattctcaagcgcctttctattttttttcagctaatttatcagtttcccacctcttctcctaaatcattattataaacttccccaggaacatgttaaagggacaacaggaaaataatcaaagtttcaaaacacaatctatatttatcatgaatttcaacttatctttttccttgtattaaaaaatgaagcttgctatcttcagatttatattccttttatcttaatccttggggtaaaatatggcatgtggataatccacaaactaaatagcctctgcatttaagaagtagaccatagtccacagttgtatagtccacattttgtcatctcatctcataaaaacaaagttgaaagcggctctgtccaatcttttgagagggcaaaaggtctggaagatccaataagactacacaagagatttttaaacattagtatgtatttaaaccaatttattcataatatagtctcaactgttacataggactaggcccagagataactgctttcaattctttaagtaattattttagatttgtttccacatgtggaaatcagtaggtgttggctcactattgtgcaaagaattgattccaggtatgcaatgaggtatggatgtctctcagcctcagggaatcaggtggggttctgaggtagcaggtgcctctgggcagataacacctggccatcagcttcctcaaggtataaaggcatggtcctcatggctctgctgagaggcactagaaacatccatggacacccatgtcaacaggctgctgcagaaagcaccccttcactttgtgcagaagcagtccatgtagctgctggaggaggtttcattccaggtatagaaggcacagctggttgaaagtggagctctagaaaggtgtgggcagaagcgcctggtaggcaaagctacaagggacagccccaaaaattctgtctatacataccagacatttctttccagttgagtcaaatatcgtcttttactggcatccaggctacctatggagtgactgctctaacaataaacacacagtttataaattcgggcctcattattattttaattacttgataggaaaaaaattagttgaatttgaaatctgttggaattatcagaggattgcatttgtctagcaaagaaaaaagctaaaactattaatgtttttaaagataactttaacttttatagaatatgaaacggtggtgaaatggcttgtttttttaaaaatcactacttgtgtagtatctcactgacaatgactaaaaagaatttgaagagagaatcattaagatattgatcaagaattgtgttcagccatttcaggcatataagaaatataaaaagttatgtttatgaaagcaagctcaggtttttcattgaaaaaatctgaaaatatgttatttgaagttttatatctacttaatattctacaaatgaatgtctccagcttcctacattatttagtatcagtttctatgcttgtcatactaaagacaaaaatttatatgcactgatttaaataacatgtttctcttactacttcttagttttttgatttcaggtattattgattgacctcccaatgaggaagatgagggttaggttttttatcacacacacgcatgcctcatgttcccatcctctcagaataattctggttgtgttaaatatccatatttacatccttagaatcatgtagtgttctatgattatatctcattttctgcctttttgtcttccttggaattaatcattgttatatttaatttgcgttagtttcctatgtacttatcatgatgctatccccaaagcctccccaagatctgtaaatctcctctcagagcaaacacattaggtgtttaatcaattttaccatcttgaagaactctctcctgaatccctctacctactgcaatttagatcagttgatcactagtccagtgcacagctgttgagatctcttttaccatcacctgtgaattcttttcgcctcgctcttgtgttggtcctatctctgggataccaggtctttctttttattagtttaccatatcatttattggaccacattctagtgttgtaaagtttcatgatcatctgttgttattcccttttaatcaggaaacttctgtttttgagaaattttggtgaattattcctttgatggttttctgtcctccattttttatgttctctgaatctggtgtactatttttggatgtaagaaccaatcctctaagcttcttattttttctacgttattttctattctttctctttttactacactttcttgaaaatttccttaatttcacctcctaacccttataaattctgttgtgtttcatggttataatatcatgccttatctgtctggagatactgatgatttcttttttcagatttattcttctggccgggcactgtggctcacacctataatcccagcattttggggggcagaggcaggtggatcatttgaggcaaggagttcaagaccagcctggccaacatggtgaaaccccatctccactaaaaatataaaaattagccaggtggtagtggcacgcgcctgtaatcccagctactagggaggctgaggtgggagaatcgcttgagcctgggaggcagaggttgtggtgagccgagatcacgccactgtactccagcctggacgacagagtgaaaccctgtgtaaaaaaaaaaaaaattttcttcttcctattaaggttgtttcctccaagttgctttttttgtttgcatgctttagtttttttctctcatgatattagacatttccttaaatgtctcacgatccttggctgtctgagatatttaagggccgagcactagaaggtccacagaaaggttgggagtgtggttgttgatataggatttattttagaattgttctggctaggcccttccttgagggaatccctgatatcagtatccttgagttctatttttaggttagagtcccagggatgtttcctggagtttcctgcaggaaaggtatccttagctgcctgtaggctaaggagcagagaacagaaggtattgtcattcttgggatttggtaaatcagtgtaatccacaatctaccacatttcaggaccatattataccacttttaacctttcctgatacttctcaatccagaaaccttctgttttaccaactctatagaaaacataatcttcatccctctgttggagtggaggagcagtttccttcttgtataaagttaggaagcagatctgaactttcaaccaatacttctcaactgtatctccactctcccttccaggggttcttgttcctgagtttttgcagtgttcatcagtataatttggcttacctttttcctttctcctctgctagattaaaatttcactttctcaggtctgctaagtaagttagcagtcatccatctatatcccaaatcccaaagtgctgtaactgttgccctatttctttgctctcatcggtgtgtgccttttaaaataaaaatcccttaaacatcattttaatgaagtttcaagaagggtcaggaactaacacatgtatttatccttaatctgaaaatgatcagtcagtctttatccttttgcattgacattgaaatggggattactcttttttgttccctcaaaaacattaagccaaggcccaacattcaagaggaacaggaaatagagaaaatagcaatttttggatttagatgaaactaaatttaataatcgcatgctcttataaactagtatatcattgccctaacgatatattggacattgtgggaaataaaaatatgtctctatttcaaaacagtctctaaaacttctgaaaaagatgaacaattaaagaggtccttaaattgataattaacctaaaagagagtattcagagagaaaaatcaccaggcaaggaagaatggtaaaaggcaaactcactggagcaaaaaggaccttaaactccattttgaaaaataagtgttacagacatttcttctgcagagtttgcataatgtgtattaggtataaagtgatcaattgattggggaatacaatttattttatgcagactagggctcctggcataagggaaaaaaaagctcttctgcttacaacacagctgttttaaggtctttattctccatttctcacaatagtggatcattaagatgttgaaacaattttttaaaataccagcttagttcactaccatcttataaaaagagatacaataaaatgcattttttcgtgatgttcaggttttaaagttatacttttacagagatagaaaataccattattacttaaataacttcaggtaaaacaactttgtttattgtgcccctgcaactctcaagtctccaacactatttatgccactgaaataattgtctttatagcacaggttttgataatgtgcagttttaaggactatattgcctggagcagaactgactttaattggatggatatagatatgagaggatttgatgcagaatactgtgcgcgttgcaaaatgggatgacagaatgaagagacgaatctgtcttccccatagggtctgggtaggaggccggtggaagttaagtatagacgggtgtctggacaagtctgaacacagatgctttcaaacccaagtagtagggaatgaactctaaagtacaatgagcccacaattttgtagacaacaaagagacattgatgttttctgaataaagagtaatgttgttaaaatgatatttcaaaaaatgtaatctgccaatactgtatagggcaggaagtctggtcacagaaaacagttaagacactaaataatacagagatccaaagtcatgtgaagctggcctggattccttggcagtaaaaatgtgagagaactcacttcagagcaagaatcaataaaaatgagggatctacatttacagtactatagatacaggcagcccagtaaaagaaacgggactgaattaggactgataaaaggacttacagtgaagtagtttttaaactaaatctgtgatatcatttggttttcaattcaagaaacatttaccgagtatctactatatgcaaggcatgcagtcttttctcatcatttgtctcattatcttagaagccaaatgtaaaaaaatccagttaattaatttcacagactgattgatgttcttctgcaagaacaacagattgatttttttttatagacagcaatactaattcttccatcatgtccttctctttctgtgcacatagtcctatcgactttggggccaactcaatacaaaagcagaagaaaggcattaagagaacaaggtccattaggcccgatattgcctcaattactttaattccattattcctgttcatattacttctttaatcaataactcttttcagtttttcatgtttacccttttcaaaatcacaagtaataggattacggtcttttgagctcagtggcaacagagtttcataaatatatttctgaatttgtgattgtctccagatctgcaactgagaagtcttaaattgaatcaagttttccagaggccattttatttaataatgcagagcatctccatgcaatataggtgcttttccctgttattccatttgtcactcactgtcaaagacaatcacacatgctgaatggctttctaagtatcttcttcccatgtctaaacctttgggcagtttaactgattttcaaactgcatctcttttctgtacatatttctgacttttgtttaatgtaatccttctaccttcactgacaattattcttccctctaagagtttcatctggacattatgttaactactaccccttccagatgacaattaatcaatccctcagttctacctctgtagcagcctttcaaattaaaggaactctgttttcctctaccgttttaacaaacatccatgcaatgtctactattaataaatgcaagaagctgcacttccagcataaataggatacaagataggtatatggcccttcccttcaacatgtggatagtctaagaatgttataaaaataacttgtgatatatgagaagcatgcgaaaattgcaatatgcagcatctattcaaagttctggaattcacaagggataaaatcattcatgagtagagaaaagttttcataaaggatatgaatttcagtgaggtcttaaaggagggaaggattttgaaaatggaatctaagagagcaaagtaaccaattctgtgtgaaaagcaaagcaggcaaatctagtagagtaaatgattcaatggagtaaattaaagagagcttgacttccctttggaagcagtgagaccaggacaagggtgaagcagtgagaccaggacaaaggtcataaaggaagagtttggcaggatataagcactctttcacacagccattctccctgcaaggagcaggatgaactgaagacatacaaaagaagcttcaacaatgtgtcaaaggaccttcaagatttgatttctgccttcctatagagtctcatccagccctatatccctcttcacactttatgctccagcagtacctaaacagcatggaatacagaaacatgccctgccccctcataccactctgctaatctcccctctgtttcatttagaatgttctctctctaccactcatctcctaccaatttccattcaaatacaatcttctctataaagtatttcctaattgtcccaagccagtttagttgctctgtttcctatataaaaggtatacttagttttatagctccatcatagtcatgcaaaaatcattgctttctcccacataaattataatatacttgatactatgcccagaacaatttttggcacacgtccaaagggtactacatgaatgaatgaatgaacaaacgaatgaacaaacaaaacagagtggtcatatgaacaagcaagaaaaaggtaagaaatgcttggaaaggataatcgtagatttaaaaaaaggaaagtaaaaatatgaaagaattacagaaatttgacagagtttagtggtaactaaatgtagatgaaagagaattccaagcttctgagttccctgccaaaagccactgctcttcttcctcatttttatattaccagctcataagcacttaacataaactcatgatttaaatgaagcaaagatggacccatcagagggagaggcagaagatcctacagaaagcagacattaagattcctattttaactgatttgtgtacaaaaattttctgaaaaatgttgatagaattttgaagtataatttgtttaattaatatactttccataatataataattacattctaatgtcagagatctaagaaaaacttaccatgttaattattaactaaaaagacataagaatcatttttctcatttgcctttttttaaaatcagagtttaacaagttagcaaattattatcaagtccatgagaatcttatagctgagttttcagaaatgtgaaattagagaatgcaaaatggagtaaagacaaagcaacaacaataaaacttgttttccatgttcaaggcacctgaggttttatttctgggttattttctccttaataatagagaagtgttagatacacataagttaattattaaaataagacttattgggatgttataattgttgtagcacacactgtagagtacttcactggctattttgggacagctgaattactagaatataattgctcaccaggccctacctgcagccagcaagggctggcccaccatcactctgtttgatcactgtataaccaaaacaaattaactgtttcaattttaatgaaacctatagacatgcccacaagccacactaggagagttcatgtgaaaagttatgggagacctctaatcaagggtagtaagctcttgcataaaatggaaaagaaaagtaagcaatggagacacaggatgaagttatacatctatatttggtatttggtggaactctgcctgcatgcatcacacatgccataaatatttgctgtttgatttaccaattttcttaggactaatgtcagaaaaatgctaaaatgaatttctactttcattttcattttctactgcctgtcatcatcttataaatccactgctgtctaagccaatgctatcagttggccataggacagcctgcagccccacccccaggaacacaaaatctcctgcggggctggaaaagcttgtaagtaaatgattccaccttcctggaggcctgggcctgacccacacagtcaatctctagacactggtctgcctgcttacagcagctccacacagcactaatccaggggcttaagtgaatttgcagggctcctaaagatgcctacctcactcctaggaggagatctgaccctggactttcactcttctcagcaggaggctcccttttgctattaaaaaggtaatcctttcctggaagtaacagtagacatggctagaaagcactaccccaagaggaaataaagggtttcccaaataagcaactctaaagaacagatcatttaagtgctaccttgagaccagtatcctaataatttatcaacacccaaatctgaacactcaaaagataacttgtaataatgttgagttaaggatgcataaagaaggaagaagacgcgattagggcagatctatttcaggatagcatttagagattaaagccagagaagagaatgttaaatttaataagtgcaaagagatgcagctggaaagaaagaatagcctggctaagtatgatttaaacggtattgaattagctggaaagatatcttgatatactgatagaggcggcatgtaaattggcagttcaacctgcgatgccaacacagacagcagtaccggctcacacaaagggctatattttataaaaaccccatctgctactaattttaaaggaaaactcttatctcatttatgaggttgtttagcctggactaaactgaaggcaagagctccctgaggacaaatgccagcgtaatacctgcccacctctggtcactgcactttgctttgtcaaattaaatttggccatggcctttatagtccttgccattcgctaattcaacaaatattaagcagcaggcaccatactagatgctttagggttatctagaggaattcacttcaggcatgccttgaatatattacaggctcggttccacacaaactttttggtttgccagtgcgtataaagttatgtttacactatactatactctattaattgtgcaatagcattatatctaaaaatgaacacaccttaatttagaaatcctttattgctaaaacaatgttgatacaggaacacagtgtaagcatgtgctgttggaaaaatgatgctgatagacttgctggatgcagggttgccacaaaccttcaatttgtaaaaaaacatagtatctgcaaagctcaataaaaccaagtgaaataaattgaggtatgcctgtacccctatagtgctattggctgaattgtgtaccccaaaaagatgctgcaatccaaatctctcatacatatgaatgtgacatttttagaaatagagtccttgcagatgatcgagttaagataaggtcattagggtgaaccctaatccaatatgactggtgtccttacaaaaaggaaacctggacatagacacagacacacatgtagggaagacagtgtaaagacacagggagaatgccatctataagtcaaggaatgcctgaggctgccagaaggtagaagaaaggcctgcgacagattctccctcacggcctagaaggaagcaaccctgctgacacctggactttggacttctagaatccagaactgtgaaacaataaatttctattgtataaaccagccagtttgtggtgctttgttaaggcagtcagatgagactaatacagactgggtcacaaaataagcaagtccaataacaaaattaccatggtcatcagaactcctaatgtgggtctatctatggaagctttggctcagttaatgggtccaggtttggtcactggatgatatagatcactgtcatccacgtcagttctataaagggcatcaaagaaaaagatagctcatatcctaaggagagactaacccaatggggactgtttaatcctctaagaaggtgattagaaagaaacagaagcaataaaggttaatggaaaattaatctcaagtgacctgtttgggcaaatcaaagttgtgagacatgtacttatttctaaagaaaatgcaaaggaaatttagaaggataactttagataaggggacagagataagactttaattagaagtcttcaatattcatgtatttacataagtgttgaaaagataaaggcttcatgataaggtgataaagatgaacaatggtagtacctttatgaaaactctatagaagttggaaagagatttcaagtgaccagtcctatttccttgctggctgtttacagaggccctgtcacaggtactttgtaaatgctccccaaatgcatgttagttcagagatcttctgccacaggccctctgaaccccagatataactaagacacacattagagaatgatgccagaggtataattaaactacatcccttcccatatggtgacaaccaacctgcttgttatttgtggtgcacataccatccctttacctgagcatggtgagctctctctcctccacatattataaatacgacatcatgctggcagcaaaggacctgtaaaataaaggccatcttgttagaaaaaacttcaaacatcaatttcagagagctgactgaacatatatatgtaagcagatgcaaggtttcgcctgcaaagttcgagctgaacatagccctttccatttctggccactgcaattgaatgcccttggagaaggtctccgcatggtgctaacttggtaacaatcaataaatgtgaaggtctcatcataaacaaagcctccgaactgtcaatctttcaaagagtatttctgctttaaaagtagtctttgttgctaaagtagctacactaaagccagtgctagggccagggcctcccaaatctaagaaagcctaaataaataaagctgtgtgttaattaatggcagtacaatctaaaaatgtcattcagaagcagttttaggggttgactggtatcagacgtactgtttttaagtatgagaaattcttgcaagtttccaaattgaaataagagttacacacttataagctttctctcaggaaatttgttgttctgcaaactataaagtgcacctagatattttcataggataaatcccaactttattttctagaaagtattttaaagccttgttactcagagtgtggtccacaggcagcaaaatcagcctcaccagtgagcttgaagtgctgaatctgagaacccacctgagacctactgcaacagaatctgcattttaacaagatcctcagataatccctttgcacattaaagtctgagaagcatggttttaaagtgccttatacatcaggcctgtgagtgctagaatcataagaaataggttgccccgaacttcaagaccatcctctggtatctaaaacttaatggaatcacaattcctctattataattgcacgaatctggaaacaaatattctactaaactctccagaaacaccttacatctggctaaatctcttttctttccagaacatgtagactaattgtaaacagataactaaaagcatagccaaatttggaagtattttacactctaaagaccagcatctgtagacattgaagatagacattatttgttccataactaggtgctcagtaataactaatactgtgtaaagagccccaaagtggaaggataaaaattaccacatggcatgatagatctaatagggaaaggtcagcacaagaagccaggggcaggggaaggtactggtacacacttagaaagtacctgacccaggtgggaaacactgggaaggcttcctgagctgagtattgaaaaaggatgaggaaagatcttttaagaagcagtccgcctacaggtatagtgaatgagggcaggtcactagaccagcaaggagccaactaccttatttcaaaaaaatatccaaatgtgattttatcaagttttttcagcttctttaatatttgtatgcatgagctataaatgtgacagcccttaggaacacgtctcttccctttcaactatcctacaagacaaggaggaatggcaaacatcaaacacaagatgcactactcagaagtcggctgcaaactgcaagggggcaggaatagcagaactgtacctccacatttgctatttgatcacacagagtgtcaatgaaactgcaaccagcaatacggggaccataaagagaatcacattaaagttaatacaaaagtcaggaaaatgtcttcagcaagggacactggctatttggcagatgccctgctgggagtaattgaaggctctcagtgtgaccaaagtatgcactcccctctctgagcccttctcttcctcctgaatttaaacagttcttatcccatctccttccccctcacttattcttgtgatttctctgactcattttccttctccctcactacctccaagtgccctcctatctctaattcaactcccttcttttccctttcaatctgcccattttttcaccccttccttttgtgagaagaaggagctaaggcccttccttttgtgagaagaaggagctaagggagagaaggaaggacaaccaaacatctttttttcccttttttctttgctcctttcccttttcttcactaacgtccccacatttttatttccctcttctatcctctcttttctttcctggaatcaaatccctgttatcagtacataacctgtcttcccaagcatagagcttagaaatgataggaaaattgctcgactcctagactgttccgttgtaattcttgggagttctcggattctcctaacccactgccaggtcaatgattgagagaggaaagaaaaactttcaaaacctagcattttcttagcatttcctaaaatgtagaacaattctggagtacttggctgttgtactgaaaggggataaagatgtaaaacatactagaccaaaggtttcattctacccctggttctccctaagtgtatttcctccaacccaccatgaaaccaactcttctgttactcttattcctctttctgcatatcccccaaaccctcctggaatgactgaaacacgcttcattaccagtaagagccagataaatgacaaggcaggaattaacagagtgcttctttacaacgacacagagtagcacacaaagagcctcatttaatgccccattaggaagccttacaagttacagcttaataaatatatgaagattatcgtaatatagaaaacatctggtaccacttcccacatgaaatgcacttatggagaactctacagagtaggctgtgatatggcaatcttgcatatagtctttgaactgcagaaaagcaatttggcttcctttaggtatttcactctttattttcaacatatgaactatgaacgaaactttgtaggcaaatctgatttcccaatctttttattccagcccctagataccatatatgcccctgaaatagagtacatattcccaaaatatttgctgaatgaatgagttaactagtcaaacaatcactggccaatcaacataagccttaagacacaactgaattaagtatttgaaggaaaatagggctgggagcggtggctcatgcctgtaatcccagcactttgggaggctgaggcaggtggatcacttgaggtcaggagttcgagaccaacctagccaacatgatgaaaccccacttccactaaaaatacaaaaattagctggcatgcctgtaatcccagctactcaggaggctgaggcaggagaattgcttgagcccaggaagtggaggttgcagtgagccaagatcgcgacactgcactccagcctgggcaacagagtgagagtctatctcaaacaacaaaacaacaacaacaacaacaacaacaacaacaaaacaccagtatttgaaggaaaatatcacacaataatgcattttgaaaatttcccctagatttttggtattgacatctgatatgatctggctctgtgtccctacccaaatctcatctcaaattgtaatccccacatgttgagggagggaagtgactggattaagggggtggtttcccccatactcttctagtgatagtaagatctcatgagatctgatggttttataaggcagttttccctgctcttgcatgctctctctctcgcctgctgccatgtaagatatgtctgcttccccttccaccatgattctaagtttcctaaggcttccccagccatgcagaactgtcagtcaattaaacctcctttgtttataaattagccagtctcagttagtatctttatagcagtgtgagaacggactaacacatcatctaatcataaggtcaatatagggtgttggatgtaactcaactctcagaactagaatgaaaagaggtgctgctttgggcagagaccctgagcagtcagatgtgtcaacattctaacagcaaatgaataaatggaaaactctagaaagcaaacaaaagttctcaaaaactacagcagcctagaataaattagtcaatccctctatttgttcccatgatactctctacacataccccattattactgaaggtctcattacaccattacatttcttcaaaggtttctgactcaccctgggaagtgacgacctgatcacagcccactacgatttccgaggcaagccaaaaagaaacccctagaatagatctgctctacagatcaggaaagggactggaatcctattttgtggaaggggaagaggagacatgacaagttgagctgtgtctggatagagctcaaggatccctatctctctggattcacctctgaattcagggactaggctagcagttccccaagagcgagatagcaagtcactccatttcaatcaaccaagagtttagtggaaaagccagtagtggaaatttgttgtaacttgctctaaatgtcttaataatttaaaaaatatgttttattaaatatcatcaatagtgttccagatattggaatctactttgtattcaaaaactatgagaggtgctttttaccattcataccattgacatcattggactgagatcatcaccccttcagaaaagaactctttagaaacctacccaatctatcatagagagagcgagcttcctgttaaccttcaactccattgccccctcagacttgagccagttttaacaaacgccctgcacttacatctgaaaaggagttgaccctttgaaggaaaaaaatgtagacacttctaggatatatgtattttagtgtaactctaacccaaagtaaagtattttgtaaaaactttagttaagtacttactaaagtaaatttactaaagtaaagtaaagccttggtaaatctctcctactttattaccgttagataatattccctttaaccaatcctatttctccacaactatccactttttcatcacctagcataaaaataaacaagtttaaccatttcttcaggtctttatgtccatacgaaggcttctttgtcatgtacaatttatatgaaataaatttgtatgcttttctctttttaatgtcttctttaagaggggcatcagccacgaacttaggttgaatgaggaaaagatattttctccttctacaccattttaaagcaatccctagatactgctcatattatatctgcatatcgtgagacctagatttgttaccattcaacaaacaggggttctaataataaggaattagagaaaaggtaaaatgttctaaccttttcctcttaagtttcactttgagatctccaatataaatttcctaattatataaaaaccaccgctctatgatttcagtgctataagtctgatttcatccttatttccagaaagaaaaaaatagttgcatttgccatctgaattcactacctacagttctacagctatgtttttgtactggggcattgaaggacagcaaaaagtagggacaaaaaagtctcttacctcccaaagccatctgagtgccctctcaccctgcaaatcacatgccataccttttctagatcaattctttgtttagtttcaccagtacatcagcatcttcaatttcttctattcccatctcaataagcaatggcttacagaaaagataaacctatttttttaaaaaaagcaggtttttaaaaacctgcttccttccataaaatttgtttgcatgtgtgtatatatatatatatatacatgttcgattctcatatgatttccaaattagaactcaagttcaaatgatcaaatcatgcttacaaaacaagatctataaaattaaaacagattgatggaggaccccttaccaccacttctaccatatccctgacacatacgactcacccagaggatccacttttcagtccctaggtgcagccaagccctccactaaacaaagctcttcctgacagggactgggtgaatgcctctataagagatcaccacatattttcatagtttacaaggataaagcaattacagcttcagtcgttcatgaataaagcctctttaacattttaatgagaacattaactcagcttcacttggtttggcctctctagaaagtctgttagcctaagagaaagtttctttaaaacccagtaatgaaattgaggcctctctgtgccccacagggcataactgggctacaaacactggctggactatttctctcctgaagtagcctatattttttgataagactacagtttggtaaatgaaagaaggcatctgaagaaatacctttctctctgcagtatttgtgtgcttgtgtgtgctcactcattttatatctgacttgtctcctaatttgctttttatgttatacacagctttgagtacaatgtgtgactcaaaaaatgttaaatcatacttttctgcaattttcccttaatcattttctactgcctctgttctctcttgccgcgtgactgattcccaccaaggctaccaaactgccattcgcctggagacccattaaattcagcagaaaaccagcagagcttcagaagtcaaaggtgaacaagaaataattcccagactcagtgacttaacatgaatttctgcctcttctctggaccaaaccaggagcagagtgaatgaaagagtttgtcaccttaagagtaaagctaaaaagaacgaatgtccaagacacacatgcatttaactcttcaaacatctgctgagtatgtattatgcagcaggaattgttctaggtactgggagtacaagccaggaacaagacaagactctcactcccacagagctaaagttctaatgggaaagacaggtgataaaccaaaaagagaatgtcagagtgcaataggtgctatgaagaaaatgcaacagggtgatgagaggctagaaaaataaggtgaaaatttaaagccaaacagagcaaaaggctacagcaaaatcctcaaggtcataaaaagacatggaataaccttaaaagcacattgctaagtgaaagaagtcagtctgaaaaggccgcatactataccattccaactacatgacattgagggaaaactcaaactatggagacagtgaaaatatccatggctgccaggggttgtgggggagggaagggagggaggaataggcagagggcagaagattttaaggccagtgaaactattctgtatgatactacgagtggatacatgtcattatacgtttatccaaacccatagaatatacaacaccagaaacaaaccctaatgcaaatgatgaactttggatgacaatgatgtgtcatcacaggttcacggattataacaaatgtagcagtctgttgggggatgctgataatacagcaagctatgcatgtgggttgtggggagctatatgggaaatctctgtacattccactgaattttactgccaacctaaaactgcccctcaaaataaagtctttaaaatccttaaagtataaaagaatgtggtgagctgaagaaccgaaaggcccagcttggctaaagcacagtgaacaaggtaaccagcagagtggctagagtaagcctggcaggtcacgtttagaagcctgaatttcattctaaaagcaccaagaagccactgaatagtttcaagcagggcttgtcattatgtgttctacatttttgaaaggtcactctggctgctgtatggaaaatggatcacagagaggcaatcaacagaggctgatgatggtggtctagtctacagtagtagcaacagagcagcagaagtagatggatttaaagaggagctgacaggactggtgatggacagattggatgtaggggataaagaagaaagaggaatcaaagatgatttctgaatgagaggagagaccatgcactgagatggggaaaaccctagctacaaagaccacacaaagtgccatgtgccatggtacagatctctggaagcagtgggaatgttcagtcctccaagggaaatcaagttcagcttgcttgatctctgccttagcatgaatagcaaatgtgtgtgtgtacacatatacacacacatatatgcatatatacatggatatatgtaaacatatatgttttaatactgtttctgaaattcaaagcaagttttaaatcatgtcagcaatctttcgaagaacagagaggcagggttgttattgttgtcccaattaacatgcaaggaagctgatggcaaatgaggtgaaaggtcttttgaaggtcacacagcaagcagtcagcagcactgaaaggaggggcccggcttcctttcaggagtccctgccgtacatcacaccctctgcctatcatctggagcatgtggggcaccctgcaagcactgcgagagaacattctcggatgaggtaagggtggaggtgctgctccctcacccatgccattttctttttgctcatcccatcacaggtgctattttaataacccataaaatgtggctgataaaaccaaaagatcgttaacaccaaagcaaactttacagagagcaaatcaagtattaaggtatattgtggcatagatttttagacagacatttaaattatgaaccacaaggcatctactgcacaagctctccaaatccttctgagggctgcacaggtggagattcctcatgaatggaagaaacactcatgcccaggaatcacaggcctatcagtagcctcatctggaattcttcatccagtctttaggtttctcaaagaacatcaaaagcactgcacacattttaggaaaaaaagacaaaaacactagaaccaaagagttcacaggtctggtctttgtaacattatttaaaggaatacaatttatctagatgaaattaccactaaaataagtcagatcatatttaaagacacatgctaggggcaggactgggaagcctggacactttgtttagtctgtatactacctgtacaagttttaaaaatacactttcatttttcatctaccaggctctccctcagagctgtgaggactcccacctcaaatttagaagtctgaaagagaaacagtgaaggggtgtccgcctctatgtttgtccctgtgagtcatacattttctgttcctactaaatgtgggttggttgttttctagttgatttgcagacttcctctctgctgcttttctctaataatatttttccaaaggacccctaccttgcaagcacagtcccactaaggaacaacaggcaattatgcatgatcacagtgatcacagttactggggcctgaaataactggactgagaacacccacagaaaggggttcagggaaaagaagtttgagatagctggtccgttgcaccctgacctccagtctacagatttagaaaatcacttgtcagggctaaaatcatggtggtcatatgtgttgccttcttatgaagatggagtcatttccatttattactggttgtcttgccaatactttcacaaagatacacagtaatatgctctcagcacacacaaagtagagttgaaacttgccctgccattaaacactcaagtgggtcaccctctgaaactgcccaccgagtctcccaccaagacccttcaacaaggccttatctctctgtccaatctgccctacagaaccctttttacttctggacacatcactttcccattttctcatatcattaaaattttctttcctttctgggagtgtagtcaatgagattggcagagaatacaggaaaggcagatggcaagcatgaaggcaaactgggagtaatttggaggggcctgggttcagagagcctgctcccaggaaaagcccgagtcagtcagccatggagatggactgccaatgggaggcagggagagcaaagagcacatgagtgagagtggccaaaaggaagcaatgggtcaggaacaagcaaagattcaagatgagggcttttggtgccactatgagacatcgtacaggtggctctgaggctggaagcaggaggctgtagagtgccaatgccacctaaactggaaagggcaagaaactgagccctcaaaaataggacaaatactgacaattttctcccttcatactcaaaacaacctctctctagagcgctctttctcttctttccttcaaatcttgagcccaatgtttgacacttgataccttgaggtgccaattatcatagtgatgattctataaagtacacaatttcacactataactttctttgcaaagcatttttttacatgtatggtatcttttagttctcacaatgttgtgacataagcattattaaatgcacacatcctgactcaaagagatttagaatcatgcacaatgctacacaagtgaaagaatctgtatccaaatccaggtcttctgacttgcgatcctgtggtttctagaatatactattagtctatttcttgttatttttatttatttttaggtttcattttattttaaattgacaaacaataattacatatttatgttagtctgtcttgtcctctaattctctattctctacatttcactaatttagacttcactaattcggaattggtgaggcaataaaacatcatttgataccctatttacttggaaatctgggaggtgctatacaaatgtgcatacaatatatccaggaggctgaatggggaagctaccatcctgaaagtggagaaaaaaagaaagcttgccttcttttagtcaccagggccaacatcagcaatttaacatcaatatgaaatttttaaaatggatttgctaactataaatgacttaattttgaattcatgtctagttaatattctataaaactcaaaaaaattcctcaaatataaaaaatatgatcttaaactaatggtacttagtctacaggctaatttttaaaaactatcacatccttatgatttttgtcacgtctttattatgtaacatagtatcctgtagttcaatttttctgtgaattcagatctgcctgtccttgtagagtctggcataaagttggttttcaaatatttgttgactagatgatggatacatacatgaatgaatgcatgtgtctgtcaagttacactccatgtcagctggagagttaaatgccacttccatcaggcacaatggaccagtcctggactttagaattccacagatacagattccaatctagctgtttgtcagctacatcatcttaagcaagttatctcacctctggactccaagtttcctcatcagcaaaatggtaacaacactgagtagcactcagaactgctgtgaggctaaagtgaagtcacacactcgatacactgcctaggttgccgccattaatatagcttatttatcctctctcctctctctgtctcacatttagcatgacccctttcataagaccaaccttgataatggtgtttcagtatataaaaccctgttgtaaagttaatggccaaacatcaactttatttacaatgactcaatttcccctctactaacattaaacttatttattcatggtctagagataggttgttatgcatagcaggtgttcaataaattttgataattttagaaaaaaaatttccagggaattgaagctcactcttttaggcactaatactctcttcatttgaaagctttcaaaaatatactataccctcaaccactatgctgagcagcaggttgaaagaactctaacctcttcttgactcagttatcaacatgaacttagacttaacaccgtaatgaaaaataataattccttgagggttttttaagtcagtagatctgctcgtaccaaatgttcccagatttctatgccatgatcatttcttccatttcttcctgtggtcagcagcatgagacactggggaatgaacaagatcaagtccctgtcatctttgagggtttaccaggaacaattcccagctatttcttatctgtggcctcatgacacacacacacgttttggtaaaagcttcaaggagggaccctagtcaaaggaggactgctccatccctcatgttttacacataatacctactcaacaatatttaggaagtgaactgagtaaacagtatgtaacttttgtaattagtatttggagataaaaactatttgtagtttctatttggagatgtttttctaacccatggctaggccctttactcatttgtggctacatttcttcatctttaagataagacaattgggttaaattatccctaagatccttttcaacacttatattctatgatctaatactccaaagctccagatgatagaactgctggaaatatgaccactggataagtgaggtattagaggacataatgaataaacaatgcatcctttgccttcaaatgcaaaatcctatcaaaaagatattatctgcatatcatggaaacaaatgcccaaaagattagctttcttacttctttctctcacctgaataccatatacaagagtagacatattgaccttggagtgtaaacatactgacctttttattttccttgtgtcaaatgttcataataaatgaaaaacctaacatatctcaaaagaagtcaactgcattcaggcaaatacaaccctaaaggggtttttctcataactaaatgcagtaatgcaatgcttcactaccttttgttcatagttatttcctcaaacaccacttggttcatatactaatttattcacatatttgtttagtgttccagttttactctttatacagaaatgaaatccaactttcttaaagtatggtttaactgtattaaaactaaaacttctaaattaaaagaagtttcataagtgtacacagaaaagaagtagatgctttcaaataacaagtcaaatatttttcaacaagtaccttgggaaggcattctgagaacagctttgcccctagaggcccagggcaagagaagtcatggacaactctctattccagataggatggtgttccttcagttcaattcaaagtataccttcctcaagcactataccaattctaaaggggataaaaaatgaaaaaatacatcatctctgccttggagaagatgcagcaagactgagtgcatagggtaatgacattggaaaatgatgtcccaggatcagatcccaacttcaccataattaactgtaaaacttcggcaagttatttaacctctctgattcagtgtccttatctgcataatggtgatgataacagtacccacctcattgagttgttatgaggattaaacggagaattactcctaaagcattaagaatgattcccagcacacagcaagtactcaaggttagtatcatccctgtgaacatacaacccatgaactatttttttataagtaaaactgaagctataacagatgtcaggaaatgaaaagacaaaaacaatctggaaaattatttttccaaccttcatcattattcttgtgtcttcctgatgaatcctaactacaactattcctcagagagatatagagatagcagagaatggaggtgtgaagaaagaaaaaacagagaaacatgaaaggagagaaagagagagcaaacaggaggtgcatttctgtattatccaaagccattagaaaggcagacactgaactaaagttggagagaaggccacacttgctgcagccctgccctgcccctttcccttctcctctcagaaactccttcctcaagcattgagctaccacacttttgtcctaaccatttctttgcttttctttcccatttatacttttgttttatagaatatgaggagagactttatatgttttatagaatggaaaaggctttagaagtcaccacctaacacaatcctctcaatttatacatgagaaaaactaagggcctgtaagacaaagacatttgtcctgggttgtatagctctataatggcacaaacaaaatcaaaactggactccctaagtccacaccatttcccttaggacaacaaaatgtatacatttacccaaaagcaatatggctagcctttatcccatatggcagatatttaaatttttctcttgggaagaaaatcttgagaattttttttaaatgagttaacaagaatcttactgtttttaatttaataaatgtgttttattattgactttattgcttgctaagcctgaaattagatttctctatgtttgggtatgtcttgtctaaccaataacaggacaaccagactgcaattaaacagatattcccacttgggccataatgcataaacacacacacacacacacacacacacacacacacacacacacacactatcaggaggcacttaaagtttcagcacattctcgttgtcacttttctggcctgtttaggagaaggagatattaaatattaaaaggctcttctaatatacagacttcaaatcatttatcttccaaaggaggaacaagtttcttgtcatttcctcatatgctatttctaaccccactgcctgcccattgtactccataagttttcatatctgtgctcagaatgtccttactatgctttgcccagatcaggtatacggcctcctaaacgttcactgctccttactcccagccttcaactccataatgaacgactgaggctctgaaatcagagccttataataatatattttttaaatggagccaataactatacttttctgttgttgttatatgtcagatctttaagtataaggatctggataaagcaaacattttaaaacaaacaaagcctcctggtttgcttatactctccccatttctctagtattcaaggtagctatcttctcttccattcactatgtggggcttcataaaaggtatgaactcactgtgactaaaggaaaggttttggcagtcttctcacacttgtttagataataggaacatctgaatctgggccactaaaaccaactcagttccacggtctaaataggtgtttacttttagtaggctagacctgcagaaggccactttactagaaccatgcttggtaagtattatttacatggatctatactactactactatgtgttttgttttcctttttctgttaatttttctttcacagcaaatgcaggctggccaccatgggtggtggcagttgtagttaccattctcattcataagaaattcaataatagaaaaagtagaattcaacattacaaaaaaaattgcaaaaattaaacactcaaagctcagaaagagttgagccaagatttgaaagtttctaaggaaggggaaaaaaaaccacattgctgcatcctcctaccctgcatgccagctagcagtggcagttcagtctctccagatgcctctcagaaaaagaaatgccacaaatataacaggagttgagatcctgggggagccaattagatttaaggtgctttcaaaattctgtaaaagaaaaaaaggcattagaaaaaacctggcacttgaaatgacattttatgtgttccgcttagggcctttggaatactactcatataagggctggttgccatgcttataaaataaactttgggtttttaatataacagaacaaaatcattagctagtaaaacaaacttagcttcagagggagaatgtggcacgtcaaatctaaggtatctcatcctttatctttggaattgtcagccaaaataagacaaatcaggccaaggtcaatggcagacactctactgagaaactctcctcctaagactgactgttgtgtagtactttgaggttctggcacttgtcaagcaattatttgggggtgagctgcaaggcaacagaaattttcaggccccccacccaacaccataccagttcctcaattgcctttcgatatcccatgacaagagaggtaggggttgggaaggaaatggggagctcagaagggactgcagtgtctccacagttacagaagcaggtctggggtccagctggtgatggggagagatgcactacactaatgtaatggctatttgtcagtccattatcatctttcccaatgagatgcagggcagatgcatcaaagacaagagaatcagacaaaagacagtgagatttaaaaatacaccaacttcagttgggtttttgggatgatttcttttcatcccaagatgaaacagccacagatccacctccaaactggaggctcaaccaggctgtctcctcagagccccactcactcattcaccttctctttaatatggtatgaaagcagtcaggtccaagaagccagcacaggggtatgtgccctcctgaaaaacattccagggctacaggacaaagacaactttttgttctaccgtgtagttgaatgtcttggcgacaccaccttgacctcctcctcctggtagaggggtggttatttcactgcctctggccagaattcaagtctataaatatgtatttagacatggttctgtgtcagccactgaaccatgtgtcgcaaaggacactatgggaagagaactcatattctgcctccatagattaccctctaagctaatgaagatgtacatgtctgtaaaggaagcaactttacttgctgaaaccctgttatttccaaggcctaccttaaaatgtaacctactctgcagtgagcagagatcgcgccactgtactccagcctgggcgaaagagcgagactctgtctcaaaaaaaaaaaaaaaaaatgtaacctactccataaggttgtcctaaccagaaacaacatctccctcacttgagctcctatgtccttgtctatcttctattttagccgtttatgaaattgtcttattgcccctttaaattctttaagcagtgatattttaataactggtaagagcaatatgtcagaagatgtcaagttcttgactgtgtggtagacataggtatctcaattattgaggaaacaaagtggtcagaaaggatttcactcagctatatttgatgggacactaaaattgaattgtctagaggaaggttttaaattaagtaagaagatgagcaaaagtcagatgtcccaggatgtctcctagcacagatatttaaaatgtaggaagttctgacaaccttctgagtggccatgaagggtgatccaaagtccttttatagcagattcatcagtcccatgatagcacctctaatccacactagtgacagtaacaactggagaataataatatatttgtttttgaggccctggaacatctctgaggactatcgccctacagagaacaggtaatcttcagaagcacttgaattcccatgtttacatttaccacagagactgatatgacctctttggagggaaggaacaagtaagagctaaactaagccaatgcttctttctgcatagtagccatagtcaaccatagacagcgaaagttgtgtctctttacagattttttggagcaatattttccctaattacaaaataggaatgcatatgttatactcagtcaaatcaaaaaaaataatgatcatagctaaataataccactataaatatttgaactttgtaatggttttcaaagaagtagtatttagaatgtctctttagaactgctagtttttagaaattactgtcccttaagcatttactttctttttggccttactgtgtaaatcatgctgctcttcctcgatttcccaggatccccaaggctgtgctctacaatgcttgctttaaataaaacttggtgccaaagagtctgccgcagctttcaagttcacccggacgacactttcctacaatgggtctcttcatacttcactatatccggatctagttgatccgcattttctgcacaaagtctcacttcccagcaattgcaatctgcatcttgcatagtttccttctattcccctgggtagcttgctgccaggaaggcagaggagaagaggagctttttgatgctaacaaggcctctgtgtaggactcatagctaatggtaaggagttgagtatggcatttctcaggggagcccaggtgagtgaaagtgtaagggcacagctgacagccatgtgcgtacctcgctgctggcctaaagtaggtcctccagcctctgagcagtaacctgttcatggcttacatcatgaaaaaatgagtcagtgcacttggcaactcatgccctaaaataggtaaggcctgaactcaaaaggaaattctgaaagaaaggcattatatggtgacaggtttttttttaagttgccggtggtaggataaaagctaatgaattatgaacatctgtattattctgctgtcttcctccttctggacttttagatgactgtaagctcaactttgagctcagctagtattttctcctgggcattctgagaaatgagaacacatttgcctgctgggaggcatacccattacttatcaaattagccctcctcaagaatctaacagacttgtcactgcctttagaaatcccagaaggaaacacacacacacacacacacacacacacacacacacacactacatggttgaaacactcagaaatctcttaatatatgtgaagtcttggccaacatacagcaaccaaggagtcaaaagtcatgtatgagtccttagggataatctttaagcaggctcttgccactgtcatgattggaatagcaaaggaaaagcacctgaccttctaaacaaagaagaaacaaatcagtaaagcttagatattgggacttaataacaaaagataaccttaagtagctctcgggatataccaggactttatttgtgttatctcatttaatcctcatgataatatcttgaggtagactggtagtattaatattctcattttttaagatgagaaaatcaaagtgtaggaagctttagtaactcattcaagtctcccctgttaatcagagatgggatgtgaatgcatgctatcaattacttctgcttatcagtggtcaatgatattttctatcaggattagcctacatccaataaattttgaaagatgaaggaaaagatgagcagaaaaaaaatgcaggagttccttattttttaacaaagtgaagataatacagggaaagaacacaatgtcagtccatttctgtgttatctggcttactgaggcaaaaggaggttctgaactcgaaccatatgaatgttgacccacaaagaccagggtttgttcttagctaagtgagtctttggttaaagattctcacatagactctgagaccttacacacatggtatcacactcattcaaatgcaattttccccatttggctatttcaagtagtcaacacacagaaactgcgttttcctcctgtgtctccttggggaggtcagggaggggtggtgacatcatgggaacagtgtctgtcttctctcctatgactcatccgagtatgtcaaagaaatgctgctaatgctagtcctgcagcatgaattatcctatctgccaagcaaactcgtggaaaacagcatactctctccatcacagccccaaagaaaggtagaaaaggcagcaatgaaaaactactcatgcaaaaccaaagcacaagagaagtgaactttactcacttcctccgctcctcacaaaaaagtatatatacatttccattttcatgttgccagaaataggtaacgacggaatttgattcctcctctgtgctctcacaccactttgtacaaattgctaaattacaatgcttaccatattgtcctataattagattttaggtgtctgccttctcactagtgtaataactccttttttcccttaccatttgtattccaagcatctggtatcacatttaacaaatatttgctaaacaaacaaatgaaaggttgaataaatggcatttgctcaagggctctctctaactaggacaaaagtaatgttctttttcctctattctttgtgactgaaaatggctgacacagtcatattggacgggggaatggatcatgtcaatctggagtattgggtgtctcagatgttctggcagttactgaatgagtgtcgtatgtgtggttacacatgtatctcatagtttcctctgcttttgtattctacagagtttgtctcttccccacttgtacccaccaagccagcctatttcatgattggctcccttaatcacttattttctttgaacttaattaggtcaattaaaatccttactctaagaaggcactcttcttattttaagttgcaggagagagaggagggcgggaaacatcacttgatattaccctacagtgcatgctatgttccaagcatgatggaggctggatattcagcaagactcagtacatccgtggcccttcctcttgcagaatttacagtcagtgggagaaagagagataaatcataaggccaatcaaatgtagtaactataatgacagatgaagcacagggtgctatgggccacacaggaaggaaaccaaagccaatctggagatcaggaagagcctctagacaacataccttttacattttgacctgagagataagtgagacttatccaggtgaaaggagaatgtaggaagggggaggaggagacccagaaactagagagaacacaatataaacaaaatactcaaagctactgaggagggctagtgtttaagtgagaaggcaaactcaggctccagctattttcccattgcccttatcctaagggcaatgggaagcctttggaggattttaaccaaggtagtgacatttggatccgagttttgggagagagacctgggttgtaggtaaagtcacatagatttgggagtggtatcattaacgggaggttaactgcaacaagtagaccttcaacatttccttttagcaagattactgtggtgccatatggagaatggattataaaactgtgagactagatgtgtagaaaccacttaggatgctatttcagtagtccagatgaagatggtaatggtgacatttgaaatggaaagaagtggatgggttcaaaagaatactagacagaattagcaggccttggcaattgaccagatgagaggttggcaaaatttatctgcaaaggactagataagaaatgcttagcctttgccagccatatggttcctgtcaccactactcaactctgctgtttagtgagaaagtggacatagacaatatataaatgaatgagcatgcctgtgtccccataaaaacctatttacaaaaaaacaggccataggccaaattcgacccaaggctagggcatgccaactcctggattaaatgaggagtgtggcaatcagaatagtaaaaatggctcccaagtatgtgaactcagcgtctggttgtccggggctactatttgcagagaaaggggcacaggagaaggagcagggtcagagggaaggaggcagtgaccagttttagacaagctgagttcaatatacctgaaatatatcacccaagatgtgtctaataagcagttagacagttggatctcagtttcaggaaaaaagatctgggctctaggtaagttgttttagttagggtcatctaaaatatactaacaggccacaaaaatcagtggcttcagtaataagtatttctttctcatatgatgacagaactcaggccagggctgggggaggacagttgttccaggagcccatctgatggcagcatccatcctactcagccaaaaggaggaaagttcagagacaagcatttgtaggaggtttctatggagggatccgaacttccagagaggtgacaaatgcagtctagctgtgtttgtttctaggatcaggagtagactgaattttggtgaacagctaccaggatctaccaccagagtcaaaaatacatagagaggtcaagaaggcatgaaaatgaataaaagtgattcaggcaactataaagcatgagaccaaggtcagagctccaaagaacaccaatgttagaagatacactgaagaggtaaaaggaagatccagcaaagtagaagaatgacaaaacaaaaataaaacgagactgtgttagatacttaatcaatgtatgtagaaatgtgagtacaaatttcatcattaagcactgagcacatctctgacaagctgacattatttggtgcctctgatatttagatgaaaaataagccaaattggatttaagagaaaatggcaaaatcagcttctcgaaaaagccagattttcattaccatgcagatggactgctttagggctatgtgtcataatattcattttttccatttacttttgtgtccataaatcaagctctctctataggagaaatgtatattctgcatcaaacattttatgtgatcttatacacatatgaacttaatataaatatgaatatacatctgtcgttgtatacacacactcaacactcaaaggattcattatcaaatgcatttctttttcacttccattttttgcaattttccatgctctctgctttgcccaaggcttcttctccaccacccaaaccatcccactttgcatgtctgttcttggctctcagtggaaagaccaaggaaaagaagctagacttcaccctgataacattttaagtccttctccattattagagaatacaacagagtctgtagcctgaatgaaaaatccaggccagaacatccatcccctgttccttggctcttcctccaagagatctcagctaggaaaagggagatctgaaatcttgctggcatgttaccaactaacagagtggtatccatcaatctagcctcttctctctctctttagaatgtaaggtattcaggacaaccatgggagttctgagatttttgtatttagaacactctttttagcaaaagaacatccagccttgcttataaataagttaaaaaaaaaaaaaaaaagacaagcagattaaaaaaagctgcccaggaggcactcatagaaaaaacaaaattagtaacctcttctacttgcccagcataaattattagtgtactcagcttgaccaagtgactatttataagtctgaacaccatggtgttcaataaatataattgaggatggtgacaatgctacccatatttccttacttaatgacacccagttggcagttcagtagcacaaatcatatgcattttactcttcctttactcgtcttcacattgtaactcatatcaggaatgaatttaaccattggaaatagccttccaattagcaaaattaatttttcgtttgatttgaaagagaccagccagtggatataagcaaggaaaaactccgcaagcagcatttctggcttctgtgaggagattttctgtcagctccaacaagtctttcttattgctacttttatagggtcatcattattcaacgtctcctagcttcaaatatcatctgcaaagcacatctagaaatttagctggtgatgcagataatgtatgaaactgagaaaccactacttgtttcccactggctaagttaaatatatagtttagaagattttagaacctctcagctagtctgaggtgggagaagggcaagagttcgccaacaccatgtgtacatagcctgtgaaacttcttaggcatttgttcaaaagagtatgtgaatgcaaaattcacaatttggacattttatctagccttcaattggcaactaggctggaactccatcaactttgtttagtcagatccttctctcatctctgccattcttctaaagccacaaagtcaaccctgccatctccttctcttcacaagacaatcttgtctcctctatgtctagaaaatcaaaaccatttaccaatactgtgaaacttaggaccacctttcactctcccatcagcatcatttttcataagtaagtaccaaaacaagtctttcatctgcctctgttctctcccccaccacccctatcttagtccgggtgcccatcactccttacttagactagtacctctcgtcatcttcttgcctactgcctaatttctctggaatccatcctactcgtcttccatgaaaagaaaaaaaaaaactatctaaaacaccaatcagatagtatcatgcctttgtataaaccctcacaacaattacaccatctgagaataaatctacatttattccctggttacaacctcatttctcatgacttctgtcacacatttcacaccatacacacacagctgctagtcctcacctaagagactttcacactcaagtctctgcctagtatgtacctcctcattaatcaccccaccctcccttggttcattcctactatatgtttaatgttcattcagggataatctcctggaagcccacagacttttttttttttttttttccgagacagagtctctttctgtcacccaggctggagggcagtggcgcgatcttggctcactgcaatctccgcctcccaggttcaagcgattctcctgccacagcctcctaactagctgggactataggcacgtgccaccacgcctggctaattttttgtatttttagtagagatggggtttcaccgtgttaggcaggatggtctcaatctcctgaccttgtgatccacccacctcagcctcccaaagtgctgggattataggcatgagccaccgtgcctggccatctggactcattcttaatcctctccaaacactctctacctaactctgtgagtgaactctaatacttctatatgtgaatctacttttttatctctgaattagtggatggtaattgacatatggaacagaatggaggaaagagaacttgacctaaggatccaggggaacttagtgtatgatgactggaaaagccacggattctgaaataatggtgttgggataacaagttaacatacagaaaaaataattttggattcttactaagtatcttcccccaaaattaattccagaaagattaaatctttaaatgttttttaaaatcacagaattagaagaaaatttaatggacaatttctataatccaaggggagaaagtttttccaagtataattgtaaaagccagaaactataaggattgatacatttgattgcacaaataagtagcttttcaattgggaaaaaaaaatgctataaatccaagtaagaagacaatcaacaaatagagaaaactgcatatttagcacattgcctgacatctaatttactttgtataaactgatttatatgtagagggctaatctccctaatatataaagaactcttttgaaccaacacaaaaaagacaaacctcctattagaaaaagcaaaacaaatgacatgaacaggcatacaaattgcctctaaatttatgtaaaattttcaaattcccaaagaagttcaaattttacatgttttgtataacagaataacaaagattttaaaaaatactctgagttattgaagacgtgggaaaatgggcactgttaaatactgctgagagtaaactgataaaaatttgcaggaagtagtttaagagtacatattaaaaattatgacccagaattttcaccagaatgtatcctaaataacaacctaaacatctatcaatgaggtgttcttaaattatagtagctctttatattacagtatcatgtaccatcaaaatcaataacacgcatatttacaaaaaaagctacacctatgttataaatttattttaaaaactatatttgaaaacaatttataacacagttgtgtttttaaataggtgtgcttacatgtacaacaagaaaaaaacttagaaggatatttctcaaaatgtaaatcatcatctctaagaggtggaactatgaattccttctttataccttctttcctatacatagatttttgaattatctgattttttttcaaagagcatgtatacttttataattaaaattattatgaacaatataattatttctactgtttaataagaatggagaaagacaaaaaccaatgtttgtgtgaatggatagagaagagtcacatgtctaaaaaagctgccattttaactaaattataccaaccacaaccaaggaacactcataaagtccagcttgtacaaagtttgacaaatccaattaacaaaataccatagactgcctggacagttaacactatagttttccttttctgaatctttctcatacacaaaacagtcagctactattctaattccagtggccgtgaaacaagaatgaactgtttcatatccattcaactctgatcattcttataatagaaaaggtgaagctaatttcctttctctgtctctgaaagtttgcccatcttttgtcacaaaaaatgttggatggcctttcagctctaaggataaacgcatgcacaggttaccaggacatgttgcaagtttatatgcatgttctcatatgaacaataatcatgtctatgattagccaataattctcacaaaacagaagggtatcagtaacataggcagaaaaatccaacaaacaaaaatgtcgactaagctttaaattcattttattacccaatattataaattttattacccaatattagttcaagtccatcattttaaaatagggtttatcaaccatagggagtatggggaagctaggacttggtgactggtcttcctgagaacaaaagaagtaaaagttatttatagtgaccttttaatgtttaccttagagctgctaatccgatgtaaattgtcaccccatggatatgcataatcaactttattccctttgctaattgagaaatagagctgttaatgtcaagaaacatttgaaaaatgcaccaagcctgctcaatggagcaagttcattttaaaagtcagagtttccatatggtaaaatcatggaaattaaacttaggggaaaaaaaaaaaaacagagagagagactaatttgttattgagctagtctgtgctagaacaaaatcagtcttaacaaccccaagcctggaaattttgaccacttcttatgttcaaaagtaactccctcagctcttatgaaaaataattccatcacatctctccaaagttcctctcctgctgagtttatgctttcccacctgcactgggtctggcttagcagtcactttgccaggacactcacacaatgcaattcacacaagtcagtccttctctttcttttactctctggtaggttgtcttttgagtttcctttaaaactgatcactgagaagtaaatgagtgagtcgtatgccaattgtgtaaaaaggggatgataatatattcccttgagtgatacttgaagattgctgtcacttttataatgccacatatggtagaagtaggcaaaattttaatttatggttaatcttagaagagatgtggttaaagcagtcactggctgcaagggaccactttgccctctcctattccaagacaagactcacttctacccttcctcagtgacttccttgttttataaaacccaagttttctcccgtttctttgagacaatcctcattattgaacattctcccccttgaaagagcttaactaaaatcttccccttaattgtctgctgcattttgtctaagaaattaaggccagccctaagcatgtgccccaaacattctcttctcaaaggcaaggccagcaaccattctgtttcttgcgacgatagaaaacacaagtcacagtgagaagagcacaagcactaaccacacacatcgatggcacacttcaagatcctgcaaggcagacttagtcctgagtgagtggggcttagtcctgagcacatctagacttcaatctcctgcagtcaccaggccccgcagagtgatatgttcacaaagacacacctgatgtgaactgcatgctcttctgagaaggtaacccatgattagcagaataagctcatatttaaaaaaaaaaaaatggttctttactccattcccaccacacactgcagggatctaagtaggggttacctaacctctctgagccttgatctcctcatccatcaaagtgctttaactgacctaatcacagccagagggctcaccttggttcaacaaaacatattcagacccattctccttttacttttaaaaaaatctaattttttttttttttttttttttggagacagagtcttgttctgtcacccaggctgaagtgcagtggcgtgatctcagcttattgcaacctccatctcccgagttgaagcaattctccagcctcagcctcctgagtagctgggactacaggcatgcaccaccgtgcccagctaatttgtgtattttcagtagagacggggtttcgccatgttggccaggctagtctcgaactcctgacctcagatgatcggcccgcctcagccttccaaagtgctgggattacaggcgtgagccaccgcacccggcctcatttttttcttcactttttacaaaataacagttttactgaaatatgatcctcataccctaaatattccccgtttttaagtgtacggttcagtgatttttaatatattcacagagttcggcaattatcaccattatttaattccagaacattttaatcatcctcaaaagaaaccccatatccatcagtagtcactccccatccccccactacaacccatgataactactactctactttctgtttctatgaatttggctattctagacatttcatatgaatgaaattatataatatgtagccttttgtgactagcttctttcactcagcataatgtcttcaaagttcatctatgttgcaacatgtgttggtatttcattccttttgatgccagaataatatttcatggtatagatatattaataccagattttgtttatctattcatcagttgatggacatgtgggttcttcccactgtttagctattatgactgatgttgttatgaacattcatgtacaggtacttgtatggaaatatgttttcagttctcttggatacatagctaagagatatactgggccatgtggtaactctacgtttaaccttttcaggaactgccaaattgttttccaaagtggttgtgccattttctttgctatttgatatattttggttccttctgtgtctgctttctggtttttgggggctcagctgggaaagtaattgggatacttcaaaagatattttacacatagtggacaatttttagccattataggtagacacaaatacacagtggctgagcttgggagccacagaatgtggtgctatagggcacaccgaaaggatatccatgctagttagcaatgatacctggagttcagagaacaatttaggaagatctgggtgggttttgatatgatatagcaataaacaacacatggatgcacgcacttagacctttatctcaggtgcttaaactataaccaggacaattcaagacgtacgtaaataatgacaggacacatttttgagattcctttgctttttttttttttttaagaatatataagaatatttccagctggccatatcagagaagatggttttggaacagaaaccatcttcactggctcttgaaggataaaaatgtcttaaacaagcagaaatgaggagttgcatctcaggcagaggcaactgtataaagaaaggcacagagtgaaacatacaaatgaggagctggaaaaagatacaaaagaaatgaaacaattaacattgaatatgaaaggtgatttagaaggtggaatacaagatgactctacgtttttggcatggaagatgggatagaccactgtgccattaacagaaaggatggtcaaatctgaaggaagaactagtaggagcgggaaggaaatgagttcaattttagacatagattgggtttaagctatcaggggaacatatgtaggtagggtccattaagcaaataaaatatagaattggagcttaagaaatatatttcctaatagaggtcattgctgaagccttcagtgggaacacagggagaagaaaagtggcctgttataacttaccctcaaagaggaaactcagtccactgcagaacaaagaagaccaggacaaggccatgcaagggcttgggaaactgaccaaattttagggctcaaccttgaggaagggagctggctgttcaactacaatgttctgaaggacagtgcaaacacaggcttaatcaggccagagctgataactaggaagtttaatctagaaagtcaggcacagcagcaggaatttccagtcacaggctagccatatcaggacagatcacctgccacgggatcaggagatgaaggacagaactcagcctctccagaactagcaggacctgggcaaaatagacaagttccatccaaagggacgggattccagaaagactctagttcacacaaattggacagatctgataggctttgctggaaggatacaggatggtctgaatacgagtaaccagaagtaactctacctcccctctgtcaacacctggtttacaggagcaagactggtttgggtccccatatgctacttactgtagatgaagcttctattgttccttctgccctgttcaggaaaggctcacaaactgactgaagctaagcttccagatgctccatcacaccagaatcagcattgaggaaggaaaggatagggccttgcagtacattcacatttggcagggcaaagaaggaagagagaaaaagaagatacggtggtggatacattcaaacactctgtatatcagcagagagtaatgatgaagcaggagagaaggagatcagagaaaatgaaggagtggactcaaaaaaaatgggtgagtcatcagggaatccctttgtgtcactggttttcacctaaaattttactttaccatatccaacagtgatgctctattacaaataatgctttgcttgtcatcctgccttcaaaagcccctttagttttcagcaaccaatacgtaagaatcacaactcctacataagtaccttttggtaaacacattcaatcttgacctggaagctacagtaaaaacaaagaaaagatcaattatataaagttggaaatacagacctccaaagaccctaactgttagagtagccagcacatatcagaaactttacagaatgccaaatcacagcataaataataaaatgtaaaactcagtggttataaaaatagactgtgagctaaaacttaaacaattaaaccatattatagaaaggcatcttttgaaaatttaaaatactacaattttaacacatataaaaattcacaaaaatgaagtttttttttacctcatattttattgaggcaagaagtaaaacaaacaatgatcttaacaccatgatcaaaaatagaaactttcaatcaacactgcacttttcacaaaattataagaggctgaaaactgcaaatagcacatgtcaagtctctgcacacttcactagagatatatttattcaaaactaaatgtctcccaacgatcttactctagaaagaacatgagtcatatatgctgagaaactcttcttacagttttaaccttttgcggaaaaaaaggcatagcttccagcccatacactagtaaagagcctgtgaaaaacaatttcacagtttaaaaagcaagactctctttggcactgatatccaacatttcagacagagaagcaaagagctcatcccagctgatgactgcctcataacttgggaagcaattgcataatgactaattctggagcttgtgcagatactgggacaaacactgcaaaccttgtaaaggacaaaaaatcccagtgggtgataaatcagcatggttgctcaggccctccaagtagtatcatggaaaagtgcagtggcccctcatatcgcactgaggcatcagctaagaaatgacttgagggaagaatgcctcctatggaatcatcaacaagtcaaacagatcacttcgtttttatacacttctggttcaggagtctgatttggtgctctacagaggaacacacaacccatgctagcaaaaagaagtagaaagaattcttttctccttctagaatggtaccccagcacaatcgggattgctagagggcagatatgcaacagagcgttcttaaagttactccttttctgaatactaaagaacttttctcaggctttttgaatgagctgaaaaccagtttcgaaagataagatattaaaccatttctatagggaataagaacactggagattatttactttgctgtaattactttggcacatagggagattagctttcaaatgctactaggtttgcatacagagatttcaataatgaagaaaaattagttcatgttttgaatatttagggcttgaagtatatattactgctaaagagtgaaaactggttaatacttgtgcagagaagaatagttaccaaaaccattaattgttttaaagtctgcacttccttccccacgaacaatcacttatttggcttattttctctcttttttaaaacaatacataatagttgtacatatttttggggaatatgtgatattttgaaacatatgtacaatgtgtatgcatgtataacacatcaggataactgagatatccatcacctcaaacatttatctttgctttatgttggcaacattccaattcttctattttgaactatatattaattgttcattatagtcaccctactgtactacaaaacccttgatattattccttctatccaaatgtatttttgtacctgttaacaattgtttgtttttaaaaagcatcttgacttttattagagccactactaaatgaaaactcacttgtacattcataaacgagtttgagtttcataagaattgggtttttaaaccaagaagcaagacagccaataattccatctagtaagggggaaaataaaacttcttttgagttaaatgaacaagcttcaagaagagataaatggaattttagaaattcattatttagtgggatattttcttgggttttcgagattgtttacatcatgactttaagctgggaccaaatttatttctgaaaagagtctggtagcatgtctcgctttatacattatagttcatctccctgcttgctatctgttaggtgagaagtggttgagattaagtgacaatgtttgcacagttatttttgactttttattctgaaacaattatcaatttacaggaagttgcaaatgttccatgttcttttagccagcttccccagatggtaacatctcaacataattatcaaatccaggaaacttggtttggatcataatcctgaaagatacaatcccaaatgttgaaatcccaaaggatcaaaatccctaaatatcaaacgccctttaaatcaaaatcttaaagtccaaaattctgaaaattatagtcacatgatagttgtatcatgttagatgaaactattaccttcttactgtctttatttggaaattgaatatgatttaaggagagctgtgtcttgaaagaaaaacctcagctattcatcatgatacaagactttaagatataatgattgtgaaagtcacccaactcttataaactatctccaggcaactgtccacaatctattcttgcaatacactttttcacacatggaattttaaaagattttttcttattattttagtttttcactctttaaaattatcagcattattttctacaattcacttgctatgtatttcatcttcacatcatttcaatactggaggtacaaaactgtagagacctttagagggttccaattagttttacgcatttttttgcaagagactccacgaaagtgcattatcacaatgttaatttttgtttgtaagcatttgtgcatgtacataaaaacactgaaatttcctcaataaagagatgtactttttgtacacgtgcatttgtaaaaaataacatttctcaagatctcagcaatttgtgtgactgtatatgttgtggtgacccatcttagttttttaactaatctcctcaaaagacttagattgttcatcacagtatttcagatgaccacaggtacaaagctgggtgcacacggttacaaaccacaatgatatgcactcattatttccctttttacctatttctttatgaatagggtttatctgctcataactgttatacccatgcaattattgtgtgtataccttagtgcttacacaaaatatctatgttagtattgtgtattttattgtgtaaggtaacctatgaagtgttctgtcatgtttttatatgtttcataaataaatccccttttaaaatgcaaatacatatcttttaaagaatttttaaattattttttccagaactatatttttgggatttttatctttcaggattgtgattttggggattttagactgaaggaattttatcttttgggattatggcatttggaattgtgtcttttggaattataataatcttcccaagaaactacaatagtatgatacccttatacagactacagaccttattcagattttgccagcttttgtatgcactcatttgtacatgtgtatgtatgtatgtatatatatagttttacataggtgtagtccctgtgtagattctgataaccatcactgtaatcaagaaacagcattcttctaaccccaccagggaacacccttatgctactccctccatcctatccctatcccctggccaccactaatgtgttctccatctctataattctgtcctttcaagaatgttatataaatggaattatacactatgaaattttttgaaactagcttttttcactcagaataatgccctttagacccagccaagttgctgcacgtatcaatggttcatttgtactctttttagtgctctgaaatattactctcattttgatcatcatacaaattgactgaatgcagaaatatcttgttgaggtttaaatagatagataaatagcacttctcacaagttccaaaacaaattaaaaggcaaatgaagcaggcagataggggataaaaagatatcaatgctttactgttcagtctgattgaagaatatagctttatatctgatgccagaggggttggctaatactctactgcaggattaaacttatccattggcatagatggaaaactactggcaggcaaatctggaagaacggggcatgctgaattcctactctgtaactcacctttcaggtaatgctatagtcaaaatgtgtccccccaaaactcatatgtagaaacttggtattaatagatggggcctctaggaagtgattaagtgatgaggacagagctctcacaaatgggattagagttcttataaaagaagtctgggctgggcgcagtggttcatgcctgtaataccaacattttgggaggccgaggtgggtggatcacttgaggtcagaagttcgaggccagcctggccaacatggtgaaaccccatctctactaaaaatacaaaaaaattagctgagcgtggtggcaggtgcctgtaatcccagctactcgggaggctgaggcagaagtatggcttgaagccgggaggcagaggctgcagtgagctgagtttgcaccattgcactccagcctgggcaacaagagtgagactctgtctcaaaaaaaaaaaaaaaaaaaaaaaaaaaaaagtttgaggaagcccttttgccccttctgtcaagagaggacacacagaaggcaccatctatgaaaaacaggcctctaccagacagcagatctgctggcatcttgatcttggacttcataggctccaaaacagaaagcaataaacttctactgtttataaactacctattctatggtattttgttatagtaccaggcacagactaagataggtaactttaaatccaggagaggaatgacttgggaggcatagaaaaatgggtagtgttctttccatatttttccttcctcaggtgcagtgtgtacattctgtcctctgtagaaacataaagagtatggaatagacattgtagccaacaatctagattttctcccccttatccctttcactgtcttttagtttttcccttccatttatgggcaaccagaaatgttgctattcccctgagtgaagactgcttttcggggccataaatccaggcagctttagatagtattcttagatacctctctgaagcgtctctgggaatgttatacgcttatcttcctttctacttcagaagtcctattcatagtcctattcctttgttctatagaatatctcaataacatttcttgagagtagattttattcagtagatgacaaatttaaagcaaaatatataacaaacaggcaatatgctaggagttaagagaatttaccttaatttccaaatgaagactttacctgttttgtttcccctaatgtttgcccaaaaaggaataactgactactaaaaataccctatgcttaccagttctatagtaaccttcctttagaagctatttctttattagcttttcctattttaaaaaatgacatatatgtacattatatatatatttttttaaaaaacagctttttgcaatttatagcaaaatggtaaactagaacaggttattgtatcccttcctcatgctcaaacctgaaaaaaatgaccttagtagcaaagaactaaaaataacagggatggtgaaagacaccaagaataggtatgccattgtattcttcttgatagaattatggataacaaattaagacaccgatagagaaaaataaaaaagaagagtgcactttaataagttagggagaatcacataatgttgaactagtgtcttttaaacaaaagaaaatgtgatgtgtacaaaggaaatcagaaaagaagaagaaaaagtaaaacaaaaagaaaacataataaacagaaaatatatatgactaagataacaggaataagtcctgatgtaacagtatttaaagtcattataaatggtataagcccaccaatcaagaccctcagagaagttctgacttctaataatggtggagtagcttataacagactaacactttgctgaaaataggtacaagctccacacaaaacataaaaacaactttttgaaggcactgaagggaaaccaaatgaagaaggaaactgacctttgaaagaaaaaaaaacaacacactgggtaagatctacttttatacatcttttcccttaggacaagataggtggaattcaagcagaaatccagtctggttagtatgaagagtcagaggacagagtctgaggctgccagagcactgcaaaaagcaacagggggtgggactggtgatccacaacgaagaaatgcgtagaaataagacctgaatcccgcatttaaatccttggctgatcacttaaattgtacgtacatgcatgcatggggcaagactccaaagagcacaggataaaacgaaccaatggaaggcggaaagaaccaaatagagatttcagcagctgtatatttcagctgctaataattattatcttgaatttgcaatttaagtcctgccagatagtgggggcttggcaaataacttgggctttctagtgacatcacagaagggccatgagttaagaataaatacttatttgaagaactattttccttacaactaaaggcaaaacaaaaacagttctaccctaacaaagcctaatattgaccagtaacataattggatattggatattatccaataatatgaaagatataggtaaaagactacagaggatataaaacataatactaaaattatttaacctaaaaaattcaggaaaggaggaacagagaaacaaaatagaggagacaaatggaaaccaaatagcaaaattgcacacttaaaaacaaatatcaaaaattaaattaaatatatgtaacacccctgcagtgagccaagattgcaccactgcactccagcctgagtgacagagtgggactccatctcaaaaaacaaacaaacaacaactctctctctctctctctctctctctatatatatatatatttgtaatatatatatatgtaacactccaattacaaggcaaagatttttaaactagataagaaagcaaacaaatacatgctctattaaaaaagatgcactttaaatgtaaagatatatgcaagtttaaaaaaaagaatgaaaaaaatacatcaaatattccacatataagaaagcctgtatggctatataaatatcaaacaaagtagacttcaagccaatgtatattaccagagaaaatgagggtaatttcataatgacaagggggtgttactatagagggccgtttcattaataaagctcaagaattttaacatatatgaaacaaagacttagtagaaataaggggaaaaaatagaaaccattcacatagttggagatttttaacacccctctcttaggaaattataaaacaacagaccaaggggatagtatgaatgcagaagatttgaacattatcagtgaacttcaacttaaaatatattttgaatagtaaactcaacaaagcaaaattcatatagtacacattcttgtccagtacattgaaaaatatttaatgagacagactatatattggaataaaaaacatcttaataaatttttaaaaatcagatagaatatgtttcctgtctacaaagtatttaataagatatcaatattaagaggtctagaaattaccaggcctctcagaatattccttctaaacaatccatgggtacaaagaaatcataagtgaaattagaaaatatttagaactaaataataataacatataaaaatgtgtgagatttactaaggcaatgcttagaaaaaaatctgtagatttaaaaagcttatatttaaaaaagtaagaaaggtttaaagtgaatgatctatgctaccaagttaagaagctacagatagaataaattaatacaaagtaattagaaaggaggaagcaataaaataaagcagaaaacaatgaaatagaaaagagacagtaatgaatatcagcagggccaatttgggttcttggaaaaaaaaagaaagaaagaggcggaaggagcataccacaacacaatttacaattatcaccctaataacaaaatgtgatagcaatattacaaaaaagaaaaatcacaaaccaatatcactcagaaagatgtaaaagctgtaacaaaatattaagcaaatcaagcccagtaatacataaacagataatacagcttgaccatatggtatttttcccaaaaatacaagattagttcaacattcaaaactgtatctgattaacaaaaatattaacaatatatgggtaaaaataaaaactatgatcattgtaagagatatagaaaggacattttacaaaattgagcacatgatcaagaaagaaaaaaaaaaaacaagctcctagtaatagaagggaacctgataaaactatctaaaaaaaatctcactctaatatcacaattaatgttgaaatattgaatgcttttctcctaaagtcaggaaaatatccactcctaccacttctactcaacattgaactaccagtcctggatagtgcagtaaggcaagaaagatatatatatatatatggcataaacattagaacagaagaagtaaaactgttttttgcccccaccctcactcccgacccagacaacatggttgcttacagtgaaaattttaaggaatgtacatacacataaaattactggaactgaaaaattcctttagtaaggcccaatgacagaaagtgaatatatgaaaatcaactctatttctatataccggcagtgaataactgaaaatgaaatttaaaacgatactattaaaaattgcataataaaacattaaatagagaaaaaacataataacaaatatgcaagacctctatacggaaaaccaaaaaatattgaagaaaaagaataaagacctatgtaaatgaatagatgtttcatgtttcagggaagtctcaacattaaaccgtgacctgccccaaagttgatttgtagattcaatgccatcccaatgaaaatcacagcaggatttttacagaaattgacaggtgagtctaaaacttgtatggaaatgtaaagaacctatagttattaaaacaataagaacagggtggggcgcagtggctcacgcctgtaatcccagcactttgggaggccaaggcgggcggatcatgaggtcaagagatcgagaccatctggccaacgtggtgaaaccctgtctctactaaaagtacaaaaattagctgggcgtggtggtgctcgcctgtagtcccagctactcgggaggctgaggcaggagaatggcgtgaacccgggaggtggaggttacagtgagccgagatcacgccactgaactccagcctggtgacagagaaagactctgtctcaaaaaaaaaaaaaaaaaaaaaaaaaccaagaacaaagtagaaagatttacaggacctgattccaaaatttacaaaaatgctatcagaaaatgtggttctgatataacgacagaaaaaaagatcaattaaatggaataaggaattaagatatgtatgtggacatatattgttagactaggtagttaggcagacatgagcagagtgggagaggggtcccccttatactaggaatgtcaggacaccatcaggtgatggctagacagttcttaaactgcctctctaaaataattggttgtagctggtgccaggaaaggcagtttcccagtagatagagaacacctgaagctgatgatcagcggcttcctaataagatctcaggagttgggtgagtgggctcaagcatgagcactaaaaggcaaactggcacgtttaactggtatatgaccttgctctaggaacatttgtctggtgagggaagaatgcctcaagtgagcatgcgtacaacttcaataagcacattgggcatgcagcccctcccaagtgcggacaggccattgcgcatgtcgacagcccaccctaagggaagaatcaaggtagaagtaacacagaccctggaatcatgccaatgtataaagccccaaggcaaaggtcaaacagtgcacttgaatctctcaagtcacctgcttggccctcttccagtgtactttacttccttttgttcctgctctaaaactttttaataaactttgactcctattctaaaacttgccttagtctcttgcattgccttatggcccctcagtcaaattctttcttctgaggaggcaagaattaaggtggctgcagacccatatggatttggtgcagctaacaataggacaaattaattttcaacagaagcaccaaggtaattcaatacagacagaaagtgtgatcttttcaacaaatgatgctgaaacaaatgtaaatctgtaatgaataaataggcctcacaatatataggtaaagtaacccaggacgattcatagagctacatataaaaactaaaaatataaagctgatagaagaaaaaacctttatgacattaggatggtaaagatctttccatacacaaaacccactaagggttaggcaaaacaaaacataaaaaaattctgctcttcaaaggacatcattaagaaaatgaaacggcaagccatagattcccagagtggctttaaaaagcaaatagcctgtctatgagaattatagtttttaaaataaggatataaaattactggggtaaaaaggaagaaaatatttaaaatacacatatctgacaaatgatgtatatacaaaatataatttttaattctacagtttaataaagagacaacacaataagtaatggacaaaagaaatagaaccttgagaaatgaagatgcaaaaggcgaattagtataagaaacggcttcagcttgacatcattagttacctgagaaatgcaattaaaaccacaaatattgatgaggtaataggccacaatattgaaaaacacaatacattccaaaggctcaacatcatatggaaaattttttatgaccatactatgtagtaaaatcagaaattaataacaaaggaacaaaaaaagtaaaaaataagtttgcaaaataaatattaaataaccattacagaagaaatcttaagagaaattataattttaagtacatttttaacgaaacaagaaagactgaaaacaagcaagttaaacagtcaacacaagaatctgcaaagagcaagtaacaaattgaaacacaaaaaagggaaacaatgatgagggcagggatcaatgtgaaaaacattcatgaaggaggaggaaaagaaggaagaagatgaggaggagagaaggagggagaaggaagattaacaagctagttcttgggaaagattcctaaattatacatagttcaagaaaatctgaaaaagataaaaaggtagaagttgcaagttaaattaaaaaacagaaataactacaaactgatttttaaatgagaaaagaatatcaaatcttcttgaaaatattaagcatcaaaattgtttgagataaaatagaaatcttggataaaacaataatcataaaaaacagaaccggaaataataatttttaaatctcttccaaaaacggaaaatattaggcccagatcattttgccagtgagttttactttcaacaaacagatcattcctattttatatgttattaaagcacacagaacaagaggataagctgcccagcatatgtgataagaacactggtaccttaactccaaaacctaataaggacaatgaaagaaaatctcacttatcaacatagatgcgaatatgttaatataaacatagtcaatcacatccaacagagtattaaaataggaggggagaggaaaaagagggcaggaggagggaaagacagtggcagggcaaggagactatggcaaagataacaaagacatcaggatcagataaagtttatcccgatgttcagatatatcctatgtctggataacatatttcctaataattcaatgatggtttgacattagaaaacatatgaaagtaatccatcacattaatagattaaatgaaaaaaatcacttggttatctcaataaatgtagaaataacatttgaaaagtatacaatgattcatgttaaaaattatcagactactaagaatgagggtaacttccttaataaggtaaaggttatatagcaaaatgtacagcaagcactcaattaattgaaaaactttagacacataatactacctgctatcactacttcaggccaacactatgagaaaacaaaaagaaatcagaaggataataattgaaggaggagagaaaaaagtgatgaacataaaatgtgtctatcaacatagaaaaattaacacaatcaatgaagagaaatgtgaccaacataaaaaagtaagctgaaccaatagataagaattaacagaatcaatacaaaagtagaaaaataataacaaatttgaacaaggtggtcgaattcaagatcaacttaacatctacaaaattgctctacagaaacaataatcaagtagaaaaatagaaaataagatagcatccacaataaaagaaataccttttttttttggtttggctatctaggattaagaaagttggttttttaaattattattattatactttaagttttaggttacatgtgcacaatgtgcaggtttgttacatatgtatacatgtgccatgttggtgtgctgctgcacccactaactcattatttagtattaggtatatctccaaatgctatccctcccccctccccccaccccacaacagtccccagagtgtgatgttccccttcctgtgtccatgtgttctcattgttcaattcccacctaggagtgagaacatgcggtgtttggttttttgtccttgcgatagtttgcttagaatgatggtttccagtttcatccatgtccctacaaaggacatgaactcatcattttttatggctgcatagtattccatggtgtatatgtgccacattttcataatccagtcttaccgttgttcgacatttgggttggttccaagtctttgctattgtgaatagtgccacaataaacatacgtgggcatgtgtctttatagcagcaagatgtataatcctttgggtatatacccagtaatgggatggctgggtcaaatggtatttctagttctagatccctgaggaatcaccatactgacttccacaatggttgaactagtttatagtcccaccaacagtgtgaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgctttttggctgcataaatgtcttcttttgagaagtgtctgttcatatccttcacccactttttgatggggttgtttgtttttttcttgtaaatttgttggagttcattgtagattctggatattagccctttgtcagatgagtaggttgtgaaaattttttcccattttgtaggttgcctattcactctgatggtagtttcttttgctgtgcagaagctctttagtttaattagatcccatttgtcaattttggcttttgttgccattgcttttggtgttttagacacgaagtccttgcccatgcctatgtcctgaatggtaatgcctaggttttcttctaggttttttatggttttagatctaacatttaagtctttaatccatctggaattaatttttgtataaggtgtaaggaagggatccagtttcagctttctacatacggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagcatgatgcctccagctttgttcttttggcttaggattgacttggcgatgtgggctcttttttggttccatatgaactttagttttttccaattctgtgaagaaagtcattggtagcttgatggagatggcattgaatctataaattaccttggacagtatggccattttcatgatattgattcttcctacccatgagcatggaatgttcttccatttgtttgtatcctcttttatttcattgagcggtggtttgtagttctccttgaagaggtccttcacatcccttgtaagttggattcctaggtattttattctctttgaagcaattgtgaatgggagttcactcatgatttggctctctgtttgttactggtgtataagaatgcttatgatttttgtacattgattttgtatcctgagatttgctgaagttgcttatcagcttaaggagattttgggctgagacaatggggttttctagataaacaatcatgtcatctgcaaacagggacaatttgacttcctcttttcctaattgaataccctttatttccttctcctgcctaactgccctggccagaacttccaacactatgttgaataagagtggtgagagagggcatccctgtcttgtgccagttttcaaagggaatgcttccagtttttgcccattcagtatgatattggctgtgggtttgtcatagatagctcttattattttgagattcgtcccatcagtacctaatttattgagagtttttagcatgaagggttgttgaattttgtcaaaggccttttctgcatctattgagataattatgtggtttttgtctttggttctgtttatatgctggattacatttattgatttgtgtatattgaaccagccttgcatcccatggatgaagcccacttgatcatggtggatgaactttttgatgtgctgctggattcagtttgccagtattttattgaggatttttgcatcaatgttcatcaaggatattcgtctaaaattctcttttttggttgtgtctctgcccggctttggtaccaagatgatgctggcctcataaaatgagttagggaggattccctttttttctattgattggaatagtttcagaaggaatggtaccagttcctccttgtacctctggtagaattcggctgtgaatccatctggtcctggactctttttggttggcaagctattgattattgccacaatttcagagtctgttattggtctattaagagagtcaacttcttcctggtttagtcttgggagggtgtatttgtcgagtaatttatccatttcttctagattttctagtttatttgcatagaggtgtttgtagtattctctgatggtagtttgtatttctgtgggattggtggtgatatcccctttatcattttttattgcatctatttgattcttctctcttttcttctttattagtcttgctagcggtctatcaattttgttgatcctttcaaaaaaccagctcctggattcattaattttttgaaaggttttttgtgtctctatttcctccagttctgctctgattttagttatttcttgccttctgctagcttttgaatgtgtttgctcttacttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcgttatatacccagtagtcattcaggagcaggttgttcagtttccatgtagttgagtggttttgagtgagtttcttaatcccgagttctagtttgattgcactgtggtctgagagatagtttgttataatttctgttcttttacatttgctgaggagtgctttacttccaactatgtggtcaattttggaatagatgtggtgtggtgctgaaaaaaatgtatattctgttgatttggggtggagagttctgtagatgtctattaggtccgcttgctgcagagctgagttcaattcctgggtatctttgttaactttctgtctcgttgatctgtctaatgttgacagtggggtgttaaagtctcccgttattattgtgtgggagtctaagtctctttgtaggtcaataaggacttgcttcatgaatctgggtgctcctgtgttgggtgcatatatatttaggacagttagctcttcttgttgaattgatccctttaccattatgtaatggccttctttgtctcttttgatctttgttggtttaaagtctgttttatccgagactaggattgcaacccctgcctttttttgttttccattggcttggtagatcttcctccatccctttattttgagcctatgtgtgtctctgcaagtgagatgcgtttcctgaatagcacactgatgggtcttgactctatccaatttgccagtctgtgtcttttaattggagcatttagcccatttacatttaaagttaatattgttatatgttaatttggtcctgtcattatgatgttagctggtgattttgctcgttagttgatgcagtttcttcctagccttgatggtcgttacattttggcatgtttttgcagtggctggtaccggttgttcctttccatgtttagtgcttccttcaggagctcttttagggcaggcctggtggtgacaaaatctctcagcatttgcttgtctgtaaagtattttatttctccttcacttatgaagcttagtttggctggatatgaaattctggattgaaagttcttttctttaagaatgttgaatattggcccccactgtcttctggcttgtagagtttctgccgagagatccgctgttagtctgatgggcttccctttgtgggtaacccgacctttctctctggctgcccttaacattttttccttcatttcaactttggtgaatctgacaattatgtgtcttggagttgctcttctcggagtgtcttggagtatctttgtggctcttctcggagtatcttggagttgctcttcttggagtatctttgtggcgttctctgtatttcctgaattggaatgttggcctgccttgttagattggggaagttctcctggataatatcctgcagagtgttttccaacttggttccattctccccgtcactttcaggtacaccaatcagacgtagatttggtcttttcacatagtcccatatttcttggaggctttgttcgtttctttttattcttttttctctaaacttcctttctggcttcatttcattcatttcgtcttccatcactgataccctttcttccagttgatcgcatcggctcctgaggcttctgcattcttcacgtagttctcgagccttggctttcagctccatcagctcctttaaggacttctctgcattggtttttctaggtaaccattcgcattcttcacgtagttctcgagccttggctttcagctccatcagctcctttaaggacttctctgcattggtttttctaggtaaccattcgtctaattttttctcaaagtttttaacttctttgccattggtttgaatttcctcctgtagctcggaatagtttgatcatctctgaagccttcttctctcaactcatcaaagtcattctccgtccagctttgttccgttgctggtgaggagctgcgttcctttgaaggaggagaggcgctctgctttttagagtttccagtttttctgctctgttttttccccatctttgtggttttatctacttttggtcttcgatgatggtgacgtacagatgggtttttggtgtggatgtcctttctgtttgttagttttccttctaacagacaggaccctcagctgcaggtctgttggagtttgctagagatccactccagaccctgtttgcctgggtatcagcagcggtggctgcagaacagcggtggctcagatggaaatgcagaaatcgcccatcttctgcgtcgctcatgctgggagctgtagaccggagatcttcctatttggccatcttcgctccgccaagcagaaatatcttgaaattaacttgaaagtaagaatgctcaaggaagtcctggacagagcattcaggcaagagaaagatttaataaaaggtatccaaataggaaaagaagtcaaatgatctctctttgctgacaatataattctacacatagaaaagcctaaagactccaccaaaggctcctggaactgacaaactaattcagttaaatttcaggatataaagtcaatgtacaaaaatcagtagcagtcctatacagctataacattctagctgagaaccaaattaagaacacaatcccatttacaatacccacaaaaaaaaaaaatgaattacctaggaattcatctaaccaaataggtcaaagatctctgcagagagaactacaaaacactgctgaaagaaatcagagatgaaacaaataaatggaaaaacatattaagaccatgctcatggattggaagaatcaatattgttaaaatgatgatactgcccaaagcaacatacagattcagtgctatccctatcaaaatactaacgctgtttttcacagaattagaaaaatctattctaaaattcatgtggaaccaaaaaaaagcctgaatagccaaagcaatcctaatcgaaaagaacaaagccagaggcatcacattacctgacttcgaactatactttaaggctacagttacccaaacagcacggtactggtacaaaaaaagatacacagaccaacagaatagcatacagaacccagaaataaacctgcatatctacaaccatctgatcttcaacaaaatcaaaaaaaatatgcaatggggaaaggacttcctgttcaataaatggtgctgggataactggctagccatatgcagaagaatgaaactggactcctacctctcagcataaccaaacattaacccaacatggattaaagatttaaatttaagacctcaaattataaaattcctagaagaaaacctaggaaatcccttctcaacattggctttggcaaagaatttatggctaagttcctaaaagcagttgcaacaaaaacaaaaattgacatgtgggacctaattaaaactaaagagcttctgcagagcaaaagaaactatcaacagggtaaacagacagcctacagaatgggagaaaatattcacaaactgtgcatctgaccaaggtctaatacccagaatctacaagcaaaaacaaatcaacaagcaaaaaataaataaagcaatttaaaaatgagcaaaggacaggaacagacacttctcaaaataagatgtacaagtggccaacaaacatgaaaaaaagctcatcactaatcatcagagaaatgcaaatcaaaactacagtgagataccatcccataccagtcagaatggcgattattaaaaagtcaaaaaatatgatgctggtgaggctgcagagaaaaggaatcacatatacacaatggtgggaatacaaactagttcagtcactgtggaaagaagcctggagatttctcaaaaaagttataatagaacttccatttgagctagcaactcactactgggtatatacccaaaagaaaataatccattctatcaaaaagacacatgtacttattagttcattgcaacactattcacaatagcagagatgtggactcaatttagttgcccttcgacagtggtttggataaagacaaggtagtacatatgcactatggaatacactgcagccatacaaaagtgaaataatgtcctttgtagcaatatagactgagctgaagatcattatcctaagctaattaatgcaacagaaaaccaaatacaatatgatctcacttataaatgggagctaaacattgaatacacatagacataaatatgggaacaacagacactgggaactaccagatgggagagggagggagggaagaggggatgggttgaaaaagccacctactgggtactatgctcactacctggaggacaatatcatttgtctcccaaacctcagcatcacacaatatacctatgtaacaaacctgcacatgtaccctttcatctataataaaaattgaaattatttaaaaattggaatcatctcgggaggctgaggcaggagaatgttgtgaacccaggaggcggagcttgcagtgagccaagatagtgccactgcactccagcctgggagacaaagcaagactccgtctcaaaaaaaaaaaaaaaaaaaaaaaaaaaaaaaaattagaatcataataaagctgttaaaatagcttaggaataacgatataatgttgctgttggacccttcaaacaagactttgttatatattcccccttgtgcaggtattctactgtgtcctttagtagtatttttaaattttcttcataaaggttttacacatttatagttttaaaaaagaatgcacaagatctctatggagaaactttaaaaactacattaagatcagatacaatggacgagatgaattaaccaagaaatattccatacataggaaaaaattatcgtcatcctgtaatttatttttcctaccactattcttctccatctctcaaggaggcaactgatttatcccctgaaggctcagggcctgattccaagctgatctagatgtaagacaatcagcattttaattcccactggcaaccattccctgaaggtctggagctagttactcttctaagtatttgtttccacaaagcttcttaagcctcttctattactgcctattagaagtcaggtgtccttcagcagtgttaactgtgtttttatacctaccactgagttgtagtactccatatatattcattcaaatacacacacacacacacacacacacacacacacacacacacacacaccagcaatcgcacattcaaggttaggtgtgggctttggtttctgtgactctgtcttgctctagcctgcccttctgcctggttgctggagctgctcaatgcagcgcctgggcattcaggctccccctgaatcatctacatcccagtggtcataatcaatgctgtggctggaaagatgagagataagaagatcacacgcgaaattctagaaaccagaaatgcaccaagtcttatggcactcatagacaaaacacctgattaatccctcatttcaacacaagatatccaaaggaactaaccaccagagaaccctaacgtagcgcaccaagtgtggacagtctcggaacatgcaatggagcaccagaaccctaaaaagactggccaaaatcctgaaaaagcttgccacaccttttggctatggagctttttgcctaaggggccatgcctgcacccaagctctagcctgtccaaatgaatgagtctcttgcccaattctgaccttctgtttaagacttctagagaaggtatcagacctcatatcctatttctgagacacgataacagcaacatttgtaaatctgctggaattctcacatgtaaagaaaataacctacagcaggttcacctaatcctctcttcaagcagatatatttttaaaaattcaagatgtatatctttaactgtaatcattctaaaaataagacagagaacagtgtttcattttgaagggaaattgtctaaaattaatataaattacatgttattattgaaaaatcacatatgtaagtctgacgtttctctcaggactgtgcttgcagacttatagatcccatgcaatataaataagaaagcaatgatcttattcaattttcttgtgccacacaagtaaatgttctataaacacactacattctctttgataaggcagccctggactagggctgctccctgaacctaccagtttctgtacttccatctctcagtgacttcgcacaagttttccttcatacggaagcccgttcaatgcctctctctatcatttccttcctcaatggctactcaaaatcacctccttgaaagtttgcccactcttcccaggtgcccaagccctttgagctgtctcaattatagctcagcttccatttgctttgaattggacttacctttttctctactactcagtgctggtgttatgggcatgtgacttgtgcagccacaaagagcttcactcttagaaactccatctgagtttaatgctctgctgtcatcatcttgacattttcaagaactttatttttgaacttgtgttttgtaagtgaagcctgatgggacactagagcatgggcacgagcagaggggtatgcacatgtgtgtccccattcctttctaccttatttgtatacagcttttttgatgctccatgaagacagaattccagtggatccacaatgggtgggaggaagtctaacaagactcaaagccaagtacaaggtaaacatattacatttatgactaagtagtgagtaaagagggacactgacaaccctgagagggcatgctctccacttgaaccagaacttgattcacaggcagaaagaaggcaatgttgttctaaatagtagtcaaccacttgctggaaataatgacatagaagaaaagggaaacacagggcaacccattatttattttcttttcagtccttccttatttaccggtagtccaaaaggagagagtggtgggtagaatgtgcacataccaagaagtgaaataaaaacaactgagttttgtgcagtgtttccactggtttggtaaggacggagttgtgtaatttcaatgattccacatacaaatttagtacccttatacttacatttaaaaccagtattgcacaatatacagatgaatggtaaaattcatgctaataatttaaatttttaattattattttcttaggatattaaatagcaaatttaaaacaccataaatccagagactacataaataagaaaaagcttttatatattttatatcttttttttttttttttttttgagacggagtcttgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtgtttttagtagagacggggtttcaccgttttagccgggatggtctcgatctcctgacctcgtgatccgcccgcctcagcctcccaaagtgctgggattacaggcatgagccaccacgcccggcctatattttatatctttactggcactttttcccctgctttttgcacaaggggccccacattttcattttgcactggaccttacaaattagatagacagcctgccactgagacatcagtccctggagcacagggactctgcttcatgcatggctctctaactgcagcacctaggctattgctttatgttcattcagtgctcagtaaacacttgttaaacatagaatgtggtgtataaggacgaaagatcttagggtcccaagctaggaagacaataaccctgctctcgactctgttaaacagaccacacctggggtacaatgtccagttctcagggccacctttgaacaggaatgtagagaagaactcatcaaaagatactgggttcaaattatttcatcagcttattagctatataaccaaacagaaattggattagtctttgtgatcctcagtgttcttttttgcaaaatagggataaaagggtatttaaaaagacaatgtaagtgaaagcattttgcaaattccattgctttatacacatgttagttattatgatcctaactggaaggtgtctgtaggaaattaactggaatgatgagatggcataacagcagggccttaggcaacagagaggatctaagaggaatacagccactgacttctaacagttaaatgttcacagagggatgtaggtttaagagtgaccagtgagagcacagtaaaaacctctgggaagaaatgtataataaggcaggaaaggagcatgaggaaaaatttccaaagaagtaaatgtgggcctgcctgaggatacagtaagttccctgtcctttgagagtacaggactacctaagattttaagaaacatgtaacatcagataacaactggacataaaataataaccataatgatggtggtagatattgtttattggtgcatcctaaataccagacatgatgacagggactttacatacattattttttaaaatcataacaaatccataaagtgggtaaaattactcttatcactgttattattactctaaaggtaaaaaaaaaataggttaagtaatttatccaagatcacaaagccaaccaccttccactgaattcaaagtcaatattgaacatttatctggctgctaaaagaaataataatgattacaaatcccaggtctatttgttaaagactcccaaaatggcatcctcaatttcacacaaacatgacaataatcatctgaatcatgaagaaatctaaaagatataccaagaaaattacatcatcataaaacagaactttaaaaatatcaaggagacaaaaggttttcctcctagggcaccaacacagtttgtgagttcctagcccttcccaaactgtccccacaccttaagaaacactaggggctctagagctctctctctacacaaaggattcctgaacacagatcttaggccccgccttggcagagcaagtgggagcctgggcctgcagacagcacttttgtcccatttgaagatatactatatagctttttatatttaagcatcttgaaaatcactctaggaaagccatatttgggcacttagaagtatagcaggtgtgaaattatctcttggtgggacactgctcacttccccaccacttaagcccagaacgtgattaaaaccaaaatctgtaaaagcaaagctgtgacattcatttaacatttccattgtcaaaaaaattactcaggagccttgtaagtactctgtattctacctgttaggattgttttgaaatgacatcaccacaaatttcaactgaaaattaagaattggaagacagccgactctatccgctattcctaaaagcacttcaaactcttaatcttcttatattcatttcaagtaggtaacaaagcactccatgagtacaaatgcattttaacagacttttgccaatgccaagacaatgtgagagtcactgaagatactcaaaatttaaaagtgggtttatatcacactataaatgggacccaagacactttctgtccaggtgttgctatacttcaaattggtggtggcattttaaccatctatacaaatgcctgaatctacacacacacacacacacacatacacatgacaggaagaattgcaccaaacctttaagctgtagaaaaaaaagaaaatgagactccagaatatttcattaagataaaaatgttaggataaaaatgtccaaacacaagctttgctactgaaaacagttattctgggatatctgatcagccgtacaacaccttatctcttcacatcactagggtagtttttatatttgaaaccacatcataaattatactgtaatacctatctgcctcaaacacagtagaaaaacacctacacagcataaatcatacatgacatcacattaggtcttttaaataatgttgtgaacaccaggaaaatattccagaaatccatttttcatgctctttcttttaactactacccaaatagaagtgtctactttgcctctccaccagtccttttcagttaaataaatcaaatatatacaaaggacttctcatgcatgaaaggtaccacatgtttctacacaaataggagtggcatatctatcctccctaggacacagaatgctgagttcaagcaggcctggtctgtcttctatgtgctctacctcttagaggtctgacactgcttctctttgtgtctacattttgtttgaacagtacctccaacacatggaatgaaaggacggggagggaattctcctagcacctatgcatccctcactccttggcaacactatcttaccacattgataaaataatctatttgcctgtacctatgcacaaggaccattttactcatttgcgtatcttccctgattagcaggatagtagaaacaattaacaccgaatccataagtgtagattaaacaaaaaccagtcaagtttgcctttgtattgtaactctggtaataggttttagaggaaattcaactaaaaaggaaaatgaacttaaagagtctggatttttttcctaatccatagttatctaattcaccctttctcaaaagaaggctctctctttcttcctctttatcggctcttgcctgtctttccctttctccagttctctctcacacacagcttgtatctaaagctatgcaagaaatacattttatactagtgatttggtcagtgttaccctgcttcttcttgctatgaatgcagtatatatgagataagtacaaaagaaagagtatctaactctcttattttcatcatgacccactgggacaaggggagagagagggcacagctgcctccacggaataccctgttattgggcatgacaaagccaaggtaaagttctctggcatacctggaattcagacatgattacatggatatatgtctcactttccttgattattaagttgtaactctagagtatttgaccagcaggaaaggataagctttttctgatgagtatttaaaaagaagggtagaatcattttacttttaaatcctgcttttaagaggaaaccaaatagggtctcccttcccactggttgagcaactaccagccaatcactctgagccaaatgcaatgactacaaaagaccttggttccctgaaatgcttgaaggttaagggattacaatatgactaactggacctttataatcgtagccaagctgaagaatacaggcctcagagctcaccaagtagtagtgttattcttttgttgtaaagggacttaaacagagggacctaaagagttaaaacagtatcagccaaagtctgctcctctccgagacaaggacaagagctggatgcatgaattttataaataagagcatatcttcgactcctgtgtcaaatttaactgccacaagtatgaaatttctgcaagaaaagtgactgctactctttgctgttttcatttctaaagccactttcttccctgaccagctagaagccacttagatagttttcgcctggcacggtgactcactcctgtaatcctagcactttgggaggcagaggccagcagatcacttgagctcaggagttcgagaccaacctgggcaacatggcaaaacctcgtctctacaaaaaaaaaaaaaaagaagctaggcatggtggtacatacctgtggtcccagctactcaggaggctgagacaggagggttgcttgagcccaggaggtggaggctgcagtgagctgagattatgccactgcactccagcctggacaacagaataagaccctgtctcaaaaaaaaaaaaggttctgattatcttactttctttggtaaccagatacagtctcaggagcataagataacaataccatttttgttttgtttcattttgttttcttaacaagccatatacttatacaacaaaggaacaaaaaataaagtgtgaccataaaattaaaacataaatccacaataaagaatacaccaaaaaaacaaaactttaaagttttaaactctgacttttgttatgaaatttttcatctttttttttttttttttgagatggagtttcgctctgttgcccaggcttgagtgtgcagtggtgtgatcttggctcactgcaacctccgcctcccagattcaagtgattctcctgtctcagcctcctgagtagctggtattataggcgtgcatcactacacctagctaatttttgtatttttagtagagacagggtttcaccatgttgaccaggctggtctcaaactcctgacctcaagtgatctgcctgcttagtcctcccaaagtgctgggattataggcataagccaccacgcccagcctcatgtttcaactttaatcattcattgaccactctatcatctgcatgagctttaaaaaatgaactgttggagaacacctaactcactcaacaaatacacacatgcctgaaggagaagaattggcctcgatgggcaacgtagaaattctcctaggattagagttcagctctaaaggaggaaactgaagaaacgcattgacttttgtgtgtgtgtgtgtgtgtgtgtgtgtgtgtgtgtgagagagagacagggtctcactgtgtcacccaggctggagttcagtggtgtgatctcagctcactgcaacctctgcctcccaggttcaagcaattctcgtgcctcagcctcccgaggagctgggattacaggcacacgtccccacacctggctaatttttgtatttttaacggagatggggtttcaccatgttggttaggctggtctcgaattcctgacctcaagtgatccacccaccttggcctcccaaactgctgggattacaggcgtgtgcatggatttttgtctcaaatccaaagtgatgcaccgaagaacaccctgcacttcttagtgtttgttctctccttcatgggtgctggtactgaatttccagctctttcacggggcacttctcaccatctcagactccagagcaaaggcagatgtcccccaaatgaggttaacagactccagttacattcttttttaaaaccatcctgcagctaattccttaacacatgttaaaccaggtgggaataagagaccaacatcttcctctagactcagcaataatgggtcccctccacccccagctgaagttctgctttgcaaggataccccaagttgtactgttcatcactcttagcagacaacttagacatagataaaaatgaacggaatccatgttcttctctatttggctggcagacaacagaactaggccatccttacaatgttgttccagaaagtttgttttaggcatggggttcctgctgtcagttggctttctatgaggaaaactgggatggataaagatggtgctgaagtccatgtatggttgctgttggggccgcgggtagacagaaagggccaggcaggatggagagggagcttataaattagatcttacattaaatggctaagtaaaagagataattaggcaactcctctctattctcccctctaccccacttttccctactgcccccacctctaaataaatgtatagaaccatttgaaaaatattaacaactttgagtggtttttaaaatacctttggctactaatattattgccattaacattatgcatttgcttattgatactttcattttaaagaagtcaaagttttaaaaaggctaattttagatccaaaacaaccatattaacacatctggtataaacaatactgagaattcataacaagaaattattttaagttaacaaaagcttccccaacgctattttctactatagaaaatatgcaatagtttaatgtactaaaggccatggcagcagctgccagaatttaataccccttgggcttttataaatccaatttcccttcctcttattctcctttgctcttttctttttatctttcttttccttcttctctggagagaggtgaaaaaacagaaatgaggtggggttagggcaagtgacctgtgaatcaaaccaggtcacattcccacaagtcagagaaccttctttttcttgaacagtccttggagtaaaagaaaaagtgaaaacctcaaaatcgttaagtcttagttccattctcttgcctaatgtgagatcaaagttaatctaaacaaaatagcagcacttgtcagttaaagattttgaggggagaaaaaaccatttatttctttccatatcatacccattttccaggcccttttacactgcaagaattcatggggtgttaatgcacatctaagtccaccacagtactactcatctctctggcatttaataccctatcccctcagtgaacatttagagagcttgggcaaatagatcattgtttcccaaaatgtgcactgagaccgagggctctctgggatggtaatagattctgaagaaaataagcatctcataaattcacttgggaactgctgtgtctaaaaaaaacaaaaccatatttgtttacagcagaacttcttggagactgggagatgcactgggaatttctaagagggggatatagtaagtagtatttcccaagacttagctgacaactaactcctttggggtgagatgtcactaacctttgttctataaaacacaagctggagaaaaaattgaccacatatctacaattcaaccatgcgtatttgtgaaatattttctctgaattacgttaaatggcaaatcaaaatatggaaagtatcattaagaatctgactgactgggaaagaaagactgggagaaaatttctgccctttctttggctagctaagcttctgatgtgttctttctcagctgtattcatttgatcaataataataaccaccacaaaaaccacttagttccgtacctttgttttgcacatgagaaaactgaggcccaaaaaagttatctgctttgcctgaggtcattcagtgagaaagtggcagaatatggaacagaaaattcaatgttccacaatccaacattccctgaaattatgtttacccaatatgtactctggatgtaattatatatgtcaagataatgtataagagctaaataagtatctatttaactcagattacaccattcttctgattaagttatagtaaagcctattaatttctactctgcaaaattggcatttgtgataattcagctaggtctaggtaaacgtgtctcttgtattatttatgaagaaggaatatgtctaatataaacacaagtagcacaggaaacacttaattcatatacgacagacaaaaaaaatgatttggaaacatcttaacagtaacccaccaagaactgagtttttaatctacttttcatctatttattaaaacatttttgtaatgttttgttgtggtacttaaatcttgaaaaataaattggcactagaaatagtaacagcagccttgggttaacatgtgcattctctaccatctctccccatcaacccctagaagtcaatgttttgttccaagtggaattaagttttaaaagttaatatattaaaggaaactacaaaaggaagcagatgacagaacaataggctgaaaacaataatgcctctctgatggaggagtatacctttgtctttattgacagaaagtcaactttgtaagctaaagctgggtgtgtaaacggccttctcccctgcactggatctctgtaccattccaattttagtatatgtgctgccaaagtgagcactgcactggatctcttcttgagttaccacccactctgtgggggacatctcctctgctcctactctgggagaacttcccattcatttctgggagagatccctcccctctctccagaggatccccactctatctgcggaagatctcctccaccctgtgggggatcctcatcactctcaggggcattccctctcacccatgggggataggagcaatctcttctactctcacaatttttctaccatccatatgttaatgactcctaaatcctttgctgtagttggctaccttaaatacttctgtaggggaggagcaaagaaaataaaggagaggaagaaaggtggtatctctagggctgacctcacaccagagcactatttatgccctaccagcatatctaattaaccttcttctcatctttgtccataaaccttattctccacttctattctcaatctgttgttagcaccagccatccaccagatagccaaacaaggacttgggggttcattctatatttctcaattgccctgagaacctacatccgatcactctccaaagtctgcttcttttaccaacaagattttaataattcttctgttttgcctggagaaatcaataagtctcctacctggtctgcatggctctggctttgttccaccctcaaaaccatgctcaaatcaagaaatccccagaagtccctgtaaaacatcatactggctccatcacattcttgcctaacacccttcagtagtaccatgtcacatacaggacaaagcccaaactccctagcacaggttcccatctagtgtctgcccacagcccagcctcactgtcatgacgcacactctgtgtgatccaggaactacttgcagctccctgcaatgtctgtgcagcttctgacctgtgtgtttttgctccagctgttccttcatcctcaccctcattccgcaggactcagctcaggcctcagctcctccaggaagcatttcctgtcatctgggatagtctagctattcattctcagcactcctatgataccctgcagcagctgctgctctttaacattgctccccaactctttcttcatgatgtgtctcatccttgggggcagaggcagtttcttactcatctgcgtatacccagttcctattacataatgtatgccaaataaatgtctactgaatgaataaaacgagaaaccagtaatgacaagcacagacccactaaggccaccttctttctgagttcctcctcagtcccaagaacccctgccaaattctaggtaatgaccccgggtaattacatcaatttgccatacactaaaaattactctaatttaaacttcactaatttggctggcctttccaagtcagttttaattaatgatgttctctctgttgagatatttcacatagagtattttctggactgaattattctgtgtgcctcagttctctgccactttccatgggaagagctttgtatagtaaatgacaaagtttataatatttttaaaagttcctgttgaagatatttctcagcagaatagtatagccacctgttttcactcaatcataactcctttcctcagccaagcttttttaagcttggtcccagtcctgtttttgtttttttttttctttaggaagaatttgagaaaaaaattaaattgccattctggagtaagagaagattgaaaattattaaaacatacttcacattgaaggtgtaactgcttttggctcagaataaccaacatatttcaaaaatgtattcaaactacatttaatttagtatctagcttagtctccctcacgaaatcactgtctaactggcttaaagcaaaataaaatatttttaagcgaaaaagaactaaagctatcacttctgagtaaatgcaatcagcacaatattttagcaaaacatcacgatttataatacataatgataataaacatttctgccattgaggtccttagcactgcagagaaaagaaaggagcttgcccctgggcttgtaatctaaattaaacaagcaatataagtcgcacaagtttcacaggtgagagttaattaacattttatcccaagcagtgaaggaaaggggaaagaaaattaaaatcaatattaacagcatcagaatttacttcaaccttataggagtcatctgaaacgtgaatataatttgagaagcttgtaacactaccaagcctgcctgatagccccttactcctcctcctacttggctatcacctaaacagcatatttatggggttgattcttgtgcagcttcacacagccaatgggcagaactgcctaaagatacaggatggataagacgaactccaaggacctgttcctgttttatgacacaaaaattttctcctagctttttgtcttcctcactccttatgacaaagcatgcaatgacagaaaatacactgaacctgtattcatttcacactgtttgttcatgagaatatactctcaaatcctcattaccaaagactatttgaaattgatttataaacaatgtgagcacctagaatgtgtttccattctcatacaattcacttcattttctaccaagtcattgaaaaatatgtaccaagtaatggtgagcgcccaatcagccacctactatttttaaaaaatttagaagtgaactagcttcccactgctaaacactgaaaaaccaataccaaaaacagtaccctaaagaaaaagacaatgcacaattacgtcaaagaatagtaagatatgttgcctcttaaatcttgctccaaggttttcttaaatgagaatccacacaagaattagttggtagatttaaaaagttcagagggcagagcatgggttcaacaatgctgcctattgatgtttttggtttactggcccccaacactcactgcattttctctggcctttcattcagccccagtaatgcaagacaaagcaagttctccacttgcccattagactgctctgaatatggcaatgtcagtgcccatgttgcagacagtgacagttcacatcactgacacaaattacatctaattgcacggaggcacacatgctgagtaaaagacggcccacacctaactggctgggtcagttgcaagacagatctcgctattatctagtcccttcctggaaacctccctccatacctggtgaaggattaaactcccttcatacatgaagaatataccttcatacctggataaccagacccatctcccacaacaccgtgagcattatgaggctggaatacaaaaatataaggatttcataaattctaaataattttataccatacacataaggaaacagtaataacaagaacaacccctgccccaccacctcccaaatacaacaaatggtaggtaaaataccttctgtgcaacagaagagcgaagaccagatagcaattcccatatggaaggcacagtaactgtgctattgaaaaacaccatcagttcagttattttccacacaaagaactgaaagataataacctctatgcacaaatgaatcttgggctttacaaacatgtcagaagcatcaaaaggcattagagtaagccacatcgtatgaggcgatttatcctcaactttgtctgaatgctccatagaaaaagacctagtttttcaatacaccaaaagcactgccctttaaaaagccttctcatcttgccttgtaccagacacttgttttccaaatataccctgttcagattgctgatcttcaggttcaatccttcactaaaagactttctgcatcattgacataaaaaaaagcttgagttattaaaggttgaattgtgtccccctaaaaggaatattaaagtcctaacatccagtacctgtgaatctgactttatttgggaatagggtctttcaagatctaatcaagttaagataaggtccttagggtcagccctaatctaatatgactggtaaacctataagagagaacagagctcaggagttcaaggttacagtgagctatgactgtgccactgcaatacagcctgggtgccagagtgagaccctgctcctgccccccaaccaaaaaaagaaaagaaaagaaagaagaagagatacaggcagaacaccttgtgacagtggaagcaaagattgaagtgctgctgtgtaagccaaggaaagcctcaaggacttcggacaaaacaccagaaacaagaaaagattctcccctacagatgtcaaaggagcatggccctctcaacaccttgattttagacttctagcctctggaactaagagacaattttgttgttggttgttgttgttgttgttgttgttgttgttgttgttgttgttgttttaatccacctagtttccacttaatggcaaccctagagaactagtacaagggttgtgtgttccattcttttacctgcaagcagggctgcaggtaaaaattaatcctgataggcagactgtgttagatgctatagaaccttctgtaatctatcctaatggagaagacctcccaaattagaaattcttatctgtaaccaaaacagaaacaaaaaagtgttactccaattcactacttttccacctgaaagtatctttgaaaactgctgaggtcatcctgccttcctttcctaaggaaatcctcctggaggaggcaacaaggcaaatccaaaaggaccagcaagcaacttttcactctcgtcatgtgtttttcagaatacccagatctcaaaaacttcatgcttcaacatccgtgggtatgagcacataggcaatgacaactctctatcatttaatgaaatcacagcatgcaccactagcaactgggaaaacagagcattcctattgaaggcgctataataaaatgtgctctaaaggagtttctggtttgctcggtttggaacaaagacatatgagatacagtcacaaaaatagaggacagctctggaagacagaatcagagaacttgttgttagctagttatgtttttagagatcccataccataattttacagatgagaaaaatcatgctcaagatacatctttgaggcaccattgagggctctggcttaggcaggctttctaccagactgtgatcccaatgcttcccacctccaaaggcaggatgataatatttattatgtgcttcagatatcccaactaaaacttgttttgtttgaaagaaaaaccagttttgtaagaaagaaaaaagaatgtctatcattttaaagtggaaaatgaggaacatattaccatgttataaaatccccaaatactcaatgtttaaatgtatcagaaagcatgacatttaggacaacatgctagtaactgggcctttaaagaccacaattacaacctggcttttctaaacagacataaaaaattcctttctgctgtatttaacaaaacaatcatataataaaacatattacagtatttaccaaactgagacaaacaataaaatttattaccacccattttaattaatacgactacttgtggaatcaaggagggtaaaaggaaaaagggaaatgtgggccaggcatggtggctcatgcctgtaatcccagcactttgggaggccgaggcgggtggattgcctgagctcaggagttcaagaccagcctgggtaacacagtgaaaccccgtctctactaaaaatacaaaaaattagctgggcctggcagcgtgcgcctgtagtcccagctacttgggaggctgaggcaggagaactgcttgaatccaggaggtggagattgcagtgagctgagatcacaccactgcactccagcctgggtgacagagcaagactcagtctccaaaaaaaaaaggcaaatgtggagcaaaaataaaatgtgagagataaaagaccagggataaaaataattcaaaatctctacagtggtaggacagttgaaacacatatatataatcacaccagaagatcactcaaggttaaagcttaaaatatctatccttccatttaggggtgaccatagcacagacaatgacaggaagaatccttgcttctggaaacttcccgtaaaagtgcaacattacagaaggtaaagtgagcaacagacaatgatgatcaaaacccattttcaggactaactccttccatttcccttctttcattgatttttttttaaacccactttgcactcagtcagcttggttgcagggaacatcgtttaatgtaccttattgattcaatcatacacatttatacttgtgtagaaacttctgctacagtgcatttattgatcttttaattattaatgtaagccacaaaacctgaagagctttattgtaaatattttttattctctcaaattatgacaagaaaattatcaaaaattgtcaacaaatgaaacatggtagtttgcttatttcctctgaaaaggctaatcaaccggttatgtatcaaatgtactgtcaatgagaatttttttctaaagtcagaattatataagcctgaacagttctctgatgaaaactttaatttctagaattattattactgtgatgcctttaatttggctctggagatggcaagcaagtgttccattccagtgtggccattttcaaattgcacagagccatcaggtgagcaagctgtctgtcaaaatggtcataagataggatcctgtgctaacggttgtggacaaactgtgaagtggcatgcattgtctggtgaattactttatcccgcttgtctccgcagtatggccctctagacctagagtaagatacattctcacccagatactctgtactatattcaaaatgagaattaaggggactgtctaggtgggaagctctgcagaaccagccaccaggctgtagcaaaaggcaggttctgcaggctttagaagaagtggaaggggtggggctgagttcttactgaagaaaagggaggcagaaaacacatttaggttcaaggtggaaagagatgaaactttgatggtcatcctttcccatgcaaacttctcccccatctctccctctaaatactacttcagctagccttaaatagtcaatgtaaacttggatgaaccaactgaaccggaagatactgtcttaacacaggcttaattctaccctgccatagatgatttccagtggaagccagcttcatgcttacatttcttttagaatactgaccagcaaatatgtttgccattgcaccttatactttccaataccaaggcaatgatgtgtgtaataaaatcaagtataacctctaaaaaacaccccagaatttgaaataataatttaaatttgtgttgctaccttctagagtctgttaggtttttccatttctagacaataacaagaagacctgccacttccggactgaatggtcctgaatatgaatagaggtgtcacatatctaacatggagcactaacagtaaataccagaaagcctgggcacttgactagtgacagaagcagatatcctcaagcaaatgttgctctggatctctgaagaatctctgcattgctcagcagtggcaacaaatgcttgaatagtctgtcaggttcaactctcttccaagcttcactgttccggaggccacagaatgctgcttctgtttggttcagaccttcagtgaactataccaaatagatgggaacccttcctcagaactgatctcactagccaaggacaccgcccatttacatgagttatatacattacccaaatgcatattcaacatatttataaaccatgagtgaaaagctgaataatatattcacaactaggaaggagactaggattggccttctaaaagggaccacgtggttaaagatctggtatccacaaatacacatgtcatcaaacaagtcataatttgtgaccatcatgcatttaccttgacttttattatttaaaatacacatacagctaatttgccaattacatagaacacacaatgggcccttacacagcaaacatacctactaatgtggtgtctaattcttactttgttctatatcccccacagcagatcaaaaaatcagccttactgaaataatttctgataggaaaatttgagctatgattttaaaccatttttgtgtccttctgaagaattcctactttaatttagacccaaatcaccataatcagttttcttgaaaaatgatacgtaagtaaaatgtgtatgaaaatgttattaattaaatggtattttccaaatatcttaaagtattagaaatgccaaattctttagagtatgaataccttcacaaaagcccttttacccaagcttaaagagtacatagtacatgataccacctagaggaaaataattttataaattaggccatagtattttaaacatgtctttaaacagtttttcaacataacaatatgtagttatagagccaagcatataatcaaacaatgcagtaatttaaagttctctgacgttaaatgaataaagaaaataacatattatattgaaaacatctagtctatggctaacattctctcaggccatgtatagaattacaaaggaactagttcttaaattacccattttaaaaattagtcaatattaacagtctctatttagataatccaccactcacccacatttaaatagaaacaatgttttcatttactacttttcaaagagaggtgtcttccaaacaataattctttagttgcatatcattagaaaggttttgaaaaaatatataaagcaagtaaatgtcccacaagcataccaagatggcaactgattcttcctgggtaatgtttgctcagttatttacagtgatatttgattatagtaatatatatagatttttttgttcccaaactctgaaaccattttgcctattcatgctagttttgccaatcagtaactcaattattaaggaggtccagcactcatcccaattaaaactgcaaagcaagaggtattgccttttacctggcccatttctgctttcatagtccttccagtccatttcctctctgaactttttttctcaattagcacccaggtcccttaccctccatactcatggcttagcggggttgccctttatggacagtgcccatccttccaaaaatggacaaatctgcaaggccacactaaaataaaaaaactatcctatctcccatttcctctatctccaactgtttcctaggttccaactagctaatcagattaattgacaccatttgttcactaacaatcttacactaagtcatttcttcaacaaatatctactatgtaccggcatttttctaagtactggggacatactggtgaacaataccaggccaaaattctttccttcatcgaaggttaacacaatgttatcaattaatgataaatatattggtgggtgtggtggctcacacctgtaatcccagcaatttgggaggccaagtcgggcagattgcttgagtccaggagttcaagaccagccttggcaatatggcaaaaccccatctctactaaaaacgcaaagaactagccgggcatggtggcatgcgcctgtagtcccagctacttgggaggctgaggtgggaaaatcgcctgagctcaggaggtggaggctgcagtgagctgagatagcaccactgcactccagcctgggcaaccagagtgagagcctgtctcaaataataataattattattattatataataaatgtatttatttaaatatatataaacgtgtgtgggagttagatgattctaagaccaagagagaaaaataacataagaaaagagctgttgtgatgaggttgtattttattaataaataagatggttaaataaagtgatggataaagtctaaagaaggtgagggaggaagctgtgtgatatacggttaacccttaacagcatgggtctgaactgcacgggtccacttaaactcaaattttcttctgcctctgccacccgaaacagcaagacccaccccttctcttcctcaacctctcctcagcctactcaacttgaacacaacaaggatgaagaccttataatgatgcacttccacttaatgaatagtaaaaatatattttctcttccttatgattttcttagtaacgttttcttttctcaagtttactttgttgtaaattttgggggagtcaaaagttatgtgcagcttttcaactgtgcaagtggtcggtgcccctaactcccacattgttggaaggtcaactgaatatggggaatgtgttcccagcagagggaacaacagattcataagtcgtgagttagaagagcgacatttctgaggcacagaaatgaggccatgtgcctgcagtggggtaaatgagacaaaaggtagtaggtgttcaaggtagggaaacaccaggaaccactggaaggactttgcatttactctgaaagagaagggaaaccattggagggtttttagcaaagaagtgacctcaaccaatttaccttttttttttaacacctttactgagatataattggcatatgatatccattttagatgtgcagttgaaggagttttagtatattcacagagttgtacaatcatgatcacagacaactttaaaacattttttatttttttttaactttttaagttcaggggtacaagtgcaggtttgtcacataggtaaacatgtctcgtggggttttttgtacagattatgtcattacccaggtattaagcctagtaccaattacttattttttcctgatcctctccctcctctaccctccatccttgttactccaaaaagaaaccccatatccatcagcagtcacttcaacctccaccccaaactcttggtcccaggcatttcttataaatggagtcatacaatatgtggtcttttatgtctggattcttacacttcacatgtttttaaggttcatccttgttgtagcacgtgccagtacttcatttctttttatcgatgaataatattccattgtctagctatatcacattttgtttattcaacagttgaaggacattggcgttgttccctctttttagctattatgaatagtgctgctataaacatttgtgtactagttttgtgcagacacattttcagttctctcgggtaaatatctaggagaagaattgctaggtcatatggtaactctgtgttgaaccttttgaaaaagtgccaaactgttctccaaaatggctgaaactttttttttttttttttttgagacagagtcttgctttgtgatccaggctggagtgcaatggcgtgatctcagctcactgcaacctccgcctcccaggttcaagagattcttctgcctcagcctcccaagtagctgggatcacaggcacatgccaccacgcctggctaaattttgtattttcagtagagacggggtttcaccatgttggccaggctggtctagaactcctgaccttgtgatctgcccacctcggcctcccaaagtgctgggattacaggtgtgagtcactgcgcccgcctgaacctttttatattctaccagcagtgtatgagggcttcaaattctccatagcctcaacaacacctgttattattggtctttttgaatatagccatctaagctggtgtggtatctcatagtggttttgatttacatttcagagactgagtaccttttcatgtgctttttgatctcttcagatctttgcccattttcgaattgtgttatgtaccttttttattaagttgcatgagttctttacatatccaatatacaagtcccttatcagatacatgatttgcaactttttctcccatttcgtagattgctttttcacttttttatggtgtgctttaaaacacagaattataaaatgttgacgaagtccaatttatctgttttttgttgctgttgctcgtgcttttagtgtcatatttaagaaactgttgcctaatccaagatcatgaagatttacatctgttttcttctaatagttttatagctttaggtcttattttaggcctttaaaatatttttgaattaatttttgcatatggtataagagaaagagtctaagttcattcttttgcatgtagagattcagttgtcctggcaccatttgttgaaaagattattctttctcacattgaattaccttgcactcttataaaactaaattacattttaacagaatttctatagtcatattaagaatagacaaaatgggcaagggtagaagcagagaagccagttagaaagctattatcataaatcatgtatattagggcttgccagagaaaaggaaccaatagatatatagagacatatagaaagaaattatgaagtattggcacacatattattgaggctgagaagtcccatgatcgacatgctggtcaggaaaaccagtgacatagtaacaatccaaatctgaagggctgaggagccagtagtgttagtcctggtccaagtccaaaggcctaggaactagaagcatcaatgtccagtcaaagacaggagaaaatggatactcaagcaaagagagacagagagagacagagacagagagagacagtgtgtgtgtgtgagtgtgagagtgtgttagttcacccttcctccatcttatttgtctatttgggcccttgacagattagatgatgcccactcacattggtgagagccatcttctttactcagtctaccaattcaaatgttaatctctttcagaaacactctcacaaacatacccagaaacaatgttttaccagttatctgggcattctttggccttgtcaagttgacacataaaattaaccacacaccaaataagagataatggtggctcaaccaagagagtagcactggaagtggagagaagtggttgaattctggatgttttggaagttgagctgataggatctgctaagagactggatgtaggtgtgagataaagaaaggactcagttgactctaatatttttgatttttcagttagacaaactgcaattttggggaatagggacatgatcgctcaaactaccgtgtgtaaaatagactgggaacagggaattgggggataggatgaaagccttctatcctagaaacaatttctgtttcattgaaaatctactgagtccatagggcacatagatggcactagttaatgttcctttacagtgaaagaggctgtttattcactgaaaagagaatgccttgagggctttattagggtcttgaactgaactctttctgtctgtttgtataagaggttctcagaacaagttcagggttgcccagaagttgtttttagagaagccctgaagcctcatactttcacagaaggagaccttgataatctctcatcaggaatttatttgaaatgtcattagaacttcttagagacatcatgactaacctaaaaaaaataattaactgtgagaactacaaattttaccacaagacagtggagaaaacattacaggatagatagaaattcaggaacccctcaaatcacactcctccagaacattttcactggaagacaaaggagcctcatttcctattaactcagaaactctttcaagcatctgttgtggtagattttctaataggtccagcccagggggttctcaggtataaatcctcaagttctagtaaagcctcttgagaagatggtcaaggcacaacttgaatagctcataccactgaactggaaaaatgctcctaaagctctagtgtcctttgaagagacttgatcttcctcccctggccttaagagaggcaggtaaagcaggataagtactgcaacacacagggaagaaatgaaatcacgaagatctctctttctgcgtaaaaatggatgaatttcttcggatttagcagctgtcttagtctgttttgtaatgctataacagaatacttaagattgtgtaatttatgaactacagagatttatttcttacagttctggaggctaggaagtctaagattgaggggccaacatctggtcagggacttcttgctacatcaaaacatggtagagagagagccagagagaggggagcaaacttgcttttataacaaacccagtctcacaatagcaaactcactctcatgacaatgacattaatccatccatgagggcaaagccctcatgatctaatcacctcttaaagatcccatctctcaaaactgttgcgttggtgatggggcttccaacacatgatctttgggaggacacatttaaaaccacagcagcagcttttcactctctctatcctagaaacaacttccatttcagtgaaaatctactgcctccacagagaacaggaatggcattagttaatgttcctttacagtgaaagtatgaggctttctcatacttttcagggcttctctgaaaacaagttctgggcaacccactttaggttctgagaacctgttacaaaaacagacagaaagagttcagttcaagaccctaataaacccctcaggtcattcttttttcagtgtaccaacagctaatgaggaagctgtgcctcttaacgaggaaaggaggctaggataccatgccaaggatctccaagacacacaaaggaagatgtaaatctttcctcaggcctggtgacaagacaaagaccaaatggaatcctaaaatgggctctttggcagtcacgtctagaggaatggaagacgtgatgaactactctaggaactggtattaaaacaagcaacccaaatgtaaataaaagactacttgcttcaattaagtcttagctacaggagtgtgaactttaatatttcctcagtgtacatctccgctagtgctttcaccattattaaagtatgtttatacagggtttggctttccagctattatggaaaaattacatcttgccaacagtactataggggtctaaacacagcaaatcctccactgaccttgaacccaagctaaagcaaatagtcactctccttggtgctgaactgcctaaataatgcactgcataaatggctgtgaatctaaattacatctacaatgcatcttagcattacggattactaacaatttttccagaaggcagtgtttgtagaggcattgcaatgtgaaggaaattcttagggagaaaactggaaaacattcacttgcaaatgatgatcatttatttattgaacactaggagtatgctgggccttgagctccacagaggaggtagcagggtgatgacagtctctggccagaaggcttcacaagagtggaggaagaagatgatggttaacagacaatatgctagaggaaaagtaactgcaatagaaagtttgaagtggtgaagcatcatgagacggaacagaaaacaaaagagggagaagacaacaaaaatgccaactgaaatatctacttaatataaaattacacttccatttgaaccaaaataaaatttatccacatgtaaaagtgctcagaaaataacattaaatgaaaaaagcaaaatataaaatgattaaaacataaaatcatacatatatacaaaggccaaaaactggaagggaatacagagaaatcaaaaccacttaaggaaaacgttagaattgtggacatatcagttttcttttgaaacttcctttaatcatattgtaagaacacatacactatatttttaaaaggcaattagagtatatgtgaatattcactacagctctgtttgtgatggtaaaagaaatagaaacaactaaaatatccatctatagataacatattaaatgaattctggcatatacataaaatgagctgctataccactgatatggtttggctgtgtccctaccccaatcttatcttgaattgtggttcccataatccccagatgtcgtgggagggacccagtagggggtgatttaatcatgggggcagtcaccctcatgccattcttgtgatagtgagttctcatgagatcctatggttttataaggggcttttcccccttttggtcagcacttctccttgctgctgccatgtgaagaaggacatgtttgcttccccttccgccatgattgtaagtttcctgaggcctcccaagtcacactgaactgtgagtctttcctttataaattattcagccttgggtatgtctttattagcagcatgagaatggactaatataaccactttaaaaattgaggtatatctatttgaattgacttgaagatatgtctatgatacatggctaagcaaaatttttaaaaggcaagtgagaaaaatacatatggtataatcatatttatatgaatataaacaactatattaatatatgtcagtgtgtacaccagaaagaaaaagtttaaagcaatatacactaaatagaaaagaaattatggaatgggagatttatattttttatattaatgtatttctgtaggtttgagttttgtaaccttggattacatatgtcattagaaaaaaactttaaagaataaaaactgaattaaaattttaaaaaataactgtcatgttaggaaaaattctttggacatttattttatggtaacgagggttaaaatttaagaggagctttgaagggcagatggaggttagggcaggagacaggcagtgtaattaaggaaattaaaataagtggtcgataagctggactcttacttggccagtagtaaaccaatcaacactaagttgaggggtaacaggaatgagaaaatcacctgaacataaacataagagaaggtatttcatagagtacaacagatcactgttcatccatatagttctaagaaaaagtaacagggaatttttgaaagagagaagaaagtaagtagaaaaaaaaaagtgaggttgaaaactagtgggtaacggtgaataaaacagcacaaagaaaaactggaggaaagtacacagaatttatgaggggactcataacatatggccgatttaccaaaagctagtcaagctcaaagtcatctgactccaaatccattaacctgaaatccactttcttgttttgaaatgcaatctgaacttcaaacggcagtttgtctcctcttaaccagttcagcaaacttcacttgaaaatcaccattgttcatgctagtctgcatcaccatgcctcagatacttgcaggaatcggggcagccaaaagtgtttcagctattgggacctcccctccagtttagcaagctgggaatggtgacaagtataagtggcatgcctcagtataaaaagtaaaatgattggctctaccatttacagtcacatcacaacccgtaccacttcagattcctagtctgaaaaacgggtataatctccaagaattgtgagattcaagtaacaaacaactgagagctccatgcctgggacatagtagactctcaataaatatttctgaatgaacaaatgaaccaatgtgttatgatactatatggtattattattgtgcacaaaaagaaggtatggaaaagggtagtattctagtgaattctatcactgtagtaaggtcaagtaacttccttttatcatcaaagtcttgcatgtattgcttccactgccataactgcccttcataaacaagtttcccaggcatctgtaatcccacctccaactttgcaagtttatgtctggacctgttgccttctctctttagaactatacattctgcgatggtgagggttgtgtcttcacacttcatggacaggcttataaccaacaaaccatgcagaggagaaaacatgtctaagccttcctcaggcccaggcagaatcctctggtgccaacacctatgtggtggcaatgaaggcgattccagattctttggtaatgttgaggcaaaaacattttgaggacctagatgtgaacaggccctcaaattggatacctttttatttgaaggatataagattcagcaataccctctggactacagtttgttaattcaggtcctcagatcccaaagggatccatggatagaattcatggaagttcttgaattcagatggaaaaaaatcagatcttttgtcaccagtatctaactgaaatttagcgtttgcttcaagtaggaatttagacaacaaatcatggtagcattagtagtacttacatatgtgtcaccaacagaaatcacagatattttcatatctcactgcaattcttgttatctcaaaatattatctgtttatcaccactttaaaattagtggtcattatgtgctctgctaaatccaatacaatgtgttaatgaagaagcatgtatattaccataacacgagtttgttttaataacttgataactatttcaatataatcggctccttgtcattctatgtgttttatttcattcatttacatattttactctgagaaacagtccatggacttcaacagactaccaaagatgtccctagcactaaaaaggctaagaagccctgctccaaactataatgcccaacaattaaaagtattatgcaagtacaaatcccattacttgaagcacttttaactataaagatgaaaacattacttgagaatctgcaatcattctgatatgtaggaattatttacattgactaaaaagttctaaactaatggcctgatttacgtaatagagcagcctatgtatgaaacagtctgatttgagttgttattacattttagcacagagttaaaaacataagtatttctatcaaggacttggctttgaagtttgtcttgaatttactacctgaccttgggcaagtcggtaaacccagctaagccttagttttctcatctacaaaatgttgaaaatacctcctccttcaaagcattattaagagaattaaataatacatgcaaaatactaaataatggatacaaagtacttagcacagtaccagacataataagtactaaataacttacagcaatgttattgtcctattttacttattaatctaagtaaaactttatattgagtctttaagatgatttctttaaagtattctataattaaaagataagagagcatgttgcttcagaatacagactctaatgacagactgcctgggtttaaatttttttgtaccacttacaagctgtgtgcctctggataagttacttaatttctctgaggtttagttttagatctgtaaaatagggaaaatagtatctatgccatagggttgttatgaaggtcaaattagtaaccacaggtgaagcacattaaaacatgcctagaacatgatactttgtaattactagctattattaccaacagtaattatgtaatagtttcacgtcaagttacacaggagtctttcttcctctttaatctgaattttagtgaaaatttcttataaatggagtcagccacattaatcatactatttgcatgaatgtatttgacatcaataagaacaaggcagggaataaattcagctacaattatttacaaggaggaattaggaagaccccatttcctttggctttgtaaccaagttaaagcccatacaagaaagattctctgtagtttgaaatgcttattttatggcaacagatctatgaattacaggaataaacataattttgcttttttacctttgaacaggtacagagaggcacctctgtgcccaaggctggagctcaccttggagaagagagccatggaaatgctgggcttggtgacaacagcaaggacaacatcagcatcaagtagcaaagatgcacctgtttcccagcagggaaccagctttgctcctcacgggcaattagcaaggtttgacttaatttaaagcctacacaaccactgatctctgagaatatgactgatgttattttctgtactgagagtaacagtaaaacaacaataatgacaataacaagcacttcactcctctccatcttttaaggtagttgagtaattagtaactcaacaattagtcatcacagcaaaactatgaagcatgtaaaagtattctcaccatcatcttatttcagttttttacttatgagctttaagaattcaggatcctttgttgaatttattagtcctcccaacatataagacaatgaatattagagtcaaattatgatacataccccaataattcgactatactctaaaattaatacacatcaccatctccaggactaccaaaaatgcaaatgctggctggatctcatttttttaaattataacaattaaaaggttattaaatcaccagtgttaaaaagtcagcagcaataaacctttaggttttcacaagatgcacacagaggtctcccttggagatttagttttccaactcataaggctgaaggtccactcccaggaggaagaaaaaacaggaagcttctccccagagtaggaaaataaaatttggcatactctgggttttagtgaccaaagattatcaggaagtggaaacatctacagtagaatcagtgcagatgtgatcattagaaggctccatgctttgtgccagtattattatttccagcatcccttaatagtgtcaaaagcataacattccagctgagggattaatagctgccctaacaacagagcacacagcaggctttcaacacagcagggggcttttcaaaacaccctagggtagataggcctggtctttagtgcttgtaccatggctcaactacactgagataccttccaagtctccaagtatgaagcttggttctcaactccactctgatgtgattctgcagtgtagcacctttacaattcagattaaggcaagatctctgatctggaaccttttgtcaaacgagtcttggaacaagactgacagatgtcccctctacatcaacaggtagggtaaggcaaagacaggagagaaacccagaaatgtatatacatgtgtatgcagctacacagttgacacgtggtgcataatgttccatgcgatcaaatttctttcaggcccattcaaaacaaaatagttgcatgggaagtaataacagagaacctttactggttggaaattctcctcttatttaactaaaatcctacatatccttaatcactgtagtttagcattcattctagtgagaataatcttcctggaacacaaacgtggcctgttactcctcagattagacaccttcagtggctcccctgggcctacaggctaaaatcctaacactttgggatgacaaacaagacctctggtttggaccttacctacctctctagcttcatttacctctctggctgccaggaccccacattcctcgtaagtccccaaattatctgtcatgctccttcttatctctcaatgcttactggcaatatctctgcacctagaatgttttgtctttgtagcatttcaacaaatgcctattcatctttcccagctcagctaaggtcagccacccttgtaaagcctttaccaactttcctttcccaggagagacccactgcttttcttggactaacagaatctcctgcatcactgctcttctggttgccacagcactttactgcactgggtttttaaaaataggtttatggaataatagtttaaacacaataaactccacactttaaagtgtacaatttcgtaagtttgaacatatatccatacctgtgaaaccatcatcacaatcaagataatgaacacattcactatttctaaaacttttccatgcccttttgtcaactctctctgtcactcctctctgtccctcatccccagggaacgactgatctgctttctagagagtcattagcattttctggagtttgaaatatagggaatcatgcaatatgtagtctttatttttgccttgcttctttcacacaacgtaattatactgagattcatacacagtgtatgaatcaacagttcgttacattttactgctgagtagtttcagcatggataggctatactataatgagtttgtctttttacctgttgatggacatgtgggttatttcaagtttttgttcattacaaagaacactgctatgaacattcacatacaagtctttgtacagacacgtgttctttcctcttggggaaaaactgaggagtggaaataaatgagtcatgtggtaggtatatgtttgattttttaagaaactgccaaactattttccaacaggctgtgccattttacattcccactaacagtgtgtgaaaattccatttcctccatatcttcatgaacatttgatatggtttgttgctttaattacaaccattctactatgtctattgttgtattatctcactggggttttaatttgcatttccctaatgattaatcatgttgagcatcttctcatgtgcttatttaccacccatatttcttatccggcagaatatctgttcaattcatttccccatttttcagtaggttgttttcttattattacattttgagagtaatttatatattttgagtattttatatatgatttgtcatatatatttgaaatattttctcccaatctgtggtttatctttgcattctcttagtactatcttttgatgagcagaaatttttgattttgatgatgtctaatttatcaatttgttcttctatgaattgcactttcagtgtcatatctaagaaatctttgtctaacccaatctcacaaagattatttcttaggttttcttccacaagatttatagttttaggtgttacatatatgtccatgtggtgttcatttttgtatatattataaaatatggtttgatgttcattttttgcttatggatatcttgttttgacactatttgttgaaaaattaatcctttctccactgaattgcccccatgccttggtctaaaatccacggtctatacacatgtggatctacttctgcctctttcttctgttccaaggatctatttttctgttgggacaccagtcccacactcttttgattactgtagcattacaagtcttgaaatcagtcaaatttagtcctccaaccttcttcttttttaaaattgttttggctattccaggttcattgcatttcttttttttttttcttttgagacagagtctcactctctcacccagaatggagtgcagtggtgctatctcggctcactgcgacctctgcctcccaggctcaagcgattctcctgcctcagccttctgagtagctgggattacaggcacgcgccactacatccagctaatttttgtatttttagtagagacagggtttcaccatgttggccaggctggtctcgaactcctgacctcaaatgatccacccacctcaacctctcaaactgctgggattacaggcatgagccaccacgcccggcctcattgcacttctatataacttttaagattcatcttttcaatttaaaaactgctggcattttgattgggtttttgttgaatctatagatcaatttgggaaaaaatgacatcataacaatattgagactttttatcaaatacaagctttaactctctaacaatttaggtcttttaaaatttctctcaacaagattgggagaaatattgtacggcttctgcacattcttgtcagatgtatccctaagtatttcgtatttttgatactattgtaaatggcatttttgtttcagttcctgactgttcattgctggtatatagtaacacaattgatttttatttatggatattgcaccccagaaccttgccagaggacactggaattaagaattaagatcaacattttgatgcctaaggggacaaaagaagttgttcacaactacccatagggaaagacacgctgtggaaacacatttgctcaggagagaggagaaatagagctatatcctcagcatttatatttctatgcctttggcctagatagtttgagcctttaagcccatcagtcaagtgatatgggaaaaattcaaatatgtagtatctatggtttttcctaaaacagtttctgaaatgtgaaacagtataatcactaaccacataagagaaactcaggggcctattaagagtaatacgtcacctttcttttggtcttgattcttttcagttggtttctgcttttttccttatccaattacgaccagatttccttaataggaatctagtcctgacatttcagagacataaactgatgtatttcttctacgtatctacgtgtgtgtgtatatatacatatgtatacacatatatatacatatatatgtatataaatacacatatatatacatatatacgtatataaatacacatatatacgtatatatgtatacgtatatgtatacataagtatacgtatatacgtatatacacatatatacatatgtatatatgtatacattacacgtatgtatgtatatatacatatgtatatgtatatatgtgtgtacatacatgtgtatacatatgtatatatacacatatatacatatatacacacacacatatatacatatatacacatatatgcgtgtatgtatgtgtgtgtgtgtgtatatatatatatattattattattatttattttttttttttactgtcacccaggctggagtgtggtggtgtgatctcggctcactgcaacccccacctcctgggttcaagcaattctcctgtcacagcttcccaagcagctgggattacaggtgtgtgccactacgcctggctagtttttgtatttttagcagagacggggtttcaccatgttgactaggttggtctcgaactcctctacttgtatcttttaattttagcagcttgtttttttttttagagacaggttcttcctctgccacccaggctagagtgcagtggcacaatcatagcccactgcagcctcaaactcctgggctcaatagatcttcttgcctcagtctcctgagtagctggggtgacaggtgcatgccaccacacccagctaattttttaattttttgtcactatgttgccgagtctagtttcaaactcctggtctcaagtgaccctcccaccatggtcttccaaagtgctgggattccattcatattttgagtgactggtcttagactcctgactctaaaatctgcatattaatgtatgcctgtataactaaatctgcttctgttcttattgatcctgcatctgtaaataaaatgctggcttaacaatgcagcatttcctgcttgctgcattgattctccacaatagaaaactcagaggtcacatgtttctccatccttcaattcaccagaattctatctgctcaggagattaaaaaaaaaaaaaagataccattgttataaactccagaacacaaaacacttctccattccacacagaaaaaaatcaatgcatgttcctcatttcctaattgaaaggatttttggttaaacatgagcttttacagcttcctccacatctccatatgaccatcactgtcagaaccatcatctttgagtatgaatgacatgctatatgaagggcagagagaaatagacaccaggagaaaaacatacagaaataacatcaaagagtgaaatctggtcaaaattccctaacctgcttcttgtctctccaggttgtgtcacagtcattcaggaggcctcgggcactgctttgttcaggggctcatgtacccgtgaagctctaacacctctcactcctgcatgctctctctctctcactcactctaaataaccacttgtgggccttacatttctttcctataaaaaatctttaatgtttttacaattataatacatgttgacggtataaaattagaaagcccaattaagcctagataagcaaactaaaatcatcattaaatctagtactcagagactaccactcctaacatctggtacatatcctcccacacttttctcctctgttaaaacattttcaacaaaaataaaattataaaatcatccacaattgttttctaagttctaaaataggtaaaatggcaagaatacatgttgattactttctggtatgatcttagcaaaaccagtaaagcattagagataattggaccttaagccaaagccataaaataattatgatgtgagacctgaactatctccagccagcccatggttcattaccaagatgagcagaattaactagcaaataaagaaataccttactaactaaaaatcagaacaccatccctcagccaggtcatatgagacagtccagtccacagacaaagctttaagcaggctataaatatatgtggttgacacattcggggtgacatagtggaaaagagttgaggctgaattgttcctggtgagaagaacaaaaacttaagtgccagaggtccaaagaaaaaggctgggcatggtggctcatgcctgtaatcccagcacttgggaggccaaggcaggtggatcacttgagcccaggagtgtgagaccagcctggacactatggcaaaaccccatctctacatgatatatagaaattagctacctgtggtggctcatgcctgcagttccagctactcctcaggaggctgaggtgggagaatcacctgagtcttgcagagggtcaaggccgcagtgaaccgggatcgtaccactgcactccggcctgggcgacagagcgagaccctgtcacaaggagagaagagggttgaggaggggtgaggaggggaggggaggggaggggaaggggaggggaagggagagagggaaaggagaggggagggaaaggagaggggaggggaggggaggcagagagagagatgtgcatgaagtggagatgcaacacaccactggccatttttatgtgcatccgtgtgtctcattggactgggagctctcagcaggtatcttattcctctcttttatctccagtgcctagtacttagtaaggatttgctcattaggggctatcccagaagcagttgagctgaaattggacaggcaggaacaagtctgcattatgcatgttacaaaaaagatgaaaattaccttctctagttataactgtcccactgtgatttaggcaaaagccatcctggatatgtcacaggtaaatgtttgtaaataagcaggatatacttgggaggctgaggtaagaggatcctttaagcccagggttccaaccctggacaacatagtgagactgtgtctcaacaacaacaaaaacaacaacaaaaaaaaaaaaaaaaaaaaaagctggataattttagggttgtaagcatcgttaatccaatttcttaacatagacatataatattgattttcaaactcccagctgaatatttttcccctaaaacatactgtttccaaggttaatgtgtgttatgaaagataaaaatgtatgggagataattatacgagagacctgatatggtggattaattgcaaaatggccctcaattctctgctcctctttgtatccattccctctgatatctgactttgcaactcctcccatcaagaggtagggtcaatttccccatcccttgaacctggattggctttgtgacttgctttgaaaacaggatacagggggagtgaaagtgtgccagttctgagactaggtctccaaaggtcttgtgagcttctcctctctcagaattctgcctaccaccaagctggccagctggatgatgagacacatgtggttgtgtggcttggccatctcatcactccagctttcagtcagccaaccaccagacatgtgagtgaggacaccctcaaccagccggctctgagccactctgtcatgttagcacagatgcatggcatttcagcaaagaattagggaaatgcaaattaaagccatagagaggtatcaatacacacctatcagagtggctaaaataaaaaatgacaacaccaaatgttggtcaggatgcagagaaacaaagccattttacactacaagtgagaatgtaaaatggtacaactgcggaaagcattttaaaagtttcttataacactaaacacgcaattacctactagtacactcttggtcatttatcccaaaaatgtatgactttttttttcatccagccaaataaaaacctatgttcaaacaaaaacctgtacaggaatgtccatcacaactttattcacagtagtcaaaaactggaaactggaaacaacacagaagtctctcaacagattggccgggtgcggtgggtcacgcctgtaatcccagcactttgggagaccaaggcaagcagattacttcaggtcaggagttccagaccagcctggccaacatggttgaaacccaatctctactaaaaatacaaaaattacccaggtgtggtggtgtgtgcctataatcccagctactcaagaggctgaggcagaagaattgcttgaagctaggaggcagaggttgcagtgagccaagatcacatcactgcactccagcctgggtgacagagtgagactcctctcaaaaaaaaacaaaaaaacaaaaaacagataaatgtttaaaaacctggattactcctcagcaataaaatggaacaaattataaatacacacaataacttagataaatctccaggtagttatgctgagaggaaaaaaaaagacaatctcgaaaggctgaacactgtgtttatataacattcttgacatgacaaaattatagaaatggtgaacagatctgttgccagttcacagacagaggagggacaagaagagaggaaggtggatgtgcatagaaggccagcatgaggatccctgttggatgaaagtgtcctgtatctatgtcagtatcctgactgtgatattgcactacagttttgtaagatatgactatttggagaaattaagtacaaggaatctctttgcattatttcttatagctgtgtaggaatctatatctcaaaataagtttaatttaaactaattacctgaatggctttgggcaggttactaatcctaagccctggtttccttatctgtaaaatgggggaaaataggacttaatgaggcttaaattagacgattaaatgatgtttacagtattcttagtgcatgattagtattcaataaatgttactgttgatatttgtagtaatagtaacaacagtcaataaacatagtcataaattcaaaattttatttgttaaagttctaccagatttggcagggatggcagcaaggcagacagcagtctgagcaaaggaaaggacgctctgtttgctcaaggtctagaaaaccaagaaaaacagctctaccttacaaacagctagagaatgaaacagaaagttaagtaagtgaaaacctggcccctggaactgataagtttctttttttttttttttttttgagactgagtctctctgtgtcacacaggctagagtgcagtggtgccatcttggctcactgcaacctctgcctcctgggttcaagctgttcctgcctgagcctcctaaatagctgggattacaggcgcctgccaccacgcccggctaattttttgtatttttagtagagacacggtttcaccatgttggccatgctgatctcaaactcctgacctcaagtgatccacctgcctcagcctcccaaagttctgggattacagatgtgagccactgctcccagctgcttgaactgatcagtttctataaagctatgtaagtaaacatatatccaaagagtcatagaacctcggagttaaattagaacttaactcactgaactttttcaacccctcatgctatactgaaacagtctccacaatatctgataaagttgttttcttaacttctagtgatgaagccactatcttgcagagtaaaatataattgtttaactctaaatcagaggatgacactctaaactgcacatcagaatcatttgataaacattttaaaaataagagtttaatgattttcaaaggtatgactttttttcatcaccttggaagatgtctcttcagtgtgtagatacaggcaacagttaaagatactgtatttacttcttggatgatgtcttaatccagccagactacagcataatcaagctgcatcatattagggcatatccacccacccatccattcatttaacaagtaattactgagcatcttctatgtgttaagacaccatgttagatgctggagctacaactgtaagcaagagtggcatagtctctgccttcataaaatgtctatcaagagaagaaaataactgcttcattatcacaaaattatgcacaatggtggagattaaagaggggctttgggaatacctcataggatgcagaagcatctacttgtctgaaaggttatcaacaataagactctcttccctataggaatacactgagaaaatatagaccaactcttttttcattagataatgaaaagaaactcctcatttgtctgccatcatgaaagaatatcctggtctaagtgcactttgtagaaggctagaatgtatcaccttgtactaaaggtttatttaacatttctaaaaccaagtccttctaaaatgcaacattaggtactgccctgaatcactaaaatagacaaatgattgtaatttatactattttcagtgctcctggtaatcctcatgaatgttagtactatgtatttataccaggaagacacagaactctctgagggatgtagaggaacagaactcccactgcatgctgtcccctgccatctgtccatgccctcccccgaatgcctggaacccaacgtgtgcatgtttgccccacactaaacatccctggatcagtgatgcattctgttttctttagggcccgttgactccattagcacttgtccacactgcccacctctgccatcatccctcccttctatcctgctctcttcagctaaattgttcttctccttgcattttataagctggaacataaataaaaatttccaagggaatccaaacaactgtcatcatatataaagtaaaaagactctttgcccaaaacaaagttcacatgcacagaatttgtggaaaatattttcagtgggacaagaggcactgcactttcctgactttattccaggatcacagatattccaaaagcattaaagtggaaaaaaaaaaaaaaaacaagcaaacaagcaagcagatgccacctgcctggcaatgagcattatgtcaattatgattaggattatacagaattttccctagaagaagctcaaacatttgtactattatctcccttattttccctaaattcctgggatatgaaaaaggcaagtacaattattattattttgagagggaagctgagaccaccaagattctaagtgagctgcccaaagtcacagaaagaggcccaaaggtcttcctgccttcctgtcctcattctccttccaggaaacaatgctcccggagcagagatgcccacaagatacctaattttcccctcaggtatagaaaaattgaggcaagagaatgcaaattcctcagcactaaaaccagtgaaaatttttaatagacattttcaatctgaaggaaaccacctttatttcatacaaaaacacatggaactacctcagacgataaagaaaataccctcatgtttctaaatttgccacatggactcatcacatttccaaacaccttgaaattacttcagataaatgcagtaactctcagagcactttttatacagagaaaaaacacactgttctgtgagagtataaaaaactacctacacacttccacagaaatgactctgcattagcatgttacaaatatcaactccctgcccactatctctggatgtctgctcacttttcagcatgagactagattgttttcagaagaatttcattttgttgggagagcctttccttgctcttcaacttgagggactgtaggtcctccttcttcgcctctgcatctgctgaatttactcaggattcttggaatataacattttaaagtgctcaccatgttcttgcagctttaagccaaatctgtgtctccttccagctccaattagtaaaatattacaaacttttacaggaaaggaattggaaagatcattccaagtagtcagctgtagaacaggaagagaaagagcaataaaaaacaataaaataaaataaaagtgtgtctctgctcttctctagggtcatgctgcctcctcctacaaatataattaatgcatattctccttgtctgctttttctaaaccatatgtcctataaaactggacttactggtacaaggagaagggtaatgtttaatgtgcatgggtgtatctgagatggatagggctgctgagatatgtcttgagggatagctcagtgttggcaaaagtctgaagaattcatctggcaacatctcgattaagcgggaaactcataaattaaagcagctcaggggcaatttaaacttcattacccaggtcggtctggagctctaggatgaatgtaaactacagatgtagccacttccatttcctctaagcaaacatctccctccagttttcccattgctccctgtgctgtcaacagcctactattgagaagagggaaaggtgtgcaagttgggagctattattcgttccacaggacagccacgtttcagtcttctcagataattaggggtagataaattaagcttcacaatcagatttgagtttcttatcaattttctcacatatatagttaactatgagataaaatttgaatttaactccctacgattgtccctctatgtcttttaagtggtagtactagtaagcattgcactaatcaaaacacaatatagaaagaaatggagaagcacaacctaagtctctagcctccagtaaatgtaagccagtggcatccattttcaccagatgaaagttaataatctgggacaagcactcactcggaatcctagagtattgaaaatgcactcatggtagccagctgtgggaattaggcaagatatttacttcttactattgacaatgcaaaacaatgcttagtctacctaaagtcagaatatactttttaaaaagaaagtgtcacatatgaagcctctgaagcattacaagaaatatttatgggaaatttctatatttgttaatgtaattagaaaggtgtctaagtgattcaatccgttctcaattagccctactaatggaagttaatcaatgcaatggatagctgaaaaaggcaaactgtgtaaatatggctaataaattaactctctttattaatggtatatgatgcattgaatcttcttcatatttaactgaaatcgtcatttttggagaagttgaaaatcttagaaaataattttattcaaccttcttacttttcatccgagggaagttaggcttaaaatgtttcaggcaattacagtttgctaagtggaagagttaggccttgtctatgtctgggctgcaataacaggatatcatagattaggtggcttataaacaatagaaatctatttctcacagttctggaggctgggaagcccaagatcaaggtgtcagcagatccggtgtctggtgagggcccacaccgtggctcatagatggctgtgttcgtaccgcattttcacagagtgtaaagggggcaagggagtgctcctggctcttttacaagtcactaagcctattcatgagacccctgccttcatgatctaattaccggtggattaggatttaaacacataaatttctggaggacacacacattcagtctatagcagatcttaatctaaacatcccaaatgacatcatgaagtggagctacgaggactctattcaaaacaagtctgaaaatcaactagttgcttcagtgtcttctcactacaaccccaacctcagttcaaccctcaagcctcattcacttcccaaaataccagaaatgaatacctctgagaacttcctaagtacaatgtcagattgatttaatactccaacttgaatagaacttcatgtcctattatctttccatagcagttgattgacatcttccctgagaaagtaagcaattagcaattttgagctaaagaaaacattactgaaaatgttgctagcgtagaataagcaaaaaacttttagatcaataatgcctgtggaacaacataaaatgtgaacactatctagaaaaagagttacatgtattatcacagatatataagattcatagagaatttgtatcctagacctatgagaatttatctgattcctgaagaatcccaaaggagattccatggcttttcacaacattcccaggtagcccagtttaatgtttacctctcttaccgctgacataaaacacctatttaaaacctgcctactgcagcttaataggcatcctgtttattctaattttgccaaaacgaggtcagtgaagatttaaacaggggatacagtgcctcttaagtgtcacccagtatagctgagtgacacttcagaggcaaagtctaccttgtcttaattgcagtcacaaccctgaaacatctacaaaaacatattctaacaaaaagttaaaatgattggagagttagataaatccttaagatgtttgtgaaagaaaactctgcttgaatagagggccttatattccacaatgaaacatcctcacaaaggcagctaagaaatgagcccacttgtaacagcacaaccaggagccaggataattatgatggaaacactttatttcaaatcatgaaaagagttacacttgatcttcttgttagcaggggctgtgcagacagcaacatttactgtgaaatgtaaaggcagataacagctgatttgaaaggggattgtgtaaatctagttaaagagcaactttagaagattattttcaattactaagataacatcatggctctcagaaaaaaaaaacggaaaggtttgttctttacaccacatacagtgtacaaaatctaacaaaaacgcctgctttcaagcaataatatcagctaagagctaatatgccttaccttcactttatcctccttcttcaagttgttttcaattatttctaacatttcctcatgtctgtgaacaaaaaagttacttttcaatcagaagaaacagcttaaaaaacactgtctccttcaaaataattactaaagcttttacatttgcaagtgccaaatatacataatctgtgagccctctaaactagggctaaggtcatgaggtaagagtgcttgcaacttggggttgattaaaatgacatttgcttcacgggcagaacacttaaatgagaatgtctgggccttagcccccactcacgtcaccttaactgatccataggaacacgccctgacctgtacatggaccaaatgcaagctacacctctagcttaaatggataaccttgtcaagtgaaactcctagttgtcatattcctcaacatggcatatatagagggtgctaatgatgtatttagggagaaaaaaactaaataacaaagaacctagtctaaaggaaaaacatcaaactgggaagcagaaaaccctgtactttcccaactctgtcatttacaaccgacgtgacctttccaagcctcatcttcctgtactctccacatgttctcaacatcccacccacttaatactatgctccctggacatactgtgttcttctgtgtctctgctttgaatgacctccacctggagagccccttggagcctagcttagttcccttgtctatgaaaggcaccccaactcccttgtcagaattaatctgacaccctgctgtgcacccctctaatgcttggtaattatttgcttcctaatgctgatcacacactgttagttatctatagctatccattcctcgagtagcttaagtgctcctccagggcagggacatgtcatctttgtatattcagagctgcagtaacattaggaagcactcagtaaacacttacgaaataaacaatgaatcaatgaaggaatgaatgacaaactgacttcaccaactttcaatttcatcacctttataactcggaaaataatcattacccagttcgttcagaaatcatagtgatccaaagatgcaatgatgcttttcacatcgttaggtaatgattataataaagatagtaatgttaaaaagtcataacatacaaatagagtatgatgtcttcacatacagtctgcctatactcaatttcagtatctttcttctcataaaaagaaatttaaattttagcaaaaggagagacttcattgtccaaaaagtgttcttatgacactaaaactaaatctctaaaagacaaaagaatcattagtcattttatatgtgcttctccttccattgattagctgcatttttccgcttggacatgtggctagacacagattctactctgtgatatgcactggacactgcatattccactcccgtgttgccacctcaaaacattctaaaagcaaaattgcatttatctggaaaaacaggtccctgatgcactaaaggactgaggcaaccctttgaagaaagggactgagggatcctgaaggtgcacaggagcagtgataatggtctcatatttcaactgtaggtaactgcggactgtatgttaaacattttcctctaaagacctacgttctttctaaccaaaacactttcttgtcacagagagagaaagaattatcttatttgattaaggctactgctgtaacaataaatcccaacacagttcattcacttgaggaagcatagtatcctagccacgcactcaagccaaagcaccacaatcgtcccagcctccgggacaatggggtagcacactgctatagctcaactgtagaaaggtaaactttggagcactgaagtctaaaaatgtattcagggaacggttatgagcttgtatttcatgattattttaaggtgacaaataattaaaattatattcaagtcccaatgttcccattgctcagaagagtaaaatagacttggtttctaaatttgtagacacagacaaggtcaagctacggacagtcaaaaaccatccaaaaaaattaaactaatttcatcatggaacagaagaatgggaattgagaattctcactaaaaagatgaaaaggatatcccagctgcaagttatcataagctagttggcccatcatctgcccggctgcagctgtatccaactctcagctcacccaaagagattcacgctctcatggtgccaaaatgaatgtctctcttaaaaaaaaaaaaattgcccaattgaaaataactctctaatctgcatcctttcaatagaactgaagtgcacttcaccaacacagagcacaggcatcttgaattagcagagaactatttttaacacatgaaggatacgatatgaaattagtttcacggggaatgagaaccttggagattatttactttgccttaattactctgactcaccattaatttagctttcctagggcactaaatatttcacgctaagattttcagtataaagagacaggagcaaaaatttggagcactggaagtttgcagtggcatcttcaacaatgaaacacagatgtccccattgggcactgaaggccattcaagtatgcactgttcaatgacatttttagttactgtttctgtgttgtttttaaccttgggatcagaacctgtgccctgaagtatgcagggagccaaactttatgcagcttctgttttactcctcagccaacaatatcaccagtgttcacagctactcccagcaactgccaaatagggcaggcagcaattgcctcacgccaaggagggaaaagtttagactgtgctttaaaaggaagtttctaacaatcagtgcaattgggcaatgaagtcaattcccaataaaggtgactaaggagacagtacagcagatatgctgtaatgggttcattagagcatcagtgggaaataatgcactcagcttccaccaaagcacttacagtgagcagggtctgtcatacacagctgggcacttgccaaagccctctactctcccccatggctcttaatcagttgtccactggcagacaccacaaacatgggcagtgcatagcagccggcaggagcctgaggggagcaatacactggatgccagatgcaataccagactcactaggaccactcaatctgtcagtgccctccagctccacctggcactcagcaattagagatgaggaggagggagagagactaagagagtcgggggggagcggaggggggcttcttttagtggatgcccacaaagaactgttccatattctaaatgtcaaatgaactggttctgtattacataactccattccagtgagcttaagccatatttttccccactaagtactctacaacctaacattttccttcttacatacatacatttttactctgataaagttgtgctttcatttatgttgtgcttttcctcctttttgattactgtttaattgttctatatccttctagcattctgaacccaaaaaaccatagcagacaagttcagacatctccaaatcttcaccaatcaaattttctgtaatgaacatatgcttccatagtaaacatttctaggctgagtgtgttggctcatgtctataatcccagcattttgagaggctgagtcaggaggatcacttgaggccaggagtttaagaccagcctgggcaacatagtgagatcctgtctctgcaacaaaacacaacaaaacaaaacaaattttaaaactacccaggcatggtggcacatgccttgcagtcttagctacttgggtagctgagatggagatcacttgagcccaggagttcgaggttacagtgagctatgatcatgccactgcactccagactgggcaacaaagcaagatactgtctcttaaaacataaataaatatttaatttgacaataataagtactaacatttctttagcatatttacagctttaaaacatacatacaccatattactttatctcatctatttttaccacttggcctctttccatgtttctcatgctcatgaatactcccaactagcagtcacttttcacaagtaagcctgttcactttgtcattgtcaatccgatttcctcgttgtctgcctaggtcacaaaccttacttgggccatttacactttcagtcacttatcatttacaattattaggtgaatctctccaatgccatatctcaatttcaatacttaacactgtgttgcttattttctagtatcagtgaaaataaaataaacaaattgctattagttaatttctatttgaggagagaagaagcaacatggtgaacaatgtggtaaaggaaggtgttcagaactcttgctgcttctatttaccagctatcacagtgggcaagttgcttaatctatgttttggcttcctcttattgtcattagaaaggctgccatgaggattgaataggatgacatatgcaactgtgcctgaagatactcaaaagacattacccataacactgaatcttctgctaggtttctaaatgccctctccttcacattaataaaggctactatagcgaatagcacccctctgccactgggtccccacaagtgtgccaccctaatgagcttccccattcacttcctcaaaaggatgaccaaggcacactaagtgttgccacccagaaatcactgatttctaagttaatttttttttttactaaattcaactgcaagaatttcagaaaaactacagttgagagcagagagtaagtgcatagatggccattagctccaagcactttcaattatgcttcactggtctttacatcctatactggaatggagaaggagatagtaacagactgactgcagagcaagcatgtattgacagcaagatacaggtggccactcaggggctcccaaatagtctatctctaggccatcacccaccaagcactaggcttatggctggtagaatacattcctctccatccctttctctttgccttcctcgtgaaacacttaaaaaccacaggagctttgattaacctcaaatgatgtcagttccaatttgtcatgctcagagaaattgtgacacctgaaattctgctttaattctgaagcctccacttaaaggttcagagacttaaaaacaaaagctcacaacaggcagttgagggatatcaacgcctaactggcaatagtgtagtttcatggcttagatggcttatgtaaaatgcaaaaggagcgtatcttttgatccagcaatttctctaataagaatttacccaaatgagataattgcccaagtgtagaatggtatacatgcaagtatgcttagagcagcaatgaattttagaatgaaaaattggaaacaaatgtctatcagtaaatctagagtaaactctaacaaacaccattagctgcctagtcagtgaggcatttccgcttcttctttaacaaaactcttagtttccaattcatgaagtttggacgaagttagcatatgcttctacccagatctgagacaatgagaaaatggcattccccctggtcacatgacctacaatggtgtaagtagaaggagtaaaagaagagaagctctttttctctggaaagttaatgtgctcctagagatgcagaaattttgctaccattaggagcatgaaaaagagtaagaaatagacaattataaagaaagaaatcctatatcctgattaaatcatgcctgaatcccctacccactggatttttcagtatgttctatttatgctagtttgccctgggaaatgtattacaatgaaaggcatccaataaaagtattcaagtcattaaaaattttatttattgacatggagagaggcccattacatgttattatgagttattatgaaaaaatggattatataatagtacatacaacaaaaatctcatttatttactttatctgcatatagtatacgtatgtgtacacacacacacacacacacacacacacacacacacagactcaagagatatgcctggatatatcaacaatggttatctctagtaggaattctgagtaattttactttctttttgtattcttctacagtgtttacccgggtgcaacaacagcatttttgtgggagaaaaataagcttctaaaaactagctatttactgattctgtctgtctctagtgtgaaataaatggatggctttgcttcatatccctctccaaacttgtgttccaggagaaaaaaaaaatcaagaaaactagccaggcactcaaattattatttcattataaaattccatgatgaagcaatgaaacccctttcagatctgaatttatacatgctgaaaaagaaacacagccagcggtacctaagtgtctttccagaagagtggaaataacattaatcaaaatgaaacatcctacagaagctgaacacttcttatcccaaaaagagagaatccaaggcgggagggcagaggcatagacagagcaatgacacagctgcctccagaaagagcaggaacctttgaggccacgtaaaagctgcaaaggggttctcagcactatcatattagacagatggtacctccctgactgtcgctaggtatccacatctttttttgtgtgggataaacccccgaggacctaacccacccatcagtaaaggagccttattctagtcactccaggctctccaaaggtaataatttcaaggaaattagaagactagatgttctctgtgacctctttcagttctacaattataacttaattaattaagtacattatatacattttgtgaagagagattctttgaaagacttttgaaaaacatgggttagagacatctgagtgctgtagattcaggctggaagtgacaggtctaagaggtaacagtgggtttagaaatatctaccaaaggcaaacagaagtcaaagataaaaatctctatttgtttactggtgattttttaccagagtttgtagaatcttcccaaaaagttctcaaaaactctggcttctaaaatcagttcattggtgtgatatctcttttttttttctttgagatggagtctcgctctgtcgcccaggttggagtgcagtggcgccatcttggctcactgcaagctccaccttccgggttcacgccattctcctacctcagcctcccgagtagctgggaatacaggcgcgtctgccaccacgcccggctaattttttttttttttttttttttttgtatttttagtagagatggggtttcaccgtgttagccaggatggtctcaatctcctgacctcatgatccgcccgcctgggcctcccaaagtgctgggattacagcattggtgtgatatctctttaaagtaaaaggaatcttataaagtaactgcaaagatagtaggataatttccatcagttccaaagttaatttctagcagttatttgttgcttttacaataaattactacactacttacatggtatttcatgatactggcattattcacagtcagacactattttgttctgagaaagtcacggtactcaaagaagataatctaaaataaacaccaagtatcaaattgtctatactacatgttggctttgggatcaagttaaagatgcttccccaaaaagcattcctcccactcaaaattacaagcatgcactaggttatccatttgtctattctgtgtctgattgtaattccctcccacctagatggactgttggcagccttcaatcctacagagcataaaaatgggaaagaagatcccagcactttgggaggccaaggcaggtggatcacctgaggtcaggagtttgagaccagcctggccaacatggtgaaaccctgtctctactaaaatacaaagaattagcttggcgtggtggtacacacctgtaatcccagctactcgggaggctgaggcaagagaatcacatgaacccagaaggcagaggttgcagtgagctgagactgtgctaccgcaccccagcctgggcgacagagcaagactctgtctttaaaaaaaaaaaaaaaaaaaaaagaaggaaagagaagagaagacaatactgagtggttctcaaacttcagttccaacaagaatcctttatggactatcttcagcgttctgcatcagtagcttgagatgggctgctagctataattttaaaaacaacctagatagatctgaatagtgtatggatcaccctttgtgaaacaatgatgtagatcattacaagaggattttgtcccccttacagataatcaaacctgatcctatgactctatcctggatgattctactcttctctacatttatggtcactattcttgtcccttgtccaggaacccaccaccatctattcctgcacttgaaaataatttccaaattagttctcttgtttctagtcttgccctctccaatctctcctccagaaacctgccagaagggttttatgtattacaaatcagaccacatcacttcccttaaaacccttcaatgactgcttaaggagtataggatttccttttggtggctgcacaatattgtgaatatactaaatgccactgaattgttcactttaaaatggttcattttgtgtcatgtgaatttcacctcattttttttacatggcagacaaaagcaaaagcaaaaacacttcagtggctctccactgcacataggagaaaatccaaagtccccagcatggtttactaggtccagcataattgggtcctaacctccacctcagcagccttgttcctgccactgttcaccctttctctctatactctccagccacactggcctccttctggtttctaaaagccaagctttcacacatctggacttcatacttgggactctcacctggataaccccaaccacccttcaggtatgaatttataaattactcttccatataagcctcctctgtcacttcaccctcattatgccctttcagagaaacccagttttttcaaagtacttatcataagatccaattacataattactgttctgtttatctgtttgatgtattttccagtaaactgtagactcccaagacaggaatgctgcttattttgttcaccactatgttcccagcatctcatgtgaacttggcacaacaaatacctattcattaggcacgcacaatgaatatctagcatgcttttctccaaaaacattaaatctctacaaaatgattaaaggcctataatcgcaatatgatatgaaaaataaaatgttagttattctaaaattcataataactagatgaggaaactcagaaacttcttagaatcagctcaatatagagtacatccaccaagcacagaaaacagcttctctaacttctacagcacctactttgtgatgcttgatagaatcaagtctctaatgcccaagaaaattccacttaaaaactctctcttcatgccacagcacattactaagtaataaggaaagaaacattgtgtacatctctgcagaaagatacaactgaaatggatcaaagactagaattcagaaggatgtcaggagaaactgttagctactttcacataggcatgactttcttgaaaaagggtgtatagagtactaccagaaaataagggctctggacttagtcggttctgagagataaagaaaacggaaaatggagaagaaactcacataaaggcaggcataattggtgttttgttactaaacaaactgctcttcagtgattataggtgtgcacgtgattgattttttccaatcttgcacttgtattaactagaaccctaatttgtccatgaggctgaagtgtgtcttaattacttgccttcaaagcttatgcccatttaaaataagctgatttcttttccattgtcagttcactcagagccacctaatccacaatcctcccgcccagcactcaccacttctgatcattatggagagcagaggcaagggatggccttacagacaggttccaaaaagatccacctattcataactgtgtgcaccagcccacaacacatcccccagccctgctctcactgcaagggcaacaaaacatcaaaacctgaacacatttaccatccatgccacaagccacaagcaatctttcttttcttttttctttttttttgagatggagtttcgctcttggcacccagactggagtgcaatggcgtgatctcggctccctgcaacctctgctccacaggttcaagcaatctcctgttcagcctccaaagtacctgggactacaggtgcctgccatcatgcccagctaatttttgtatttttagtagagacggggtttcactatgttggccaggcttgtcttaaactcctgacctcaagtgatccgccaacctcggcctcccaaagtgctaggattacaggcctgagccaccgtgcccaaccttttttctttttttagagacaaagcctcccatgatctttcacccaggctggagtataatggcatgatcatagcacactataatctcaaactcctctgtgttcaagcaatcctcccacctcagcctcctgagtagcttatgactacaggtgtgcatccctaatatttttattttttgtagagacagggtctcactttgttgcccaggctgctctcgaactcttagtctcaagtgaccctcccaccttggtctcaccaagtgctggaattacaggtgtgagtcacctcacctagcccaaaggtgatttttcagtacttgagttttcttctgctaaagctttgagttttcccaggcctcaggtcagtagacctggtggtgatctgcatggctactaattttaagattattcccatgtgtgctacaatgcctaaactgctcctggcatctgaggatggagtgcccacgattgggtggttgatgtgcccttttgaacatcttagagatagcgctaaagcttgttcttaattgaggctccagcttcctgctctctctgcttgacttggggcccccggagaaagaatgaagctgctaggggggcctacacggttgcaaccaataaaacctctttccaacagagacagggagcctgaagagtcaccacaatgccccactgccacccctaaggaattcaagttgctcttttgtgcctccttccttaaggcagtgtgtgtgaccactatggtggcccccagctttgctccattgacagaccttcttaatttgccttgtttgaagatgctacttgaggcctgttttttcttaaccaagcattcttattaatgttcttgacattgtttttatgatataaccacatatacttccggaggcaataaggtggaggaggctgataatactataaaaagtattttcatgcagtaaagtgccagccaaaccaaaccctatggagcagaggtatgaactgaaagccaacatacatttaggagtgaatcataagaccaatatgttagtatgttaatggtataatacataagagatgagtaagaactgctggtagaaaataagatagggagtgttagcaaatgagggtttgaaggacagaataacaaagacattggagggagattgccaagttgacaaacatgtatgaaaaagaggtgcttggaaaccacagtcgaggagggaatgaagaatcagcaaagggacagagattcctagtggcaggggtgaagttataaatgcaggtaacgtctaccccacctggaactagtaagatttttttggagtggaagaagctacaatgtcagaagacaaaaaatctcaccagatttataacattcccatgctttgaggaactggggaatgtctaattaggaaaacagaaataccttcaagattttccactgaggaaattaaatgcagagaattgactactcaggtgatggaggtgcagacagcctaccaccagatagtgaggtaatctagagattagcatgaacaggaagcactacctcccctggactatagcaggaagtagtattgctggaatctgtgggacaaagtcactagtaagcagctagaaccagagaaggtctgttgagcacaagctgtgctacagacgtgaattcccattgccagggatgctacccacagctagggaaaaaaaaaaaaaatcctgcatcacccttttccctgcggtctcccaccagtgcctcccaagggtaaaacacagcaagccagctgactcagaaatctgagaaagcagcctgcaggggtgagcccttcatatacagagaggaggaaggaagagcaaggaatgctgtacccaacaccagagaggaggatagaaatgctggtgaaaggaagaggagttccagtgagcttgaataagaagctccttttacaataggcatactttaaaaaggttcgcttgttgccatacaatggtcaccaggggataaataaactagaagttctaccttctggaatagctgactgaccttcctgccacattcaagcggcccctgatgctgctatgcagaatccacattggaaggggttggggaatttattctctgttacgctttcttcagttacaattaagtcaggactagtccaaacacgtgaaaaaaattcttaagaaaaattctacactaaaaaaggctgacttttaaaatgagaaatataatagtccataaaagtaaatacatatgtgcgcacacacgtacacacacatagttgtacaagtaaaactgaggaaatctgaataagattgatggattgtatcaatatcaatatcctgctaataaaactgtacactatagttttataagatgttatctttgtgcaaagatatcacaggatctctctgtattatttcttttttttttttttctgagacggagtctcactctgttgcccaggctggagtgcaatggcatgatctcgactcactgcaacctccacctcccgggttcaagtgattctcttgcctcagccccccaggtagctgggattacaggcgcccaccactatgcctggctaattttttttttttgtatttttagtagagacggggtttcaccacgttggtctggctggtctcgaactcctgacctcaagtgatccacccccttggcctcccaaagtctgtattatttctcaaaattgcatgtgaatctacaattatcccgaaataaaatgtttaataaaaaatagcataagtatgtacataatatccacaattaacaaggcttcttcttttctactgtgtatccggggccccttacactcacatgctcagtatttctactgtcagcactcttttgttctcgctgataagcaaagcccagtaagctctttgctgacccactccaccacttcttataatttggtcttttctttgtcattgactcaaaactacttttgcaaaaatatggggatgatgttgggttactattgtttgattattcagcctttgcatttctaactatagagagagccagaatattagtattcctacatgggacaattagaagcctgccttatcttatttcatatcttctaacaagcttcaacctcttcatttcataattaagcattcaattcaaaacagctctctttacagatttatgttttctttctctcactctctttacccctttatcccctttgggagctagtggcctaagaactggcaggaaaaattgcagtcaaaagcttggcattatgacagaacaagaggaaaaaaagcaaccccacccccagctaccactcattcacttagctaaaatataggctatcaaagcatcagggaaaacaacagatacaaatgcacagagtcatactaggtcttccagaaactgatggtggatgaaaatcacctcttcgccaagagcaaggggggaaaaatcactattcatcacaaaatgatgcaccacagatctctcttcagctctccttctctacaactccacaaatccttcccgtaaaatataactttcttcctttaatgatctgatagtgaattattcatactcttcaatttatctttccttcttttatttatgctcagacatgtactacttgactgtaaaaagcctaagattatagattataggcaagacagaggattcccagccctttcaggggtgccaagtccaatgggcagggcagggcagggcaacaggacgaggtggagggctaacactcatctggggaatggcaggtaagtgaccacatggcacaggcctctatgtcatgctgactgttttagagaatccatctcaaatcctttccgtacctccatccccacagttataccttagcttaggtactcatgattgtctgagcagtgccacttcctagctggtctccatgtccccaactcctcctccatcaatccatttcccacacatctgccagaatcatctttctaagctgcaaatctaaggagcaatgccctcatcagtaggtctctatcacctgaggccaggtctcccaaacttgcctcgttatttaaaaaaaaaaaaaaaaaaaaagcagattcttccatatcttacgttgaagaagccaaccttgtgacagaatttaagtacaagttatttatttggggaggggatcctaggaagtactggtagaggaatggagaagggagacagccacttttaaagcacaggttgtctagctggctatgactgtgggtaactgaggatgctagcatgttacccaactctctcatgtcactggctgaggtctattcctgaggccattaactgtgctgcactactaagcttccccacacacgggagagaaaccccaggtggggaataggaggtacttgcagaattgcatcctgaagcagggagtgtcagggcatgagtagcaaactgactatgtctgctgcaccaggccacatccctgaagatgtccattcagtgggtcttgggtgggatctggaaatcagtattgtgacaaacacatcatgggattcctatgaacagacagatttgaaaaacactgacaacattattaagtccaaaatctttggtggactctaccaggtcctccatggtctgtgtcttctgccctgctctccataccaacctccatgcacagtccacttgccagaacacattgaatctgtgcacttccctgcaagcagcatgttctcttccatgagcagcaactgtgccttaggaatctgcatgaggccgggcgtggtggctcacacctgtaatcccagcattttgggaggccaaggcgggcagatcacgaagtcaggagatcgagaccatcctggccaacacagtgaaaccccatctctactaaaaagcaaatacaaaaaattagctgggcatggtggcgagcacctgtagtcccagctactcgggagactgaggcaggagaatggcgtgaacccgggaggcagagcttgcagtgagccgagatggtgccactgcactccagcctgggcgacagagcgagactctgtctcaaaaaaaaaaagaaaaaaaaaaaatctgtatgatccccaaagccaaatacagtaccatttatatggtaaatgcccaacaaatgtttattaaagaaataatccccaaagaaatacatagtatgatattatttaagtggtattgaaaggttccctggacaaaaaaaaaaaatcttccctatgtattaaaatagtaggtacaattccactattaaaactaagcaaatacatattgagcacctaatatatgcaagacactcaggaatccctccagaaaagaactttaaccttttatcagcttttacactttgacaaagatgtgctgatacacagatgtgaataaaaccctacaaaggagataaacacctgggcagtggtagaaaggtaaagggcactcactgtaaaaggaactggaggtatgaaagactacctatcctgtgattctgtcagggttgtcttcagggacactacctcctccctcacaaagattcaacaggataaagaagaaagttttatttcaatggcacaaacacctggaattatgacttcttccagtgactagaaatgtggtacttgggatccagatggtaactctgggctctatcccttacatccacaatggcttctggggcttttgagatgctcaaggtactctcttgcaaatgagaccagagcaaaggctttggctactgaagtcattacagacctcacctgtggcttttctcccactgttagagatgttaacacagcaccttggtcacattccagtctggataattacattggggccagcaaactttaccctccagcaccaactaaacaaagtattcctttggacttgctgccataacctttgttatgctgctgtgggctattaaagggctattccatacttaggatggctgtatttgtggaaaataaatagccctggcattactttctatactgacaaatatattccaaaatatcattggctaagttggctattttggcttaaaatatgcagtgccagaaacaattagaaattacagtaatttcttctccattctctaaacttttactatccacacaaatgaagcttgaaatacttgcagcattacacaaagagggagagatgatgcattaattccacaaaatatatacttagtgtctgccatatgccaggctatatgtcgtaggtaccgggcactgttctcagtgctgggggttatgttgacagtgtaaatatgaaaattttccagagggagtaattcaaatgaattcttcctatgctgctacatttctaaaaatctgaatacattatttttacttgaaaaactaccatacacagttctcccaatcaaatactacttttgtccactattttttttttttagatggagtttcgcccttgttgcccaggctggagtgcaatggcgcaatcttggctcactgcaacctctgcctcccgggttcaagcgattctcctgcctcagccccccgagtagctgggattacaggcatgcaccaccatcccggctaattttgtatttttgtagagacggggtttctccatgttggtcaggctggtcttgaactcccgacatcaggtgaactgcccgcctcgacctctcaaagtgctgggattacaggcgtgagccaccgcgcccggccttgtccactatttaaataagagtctgtaggaccttaaactctatgtgtatgtggaagtatatgtgtacctaagagtgagaaaatatgccttcctggctatcctggagggtggcaaacagaatgctgcttatatatttatttgtttgcttatttttagcaatcatcccatttgggtgggtaagagtttacaggttataatagcagaagctgacataagaaaattgaaaacataaatatctcttgtttaaagctctttagtgtatgaaagaaacacaaatcaggccctctgatattctatcataggaatgaaaagtgacaaaaagaaaaaaatgtaagtattgtgtgtgtttgcacatacacacaaattatcttgcacatgaaaataggagagggaagttaattaaatctcaagattccagttggttaaattaaatgtatgaactaaagaatatttaacatcacactatgcaagtggatgcagaaatagttcagaaaattttaagaaacataacctttaaattcagattaatcctagtggatctgaaacaagtacttctcctagacaaattatatccagacagtggaaaatagattttttttaaagtgaagttcacttgaaatatgccaaattattattcttttggaaaatccttctagctagaataagttaatagcaggcttctaaaactaggtttaacatgctgtaaatccatttattcccctctacaaatctactaaagtacgtcttttctggtgaaaaggcctctttaatggtacttaatactgtcactacattgtttctccaatcagtcaatgtcaaggttttctacttaaggagttatattaaagttaaatgcttacttttgtcataaataataaacaatggaatacagattatttaaaatagcacacggaacctcaaaatgtattacacacaatatatatttcctaagtttagaagaaatgactaataatgcatatatgatccaagttttccatcctataatccattcattatcattttagcattaagaaacaatctgcactatcacctctctcagagatagatgactcatcttccactaacaggcattaggtaacacctttggcaagatggctttgataaaagactgaaacaaatattatgcagggacacaggcaccccacaaaccttaaagagcccagatcactacaccaacagtatgtccattgctttgtaggataggagattgtaatgagtgattgattaattagctataatgtacaggtatacaaactgaccaatacaatcttgagtctcattcctgttgaaaattcacacagaataagagattattaaagactgcccaaagctatagacaactaccaaagcaagggactgggcttcccagtttagggaaaggcaggaatcataggacttttagagattgaaggcacaatatattatacacaatgcatctaagaccacaatctagcctagcatgtcaatgttgattttttactctcaaatgctaatgtattttctaagtacaatattagaaattacattataaggtttttattaagataaaaatcttggttgcaaatgttatgtaaataaaaaacaaagaaagaataatcaaggagagaaatgagggggaaatggtcaagtgtgacccaggggaagacatcctgagactgggtctgtcaccagggttgtgtcacataatctcactatgcctcagtgttccttaatattaaagggtcaggctagagcctcagtctctacttcattcctagcaggaaaatcctgccatctatttaggtattatagaaaactcagctttttgtaatatcctaagagcacctggcagcagcagaaaatttgcttacgatgtttaatgagtgaaaagggaagaatgagaagggtctaaacaatcctcccaatcttgcatttttcagtttatactaggcttaagagggcaattgaagttagatgcttcatttcatcccacaataattcttattataataaaacatttaatattccttaaaaaacatccaaaaaaaaagaaacagcttcaccttactcaaatgaaacttagtggatctgtctcatttggagggttgcaatgcctgagctacagtgtgagtatcaggatgtggaagcagctgtcactgctttgtttttcattcacagtaggtggttgccaggcaacaaaatactattgtctgtttccatgatctattggccaattctactggtgataatgctttctacagtttaaaacagggccaccttttggacaaaaagaaatgagaaaaaattctaaggatgacaataacatatatacgaataaatacactgaatgtaccctaaaattacgtgtataaatatacaactgtgtgctgatagacatacaaatattttgcatgtatgcatatgtgattatatacattctcctacatacaaacccatctaaatttaataggcccacaacttgaaactaaatcccttagggaaatcaaggtatgaactagagaaataaaaacacagaattattttcttaacaatagcaataatttccaatttgtcacatatatcaaatcctgtttcttgaataggaggtcctccagtcagaaaagcaatcctgtctacttatataaaaatgataataatggaaagcctttaccatctactttagaatcatgtaatacgtttaatatgttgatttactatcatatgctaccaatgtgtacaaagataattcaaagagtgttgctgtttacaaccaagaatcttaaattttattcatcttaaaaataattgaattgttctccatggaatagcctcatgtgattccccactttgttttgatatgggtccctggggaacaacagtcatgctatgttactcttgcatatttcactagcttacaaataaaataacacacagtgtactcaatataaagttgtcaacattaacttgcatcagttgctgtttgtttcacattgacaaggcttctaaagataagaattacaatattcttagatgtacagacacaacatcaaaacagcctgaaggaattaaagctggaaaatgctagaggcaatcacgctttgaaatgaagagaaatcagtatcatttatacgtacacatatatttcttcaaaggctctaaataatgccagaacaatatgcattttatgcaatgctcatccgtcttccctcacaatattccgaaagcactttaactgtttaacgcatctcctccaagagggctttcactttttcaaactcattatcactttcaaatctgtatattacaagaaactggaatgagcaatatccattacatgaatagacattattaatataaagtctctatcaaagtggcaacgctagtaaaacaaaagcagagtgtgttaaccataaactaagtaccagccaatattaccactttgcttgacagagccgtctccaacagcacgcacccacctctcgagcgggcccaccagctcagctttccaagctcgctcacctgcgtctctcctccaggaatcaatttccttcccactttctccaccctcttcagatcccttaagcacgcttcattgctttctccaaactaccagactcaaatctgcagcccagttggccaggaacctttccatacgcacgtatttcctgcattctcctgggtctgcttttaaaaattgctaccaccaaacaaatgcaatcttaacaaaattgggattacaaagccagtttttttcatgtaatgttacagcagtgaaagattgagggagagaaaaggagagaagcaggagtgtatctgggtgaagaagcgtggctcagtggctatacagtgagacgcagagattccacagagctgggcttgcccacctgtcgaccccactttccccatgtgctcgccgcgggatgacaaccacaacactccagaaccaccccccttccgaaagagggcggggttacgccttcagccaatcaggacccgcgagccccgggtgtccaacctatggggtggctgtggccgtgcagggggaggacgtggggtggtctgggaggggccgcgtccgtgggaggctcgcacgtgtcgggtccggagaggcggggaggcggccggcgtccagcggccgaggcgcgggctctgcaccctggcagcggccgagtccggctgccccagtgcctcctttacctcgcgttgggccaggcagggcgcgctcccgccgacgaagacctgtccaaggtgtccgagctccccgcgagaggggacagtcacgaataacaacagtacccagcgcagactaggcggggaggaaagtttccggcccgcagcagagcggagtccgccaaggctggaggaaaagggatgcagagcgggagggtgaaaacctgaaagaagagggcagcgggaacactgtgtgggcaggaacgggtcccgggggcgacgcccgcagggggagacgggtgcggggtgcgctgtccaaggtgcaggggaggtgactggcgcgcggcgggcgcggagcccggagctgacactggctggcgggcggaggggagagcggggaacagctgtctggggcgctgggcacccccgggcgcgtaaaagtgagggagcttgagacggggcacggcggggaagggcgtgggggctgcaccgaagcccccacgcgtccacgcacccctcctcaccagcctcacctctagctccactcccctcccccctcgcccactcccctctcagtctagatccaggtgccgtggcgggggtgagaccagaggaccccggctcggagcccggacgccccagggaggctgcgggccccggagctgcttacctggggccgccgtatggggagcggaggcaacccgctgcgcggagtggggcgccgggcgcggcgcggctcctcctagcctcggcgtcctcctcctcctttgcttctcccggactctgtcccgggcacggagctgggagacgcggccgggctgcagtcgccgttccctctgctgccgccgccgctgcagcagacagaggacgccccgtggcggctggaagcctgtgtgagtagcggcgcccgggagagcggggatctgctgaggggcgctggagactccgcggctggaggcgcgcgggcgtgcgcacgcgcgcctgcgagtgtgagtgtat

SEQ ID NO: 1507 - DNA, 573452 bp, Homo sapiens; identical to SEQ ID NO: 1506

SEQ ID NO: 1508 - DNA, 85946 bp, Homo sapiens
ccaccctcaggcactacagctagactccgagcttactgggcagtcatctgattcgaccaacatcagttcgcagggcttaagcccagtcccttacggcggcctggggagggaccaggcccaagtatataaagctccctgagggtccgcgttggctttgcgcctgtgagtgtgattcaagaacgtcccagtgcccttggctcctttcggagtgtgaccccgtgcttgcacgggacacgttacccagctcgggtgagaagggtatcttccgggaacctcgcctttaatagcacaacgagcgcagagtccactggatctgcgagaagaaaccgcgctaactagtttgtccctacggccgcctcgtagtcactgccgcggcgccttgagtctccgggccgccttgccatggctgcccgtggtgtcatcgctccagttggcgagagtttgcgctacgctgagtacttgcagccctcggccaaacggccagacgccgacgtcgaccagcagagactggtgagtcctgccagcggcccccacccctctctggctcccttgtagtttctgcttcagccccctctaccgcctcacccttgaacctttgtactcccccgcattcgctcacggtctgtgccctagcgctcacttgttcagtggagagaccgctttgtgctgggctttgacgcctgggcgtggaagacggagcagttctgaggatctgtctcctcaaggagcttccagtcttgtctgggacacaaaccagaaaacaggcaattgcaaatacagtaaaataagtgctgtatgtggattttcctatctcataggaggccctaaaaacgtcttgcaggggacgtggtgggatcagggacgcttcttggagaaagctgtagttaaaaattaagatctgaatgaataaaaacagtccattcagcaaggagaaggggaaaaagtgtttcgggtaccaggactactgtctccaaagtctccggcacagaaacagggcccagttggaaactccaagtggtgtattcaggatgaactgtagagctggaaaaaggaagggtctaacagaaaactgtccaacagaagcatattgtgagccacatacgtatttttacgttttttttttttttttttttttttgagacggagtctcgctctgtcgcccaggctggagtgcagtggcgcgatctcggctcactgcaagctccgcctcccggtttcaggccattctcctgcctcagcctcccaagtagctgggactacaggcgcctgccaccactcccggctaattttttgtatttttagtagagacgggggtttcaccgtgttagccaggatggtctcgatctgcttacctcgtgatccgcccgcctcggcctcccaaagtgctgggattacaggcgtgagccaccgcgtccggcatatttttaagttttttgtagccatattaaacaactgaagagaaacaggtgggtttgattttaaccatgtattttctttaacctgatatatgcacagttgcatggtaattttcaacattcaatatgaaatattgcccaagtggtggtttaggcttgtaatcccagcgctttaggaagcccaggcaggaggatcacttgaggccatgagtttggaggacagcctgggcaacacaggagaccccatctctgctaaaaaaaaaaaaaaaaaattagctgggtgtggtggtgtgagcctgtagtcctagctgcttgggaggctgggtcgggagaatcacttgagcccaggagttgaggttatagtgagctatgatttcgccactgcactccagcctgagagacagagctagaccctgtctccaacaaagaaaaaaaaatgaggcagtagagatttagaaagttttaagtaactggtccaggatcatccctggtaagtggcagatctacgattccaaatgctacactttttcccttatgacttgctgactccttagaaataaggatttctggatatagtattcagtgtatgatacagctgaacaagatcaggcagaagtaatccttttgtggagagtcgtaaaaatccgagtatcaggctttcaaggtagttgggagctgtggtaattggaagatagaactaatattggtgacttttacatgtgtaggtatttttacttggaagaggagagagtttacagaatccagagtaccacataggaagcatctttagtagtccaggtacttgaaggctaaagtgtaggccagtgattctcaaactgtctgtgtcctgtaatatcctgaaatcctgaagtcagattcatagacaataaaatctacctgtaaacataacttttaataatcaatataatgctttaattgagacataaaggtgaaatattttattagacaataacatgtctacaggctgcgagcggtgtctcgctcctataatcccagcaatttgggaggctgaggtgggtggatcacttgagtcaggggttcgagaccagcctggccaacagggcaaaaccgtgtctctactaaaaatacaaaaattagctgggcatggtagcacaagtctgtaattccagctagtagggaggctgaggcagaagaattgcttgaacccagggggcagaggttgcagtgagcggagatcatgccactgcactccagcctgggcgacagagcgagactttgtctcaaaaaaaagaaaataacatgttaacatgtctacaatttaaatatgtaaatacttagacattactacattagaaaacataatgaagtaattattagttgctgtcatattacaccaatttgtagaatcactgtgtatgtgacagctaccaatgcaaattgtttatcaaatgtattatattggcttttcaagtagcagaaggaccattgttctttacaaacttatttctcctaaatggtgaacaatttctggtaaaaacttgaacaaaacagtggaatctccctcaatttacatggcacttgcacttatggaagattcagtctgtactaaaacagtgtaataatgatatatttatatataatgaagttctggactaagattatcataaacttttcacctacttaatcttttaaaattgagggatgcaaacagttttttgttacacaggcttgtctcatatattttaggacttctacgatcaatggtcccccatccaccaaataccctcccttctattcaaattattgtgcaaccaaacagggcctcacgtactttcagaatgtccctaaggggttgttctgcttcttttgggagttgttggtccaggcaatgaccaataatgaggcagaagattgttgataataactttagggaacttggaagtactgaaagcaatgagaagctgacaaaaggtaaatattaggaaagaaaaaaaaatggcctaggtgtagggcatatttggaaatcttatggaaaatagaaaataatgtttgtcaatgagttaaagaaaaactttcacactgtattttaaaaatgtaattcattttaaggtttatgaaatatatcttgttgggctggacatggtggctcatgcctgtaattctagcaatttggaaggtcaggtgggagaattacttgagcccaggggttcaagacccagggtgggcaacatagtgagacccctgtctttctaaaagaaaaatcaaaaagaaataaatatatcttgtcatatttgttaaataactttttcttaggtaagcttctcttttgaaactaagaactaatgttcattagcctgcttaggagattaaaataatttttaaaaataggcaaaatatgtagcatcttgaataaagttagcattttacaattaatggtttaatagaagtcataatcaaactttgcactagcaaagctgtttctcatggaaaagtagaaaagaaactttaagagattattatcaaattttaaagcagtttgaacaaaactcagtttgtatgaaacggtagtcatttagtttccattactttcctgaaaactgtaactcttacttttatttttcttcaatttttattttaagttccggggtacatgtgctagatgtgcaggtttgttacacaggtaaatgtgtgccgtggtggtttgctgcacagattgtctcatcacctaggtattaagcccagcatgcattagctattcttcctgatgctctccctcctcccacccccacaactcttgttattattaggatagtgtaacatgtaaaaaaaactagacacatatatgtttcattataaacaatcctgatacgtgaaaactaaaacctgtcaaactaattttcaggcatttattcatttccaaaaataagacagtacttttactattttgcaatgataacatgatttaaaacatgttttaacaatactttgaagcttacattggtaatcacatggattatgtactgtatacccatatttttaacttttttttttttgagatggagtcttgctctgttgcccaggctggaatgcaatggcgggatctcggctcactgcagcctctgcctcacaggttcacctgagtctcctgcctcagcctcccaagtagctgggaccacaggcgcctgccaccacgcccagctaatttttgtattttcagtagagatagggtttccccatgtcagccaggctggtctcaaactcctgacctcaagcgatccaccctcctcaacctcccgaagtgctgggatttcaggggtgagccaccgcacccggcctaactgattctttcccactgttttttacaccataatgggaggctagaatgttaagtttcatggacagggactttatttgttctctggtatgtatttctagcatttataatggtgcctgatgtgtggtaaacattccaaaaagaaattgttgaatgaatgaatgttattcttgaatgggaagaaatgagaagaacttttctttcagtgaatggagtaagaatttccagatgtctaccagtgagtaccatacacaaaaatagaaaattcagcttatttaaaatgtagctcattatagtcttccctgaacatgctgattctcctcttctttccccctttcttgactagtgccatcatgtgcactttctcctttacctccaccattcagttcatgagtcacttagcctcatctctgtaatttttttcatggtattccttcccttgctattttcttagtctttattgtttctcctctggcctgtagtgatcgcctttaaaaacaagtctctttgcttctggtattgtatcctttctaaacttcacactgccatcagttatttttctacaacacagacttgttaatgacaccatccctttttatgagtttaacatgatctaaacctttcttaggatcttacacaggactcttcatgtactgatccttaaatgacatatccagccacatttcacatcccctacattgcactgtaccctgtactatagttacattaagtttccttcatgaaattttatggttctgtgactttactagagctttctcttctgaaattcttttcctggctaactcctattcattttttttttaaagacacatccagtgtgaagccttccctgaccccagttccctttgcctagtaggagaaaattgttttatactgtgtgtttccttaggaagttgcacaagtttttattatagtttattaagatacatcaaaattatttatatttgtataagcacctatggtgtgaagtcctcagggaagacacttgtatctgtatctgtgattggcattgtaattggcacatgatagccatttaattatttgtctatgaaatagctattaacttctattattattgagcaacttaataaataaacatggatatttgattttaatatcattgacacctgtattttttccttgtagggtcctcttatatgttagcctctaagggagagcaagagtctgtgtctctcttgctcactgctttttccccagaacttagcataagtcctggcacatgccaaataaatgtttatatatttatatggtaaaagttaaataagtatttgttgaatgagtgaatagtctacgtctttcctctctccatcacaactaccacccctcttgtgaggaggaagaatactttttttcttcttcatttccctctggtacaactcttgtttttcttggactgaaatgttcagtctcaaaatagaaattttagcattttataacactttcaggcaacttatatttatctaaaaagttatttactgcctatgttgtttagggagaataaaatgccatagggaatttgtaaacaattttggtgcctttttttttttccccagctgtagcagctatgatggagtgatcttttttcccagttttcagaaattttttgattcatggtagtggaacatttatagtaatttttctgtttttttaattgttgctgttgttattttggtttttttagtggatatttgaaaccaggtagtggtaacagatacctgacatggcccatttgttgatctgctggcattatttaaataatgtttcttctctttgaaatatgcctttttaactaaaattagatattctttatagatggggatgaagttttaagaatactcgttctctcagttcccaacatagtaccaggcacatggttgctctgcctcataaatttttgttgaatcattaaattaacaaatgaatgaaaccaacaggcttggagataagtagattagggaaatgttatagaatgatgaacggacagccttcaggaattaaaaaaagaataagataaatgagactatgcctctttgacttttgtaatagtcaggagaggcctaaaatgtcagtatctaataaatatgtgtataatcagagtacgtataatactctgacttctgatgtgctttttcaagttttgatcattgcttattaatatctccaataacacaggcagtctccaacttagaaataggttctgtttttaaaatttgtcaattaaattcattttaatagatttttgggtaacaccaaatatatggaagctataaactaagtgtgtatagggagggtataaataaaccaagattgccaccctcaagggcagaggatagcaaacttaatttgtaaagggttagatagtaaccatttcaggctctgcagaccatatagcatctggcacacatttacctgtgtaacaaacctgcacatctagctgcaactacactgttgtagactgaacacatagacaataaataaatgtggctatttatgaaaacagttgctctaggaggcaaatttggagcaaatttaaatgcccaattaaagacagtttctctaagtgctatcatatttttgttcatttatttattcatccatttaacactttatttatggagtcgtacattattaggtaaggttctgagtctaagtgctatagtggatacaaagatgaatcaaatacgcattttttcctcaagggacttgaccagaaactaaacctagactctcagactgggaactccccagcagtggagatcctgcctgattcacttttgagaatgacttctagggccaagcacagcacggggtaggttgcagatacttagtaaatgtcttttcaagggtaagggaatgaaagactaaggcataggtgtcataagagaaatatatggataaaatgcttgatttcgtaggaatgagccattgtttcttatttgggaaatcagagaaaactgtgaaaagtgagttgaatgagtagaacattgagaaaagggaagaatgtgagctaagttaaaaagataaaatcttaggcagaggtagcaaattcagatgcttaaagggggcagtcacgtggcacaaatgagtgaggggatgactgggttaaatggtgttgcattatgtgagtgatgattatagcaaaatgagagagcacttgcttttctaaaggaggcagatcattggaataaaccattattaccagatgtttgatttttcgaaagaaaccagaaagagataaataagtttttctaaaatgtgggttatatcaaggaagaaaaatagggaaaggtaggttgggttaacaactgtagatagctccaaatggcgggttaaggaatgtgtggactaaatttgtaggcagttaattttgtaggagttgtgtgatcagtggaggccttcaggagaatcaagcccagagcagtgtttaagaagggtagaaactaaacctagactcctagactgggaactcctcagcagcggagatcctgtagaagaggacaagcctagttgaaaatgcgttacagtgggcagtactttgggagtgtagaggaggagatgatggcagcaataagagtgatgatagctgaactgttttgtgccaggctttatgctaatgttttaaatgcatgaactcatttagtctatataataatcctagcaggtatagatcctgctaatattataaccctctacttgtagatgaataaattgaggcttaaagcactgaaataatttgtgcaaagtcacacatttgagaagtagatgaatcccagaggtactctgctttgttgcctctgtgctcttattcagaatattctctttgtttctctttccccttcaacttcttaaattatgtcacggtctaactaggaaaacatataacttaaataatataaaacaagggaaatgtaattcaaggaattggcttcatagctagtggagttgttgagaaatgaaactaggatggtgaagcaatccagagattgggaacagcaaggaaccactagcactcctagagctgtagggccaaagggaggagttggtgtttttcaaaaccactctacattaattggaaccacggatgtctgttcagggggagctggagccactgctgctgctggagcagttgctaaagacggagaggaaggggcggtaataccgtggtttcttccttgttttcactgtccagtctttcaccattgcatcccattggtctgactctactgggaccagctgacacaagagcctgtaggacttagctcttctaacagaacagagaatagcccaggaattgattggtgaatgcatatgggcctgcgaccaacacattatctgttttcagctgtaatttgaattccactgataataagaaatttgaaagcacagtctcctaaaagcagtgttagaaaacactttttgaaatgctaagtattcccttaatccacagtgtaagggtaacagtattattttgtggaattccatttacactgtcttatgtccttggaatatcatttccatgctattggagataaaataagtactgttgccaagtgtggtggctcacgcttgtaatcctggcactttgggaggccaaggtgagcacatcacttgaggccaggagttcaagactagcctggtcaatatggcgaaaccccacctttactaaaaaatacaaaaattagctgggtgtgatggtgcacacctgtagtcccagctactcgggaggctgaggcaggagaataccttgaacccgggaggtggaggctacagtgaacccagatcacaccactgcactgtagcctgggtgacagagcaagactctgtctcaacaacaacaaaaagaagtaagtactgttagcttataaagaaaagaggtttaattggctcacgattccataggctgtacaggaagcatgatgctggcatctgctcagtgtctggagagaccttgcaaaacttacaatcatggcagaagacagagtgggagccaccacttcacatggccagagcgggaggaagacagagacagggaggtgctgcatacccccagaaaaccagatcttgcaagaactcactatcacaggaatagcaccaaggggatggcgctaaaccacccatgagaaattgccgccatgacccaatcacctcccaccaggccccacctcccacattggggattacaattgaaagtgagatttgctgagggacacagatctgaaccatatcaagacaatatagtgagaccccatttctacagaaaacttaaaaaattagtcacttgtggtggcacatgccagtagtctttgtttcttgtgaggctgaggtggtaggatcagttgagcccaggagttaaaggttacagtgaattacgatcataccactgcactacagcctgggtgacagagtgagaccctactggaaaaaaaaaataaaccaatattgatccattattattaacccaagtcatattttattcagattcccatactttttagctgatgtcctttttctgttccaagatcccaaccaggtaccacattacatttagttttcgtgtctgttttggctgcttgtggctgtgacagtttttcagacttgctttatttttgatgaccttgacaggtttgaggcttactggttaggtattttgtgggatagtctctactggaatttcttaggtgtttttctcatgattatactggggttttaggtttttggaaggaagatcaatcagaaaggtgaagtgccaggctgggtgcagtggctcatgcctgtaatcccagcactttgggaggccaaggtgggtagataacttgaggtctggagtttgagaccagcctggtcaacatggcaaaacccgtctctactaaaaatacaaaaattagccgggcatggtagcaggtgcctataatcccagctacttgggaggctgaggcaggagaattgcttgatcctgggaggcggaggttgcagtgacccgagatcatgttattgcgctccagcctgggcgacaagagtaaaacttcatctcaaaaaaaaaaaaaaaagaaaatgacttgccagtttcatcacatcatatgaagtgtacatactataaacatgtttgttgcaattgatgttgatctaatctgatgcggcagtatttgtgagttttcttaactgtaaactttatttgcatactgcactttttgaaagaaagtcactttgtgcagcccacatttaaggagtagagagttatgctctccactccttaaatgtagagtaatctgtcagattatttggaattcttctgtatgggagatttgtccttttttttttttttttttttttttttttgagacagagtctcgctgtgtcgcccagactggagtgcagtggcgcgatctcggctcacttcaagctctgcctcccgggttcacgccattctcccgcctcagcctcctgagtagctgggactacaggtgcccaccaccgcgcccggctaattttttgaatttttagtagagacggggtttccccgtgttagccaggatggtcttgttctcctgacctagtgatccgcccgcctcggcctcccaaagtgctaggattacaggcgtgagccaccgcacccagccgagattgtccttttactcccatttattacttatttatattagtttggtttcatggatagtaattttatgctttggattataatccactaccacatttattttgttgttcaagctgttttatctttggccattgggatctctttcagttgactcttgtgtacctttgacatacccccaacgttgtgggggtttttttgagcacttccttgctttctggcactacatggtgctctaggctcattttgtgtatttcctgccccagtcccaaaatcaggcatttctccaatgagttctgtgtatataacattttatctcatggggagcttcattctgggtcataacttcagatcctaatccatttttatcctcccaccctcatccatttttatcctcccacccaaatgttccccaattcctttatcttttccctatatagctgatgaggtaagagcaaaagatatccttgtcttggtacacgtggctgctgctttcagtccatcaaggacagtagaatttttccctgaagcttcagtaaagcgcttttgtgtttgtttagtttgggctttatttttgtttttcaatatctggtgttagggactgctaatggagggagggtgctagggattgtgaaaggaattagagagagagaaagagactcattaacctttctgccatttgtcattgtatttcaagtttgttatagaatcttagtacaggtcaagtgaacagtaaagaacctgtctctgggtataaggttaaatattgcatattcattcctctaaaggactgaatatggtcttcaagagaatgattttcacttcttttggaatacctagaatttaacaatcaccaccacactgaaaaaatagtttttgtatagtaggcattagaactgaagagaactaaaccaagggagaaaagaatggtactttaaatagcactttcctccccaaataatgcctagctgcagtgatgttaaagtttaattcaaggacttcattactataagtacttaagagatttctatatttttatgtggtttttgaataatttctgtattgatttgtaagtaacttttttcaaagtaccaatttattttttaattttaatattttatttcttttgagacaggatcttgctctgtctcccaggctggtgtacagtggcgtgatcatagctcactgcagtctcaatttcccaggctgaagtgatcctcccacttcagcttcccaaggagctgggaccacaggagtgtgccatcatgcctggctaaatttttatttttatatttggtagagatgggggtcttgctatgttgccgaggctggtcttgaactcctgggctcaagggattctcccacctctgcttctcaaagtgctgggattacatgtgtaagccactgtgcccagtccaaagtaccaatttaattttacattttaaaaattggattctaaaagtctgccttcttatctgaacactatttttcagattccattttattttgttacttttttaaattgtgattggacaaaatgtttttcagtttctgtctttttttttttttttttttgagacagggtctcactgtcatccaggctggagtgcagtgatgcaatctcagctcactgcaccttccaccttccaggctcaagcagtcctccgacctcagcttcccaagtagctgggactacgggtcgcaccaccacacccagtgcagccctcaacagagaggagactggagtgggtagctcctatctgcaggcaggtcatcctgataagggtgtctggctaagtctgcaggtttttatgtgctcagaatggaggaagtgcatgttgattggttgatgggtggctggccatgggcaggcctggaaaaagcaccatccaattggccgattggtcatcaatgaacttcatactcctgttggtggacttcatccagaactggcagcctggcccctaggcttcaggccagtcctagcttgaaggaggggttctgccagggacccaccctttcctgcccaggaaactttcaacctcttgctgccaccaacatgacctccacagcaccctggctctagaggctgcggggagcccacaggcccatgccaagctactaccctcagccccttggctggacctccctcctgggcttgtgcccaaagtctagagggggctgaagtggcagggggctggcatgtcatcaccgctcttagtgcatgcacacccggctgggttgagacagtgcctcagcttagccacaactttgccccaccctggagtggatgccgtgagtcgggagaggccaggcagtgggagcaggcatttctaagcctgtaggggcaggggacttcctgggcccctgagagtgcggttgggcggctgcagctgctcctgggagcactggctcctaccctgccaagctgataggtggctggcctcctgcctgttcccagctcccggcagctctgctgaatgtccagcccccatggtgcctcccgctctgcagccaacatccttgtgggggccgctccagacgggccgtagcagccactgccttaaagtaaaatcggttgctgtaagggagtaaaagtagctttcattaaaggggatgatttcccaagcaagaagaaataagcaaaactacaaaatgttgcagataaggtgtacatcagatataagccgaaaaagagagtttgaggggttcttgctggagacttcaaagtcagtatgataaaagcttggagtacttgataggaaggaggccaactagagatgcagtgggatcatttttatgatcagggtgcagatttaagtgcaaggataaaaagggagacaccgaagatcaatgtagttattcttgaagaatgtaaggaagaattcatttttaaagtttattttaaagtagacaggtcagagggttttctgccttctgatgttaaaacatgttaaacccatctcaccaggtgagatcttcctttttctttttttaataacctttatttttacctcctgattttaaaaagacgattatgtaatgttatatagtaattgtaatagctaccatttgttgaatgtttatcccatgttaaatatactagtttatatatatgaatgccctaacttaaaaaaattcttatcaacccaaggaattaggtgcagtcatcatcctcattttacagatgaaggaacacatggaggtcatgtaacttgggcaggtcatggagctgacaagtaaggagccaaaactcaaaccatatttctttgattctaaagtctaatgatcccaagactacgttttaatgaaaatattcttttttatagcctgcttttattctgtacttaacatgtggttgctaaacattcctcaataatatatttaattgttgatccatattttacatgtgccttaatttatttaatgattcccccattgttgggtagtcagattgtttccatttttttgtattacaaataaaacacagtgatgaattttctcttaaatgtttttatggatttttctgattattttcttcggataaattttttgaatcttagttactaagcctaaagacattagtatatttaaggttgttgattcctgtgatgaaagtaacctcaagacacattgtcccaatttgcattcctagcatcagccatcagttcaggagattgttcattgaaccattcttttgacaatttgtaagactttgatttgttggccaaaatgtatacctctcatgattaacaggctgcgtactggaggtatgacagattgtcacatggccccatccagaggaaaagctgaaagagggactagtaatgccagtttcatacttatcaaacgattccatttttgtattaaacataggagtattaaaaatacgactggggaggccaggtgcggtggctcatgcctgtaatcccagcactttgggaggccaaggcgggcagatcacgaggtcaggagatcgagaccatcctggctaacacagtgaaactctgtctctactaaaaatacaaaaaattagccaggcttggtggctggctcctgtagtaccagctactcgggaagctgaggcaggagaatggcatgaacccgggaggcagagcttgcagtgagctgagattgcagcactgcactccagcatgggcgacaaagcgagactctgtctcaaaaaataggaaaaaaaaaaaaaaaaaaggaaaataccactgggggaagggagaccaaagaaaatttcatgaaataaagaattaaggacaccaaggactggtgctaggatctagcttgatgttagataataaaaatgacactgtattctctagaaaatttaaaaacctacctagtaataagttgtagaagactttatatgttttttgtgaatgggcagataggggtgttttgttgagtgtgagctcacactggaaaaaatcttgagtaatttttataatccattaaaggtaatgtgagagtgacttcagattgttgcttgaaggcataagctctggtctggaattaggatacctgggctctagtccagtgtagaattgttgctgcaatttgcaagtcatgtaacttctcgggccctcagtgtcttcctcataaaatgtgggttttggctaatgttctctgtcatttttttcaactctatgattccgtgacattgacttaatttattattacagtcagaaatgtcaacaaaacattcgtggaaactattgaaaatggaacagaaacatctttttgtataaaattatagtgtttctatagaagtctgtgtgtgcctttgcatgtacctttccatgcaatcaaacagaaatgaaaagtttccagaaaaggtcaacaagtaaatttactgaggggagaagtgtgtgattgagtgtctaggagtctcagggggtggagacaccaagggaaggctaatttgaagacataggcaaaatagttcagaacttaattcaggactttagaaattcattggccaaaaaattctaataaaatttcagtacaataataaaatgataaaagctgttggttgggtgaaaaaggccctttccttcaaatgttagaaaacaaaactaaggatactatttaaacttgaaagagataaatttggctgggcatggtggctcatgcctgtaatcccagcactttgggaggctgaggcagggggatcacctgaagtcaggagttcaaaatgaccagcctggccaatatggtggaacctcatctctactaaaaatacaaaagttagccaggcgtggtggcgtgtacctgtagtcccatttactcgggaagctgagacaggagaattggttgtacacgggaagtggaggttgcaatgagctgaggtcacaccactgcgctccatcctgggcaaaagagtgagactctgtctcaaaagagagagagagaaaaagaaatatatacatttaggactagtgaattaaatagcagggatgagcaagttaaagaatctcactcctagacccaaatgaaccttgagctgcctagaagactgaacctttgagagcagctgtatctgaagcttcaggccaaagaacagttctcagaagttgcattactagacttgacatgtgccagccatcaagacccacaaagcaaagatatagagcctgctgtagttctttcttcctaacaaattcgtttcaaatgctgaaggttttaaaatattttttctggcttaattttctaactagaatttggttttggctttgaaatttttgtctctttttgacttacctgtttatctgtgggggtaataatctgttacctggttatcatcttgaagtgaccccataatgttaagtagatggaagttgactttacattttacaagttgtctggtctaatctgtgtttaaaatattctgcaggcctagtctgtttttaacatattctatatgaaggggtggtttgcccctccacacctgtgggcgtttctcgttaggtggaacaagagacttggaaaagaaagagacacagagacaaagtatagagaaggaaaaaagggggcccaggggaccagcgttcagcatacggaggatctcgccggcctctgagttcccttagtatttattggtcattcttgggtgtttctcggagagggggatgtggcagggtcataggataatgagagaaagtcagcagataagcacgtgaacaaaggtctctgcatcatagacaaggtaaagaattaagtgctgtgctttagatatgcatacacataaacatctcaatgccttaaagagcagtattgctgcccgcctgtcccacctccagccctaaggcagttttccccatctcagtagatggaacatacaatctggttttatactgagacattccattgcccagagatgggcaggagacagatgccttcctcatgtctcaactgcaaagaggcgttccttcctcttttactaatcctcctcagcacagaccctttacaggtgtcgggctgggggacggtcaggtctttcccttcccacgaggccatatttcagactatcacatggggagaaaccttggacgatacctggctttcctaggcagaggtctctgcagggttttgtgtccctgggtacttgagattagggagtggtgatgactcttaaccactgctgccttcaagcatttgccttcaagcatttgtttaacaaagcacatcttgcacagcccttaatccatttaaccctgagttgacacagcacatgtttcagggagcacagggttgggggtaaggttacagattaacagcatctcaaggcagaagaatttctcttagtacagaacaaaatggagtctcttgtgtctacttctttctacacagacacagtaacaatctgatctctctttcttttccccacactatagatatttaacatgtcttgtagatgatccctgcctcccaacacacacattgactagattgcagtaacagtgaggtgagggcagaatctcagtcagaattcaacatctaacctttgttctctccctgtatcctcacatttccctccttggcctaaccttgaccctatgcttcagttttagttctacttttctaagaagcaatctatgattcagaagtagagtactcagccagctggccagctgtctgttttactgtctctccatgcatatacatacatccatgcagtcaattaactgctaacttttatttagcctatgctatataccgggaatacaaaggtgaatgaagcctacctcttgccttctagaggttcatagcatggtgagggagggaagttttgaagtgtggcctgggatcacaatggaggagtaagctgggaagtagtcaggtggtgatatttaaataggtaagaccataacactgacattgatttctttaatggttggatgtttacttaatcctgctgcctatctatagtgtagtaggccccctcttatctgtgggttctgtgttccaagaccaccagtggatgcctgaaaccatggaaagtactgaaccctacagatacagtattgttttcctatagtactggtcccttcatacacaatgttttttcctatatatacataattatgataaagtttaatttataaattaggtacagtaagacattaacaacaaacaatgcaatggaacaataataactatagttgtaataaaacttatgtgagtatggtctctctttctctggaaatatattattataaccatggaaagcaaaactgtaagagaggactactatagttttgtttcttcctccttcttagtagctgagaagcaatatagagcaggcactctcctgtgttagggacagggatcaatcataacatctttacatgaagggtggtgaaacagaagggcaggagtgcattaagagtcaactaggatggggggatatgactcaagtgctccagctcccaaactgaaagccagcagattcaaaagagggagagcttatcttgagaaaaaatgtcatggtgccacataaggtagggaccagctgtggtggtgtagctggcaagtctaaaatttgtagggcaggcccacagtctgagagctttcagataggatgagattcttgaggcagtatttcttcttcttcagagaaacttcaattttgttcttaaatccttgcaaatgattggtccatatagattggcccacatagattatcaaagataaactccataggtgttagccacatctccaaaatactttcatggcaaccccaaaatcagtgtttgactaactgggtaagcatagtgtagccaggttgacacataaaattaactgtcaccatgttcctgggttcaagaacttaaagccaaatatgcaacctggtttggcaagcctgtgatgagttcaggggctgcaagtgctctccaggctgtcaggaaggacatggttgatgacaggagcaagattttctgaccagtcacatttattcacattttggtttaaaaaagctgctttttaaatttgtttatttttatttttttgaaaggctctgtcactcaggccggagtccagtggtatgatcttggctcactgcaaacctccgtctcccgggttcaagcgagtctcccccctcagcctccccagtagctgggactacaggcgtgtgccaccactcccagctaatttttgtatttttagtagagacggggtttcaccatgttggccagactggtctcgaactcctgactctcagttgatctacccgccttggtctcccaaagtgctgggattacaggcatgagctgccatgcctgacctcaaaagcttcttatattatgagaaagtagagccatgactcacactgttattttgagtaaatgcaaaacagtacttaaaagatcattcttgttattatttatttacttattctagaccttttctgacagtgtgaaaaagattattcttaaaaaatcattatctatagtgaagatttaactttgaggagtttttaattatgctggagagtggagtaacattcatttggggtaagcctaagagttttgtttcctaacatgtttggcctctgattttgttgtttcgcccttttatttattcactagtcttgctgtagatactaatgcttgcctgtggtttaagagaaattaagcaacttaaaaacagagcaaatagaaatgtagttagctttgcctttcttttttgcttaatgtaagggtttcgtgggaattggtgttttgggagaagttcaaatgtatttgcttttggcaatggaacaataatggtaaaggtagggtgtcttaatgtagattggttcaatttagatatgaaagtctgaaatttatattggcttgaagattttagggcaggataattttataaattctcgttattgtcattttattgtgtctgacactttttcttgaatgtaaattctcctcccctccttattctaatctgcatgtataatacctcttttacccaaattatattgatttgccagcagtctttcttgtttcctctctttttttctcctttccacttgctgttgtttaaattcaaagagttttctttgtggagactgaacctaatagtaagacagcataaaacactgagttcagcagaaagtgatttgcttgtgattaacccttgagaattaactcactgcaagataacaaagaatgaatgttttccaaacatctggctcattcttcttttccattagtagatgagacctctccatttaccctctaggtgttaggaattctcatactgtttcacttaggctttatcatactcgtcacggcatattgttagaaagtaagtccaaaagagagttcatgacataccctttctctgccacagacctctcacagtccttgcagcaaaaggcagttagtgtcattcttttagttgttcaagacaataaccttgactcttctcttttccttttagttgctcaagacaactaaaaggtccttttagttccttttggttgcaaagactttattttctttgtcttccgagagacttttggatatatttacctggtccagggtattttgaagcatgaccatatgttagattcttaattacgtttaactagcattgtccattatattttctcatttcaaaaccttgactccatatccagtgtctcagcaaatcctattggccttacctccgaactctatctagtatctcaccactttcctcatttccatcattaatcgctgtagcccaagtgaccattatctctttcatggattattttaatagacttacaactcatccccatgcctctgcttttcatcctctacaatctattctcaacatgacaagtagaatgatccttagaattttaattgaaataatcttaggcctctgctcaaaacaatgatgtactgtatcactcggagaaaagctagtctttatgttgaccatataaggcccagcatgatctgctccccttgtgacctgttcgaccttgttgcctatttttttctctttctcttcctgctgtatgcacactggccttctggctattcgttaggcacactgggcacacctgtgctttagggactttacacttgttcccattgctagtccaaaatctaaggaatcctttttcttgctttaatttttttccaaaagtcatttttttcagtgaagcttgccctactcactttaaatttgttgctcttgtagcaggacaagccgcaggcaaaacctctcagacatcgagttgtagaaggaagggctttattcagctgggagcatcggcaagctactgtcttaaaatccaagctccccgagtgcacaatttccgtcccttttacgggcacacaacactaaagattttatatgaaagggttgtgattgattgagcaatctaggggatatgtgacggggtttcatgcactggtagtcagagtgaaacagaacagagcagggagtttcacaatgttcttccatacaatgcctgaaatctatgggtaacatcgggttctaagtcatgagttgatttttaactactaggtttaggccatgcaggctcgggcgtggttttgggcctggggccaggctgcctgtctttgatttcacttccttgtttttttcttaaaacaggtactgagtataaaatataaaacaatgtgagagggtctctctcttccctcactctcaccatacaaacacatacctacttctttatctgcttaatttttttccatagcacaaatcactgcgtaaaataattatatatttttcctgttaaaattgtttgttgtctgtctctcttgctaaaatgtaccttcatgaggatagggattttgtctgatatatccctagggcttaaaatcatgactggcacatagtaaatactgagtatttattgaattaattaatgaaccagtcagagatgggaaatagccttcaagtgcctgtttgctaaattacctaacctttttattgggagtttattttccttaatgtttgtttaacaaattagttattctttcatgttttccacataacctgtggattatcttcatttttttttttttgtaaggaaatttaccagacataaggtcctaactttattttctttgtcttccgtgagacttttgaatatatttacctggtccaggatattttgaagcatgaccatatgttagatttttaattaagtttaactagcattgtccattatattttcccatttcaaaacataatttcggtcaccagtatggtacacataaaatatgagctacaagagacatctcggtggtggtgagagacaggactagttggacttcctaggccgactaagaattcctaagcctaactggggaaggtgaccgcacctacctttaaacacagggcttgtaactcagctcacgcccaaccaatcaggtagtaaagagggctcactaaaatacaaattaagctaaaagcaggaggtaaagaaatagtcaaatcatatatcgcctgagagcacagggggaggggcagtgattgggatataaacccaggcattggagcagagagtgggcaaccccctttgggtcctctcacattgtacgggagctctgttttcattctattaaatcttgcaactgcacactcttctggtccgtgtttgttacggttcgagctgagcttttgctcgctgtccaccgctgctgtttgctgccgtcgcagacctgccgctgacttacacccctctggatccagcagggtgtccactgcgtttctgatccagtgaggtgcacattgccgcacctgatcaggctaaaggctcgcctttgttactgcacggctaagtgccctaatcgagctgaacactggttgctgggttccaccgttctcttccatgacccacagcttctaatagctataatactcaccacatggcccaaggttcaatttcttggaatctgtgaggccaagaaccccaggtcagagaacaaaaggcttgccgtcattttgggagcggcccaccccatgttgggagctctaagaccaaagacccgcccgtaacagtggtaaagtttcttaagatcattttcatgtcattatacaaacttttagaaaatgacgctttgctagattttggaaatccaaagaaataaaacacagtccctacctccggaagcctacatgttggaagggatttgaaataggtaaatgagtattaactaatgtaatatatattacagtagaaagatctcctgagtactatggagtactgaagagttttgtttgggtgagaggtgagtgaagaaagcttttttgagaagatgagcttgaagttgattgctgagtaagatttcccaggagtaaagcagagaggaacaaaaggagtaagagtaaataatatgagaatgaaaaaaggaccaacatggaatgtctgtgacgttcacataggtgctggttatttttcataaccttgtttgaatcattacgagcatgttaggatacaggtatttgtatcttaattttatagatgaggaaatgggcccaaagagaatagcttaggatcacagaatgttgaattggagcccaggcctgattaacttgaagcccatggactttccatagcagccccatacatagcattcaggtgtgaaggagtagaaagtataaggggctcatgcttgctgcatggatgaaaaacttgaaggcttatttagaaagtaaaagtttagtacgagccatgaggaatgggaaagggtactaattaatgatgaggaagatgatggtacagagtaggcttgaagggccagcgggcatcagaaaccataactgtgtaatgatgctatttagtgagaacataagatttttctttagctagacctagcagtctaggatgaggattctctgtggtaactctgccaccattttgaaaccattcgatttcactgacaatttgccatctgttgctttctgcagtgctattatgcatatgcctggaagtttttaaatccaaaatattcatgcattgtatatggtcagagagaatgcagtgaaagctatgctttttgtaatttttgacaagtgtactctaaagtaatgaattttaaaaacttaggccgggtgcattggcttacgcctattatcccagcactttgggaggccaaggcaggtggatcacctgaggtcaggagttcaagaccagcctgaccaaaatggagaaacctcgtctctactaaaaatacaaaaaaaaaaaaaaaaattacccgggtatggtggctcatgcctgtaatcccagctactggggaggctgaggcaggagaatcgtttgaacccgggaggcggaggttgtggtgagccgagattgcgccattgcgctctggcttgggcaacaagagcaaaactctgtctcaaaaataaacaaaaaacaaaaagcttaaatacccttgtcccatatcacataaatttgttttttgaatatatatcatctttttttcccccatggtgaccatgacagattattaaaaactaaatttctaaatttgatgtaagtagaatgttaggtttttggtttttcttacatagagaccactgttcccaaacattatgctggaccagttgtaaaagaatttttttggtggcatttgtaactgatttcatttttaagtatatatgtgcatatatttatagaaagatcagcttgttctataagtagaagtatgtggtaccctaattttgtgtaacaacaacaaaaatatatccaataattagattttctgcaggcctagaaaatgttagctacttttttaagccataaacgtctgaatcgtcagataaaatgtttcaaaactaaaacttgcccaaggcagccttgtgaatttttttttaaagaattaaaaaaaaagcctcatatggcatccatattcatcatctactgctacatatgtgtgacacttacggcagttttagcctatactagggtacaggaatatacttacttttttaaatcatacttcctgatttcttttattttcatatcccaatttttcctaagtcaaagaaacagcaacatttctgtttctgcagaatttaacctggttattgcctagttggtagaaaatgactgtagttgtggtaccaacactatgcctgattcaccattttactattatattgtcttttcaatgtcattttttctcattctgttactggcagtttagttttaaagcatcattgtttaaaaaacattcaaaataaaagtcgaaatacatcttcatgtttacaactggatcagatatggtgttgtgcatataaaagaaacaaaatacagatcctcttagcccaaggatatgatactgaagtttagtaaacgagaaatagcatagtgatgaaagcatgctaattgtttttcaacaatagtaaaatagagaacatgttaatggaattatctgatatttacacagttatgccaagtaaaccataggttattcagaaaccccagtgtgttttagatgttattttatttttaaaattaaagccaaagaaaggtatggtcaggagttctgtgttgagttacttacttagacttagattgactccctttctcttatacttctgttttctacatttgaaactagtttctttttcctgtttgagtcattcatatatgtggaagtttgaggagaattgttactgttttacagctcacaaaatctgtgtctgaaaagaaataccaatggctttttagcaaataaaaaaatgttaggtagtagataaatttttttctaggaaacaattcatattattctgggccagttaaagttttgtttgtttgtttgttttattttatttgtttgagacagagtcttgctctgtggcccaggctggagtgcaatggcatgataatcggcacactgcaacttccacttcccaggttcaagcagttctcctgcctcagccttttgagtagctggggctacaggcacctgccaacacacctggctaattttttgtatttttagtagagacggggttttgtcatgttggccaggctggtctcgaattcctgacctcaggtgatccacctgcctcagcctcccaaagtgctgggattacaggcatgagccactctgcccggccagttttaattgcttgtaaatctaacagccttactatttccacaggaaactttataagtacttttattctttcctttaaaattttaaaaaattttttagtttttttgagacagggtctcactctgtcaccaagctgaagtacagtggcataatcacagctcactgtggcctcaatctcctgggctcaagcaatccttccacttcaggctcccaagcagccaggactacaggcacacccaactaacttttctttagtagagacagggtcttcttgtgttgccgaggctggtctcactcctgggctaaatcagttctcccatctcagcctcccaaaatgaagacttttattcttacttcagattacaaaatatgattgtataggatacatgattaaaaaaaaatttcaagttgatttcaacttctaaatatgtttttgtttgtttactgtcaattgttcatgctcaaaaagttttattttaatatcaaattaaaatacaaagagaggtaatttagattaaaccctttcaatagagaatttttaagatttaaaaaatttttttagccttgatttgaaattgaataaggaattttaattccagtaaataaatgggtttttgattagctgtgctgtattttatcgttttagtgtggataagtaagatttgattgctcaattttggttatttactgaacatccttttttactctagtgatctacctaatttgggtttctttttgttgtttttgtttcttggtattttatttatttttttgagactaagtctcactgttgccgcccaggctggagtgcaatggcgcaatctcagctcactgcaacctccgcctcccaggttcaagggattctcctgtctcagcctcccgagtagctgggattacaggtgcctgccaccacacccagctaatttttttatttttagtataagcgatggggtttcaccatgttagcaaggctggtctcgaactcctgacctcagacgatccacccatctcagcctcccaaggtgctgggattacaggcgtgagccactgtgcccagctattttattttttatttcaataagttttgggggaacaggtggtgtttggttacatggataagttctttagtggtgacatctgagattttagtgtactcatcacctgaacactgtacccagtgtgtagtcttttatccctcgctcccacccattacctgccctgtgagtccccacaatccgttgtatcaattcttatgccttgcatcctcataccttagctcctagttataaatgagaacatacaatatttggttttccgttcctgagttacttcgcttagaataatggtctccaactccatccaggttgctgcaaatgccgttatttgttcatttttatggctgagtagtacttcatggtgtgtgtgtgtgtgtgtgtgtgtgtgtatatatatcacattttctttatccgctctttgatgagcatttgggctggttccatatttttgcaattgtgaattgtgctgccataaacatgcatgtgcagtatctttttcatatgattgcttattttcctctggttggatacccaagagtgggattgctggatcaaacagcagttctacttttagttctttaaggaatcttcatactgtttttcataggggttgtactagtttaccttcctaccagcagtgtaaaagtgttccctttcaccatatccatgccaacatctattattttttgattattattattatttttttgagatggagttttgctctgttgcccaggctggagtgcagtggcgtgatctcggctcactgcaacctctggctgcttggttcaagcgattctcctgcctcagcctgccgagtagctgggattacaggcatgctccaccacagccagctaatttttgtatttttagtagagacagggtttcaccatattggccaggatggtctcgatctcctgaccttgtgatacacctgtctcagcctcccaaagtgctgggattacaggtgtgagccaccacgcccagcctattttttgatttttaaattatggccattcttgctggagtaaggtggtatggcattatgggtttgatttgcatttccctgataattagtgatgttgagccatatgttttttggctatttgtgtatcttcttttgagaattgtctgttcatgtcttagcccacttttttttttgagacagagtctcactcttgtcactcaggctggagtgcagtggtgtgatctcagctcactacaacctccacctcctgggttcaagcgattctcctgcctcaacctcccaagtagctggattacaggtgcctgccactacacctggctaatttttgtattttagtagagacagggtttcaccatgttggccaggctggtctcgaactccctgacctcaggtgatccacctgccttggcctcccaaaagtgctggattacaggcatgagacactgtgctcggccattagcataatttttgatggcattatttgtttttttcttgctgattagtttgagtttcttgtagatagtgtgtattagtcctgtgttggatacatagtttgcaaagattttcccctactctgtgggttgtttattctgctgattatttcttttgctgtgcagaagctttttagtttaattagttcccatctatttatattagtttttgttgcatttgcttttggctttttgatcattcaggagcaggttatttaatgaaatctttgcctaaaccaatgtttggaagggtttttctgatgttatcttctataatttttatgcttttaggtcttagatttatccatcttgacttgatttttgtataaggtgagagatgaggatccagtttcattcttccacatgtggcttgccagttatctcagcaccatttgttgaatagggtgtcctttccccactttatgtttttatttgctttgtggaagatcagttgactgttaagtatttggctttatttctgggttctctattctgttctattggcctatatgcctgtttttgtaccagtaccatgctgttttggtgactatggctttatagtatagtttgaagtcaggtaatgtgatgcctccagatttgttctttttccttagttttgctttggctgcatgggctgtttttttggtgccgtatgaattttaggattgttttttctagctctgtaaatgatgatgctcgtattttgatgggaattgcattgagtttgtagattgcttttggcagtacagtcattttcacaatattgattctatccatccatgggcatgtgatgtgtttccatttgtgttgtgtgtgatttctttcagcagtcttttgtatgatagttttccttgtagaggttttttacctccatggttaggtatattcctttgtaattttttgtttgttttttctttgcagctattgtaaaaggggttgagttcttgatttgattctcaggttggtcactgttagtgtatagcagagctactgatttgtgtacattaattttgtatcctgaaactttgctgaattcattgatcaattctaggagatgtttgaaggagtcttcagggttttctggtatacaatcatatcttcagcaaatagtgacagtttgacctcctctttaccgatttggatgccctttatttccctctcttgtttgattgctctggctaggacttctagtactatgttgaatagaagtggtgtaagtgggcatccttgtcttgttgcagttcccagaaggaatgctttcaacttttctccactcagtattatgttggctgtgggtttgtcttttattaccctaaggtatgttccttctatcctgattttgctgagagttttaatcatgatggaatgctggattttgtcaaatgctttttctgtgcctgttgagatgatcgggtgattgttgtttccacttctgtttagtatatcacatttattcacttgtgtgtgttaaactatctctgcatccctggtatgaaaccctcttgatcatagtggattattgttttgatatgctgttgggtttgattagttagtattttgctgaggttttttgcatctatgttcatcagggattttggtctataggtgttcattttgttgttgttatgtcatttcctggttttggtattagggtgataactggcttcatagaatgatttagggaggattccctgtttatcttttggaatattttcaataggattggtactagttctgttttgaatgtctgacaaaattcagctgtaaatccatctggtcctggacttttttttgttgacagtttttttgattaccatttcagtctcacttattgttattggtatgttctgagtttctagttctaccttgtttaatcttggagggttgtatatttcctggaatttatccatctcctctaggttttctagtttctctgtgtaagggtgttcatagtactcttgaatgatctttttatttctgtggtattggttgtaatattgttataggaaatagaaataaagtatttgggtagacggggagaagagagtccctggcagaaaactttccttctaacataaagtagctcagaaatagctcccttctaacctcatgcagttcaaagaaatcacttctctaactaaacaagcagcctgaaagatcaggctgtaaatcacagataaacccctggagcacagaaggagggcggggagtctcctgggtaatcaccaaacttcacaatgggccccagtaaaaacagtgggccttaataagcacattcctttccctttaggacatcaagatagagaagctaaaagtggacttggggaggtgggggtggagacgtcgtgggggaggggtgttggggggatgcctgcagctgcaagaagatgtctgggaacagacacagaaactctccctctcagataagcaaaagaaggcatcacagactaagtctgcccatgtgatccaggaataaagtgagagctgataaaaaaaaaaactctgctctataaagatagcacacctggtcccaactaaatcgtcaggccctaggaggataagacatcccctcctcactggcaccacccccgccacctgccactaactccctcctcactagcccatttataaaaaccctgacatttttactaagcaactcactcgggacccatctcttcaagggagagctgttctttctttttgcctattcaactttgctccaaactcaagtctgtgtgtgtagtgtgtgttcgcgacctccgtctccttgactgttcgaccaagagccttggtatttaccccagacaacgaggctgcttcagtatctcccgtttcatttctaatttagcgtatttggatcttctctcttcttttcttggttaatctaagggtctaccaattttacttatcttttcaaagaactgaaccagtttttgtttcacttttgttttgttgttgttgctgtttcaatttcctttagttcttctctgatccttctttctattctcttgctgggtttgggtttggtttgttcttgtttctctttttccttgaggtgtgaccttacattgtctatttgtgctccttcagaatttttgatgtattacatacattttgatttaatattatgaactttcctcttagcactgcttttgttttatcccagaggttttggtaggttgtgtcactaatgtcagttcagttcaaatacttttttatttttcatcttgatttcattgttgacccaaagatcattcaggagcaggttatttaatttctatgtatttgcatggttttgagggttccttttggagttgattttcagttttattccactgtggtccgagagagtacttgatataattttgattttcttaaatttattgagacttgttttttaattttttttttttttttagaaggagtttcgctcttgttgcctaggctgaagtgcaatagtgcaatctcagctcactgcaacctccacctcctgggttcaagcaagcctcccaagtagctgggactacaggcatgcaccaccacgcctggctaattttgtatttttagtagagacatggtttcaccatgttggtcaggctgattttgaactcctgacctcaggtgatccacctgcctcagcttcccaaagtgctggggttacagtgtgaaccactgtgcccagctgagactcattttgtggtctatcttggagaatgttctatgatgaatagaatgtatattcttgcagttgttgggtagaatgttctataaatatctgttaattccatttgttctagggtatagtttaagtccactgtttctttgttgactttctgtcttgataacctgtctagtgctgtcagtgaagtagtgaagtcccccactgttattgtgttgccatctatctcatttcttaggtctaatagtaaatttgggagctccagtgttaggtacatatatatctgggattgtggtattttcctgttggactgatctttttattatataatgtccctctttgtgttttttaactgttgttgctttgaagtctgttttgtctgttgtaagaacagccactcctgctggcttttggtgtccattgtcatggaataccttttgctacccctttatcttattatgtgaatgtgaaaattgttttgtttaaggaggctaaatataggacccagattccttcttgatcgtagggtttctgctgagaaatctactgttaatctctgataggttttcctttatagattacctgatatttttgcctcacaacacttaagattctttccttcatcttgactttagataacctgtgtttgtgcctacatgatttttttgcaatgaattttccaggtgttcttagagcttcttatatttggatgtctaggtctctagcaaggccagggaggttttcctcaactagtctctcaaatacattttctaaacttttagatttcccttctttgtcggggacaccagttattcttaggttatgtcatttaacgtaatcccaaacttcttggaggctttgttcctttttttaaattcttttttgtctttgtcagtttgggtcagtttgaaagccttgtctttgagctatgaagttcttttttctacttgttcgattctgttgtaactttccagtgtattttgcatttcctaagtgtgtctttcatttccagaagttgtgattgttttttctttatggtatctatttctctggatatttttatccatatactgtattatattttaaatttctttaagttggttttcacttttctttggtgcctccttgagtaacataataatcgaccttctgaaatctttatctgacaatttagagatttcttcttggtttggatccattgctggtgagctagtgtggtcttttggagatgttaaagaaccttgctttgtcatactaccagaattgtttttctggttctttctcgtttgggtagactacgtcagaggaaagatctggggctcaaaggctgctgttcagatccttttgtcccatggggtgatcctttgatgtggtgcactcccccttcctctagggattgggcttccggagagccagactgcagtgattgttactgctcttctgggtctagccacccagcagagctactgggctctgggctagtactggggagtgtctgcaaagagtcaaacacagatgtgatctgtgtttgagtctctcagctgtagataccagcacctgctccagtggaggtagcatgggagtgaagtggactctttgtagttttgtttagtgagttggttttcttgaatactgggtactagtagtacagttgttacatggacagactcaggacctctggttagccaggatgctacaggcagtggaaatagctgttttcttttttcttagagtgtggttgttcttttatgagttgctataatggcttgagtttgttggcttctagccaggaggtagagctttcaagagagcatcagctgcagcagtatgggggatacaagcttgccctaagatcacctggataagtatttggttttctcagctgatgggtggggacatagagctcccaagagattatgtcctttgtttttggctgtggggtgggttggtgtgggtggtggaaggcggcagtgtgtagagaaggatcaccaggttggggaagggtgaggcttgtctgactcagattgtccttgggcagggcttgctgtggccactgtggggtatgggggtgtggttctcagcactgggaatttgccccaggctataagcctcccactgagaaagcaagcatggctttcaggctccctgcatgctgcatcttctgtgttcatatctgcacttcctgtttgaacctctcccaccccttcctccattcctcccaggaaaattcatgctcaattgaaattatcacaaagttcatctggaactttccttctacctgtggtccttccctaattccagtggcaaccctcccgaaggacccctgtgagataaagtcagaaatggcttccctggggaccaggagtgcttatagggctcttcctgctgttgcttctacttttaattttcgctcagctctcttcagctctaggtaaggttaaatcctactgtttcctggattttcaggttccccagtgaggatgcatgttcagaggcagactccccctctcacactttgggcacttaacggtttttctgctgtctcatggagtctgcaatggcaagctgctgctttcaaagggtctgtgaattcttttggttttcctgatatgtttctggagtagttcttggagcaaaagttcacggtgtgagtctccacatgctgtttctgcacgtccgagtgggagctggaagttagtccagcttcctctccaccgtttttttctttttgttgtttttaaaggttacaaggcctttgtttttccttctgtaaaataagtctttagaagtagtctattaattttattattaaaaactcaagtttttattacattattattgaatgaaaaagtaaaatatatgtgacagaacttctgatgtgctctaggagttgaagattgaatgagatatccttcagtgagctcatatatttatatttcttcttctctttctttttttggagacggagttttgctcttgttgcccaggctggagtgcaacggcgcaatctcggctcaccgcttcccgggttcaagcgattctcctgtctcaacctcccgagtagctgggattacgggcgtgcgccaccatgcctggctaattttgtacttttagtagagccaccacacccaggatctttctttttaaagaaagattcttctgttggagcttgtgagctgaaggacttcaggaaaacccacggaatcccctcaaattgtatacagatttttgtgatgtttgtgtctcacgtgtccgtgtgaagagaccaccaaacaggctttgtgtgagcaacatggctgtttatttcacctgggtgcaggcgggctgagtccgaaaagagagtcagcaaagggtggtggattatcattagttcttacaggttttgggataggcggtgcagttaggagcaatgtttcgcgggcatggggtggatctcacaaagtgcattctgcagggtggggagaatcacaaagaaccttgttaagggtgggagagattacaaagtacactgatcagttagggtggggcagaaacaaatcacaatggaatgtcatcagttaaggctattttcacttcttttgaggatcttcagttgcttcgggctatctggatgtatacgtgcaggtcacaagggatatgatggcttagcttgggctcagggacctgacattcctgtcttcttatattaataagaaaagcaaaacaaaatagtgaagtgttggagcggcgaaaaattttgggggtggtatggagagataatgggcgatgtttctcagggctattcgagcgggattaggggcggcgtgggaacctacagttggagagattcaactggagaaagattttggggtaaggggtaatattgtggggttgttagaaggagcatttgtcatatagaattattggtgatggcctggatgtggttttgtatgaactgagaaagtaaacgaaagacacaaggtccgaataaaagaaggaggaaaataggtattaaaggactaagaattgggagtatccaggacatccaatcagagagtgtccaagggggttcaacgttattgtttgcttggttggcgagtttttgggctctatccttgagttttttatgttgtcatataccaggccagattgatttaggtaaaaacaacactcttcattaaaaaatatacagagtcctctttaacagtaagtcgaggccttggtgattttggaggaaagagaaatgcaaagccagcaactgtttgttgaagaaggattagaaacgtttgaggtaaaaccaggagccactaaataccaagagcctgagaaacagcttgggtgatttgactaataaaggccggtctgttattggactgtatagaggtgggaaggccaaactgaggaattatgtctgacagaagggaagaaatgactgcggtggtcttctcagatcctgtgggaaaggcctctacccacccagtgaaagtgtctacccagaccaagaggtattttagtttcctgacatgtgagtaaagtcaatttgccagtcctgggcaggggcaaatccctgagcttgttgtgtagggaagggatggggcctgagaaattcctgaggagtagcagaatagcagatggaatgctgagaagtgatttccttgaggatagatttccacgatggaaaggaaatgagaggttctaagaggcgggctagtggcttgtaacttaacatggaagaggttatgaaatgacgacagaatagaatgggcctgtgaggctggaaggggatattttccttggtccaagaactatttgccttgtgtgggaagagattgataggtggaagtttcagtgggggagtgggtgggagtggtcagatgagaaggagaaaagggatagaagtttgaacgctagctgcttttttagttaccttatcagcataagcattgtcctgagcgatgggatctgatgccttttgatggctgcttttttagctaccttgtcagcataagcgttgtcctgagcgatgggatctgatgccttttgatggtctttgcagtgaatgactccagcttcctttggaagtaaagcagctttgagaagagtttttattaaagaggcattgatgatggaggacccttgcatagtgaggaaacctctttctgcccatataacatcatggtggtacaggatatgtgaagtgggagcaggcatttcaaatggcggaaagcagtacaagagagggagagtgtggtgggaggtgccacatacttttcaatgaccaaatctcatttgtattcagagcgagaactcacttatcaccaagggaatggcccaagccgttcattagggatttgcccccatgatctacgcagctcctgccaagccccacctcattacatttccacatgagatgtgagtgtggacaaatgtttaaactataaggataaaaagcaagatctttaggagataagcatagagatttaggagattagcctacctgtcatgttcaagtttctatgtaggactcatatgatatagacccttgggccaactttaccctgttgcatgccccgtctctcacatgcaatacagtgactggtatgtagtgatgattttatcagtgaggatcctggtagtaataggtggattttttttttctttttgaagatagtttattgaagggactgttttcagaggtgtgaccatggtttaagataaccaagaaaggatgatgaatcacttagggactagcagcacttggaaactgttattcatccaggtgacagggcaagggtagaaatcatgttccagaactcagtgagagttgtaggcatgaaagaggagccttctcaacaggagctgtggccaaaaaagaaacaaggcaggtaagaaatggggaataaattatgccattatttctctttccttccactctttctttttctgctgatgcttcctctcactggtgaaacccaaccagaagctaaatggcaagtgaatccctagaaataaggcaaggcagagatgcagagcaaggcagataaaactagaaaatgggtctagggggagacaaatggaaataatcaacagagtgctcaatacttatttgttgaattaaactgaatttttattgttaaagtggaaaacaagcaaatgcctgatggtttaatgttttcttatatacaaaacttgaaataaaaatctctttgaaattttggaggcaactatttcatcttttgaatggttgaaatagtaaaaatgttgcaatacttaatctataaaaaattaaatactttatatttttcttttttcttttcttttttttgagacagagttttgctcttgttgcccaggctggagtgcaatggtgcagtcttggctcactgcaccctccgcctcctgggttcaagtgattctcctgcctcagccccctgagtagctgggattacaggagcccaccaccatgcccggctaattttcatatttttagtagatacggggtttcaccatgttggccaggctggtcgcaaactcctgacctcaggtaatccatctacctcggcttcccaaagtgctgggattacaggcatgagccaccacacccagcctttattttttgagagagtctctcatctgtcgcccaggctggagtgcagtggcacaatctcagctcactgcgacctccaccttccaggttcaagtgactctcatgcctcagcctcctgagtagctgggattacaggcacacgctcccatgcccagctaatttttgtatttttaatagagacggggtttcaccatgttggcaaggctggtcttgaaattctgacctcaggtgatctgcccgtcttggcctcccaaagtgttgggattacaggcgtgagccaccgcgtccagcttttattgatagtattaaaagcagttcacatttactgattgtttgacatgtcccaggtcactgtgctaaatcttttacgtgtattcttatattttatcctcacataaccctgtaacgtgtcaatactgttgctatactgttgggatgcatcactgtacaaaacaagttccacaaaggccacagatctttataatctgatattaatatttctataccattctgttgttattgttagtattctctggttactcttgaaattgagcgccttttcatatgttttagccatttaattttgtgtgtgtgttttgtgaaatcactgacttagtcttttgcccgttttctatttggttgtctttttattattaatttggaggaagcctgtgtatatttggatatgtgctattagctatgtgttgcaaatgacttctgccatctgggagattcaagctgaggtattaagagcaggtaggatttgggtaggcaaagatgagtgtttctagtgagatgaaagaataaacaaaattataagggaagaagatataattcacatattaaatagttgaatagtttgattggactaacaccagaaagctcaaaatatgtagcaccagggaagcgctagaaaatggcaaaaatatacctcagcagaacatttgctttaaatcaatacgtcttctattcaggaataacctatttcaggcaggctagacaacctgaaaggaaccccaaagatagtttgcctctctggtaggcagctctaggctttcgctcctctgccagggaatgaatcttcttttactgaaatggccttgctgtcattgccttgtgaaaaggtgtgacttaaaactggaactgatgaggggagaagcctagaggaaagtccttcctcttgtcctccggctctagatttctcagagtttttgcatattaaagttagaacaccttcatgcggctgcccttgctgacctgatgtttctcattatagagtcattccttgaaggttgggactttgatttcctatgacttggtgtatatttccctacagaacttgaatgccaatggctgaatggctttttggttttagcctccctttagtctcagcctccatcttactatgtctgcaccaatgaagaagtctattcattctgttccctagggagattatgctagtgttttaaaagtctctgccgactcttcaggatttgcctctcccaccatttatcagacaaaaatgtttctgtggtttcacttcttaattttgtatccattagaatttgttttggctccaagtgcctaaaacccaaaaatatagtggcttaggaagatggaacttttatttttatcccatgtattaataaataaaggcaattcagggatgggaaggcagctctgtgatcatctggaaccaatgtcttttcatctcattgttcttcctactttatccaagagggttgctccagcagcaatgtatgcattccagccagcaggaaggagaaatggagaaggacatctccttacccctctgtaggacttctcagaagttgcatacactactctggttgtatcttacgtgccaacgcttagttagcatagccatacctaaatctaagggaggcttggaaaaatatatctagctaaaaacaggaattcctgatcatattgaaaaaaaaaaaaaaagagaatggatattgaggattaccattgatccttgccacataaatcttttgttattgtgacactaatagtttcctgagatgtttaaggagaaaagctcagaatattgtgggtatatagccaatttaaaataaattatcatcagaattagcttatatctgacattctgaattttggacccttattttaaaatttttacactggtctagaaggtagaccttaacttttgaattttttatcatttttgataagtttggaagcttgacttctttcctaaacattgatgtaaggtttcatgaaatttttaagtatagcaaatgctgttgaacattgcaaatgtaaaatatggaggaggaaatatgtgctttttatctttatagaagataaatatattaaaccccctattaaaaatcgtctatagaaaaaattatagcaataggtagtataaaagctctgggttagagtggattcaaatatatggaaattaaatgaaaatctagaatcagttcactgagaattagctgatacagtgagcagcagatataatcccatagacactgcatatttttttaagtcctgatcttcacagtagagcttaaagaaagtgtagtattgtaatgtaattattctcattattaaaaatgatttacttttaaaacccagcatgttacatcataagtaatattcattttttcttccataggtaagaagtttgatagctgtaggactgggtgttgcagctcttgcatttgcaggtaagataaagaatacataccaataaattgcaggagaaatctttccaaatagcatctacagtgattcatgagtagacccttagtattctgaggttttggttttcagacataatacattctcattctttccaccatttgtagttactgaacatttgtcattgtagcaaaatctagataaactttatagggaagaaaattagtgataaaaagccagaaaaactagctccaataatagtttattcctggcattttttttcagtttgaagtatagtatactataaaaagaaattttaatattatgcaatgtaagtggcatggagtgcctttattctcccatatttattttttcttgcagacaggtttatacattttaagctgtcagttctttctcatgagcatagttgttccgtgtagtttattgatttgtctctaaacatattggtataattaccttgataaaccctggggaatttttttcactgctaaaattacgtttttcgaaagaatagttcttttttttttcttttttttggaatgggcaagactgtgccccttccagaggctctggggagaagccctttccttacccttcctggcctacagagtttgccttcatccttggctcatggacccttcctccattttcaaagccaacagcttagcatcttccaacctctgtctgactgtcactctcctccttctctcttaaaaagattttgtgattacactgggcccacctggataatcaaggatcatctccccatctcaagatcctgaacctaatcacatctgcaaagtcagttttattacataagggtaacatattctcaggttccaaggattaggacatggacatctttgaaggccattattcagcacagcacaatgctagtttttcttttttttgagacggagtcttgctctgcccaggctggagtgcagtggggcgatctctgctcacttcaagctccgcctcccgggttcatgccattctcctgcctcagcctcccgagtagctgggactacaggcgccagccaccatgcccagctaatgttttttgtatttttagtataaaaatacaaaatttagccaggatggtttcgatcgcctgacctcgtgatccacccacctcggcctcctaaagggctgggattacaggcgtgagccaccgtgcccggcccattcgaaagaatagttctgaagatctaaagtaaatttgctgagtctgtcattaacttacagcagttttaaattacatagctatatcctaattaaatgttaatttgagaatatgtccttattgataaagatttacttttttgttctagcatttgtgtttgtaagttctatcggtttgatcttgttaattggctcttttaggcagagctgcattccattttggctatatagagtttagtaagatctgatagaaaaatgagaaataagagggtcttgttttgtatggtatttattttctcacaattatcatttaaaacactattttaaccttttgtcttggaaatgatgaaacacttcaacaatcagaactttaaaatctagatcagtggttcagattctcttgatgtttttgtcatcaaggtcttatgtctcagttatataacttatacttaatgaatttctgaggttttatgagaagaatatcatgtctcaaacagaattctgacaaacttgcccctaaacataaaggaattttagtattaattagagtaggcatagttatgaattcaaatgtaaggttttgatttgaaattagataaagatgtattttttccagggtcgtctttgtaaaatgacaagaattggtgtgtgtattctttatagaccacaccattcccaaactcgtattactgactagaatattatattaaataacaacaagatctcttccagagccaaatacaaccaaataatagaatttaggagaaagtacacttagatgtgttagaactaggtcttctagttagagtaaacctccaggtgtcacttcttgaagcatttaactgctttttaactgagattagaagtcagtcactgtggttttgaagaattttgaggtaatataaaagctacatttcatactattataaaatcaaatggaagatgacatctatgtgataagagatacaggcaagttagggaatcagcctcatttaatttcactttatttaatgttctcctttatctcaagacctttttatcttcacattttcccatttctggcatcctgtctttcactgtaacatgtttgcacagaataacagtatacataggcaggtaaatttttctaaaacagtatacataggtagttgaatttttgcagtagaactcttgatttgcaaataggcttatggttagaagttgaattaaagcctgtagtgtcatatactggttttctagcaagactcttggagaaagagatactagtagaagacacaatctgattggggtgcaaaagataaagtagctagataatattttactcttatttgatgccctcaaaataatttagaacctgttttactattgactcttagttgttaaaactcaggggagttttgattattgggattcccaactagggaaagaactaaaaataagttttcagagagagtagccatcctcagtgagaaaaattgataattaacatccttggtaagtatttcatatgtaattgcttttttactttagagataattgattaaaaccatttctgtgtagtatagatcataaatataatttgttttctatatatttcaaagtgattatcataaaaagcaatacaattaaccattttagtattataagtatcttttatatgtaataggactttacagtttgttgtataaagaatactaggatgttattttttttgtgacctataccataatataaatgtaagatattacacataaacattgaaaatttctagttttatgatcataaactagaacttgataaatttaatggctatgataatggtattaacatgaaattttgccctccaataaattaaaaatttgaaaaaattgaccatctttctggtaagttttgaaatacttattgcaataacatatataaactatcaataaatactgttgcaagcactttgaaggtgttgattgattttgattatagaaaatacatttgcttttattccctttactatttaggtcgctacgcatttcggatctggaaacctctagaacaagttatcacagaaactgcaaagaagatttcaactcctgtaagttaaacgtggctttagttagaagactcattttgatttttgttcatatgacatatttcaattaacttagaaaatgtcttggattttccaatgtttgtagaagtttgtttccttcactatatcattggtgagtttgtctaatttactggctcagtttcttttaagttattggtcacattatttttatatctaactttattcctggttttgacatctaattattataatctgtttagtagtattacatcaaatttgatgtaacttactttacccgtttagttactgttcatttattcaataaacatttagtgagtcccccatccctgtgccaggagcttggaatagctgatgaacaaagaagacatggttcttgtcctgatgaagcttatccaagagttgatgccatcttgtaatttgaaactagtccccttataccatcatgcctggccatctcaaacataaaattatgagatttcaaccatgaaatcctgtagaacttattatacatttttgtaccagcattatagctactctggggagctgaatgtaagtgaaaaaatgaatgagagtatgtatccgtaaaagcaacagtatggattgtagtttgtaaccactgaagacaatataaagaaaagtcagtgaggccctgcagcgtaaacattggcttcagggaaacagaagcagatctgggatagatcaacttggttgagacttgagattgtcaaattgctgcaaaccaagttgatcatccgctattctgctattctgagttcctggcacagggatggggactcactaaatgtttattaaataaatgaacagtaattaaacagggaaagtaagttatgtcaaagttgatataatactactaaatgtaaaactactaaactacctactttatatatgttatttcaataaatatttcaaaacttaccagaaagactgtcattttttccaaatttataatttattggaggacagaatgtcatgttaataccattatcacagctattaaatttatcaagttctagttcatgatcataaaaccagaaattttcaatgtttatgtatagtatctttatattatggtataggtcacaaaaaatgaattgcttcttttagcaaagacattacaggcttgtgaggcttagttagccatgaataatgacagcaccaaaggatgacatactgacaaataattaaacttagattcaaaaaaacagcaagtgattttacagtcctataaatgcatgtctgtgattagagggaacataggtgtattttctgttttcctatttatattttatttggctaaaatattggtaggtattcagtaaatattctttgagcacctactacatactacattaccatagacagtgggatatagttatggaccaaagacattgccgtctaggagcttacatgttagtggagagacacagtgtaaaaaaaaaaaaatgaagtaagatatataatacctaaaagtgtcgagtgcttttgagaaaaccaaatcagggtaagaggttaaagagtaacagcaatgaggaatctttaccttagataggccaggtaaggtttctccaagaagataagggagcaggccatacaagcctctggtgtaagagcttcctaggtggtgggatcactgcaaaggtcctgaggtgcaaatgagtctagcagcaagagtaactccaaaggagtatatgaagggaatagtggtagcttgggcccagatcccttagggcctaatagacaatgaaaaaaaacttcaaattttaccttaagcgtgaaagaaagcccttggaagggtttgagcatggaggcaatgtgatttgtattttaagttatcactctgcttgctaccttagagccagagtagaagctgtgaaaccagtaagcgggtattgagatagtccgggtgatagatgatggtggcttgaaatagagtagtagcaatggacacagtaacatagttctttaaatgaattctatttatatatttccatatgtttataaataataaatggaaagaatttcagaaatcgtttcttttctgttacggtgatcttcaatatagtgtaaatagaaaattaccaagctgtgcaaaactacattatttaacattgtaaaggaagagagagcaagaaaatgagaaaatcttcagtagttggtagaggcttacagataaggccgggtaattcaagagattataagggatatactcatgtaaactctttattcagtggctcatatgacctgctccctcatctcagaggagccttacttaagagtctgagcctggtacctgcgtttcttaaagggaaatgatgtgtgtacccccttttccctctttgtggggctcaaggtaagaaacttcgccttcaataaatctggcttctttttcacaaagtgctactcttaagagtttgcagtaaaacatcttagaatatctttatcattgtcataatcataattatatttttacctcaggaaagatgcaagtacttttaaacaattttaaaactagtaatcatttccagggaaactgagaaatgaaatatgtgcatactttctgttggtactaatgaatcccagtgtcacacctcataaacacagtatacacagtgttttgattttgtaaatattattaattattgaaccaaatagggttactaaaaagacaggaactgtaattgtgggtcactaaatctctgtcattcaaaaaagattgtccaaggctcaagtttcaacggggggtctcttttccttgtttctttaaactttatttgctttctctaagctttaacatgttgtttttcaatcttatctctttttcatacttttttttcatcttgctgaaatagtgccttggataagtcttttatatggaatgcatggatggtaaatgtattttctgctttgttaaacagtttgtttcttttgttctcactgttaattatcagctgctagctccttgaaatctggtgaagccaacattagagaagtatagaaatctctgctgagactaagccttagtgcctgaactcccgcattcctgcatactcacagctagattttttggtggtcttattattcttattccattgtagacaacctattgttttggttttcttttgttgtttgggttttggggttttacattttggtggtggtggcttttatttttagctctgaaagtttgtaggattttctctttcttactgatgttctggaatttcacaagaattcttagtgagccctaacttatttgaaaatggtctttagttctgtaagattttcttacagttttttcttttattatttcttcctttcattgtctctcttttctgcttctggaactctgaacagagagatgagaaagatgttggacctgataaaaagatgtctgtcctctatgtctcttaccattttatctcttattttccatctccttatctttctttgctcttcattctacagtattttcacagcttattttccagatcaccaggttggcctttagcaatgtctattctgtttttcatctatccaccgaattcttcacatcagcattttttttttttttttggagacagagcctagtagtgcggttgcgcaatctcggctcactgcaacttctgcctcctgagtttaagtgattttcctacctcagcttcctaagtagttgggattgcaggcactcgtcactattcccagctaatttttgtatttttagtggagatggagtttcaccatgttggccaggctggtcttgagcttctgacctcaagtgatccacccacctcaacctcccaaattgctgggattataggcgtgagccactgcgcccggccaacgttagtaattttctaacttccaaggattctttcttgtttcttttttctggcaacccattttttaattaatgtggtatccttttgaatatttctaaagccattaattagcatttggccaaattctcttctgcttcctaatttatctccttttcctaaagtcagttgttatgtgttcatattggttctttttttcccctccatgataattgggtttgctcaaatgtccagtgatccttggttgttgattcatatttatgatgactaaattgactaatagaagtaatgttcttgacttttcttcagcagtttggtagggttgcttcaacagcttaattgaatgacagtgttgacagtgggctgtaaataacataggtgggtttgttaacaggcatgtctttcagagcaaggagactagaaggcagcattggtacctggagagtccaggagaggttgagcaccgtgtatattttactccttggcatagcttctcacctccctaggcttctgggttctgaaatgggatctgctggtatgcctctttggttctcttagtacctaccacccaaaataagatgcgtatcagaaaaagaggcatatggttctctttctcagcctgagggcatgacaggtacctggcctcttatgctctatatgagtagagtaggaatgatctgtttatattgttctggtttaataagtttcgctgatttttttattgttgttgactctgaatttagtgttcttgttttcctgaaaagggtttctttttttctctgatgtttgaagctgctgggatttttctgtacatgcaaattttacctaggatttctttaaactttctggtttgctatttatcccatttcttgttttctaggcctattaagggtgttttaaaatttacagtgtctttactcatttcaaaggcacttcggaaagcaaaagatctttatgattcagtctgctcttttgaacaagtgcccttttgcttgtttttttgttttttttttaaattaatgtattaatgtatattattgactcagccaatgtctaattacccttaaatttttttctgggggagaaaacccatccttcttcttttttttttgaggctttgaattttctatttgtgaatctgtccttttatttgaatataattttttaaattgcatttattttgttttatgatcaagtgaaatttatggaaaaatatactaattaaatcatcctttgttagctttaaatcaaatagattattgtacataataaagtttatagtttatgataaatgtattcttttaaaactatgggatgatccagttcttctctagttgtctggaggacttttgtgtttcaggctattgagtgaatgaattagctaatgaatactttggtttaacttagcaaaggagacacaaaataatctaacatggcactatagcatttattgctaattttagaaggaaaatgattttgatttctgtcatttatatatacaatattttatgaatgggatagtacaaaataatcatttgtaaggtccaggatgtgtttctgttttcagaaaaaaaggaccatttactccatctatttgatggtatacttgttccttacagtaatctcattttttggatctaaacattttctttgacctaccacagtgttgtcagaaaatggttctgcagtggcttatacctgtaagtcctaatataatgcaatgtgggtatattattttcaagcttaaaaggacctttcagttttattagtggggaggagtacagagttacaattttgtgctttctcatgacatagatattaattcaaacataataatggattaaaatactgtgataacagttttgttctatttaaagttatataagacctaaattttctagaagtttaggaagcatgattttctctgaagaaatgtgtaaatacagttgacccttgaacaacctgggtttgaactgcacaggtccacttaatcatgattttaaaaaataaactcaatgagccctccatgtctgcaatgaaatgtagatcaaaaatgtagtattcatgggatgcaaaactcacctatgctgaggccaactttttgtatctgtggtttctgtagggctgaccgtggtgcctgagtgcagattttagtatgagtggtcctggaaccagtcacccacagatactgagggttgaatgtattttagtagtgtgtaacatagcaattttttgttttctctttgtatacttttctgcacccagccccacatgttaagtctctattctcaaaatggtctagatctttttggaagggttgtgttgattatatgtatatacagattgacttactcgtaataaaatcagtgttcatatgaacttcttcccgacactagatttttggcagccttttctgaaactctatgtctacctgggcaaaactgaaagtgaaaaaattgctcagataccaatacctgcttttaagattaatgagcttggtgactatagtgggaatgacagtttatgaaacatgataaatttatcttttttattatgctggctccaaattttagagctccctaaggtaaataaagactcattgaaatatttttttcctgaataaagaattattctatgtagtagttcaggcatgatttaaaaacaaaagtaggagcaaatatttggtgatacttctgttttgttatgactaaatcaactaattacctttaatttagggagtaacgtatgcatctagtaaaaattttggtttcctgaaagaaaccttaaaaccagcccctattcctctaagtccctcgttttttgagacagtctgtctccattgcccaggctggagtgcagctgtgcactcacagctcactgcaacctccacctcccagggtcaagtgattctcctgcctcagcctccagagtagctgggattacaggcatgcaccactacacccagctaagtttttgtatctttagtagagacggggtttcactgtgttggccaggctggtctctaactgacctgaggtgatccgcccgcctcagcctcgcaaagtgctgggattacaggcgtgaggcaccacagtcggcccccttacttctttccatttgtatctgtatctgtatttctctctctatctctctttatatatgtgcatactctctatgtatgtttagaaagatataaaatttgttcaggttagtatgtgtgcttaacccaatttgattatccttcctctcctcaaaacttgtgtcaggggtgggggactatttgtttttttactggattataaattacttgaaacttggagagtatattatattctcacagtattgattcattgatagattagcatctgtgtgatgaaggacagtccttgatctctcatttgaaaagtgcctggtacacagcaattgctgaagtgtttattgaatgaattaattgccaggaattatttattaccaagtagaaatttataataagctgttcaaagagtatagcttatataaatggccagatctgactccctagaacccattttttaagctctagtcatttccttagtttcttttagtattcttctttctttaattgtataaatagcctgtgctcattgttgaaaatttagaagttaaaaacaaagaaaaaattataatcccaccagctaaaaataactttaaagttatatgctttcagattttatttcatgtaagcatacctatttttccctacttttgtaaggaaatggtttcatgcttagaaacgtttaatgcctgtaatcatatatgtgtatgtttcctcctaaaagctaagtttatacatcctgtttctctgtttagagctactgaaaatagtgtctttacttgctgtctccattcctttctttccattctgtcttaaatacactctaatcatacgctcacctcactttctgcagctcttctcagtttttgatgtcctctttgctaaatccagaggtcagtttgtggctctcattttactttacctattagaaactttgaaaccatttttcatttcctcactcttgacttgtagttaccatcctcctttactgctaggccttgtcagcctccttgactgattcctctccatttctataccacaaagtgttgcagtctttagggaagactccttggacttctaatttttaaaccatcttacttcagtctcatggctttaaatgctatctgtacactaatgactctcaaatgtaaagtctgatgttaagtcagacattctccacttggatatttaagacattttaaacttagtatatccgaaatcattctcctcatgtctgttattcacaacaaataaacagctgctcctttcctcagtcattaaatggcaatttggcagtttaggccagaaaccttgaagtcatttgcacagcttgggttctctggaaagcagagtgagataaagattagcaagctatacttttattaaagagtgctcttagcataaacaactccagaaagaaagggaaggacaagttaggcttcagtgcattcctacaaaagcctcagccaatctcacaataacctctaagcaaggatggctcattgtagttatcccaagttggggcaaggggtcataggattaaatgacattacccaggaagtgagcatatatataagaagtccaaggactgaaccctagagaaatacaatgtttctatcccatgtcaaccagtcagtagatacaggctgccctgcaaagtgggataagcttgacttcctttaggcaaggcaattcctaaagtgtctgacagctgggagctatcagccagccacagccccagtgtctggggagtaagtccttcacgcctgatggggatctgatgagcacataacagtgtcctcaacatcattcttaatttttctttttctcatatcccaaattcaatccatcaaggaaatgttagttctgttttaaatatacatccagaatctaaccacttttatcacctcctctgctaccgccttagttcataccatcatcatctgttgtctggattattgttatgttttctgaactggtctgctacttctactcttgcacctttctattctctacatggcagttagattaaatcgaagttagattgttattccagtgctctggcttctcctcccacttaaaattctaaattccttccattgtttacaaggccatccacagtctggttcccattatatctcgagtcctccttttctccttgttcacgcctctccagcagcattgaaaccttttaatccagcttcccagcctctcttggcttgcctgtctgctagtgtgacatactcccctcttcattagttcctccccattctctgttggctagtgtggtaggctaaacgatgtctgccatatcaacattaaatgacttcatcaaggttatccaatgagaaaagtactacagagcttagaaaaagttcaagcattttgcttctaccagtctgttttgttctttctgttgtatcttggtgtagaaaaattaatctgttttaaagtgaaaaaaagttagtattttttaagacttcatattggtcaaaatttcttgaaaagtttcattgtttggtgcttccccccgccccataattttgagttgacttctagtaaaatgcattactctcactgcagctacatgatgagattgaggtcatgccacctcatacgtggaactaatgatttcttgctctttctttcctatacagagcttttcatcctactataaaggaggatttgaacagaaaatgagtaggcgagaagctggtcttattttaggtgtaaggtaggtgtgcagcataagtattgttttgttgtgtggccaagcttgtctttaaaaaagagaaaacgttacaataaggttatacttagacttaaaattatgagtaggtggcagaggagaaaatatcaaatttttatattttaaagcctcaaatctaaaagtatcccactcccctaaaaaaacaaaacaaaacaaaacaaaaaaacaggcaaagttgtgaagtacctttattctttaacaaggatctataatatttgaatactgatgtttcagttaaccaaaatatccttttttgtgacattctctctagactcagttttataatttgatatcatattgttaattataatccaggatatgtttcatagttcttttctgcttctgcagtgtgacatcaagcatatttattgtgcttgtttcaccttagtatccttttattgtctaactttggacaatatgagagaaaattaatgatattatataattgctgtgtgatatcatttaacatttaatgttaagaatattttcccctatgataatcatttgtttaccatatgttcccttagagcctactctcaagtttttgtgggaattggttacagtatgtcatgtacaacaaatcttctgatgatataatcaacacaattaagcaaattagataataaagtcctgtattgacaaaaatgttttgatatcttgtaaattttttaaaatttaaagattttttaaaaagccaaaacattttattatttcttatgacctagcagaaaaaacaagagttgggaggaggagcccagtttagtttggtgctttatttaagagatctcatctcttcttagatgagatctctccttaccagacaatagaaaataggaaatgattttaagcatgagggtcagattaggaagtttgctatactgccaactatttcttgcttaatatcattcagaatggcattgttatttttcctgaacttttattggcctcccaaaataccctgttgattatcttgaaatctgagtataaaacattataaaaccaagtacaaaggtttttgaggatatcctttaatattatgcagggcacttacgttgttaggacagacaggagttgactgtatttttacattctcttaagatatatatttataaagttttatcccatagaactgaaagctgtataaaattcacttggaaaattcagtgattaagagcacagactctggtatcaagtatatatgcgtacaaataccagtttaacacctattaaatgggtgaccccagtttaatcatctgtaaaatagagataatagattagttttaactgcataaagttgccgtgaagattaaattatataatatatgtgaatttctttttttggaagtttttttcttttttaaacttttaggttcagggttacacgtgcaggtttattataaagataaacttgtgtcacaggggtttgttgtatagattattttgtcacccaagtactaagcctagtacccaatagttattttttctgctcctctcttacctcctaccctccaccctcaggtaggcctcagtgtctgtttttcccctcttactatttagctcccacatgtaagtgagaacatgtgatatttggttttctgtttctgcattagtttgctgaggataatggcttccagttcatccatgtttctgcaaagcccacgatctcattactttttgtggctgcgtagtattccatggtgtttatgtaccacattttctttatcctgtctaccactgatgggcatttaggttgattccatatgtttgctgttgtaaatattgccacagtgaacatatgtctgcaacacatggtacttactaactactcaataaatagcagccaagcaaagcagattattgccctgagtctgtcgcttaggcgctgccctgtatgatcttggtcaagcttttttgttttgttttgtttttagcttttctatactttggcttcttcatttttgaattgagagtaataatattctgccttgttggaataatataagaatgatatgatgatacctttttacataatacctaccaaatatcaggtgctgaaaaaaatttggctcctgtttctttccatgtctgtcacgaacgcagaagctagatatttgtcctaacacattaagtggaaaggtaaatgaaacttatctgctttcctctagccctttcttttcagtcaggcaatgttgattatgacaagataattttaagatgtgagtatattcattgaatctcagctgtgtagactatataacaggtaggtgaaggcaaaatggagccgatccttttgataacctattttaaaaatactgtatgtgttctagatgatactatacattctgacatattgcatatgagaattgtttattgaaatgtgtatttgagtctttgccttatgtttttccttgcaagagaatagtgtcctgcaatatgactcatgtctgtaacaaaaagcctgaattattttacaaagctgcccaggaaaattgtttttatacctggtatagtaagtcctcacttaatatcacccatgggttcttgtaaactgtgactttaaacaaaatgactataatgaaaccaattttttaaatcaatgaaaggatgttgaaggaaatgacattattcagggacctgccatacatcattttgcttaaaatcacagtttttaagaacctatcaacagtattgtgtattatatgaaatgatgcacatttatgatttttttttttgagacagagtcttgctctgttgcccaggctggagtacagtggcacgatctcccctcactgcaagctgcgcctcccaggttcacgccattctcctgcctcagcctcccaagtagctgggactacaggcgcccaccaccacgcctggctaattttttgtatttttagtagagacggggtttcaccgtgttagcaggatggtctcgatctcctgactttgtgatccgcctgcctcagcctctcaaagtgctgggattacaagcagaagccaccatgcctggcacatttatgatttttaagctttctaaaaacttttgtagaattctgtttataaactatattagtccattctcaagctgctatgaagaaatacccaagactgggtaatttataaggaaaaagaggtttaatggactcacagttccacatagctggggaggcctcaataatggcagaaggcaaaggaggagcaaaggcacatcttacatagtggcagcaggcaagagagcatgtgtaggggaattgccctttataaaaccatcagatctcatgagacttagtcactatcatgagaacagcacaggaaaacccgcccccatcattcagttacctcccaccggttcccctcccatgacatgaggggattatgggagctataattcaagataagatttgggtggagacagagccaaaccatatcactatatgttactcaaaagctcagtagtagaaaaaaaaaaagatgaaaccaaaactgctccatttgccagaaggtccaagaacaccactccacatacccccactgccagccagatgcattctagggaggtgtttgaaatctctggtctaggtaccatcatatttaaagttatactggaggtatatcatcatagctacatttagtttttatactaagcttaaaaactaggcttctctcatgttgtttaatctttacagcaacaaacatgtattaatattaaaatgtattaaggtccaagagacttaatataataataactaaaaggaaataaacactgccagcaaagcagaataggtctcatttccagagctcaccattaggagtctgatcattattatcttaaaggcagagtgttttgaatgccatacttgtgcatatgaactttccttccttgtgtttactttagttcagtggttggtggacctcagtatgcataatgcgttgtggagttttatgtacaaaactatgtggaactgattttcagagcattgtaattaattatcaaggaaattttgacggagtaattttcagattttgtattatgtgctcaactaaaacttaatatctagaataaaatggaccttgccatatatcttctaaaaaaatacaatggttcagcagaacattcacctatatatatatatatacacacatatatgtgcgtatgcgtatatgtgtgtatatatatgtgtgtgtgtgtatatatatatgaaatttggattttactgaacttatctcattatttagagggccacatggtgatgaaatttatgaaataggtttttaaagctcccccttttttactttaaaattatttgcatagtaatcctttataatattagtatttactaatatggagtatttgttattttaaggagtttacctttttacagtcatttttggagggtgatgtaaaatgcattaagcacttgtacgatatataatcctaatttcttttttttgtttttttttgagacggagtcttgctctgtcacccaggctggagtgcagtggcgctatcttggctcactgcaagctccgcctcctgggttcatgccattttcctgcctcagcctcccgagtagctgggaccacaggcgcccgccaccacgcctggctaattttttgtagttttagtagagacagggtttcaccatgttagccaggatggtctcgatctcctgaccttgtgatctgcccgcctcagcctcccaaagtgctgggattacaggcgtgagctactgcccccggcctacaatcctaatttctattttaagatacaaatcatagtttcagccctaaagttatttagaatctacctaacacaacatgccaaatacatacagaacagctagaaaacataagtaataaaggcaagatgtgccacagagcacctgtgtagcaaaaaaaggagttgataaatgtagattagccacagaaatcgaaatcattgagctgtaatttttcagtgtaattttttttgtttcttaataggcagttaaacagtatagtgttcatacctctggtatgatgtttaacagttattttctcaaaattcagtagtcttttaaccagacaatgtttaattgtttatctgggaggtacctacaagccaaaaagtaagtttagaatgctgcttcaaagacataggtaaacagccaagaggaatactcttaagtccttataggaaaatatttaattcattttactcatggaagactattttatgtgcctactcagcaattaatagtgcattttaatgtgcttggtgatctatcacttacccacagatcagaggtagcaagtaactagcaaggaactgccaaagactagaacaatagcagaatcaaggattgacagctgatagcataggggaggcactgttcaaaatagaacttaaatgaataacattctaggtccatttagtaggaggacaagcaaacatctgcagaccttgagagtttaattggtaataatgacaatgctgtgagccatccaagaaatgttaagttaggttatttacactttattttcaaaatgcaggagatatctaatacagtctcataagcatcctttactttcatgtgtgctaggttatgttaatctttttacttatattatctaatttttctttaaaataaacctgggggtaggttttattacgtgtatgctacgtatgagaaaattgcaactgagtttaagcaagacatactttcacagctaataagtagtggaatcaagaatttgaacctgtttctgactaactgtaaaagcacatgcttttagctattatgttgtggttcatccatgcaaattaaattattttgagctttacaataattacactgtgctttaagtcaactattattatccccatttgagactcagaaaagttaagtagcttaaacaagatagtatagctattaagtagcagtagtaggattttgttgttgttagtgttaatttttttcccttgcctagaaaatgtactaataagcaacatttccaatactggatacattgggttttacccaaataattttaggattatttaattatctactttaatttttgtttacagcataggctttaacagccaagcttttcccatgggtttttttcacaaagctaaataactatgagacataaagagttttgagatcctctgtaaaggtaaaagataactataatgaagcacttgctacattccaggtactgttctaacatttcgtaggcattaactcatttaatccttacagttgctctagccctgttttacagtgaggaaactgaagcaccaagaggataaaaatttgatcaagcttacacaatcttaagtggcaatactggcattaaaatccagcagtgtgccaggcgtggaggcttacacctgtaatcctagcattttgggaggccaaggtgggtggatcacgaggtcaggagttcgagaccagcctggacaacatgatgaaaccctgtctctactaaaatacaaaaattagccgggtgtggtggcgcgcgtctgtaatcccagctgcttgggaggctgaggcaggagaatcacttgaacctgggaggtggaggttgcagtgagctgagatcatgccactgcactccaacctgggcaacagagcaagactcctccttcttggggggtggggggggaaagtccagcagtatgcctctggaatccaaatacttgtctgctacaccgtatataccgccttccccccaaataacttagaagcataagttttcaaacttacagtattgtctgcagaagctgactcccctaacctatatgttgttttgttttttaaattgattgagaataaggattggcattacaaaggactgaagaaaaacacatgtaacattgaatcaatgatttattttgatggttagtggaattaagtggaaagctgtagtttcatatttgtccacaagatggtgaaattctcattaggtataattttttgaaacccatataaacccttaatttataatctgcatttgatgctatttattataagcactgtaatttctttttacagcccatctgctggcaaggctaagattagaacagctcataggagagtcatgattttgaatcacccagataaaggtaggtagaattcctatttttcataatatgtatatcaaaatatgctgtgaattcctttcagattaaagtcatatatgatatatagttgagatggaagtttgtgcgccacatgtattgtgatttttttctcataaatgagcatttaggttggagttcagtgattcacacaagtagtggatttatattatctgctttcaagaacttagttgctggtttttatatatgacttcctgaaccatctgatgcgcctaccatttttatcaagaaaaatcgaaaacacgagttatggactctttggttgtataaactgatttgggcatcacgaattgtatttatgtaaccttcaatgtaaaagcacaagagttagaggatttcctccaaatctgtgaatgtaatatgtcatagatgattctgaatttctgaattttattctggaaggctctgaggctgagccatttgtttttaactggccaggtttttaatgtaaatttatcttacagaaagacaattattataactttaactacactacagctgcttgagagggaaagcccatatgttcattgctgtttctgctttaaaataacagatggtagaaagttacactgtatttcagaagtcaaaggggggtgggggaggaaagtgaagggtttcttggattcttatttacagactttcagtttcctaattatttcaaaaaaattaaaaacaaattttggattcctctccatcctaaccagtaccaaaataaggcattctttttcagctttctcacttaattacttactataaaagtttttttcgctaagcatcatctctgttggtttttgcacttattattctttagtgtgaataaacatgagaataaactttcaaaagaggttttgctaaagatttctaaacagtttcaacagttactgaaagattcactcagctaatttactttgcattgtgggctatcttatgagcaagtagtgtttaaagaattacgatttattttgagatggtatatttatttgaggtgggattgttgactatagtgggcttactaacatcctttagtctcaccctgtgtggggtagctgggtgtgaaagaatggacttcggagcaagggatcagcatttttctttggcttctaccttccagtcagcattgtggccttgaaaactcccttaactccaaatatgagttttattatttgcaaaatgacaggatttatttctaaagtcctttttgtttgcatgatttaataaccttttatgcctattcaattaatgtagaggctgtaccctatgtttctgttcagatcagatttttaacttaagaaagatgcttttaatgtttttggattattgttccctctgagaatatattgacaactgtggactttttttccatataactgctcattcacccaaaatttataaacatttggagtttcagaaagttcatgcacttcctaaaacccatccatatactcacagttaagaactcctgctctagtaaaagtgtagtgataggaatgttggaacttctctctttgatggagttgagagatgatagctcataaatctaaagattatcctttgagaaggaagattgttttgttttcaatgggaagctaacagattttaaacaaaaatgcctcattgcctttggtaagcgaaatccaagagtatttggggaagtatgagaatgggcagcttttaattttgtttcttcttcttggaatccttcaacatatttactttagccaggtcaccactgggtattataggtagttggaaatacttaaatctcatttccagtgcttccgaattcatgaatatgtttccccacccacccccaaggaacttttctgttggttttgctaccagctgatagaacaagtttggaatttcaaatgtgtgaccaactataatttgttacacatttcattatcagctgtgcaaagaaagtgacaccagaaaattaggtgtgggaaatggctgaaaataaatttttgtaattagttttaaataagcattcagacgtattttggtaaaaaggaaatttttctttttcaatgtagtgagataaaaaaataatgcagtaaaaacatttcgtgtccttgatctaatgctttcaaggctaatatcttttagattactgcttttcttaaattgatgaagaaagaggttggtggttatgaaatgagtagttttacagtaatgcatagtgaatatagaaggggagaggacagattgcttagagatgtcttacaggctgtctaatgcagtcttaatcaatgtgtattttgcctattcttaccagtccagtttgtgcaagttaaaaacagaaaccaaaagtaaacatttagaaagcttataatatcgccacgatacccaaatgtgtgatacttttgtgctatgtaaaagtattggtccactaaagattggaaatgtttaaaatatttaaaaagtacacctttgccgtagcttgagaggcactgatctaatcaatgctgcctcctaaatctgggctttctgctctgtcccggggaaaatgtcctattagctctccttcaagacttttagtgattaagagcttcctgtttcacaaggcagcttgctttactggtggacagctctaactactagaaagttctttcttgcatttagatgaaatctgcctgcctgcagtggggagattctcaaccttttcccacttacacacctttcagtaaacacgcagtattctcacacttccttattagagtgtttaagtcaaaattaaatattgggatcaaaaacaagtcaaagtaattatactgttgaatggattttctctaattattctcattgtaaagtaagctaatttttatctgaagtcctgataataatatattgtaatttcttacagtatattacatttaaaaatgtgttctaaatatttagaaagagataatctccaagagtcagcatggattcactaagaaaaggtgatgcctaattaacttggtttttttttttttttgatagatttactggactgtttgttttggagggttcatctttcttttcccttcatttcagcattttagatttaaggctttgtgttaactaatttttttggtaaagagaaaattttgttttatgcattgattttccttgataaatgctgagatccttaaaagtgaagaacgtggcttactcttctttataacttatatggctgacacatcataaactctaaattcgtaagtttttttggtgagtaaatgaataaacaaatggataaaaacaaggcaaacacttggtaggtaaaacagaattggtagtgataactaatacattaaataatttcttagattagattgataggaaacaacctgacactaatcttccatttattcaaaaattatttatttagcacctactatgtgccaggcattgtgctaaatcttaagacaacttcaacaagacaattagatctctgtccccgtgggatcatgcattctaatggaggagcagacaaaaaataagtaaacctatttcaagttgtagcaaggcgataaagggtataatgagccaagatataaaacacaggagagaggcaactttacataggatgactgggaaaacctctgtgaggagatgtacaggatgagaaggagctagctgtgtgaaaagtggtaaacaaagtaaaggggctaatgtgcaaagcctctgagggagtgtgcttaaggacctgaaggaaaactagtgtgataggaatgtaataggcaaatggaaagatagcatgagataaagtggtacccagatttttaaaactaggtatgtattatgataatgaaatactgtaggttctatataagattttaactttgttccaaatgcaaagggaagttactgttaacttttaaacagtagagtgatataattcagtacaccttttaagaagtcatttttctttcatcgtcaatctctatttttgatttttaagtatactttaattgaagtgtaatttatgggcagaaaagtgcacaaatcataactatattcctttttcactttgccagcctttgcactgatggtgtaaaaatattggtgggtaaaactggtggtgtcttaacattagtcaaggcagtgacaccagtctatccatatatatgcatatgggaaaaatgaatcatgtgatgccatatgcaaaattaattcttaatggattataacctgttaaaagaaaaacttcagacaaatttagcagagtttatttgagcaatgaatgattcatgaattgggcagcactcagaaccagaagaggttcagagggcccccttaacagcataagcagcaagcttttataggccagataaagaagcaaagtagataaattacctgattggcttcagctaggcatctgccttgttttgcatgggcatggtatgatgaaacatttaccttgtttgagcatggtgtgatgagttggctgcttgtgatcagctgaaactatctgtttgttatacttctaagttgggtttcagtttgtgtaagtactaagttaggttgtagttcattacgtaggaactaagtacagagacagccccaggctaatggcatcctgcttatttaatttaacaaacctaaatatgaaaggtaaaactaacttccatattaaaaaaaacatagacttaggcaaagatttcctatacatggcataaattaaaggggaaaattttgcctctattcatgaaaaaaactaactggttattttgcctttttttgaaagttgacagatattgttatcaaggcgctctggcctcttaaaagaaattgggcagcattctttactttctgaacgtttgtgtaagattagtcttctttctttcttttttttttttttttgagatagagtcttgctccgttgcccaggctggagtgcagtgttgcgatcttggctcactgcaaactgcgcctcctgggttcacaccattctcctgcctcagcctcctgagtagctggaactacaggcgcccaccaccacacctggctaatttttttgtatttttagtagagatggggtttcactgtgttagccaggatggtctcctgacatcgtgatccacccaccttggcctcccaaagtgagattagtcttatttctaggtatttgtaagagttcacaaatgaagccatctgggcttggagacttctttgtgggaaggtttaaaattacagattcaatttattttattttttttatttctttattttttatttttgagacagaatctcactctgtcacctaggctggagtgcagtggcacgatctctgctcactgcaacctccacctcccgagttcaagtgattctcctgcctcagcctcccgagtagctgggactacaggtgtgtgccaccacgcctggctaatttttgtagattacttagtagagatggtgtttcaccatgttggccaggctggtcacgaactcctgacgtcaggtgttctgcctgccttggcctcccaaagtgctgggattacaggcgtgagccactgcgcctggccaattcaggttatttaaaagatacacatctctttcacatttttcatttctccttaatatcatttttggttagtttttttcttaggaatttgttcatttcacctaaaatttcaggtctattgttacaaatgggttcataatatcttcttattaccttggtaatgtttgtaattgcattgttaagccacatttttattcccaatattagtactttatttgtatcatctcttattaatctgtttataaaataattttttgcatcattgttatttcattccttccactatctttgagtttatttgctgttctttttctaattttttgaaatgaatagtcagatcactggtttcagctgtcattcagttcaaaatactgtaattttcattatgattttttttctttgacctgtgtgttatttgacatgcattccctcattttttaacaatagagggttttgtagttatctctatagtattgattgctagcttaattccatttgggaagagaacatactctgatttcaataatctagcatatggtcaattttgggaaaaatttgtgatcacttgaacagaatgtatattctgcagttactctatgcaatgttctagatatgtgagtaaagtttgttgactgtattgttcagatcttctgcattcttactatttcttgtctgcctactccattatctgttaagataggggtaaaacctcctacagtgattgtggatttgtctgtttcttcatttagatttttttgcttatggtgaaaaggattttggggacaaatgatttaggattgttaaatcttacatatggatttctcccttgttttaaatatctctcatgatttatagtactgctttttgccataaagcctaccttatcgaaaatatgtatagctgtaccacctttcctttggttagtgtttacatggtatatcttttttccatctttttattttcagcctttttgtatctctcttgttggtttgtctcttccaagcagaatgcagtcattttaagtgtgacaattttagacttttaatgtaactattcagtccttttacatttaatgtagtttactggtatttgaatatatacatatacacacacacatgtgtgtgtgtatatatatatataaatgttactttttgttttctatttgactcacctatattcctttttctgaccctttacttttagctggttctgttttttaaaaattttatacttttttctttagtaacttgatagatacatttttttaaaagaccatttattttgggaggcctgggcaggaggattgcttgggctcaggaattcaagaccagcctgggcaacatagcaagaccctttctccagtaaaaatttaaaaaaattagctggacatggtggcacatgccagttgttccagctacttgtgaagctgaggtgggaggattgcttaagcctgggagatggaggctacggtgagctatgatcatgctactgtactccaacataggtgacagagtgagaccctgtctcaaagaaaacaaaactgtttctttagtgactgtccaaagaatacagaatactttcttgacttactacagtctgaaataaaatattactttggccactcctaaagtaatactgggactattaattttttccagttcattgttctttcttctacactgtctaatttcctcttaaactatctattaagctcttaatgtcatttctaaaatttccagttgattcttttttatgaaatccaattctctgtaaaattctctgtaattttacgtatcttttccatcttccctctgttttcttaaatatattacttatagttatttggttttcaggccttctgtttgtatgcaaagtaatttttttgaatgccatacattttgtatgaaagcaacagttttcaaacttttttgtctcagaccgaaaaagactttatatggattctatctgtgagtatttacaataatagaaattaacactgaaaaattgttttctttttatttttctttttctttgttttcattgagacagggtcttgttccattgcccaggctagagtgcagtggtgtgatcacagctcacttcagcctcggcctctcagactcaagcagtcctcttaccctagcctctcaagtacttgggacaataggtgtgtgccaacatacccagctaattttttatttttatctttgtagaaatggactctcactatgttgtccagtctggtccctaactcctggactcaagccgtcctgccaccttggcctctcaaagtgctgggattacaggcatgagccactgtgctggcctaaaactgagaaagtttaaatatatttacctattaattcattttaaaatattaaacttcttatatattagtatagataacataatctttataaaaatatatcttttccacaataaaatttttgaagactaatgagtaaagtgacattgttttacatttttgcacatctcttttaatgtctggcttaacagaaaataccctgatataaatatcaacctctacattcattctgttgtgatatgttgttttgtttaaatgtatgaagaaaatacgacttcacacaaataggtagttgggaaaggaaagagtattttattcatcttttcaaataattgcagatattcttccttgctattaaaccagaactcaacaagtggtagcttcttaaagattagttgcattttggaacctgaaaccatgccaatgaactttcaaggtctattatattaaaatctattggtctatcttttactttgaatttttttttcccatctgtgattttgtaacgtcattcattggtcaaatactgcttcactgagagttacaaatcatccaaatgttgatgtatttcattttatcagtatttctaaagatgtggtccccacactgtcagcagcttcccctgggcaattgttagacatgcagactcttaggttccaccctagacctacttaatcagaaaacctggggttggggcccagcattttgtgtgttacgaagccctccagttgattctaatgtacactaatgtttgagaatcaccgctctaagggttccagctgggtttctggggtgttcagtggggtccctatgcgtggcaggttctgatctctaatcgcagtctccttagcattttgaaacttccaaaaactttactatgcttttcagaagcttcttgcttttttcagaaactttctactttgcttctaccctgtacaagttcagaatttggtatatacttagagggaaaaatcagctgtgtatcaggctctattttcaaacttgcctttttcagttgagttctaaatctttgagtctacaatttttgtcttagcagcttgtgagactgcaagaagccttgcctgcccccagcagcagccttcttgtgtccattgcccatacttctaatttcttgcgttccaccaagaatcatcaaataatctaagggaaaaagcaatttcagaatgtcattttacctctaaatttcctccccttccggaatctttggaccctcaagccatagttttcttagaagtttccctgtaacactaattcaacaggtggggttttttagtggttgtttcatttttgtagtgagttttgactggctttttttagttgcttttagtgtgagcatctaacacactactccatcataaccaaaagcaaaagtacagaaagttacttttgagacagtatgacaaattaattggctagccagtcatccaggaggctggtacagtaatatgagtgagaaataatgatgacctagcttaggagggagacaagaaagtgaatttgagatatgttttagaaacagaagcaacagttactgctgcttgatttgatacaggaaatttagtatttccccttgatttctgagtcaaaaaattaggtagatggtggagctatttactgaaatggggatgatctagagtggacaggtgattgtaaacaggtttaggagaaaagaaatactgtgttgatgttaaatgaattagtcagtagattgtccaagtggaaatagagaataggaattgaataaatgactctagagttcagagaagcagactggacttaagaatcatcaatataagatggtgttgaaaccaaccttaagaggtcatggaaagtgaaagtatggataagaaataggaggaaaaaaccccgaggatccaggtctaaggaaccaaacacttatagatcaagttagaaaaggggaaatcatcaaaggagacagaaggaaaaaaatgtaaggagaaaatgataccatagaagctaagaaaggaatatatttaagggaaccaagtgatcaactgggctgaatgctgctatgagaaccattaaaataaggatagagaggagggtccagagtattttttccacactggaagactttgatgaccttaaaaaacagttttaattggtgcagggctaaggaatgaaaagatgcggaagttgagttagcttatatacacaactattttgagaagttttgtgaggaagaggaggagagaaatggaatattgtctgcaacagagggatgagtcattaagggaaaaatgctgttttttgttttattttgctttttacttttttttttaattataaaagcttgttgagtaatttttagcaggtttgtttgtcagtggaaatgatcgagagaaggtgatttagaagagattaaattttgggggaaataaatgtaatgttttaagtctcaaaagtcaattgtataactgtgggacagagatttggcagtgtttcacatggaaaagagccatgggacatgtatttgatctcaaggcctgtaagattcaacagcataaaagctgctaaaaattttatgcagtcctaagctgcataaaggacacatagtatctttattaaagaccaaatattactgcaatcctctatttatttgttatgcattcattcaattaatatttatccagctgtactgagctaggcatttagatcttatctagaattttgtgtctgtttctggatcccagattttttatggatactgacaaaccaaatagtattcagaggaaattgaacaggatcatgaggtgtctggaaacaatgtcatatgagcaattattcattcaacaaaatttactgagtacttaatgtaagccagataatgcactagatactgaagaagataaccaaagaccttgctgttaggaatcttatattccactgtgagagacaatagtagataggtaattggtagtttaaaaatggccacagattcttcatagctcctcccatcaagaggtggtctgatttttcaccctttgtattcaggttggcctttgtcatttgttttgaccaatagaatatagcaaaaaatgacatgtgatttctgaacctaggcctcaagaagcattgcagcttcagctcttaccttcttagatccttgagtccaccaagtgaagaagactaagctctcctcctgacggaagaaacaccaagtagagagaggcctagctatcccagcttaggccctagtgaggccatcctggactacccagctcagaataaccaccctaccaatccacagaaaagtgagaaataaaaagaacattgttgcttttcgccactaagttttggggtggtttgttatgcagaaaaggctgatataaaaaatgcccatgatgtcatggatcataagtgctttgaagaaaaagcagagcatgaggtagagaatggcagctggaggggaggcggatgctgatttacttatagccttcttagaaattctctctaaggagataatatttgagcagagacctaaggcagtaagtcatgcaaaatgaagaaagaatatttcaggctgaagaaacaccaagtgcataggtcctgaaacgagaacatatggtttgtttctggaattataagcagatcagctggagcataggaagcaaaagggagagtggtaggaaatacaattggagaggaagcccaaggctaaatgatagagtggcttgcaagccatactacaaacttcaggttttactgttgggcattatgggaatgctattacctgttatgcagtattaggaagactattttggcagctatgaagcaaatagggagtcaagagtggaagcaaggcagtcactagagaaaactgtagtaatccaagagaatgatactgttttggatgagggttgttgtagtagaggaggtaaaggggaaaaaaaaaggtctaggcccggtacggtggctcattcctgtaatcccagcactttgggaggctgaggcggggagatcacctgaggtcgggagttcgagaccagcctgaccaacatggagaaaccccatctctattaaaaatacaaaattagccgggcgtggtggcacatgcctgtaatcccagctactcaggaggctgaggcaggagaatcacttgaacccgggaggcagaggttgcggtgagccaagatctagccattgcactctagcctgggcaacaagagcaaaactccatctcaaaaaaagaaaggtctaattcaaaatatattttgaaggaacacccaacaaagcttatgaatcaggggtaagaaaaaatgaggaaagatcactcctgggtttttggccaaagcagtggttagagaaaaagaaaatttgctatactgagaaacttagaggggatctatgcaatatcaaatacttaaaatgtggcatgtatatgtgaagtccctcttgtatgcctctatgaggacagaattatgttcactgagaagaaactctaagcagtgaaaatttgacccctataaggaagacttttcttctagctggaacgtaagacatcagtcagctagtaattattgaggctttctggaagttggtagaacagggtactttctaggcactgaagctacagcagtggaaaaagtgatgtgcagatagaggcagcaaaggtaatttgattgaaaactactagagagcaacttattagggatgtcatagaaggaatatatttattgggtaagaggtagaacctcttcagacccttccaactctgggtttctgtgattctctaatgatctgataaaccgaatcagactcaaatatttttcttcagatccccttgtctctacattatttaatgctatattgagataccataccatacaattcaattcatccatttaaggtatacagttcagtagttctggtatattctcagacatgtgcaaacatcgcactcaattttggaacattttgatcacctcaggaagaaacccctttagctattgtcccctcatcttcctgttctcagttcagtttcattgatcagtctgtctgtccttgtcctagtaccacactgtcttgattactgttgctttgtagtaagttttaatattgtgaaatgtgagtcctcctactttattcttattttgtagaattgttttggctattatggtccttccataataattccatatgaattttagaaccagcttgtcaatttctacaaggaaatcagctgagatttttgataaggattgcattaaatctgtaaattagaatggggaattttgccattttaacagtgttaagtcttctgatccacagagacatgatgtttttctatttatttagatcttccttaatttctttcaacagtgttttgtagtttacaagtctgagttttggacttcttttgttaagtttattcctattttattctttttaatgctattgtgaatggaattattttataattttattttcaggttgtttattataaatgtatagaaatacaattaagttgtatattgatcttttatcccacaaccttgctgaacttatttattaggtctaatagttattggtggattctttaggattttcagtatacaagatcatgtcacctatgaatagtgatagtcttacttcttgctttccaatctggatgtctttttcttttttaacctcattagactggcttgaacctccattacaatgttgactaggtttattaagaacagacatccttgtcttgcttctgatcttagggaaaagcatccagtcttcgctcattcaatctgtgggttttttgtagatgctttttatctacaaacatactaacacttagagaacgtctgtctattcctagtttgctaggtgcttttttcctgaaagtgtgttgaatcttgtcaaatgctttttctccatgtattgagatcattatgtgaatttttttttcttttgatgagactcgatatatttattttttggtggttaaaccaaacttgcatccctgtgttaaatcccacagggatttgcaaggtttataattcctgcatcccttggttggttgtggtttataattctttttatatgtttatatattctttttatatgttgctgggtttggtttgctagtattgtgttttagtatctttgcatccacacttataagatatattgatcagtagctttcttatgatatctttgtctggttttggtgtgaagataatataatgtaggctttataaaataaattaggaaatgttctctttctctcttctataagccatcaggggctgggcttttctttgtgggtagttttttgtttactgattcagtctcttgttgcaggaatattcaagttgtctcttcttgagtcagtatcagtagtttgtatcttttaggagcttgtccattttctctaaattatctaatttattgacatacagttgtttctcttctttttccattgtcttaggttgaaggttaagttattgaagtcttttttttttttttttttttgaaacagggtctcactctgtcacccagactggagtgcagtggcacagtcatagctcactgcagccttgacctcctgggcttaagtgatccttccaccttagcctcctgagtagctgggactataggcacatgccaccttgctcagctaatttttttattttttgtagagatagggttttgccctgtttctgaggctggtggtctcaaattcctgagattaagtgatccgtgcccccctcaccctcccaaagtgctgggattacaagtgtgacccactgtgcccagccgtcttcttttttaacatagacatttatagcaataaatttctctgcactgctatcgctgtgtcccataagctgtgggtggtgttattcatgtttaatacattctattattgtcggagaatacagtgtattatttctgtccttttcaacttattaaggtttgttttgtggcctattatatgctctgtcctggagaatgtcctctgtgcatttgagaaaaattgcgtattccattattgggtagtgttctgtaaatatgtgttagttcttgttagtttatagtattaagtcttctgtttccttgttggtcttttgtgtggttgttctgttattgaaagtggggtattagctggtatttattcttcatttcttagtttctgtttttgttttggttggtttttgcttcatatattttggtgctctattgttaggtgcacatatgtttacagttgtcccatcttccaggttgattggcccgtttttcattatggaatgcccctttttgtctctaataacatttttggtttcaaagtttactttgtctcattagccactctagcttttcagtgatttgctgctgtcaggatatgtctttttccatccttttacttttcagtatttttgtcttcaaatctaaagtgtgtctcctgtagagaacatatagttggctcatgcttgtttgcttttcttcaatttttaatagaaacagggtcttgctatattgctcaggctagcctcaaactcctgggctcaagtgatcctcctgccccagcctcccagagtgctgggattataggcattgagccactgtacctggctgggtcatgttgtaatttaatccggtgcgacagcctttgccttttgattggattgtttaatcctttctcatttagtgttatgatttattatttacttttatttcagtagttttgggggaacaagtggtgtttggttgcatggaaaagcttttttgtggtgatttctgagattttggtgcactcatcacccaagcagtgtacactgtacctaatgtgtagtctttcgtccctcatctcccttttctttcttccccctaagtctccaaagtccattatatcattcttatgcccttgtgtcctccaaagtccattatatcattcttatgccctttcacttataagtgagaatatacaatgattggttttccattccggagttactttgcatagaataatggtctccaattccatccagatagttgcaaatgccattattttatttctttttatggctgagtagtattccattatagatatgtaccatgttttctttatcctcatgttggttgatgggcatttaagctggttccatatttttacaattgtgaattgtgctgctataaacatgtgtgcaagtgtctttttcacataatgacttcttttcctgtggaaagatacctagtagtgggattgctgaatcaaatggcaggtcttttagttctttaaggaatctacatactattttccgtagtggttatactagttatactcacaccagcagtgtatcagtgttcccttttcaccacatccatgccaacatttataattttttttgattttttaattatggccatttttggaggagtaagatggtatggcattctggttttgatttgcatttccctgataattagtgatattgagcatttttttaatgtttgttggccatttgtgtatcttcttttgagaattgtcttttcatgtccttagcccactttttgatgggattatttatttttttcttgctgattggtttgagtttcttgtagattctgtatattagccctttgtcagatacacagtttgtgagattttctcctactctgtgggttgtctgtttattctgctgattatttcttttgctatgcagaagcttgactgaaagcttttattatgaatgtgtgttgaattttctgaacttattgacatgattatgtatttattttggctgggcgtggtgattcacgcctgtaatcccagcactttggggggaggaggctgcagtgagccaagatctagccattgcactgcagcctgggcaacaagagagaaactccgtctcaaaaaataaattaataaatatatatttattttttattaatgtggtaaattacatcgattaatttttgaatgtgtaagccagtcttgcattcctgagataaacctaacttggtcatcatatctagtctgatttgataagtgagtattttgtttgttttgcacctgtgctcatgagagatctgggtctgtggtttccttgtgacattttcattagggtttgttatcaaagatatgccagcctcataaaaagagtttaaagtgttttctttctcttctgtttttcggaaaaattcaacaaaatcatggccaggatttttatttatgggaaggtttttaattacatatttagtttcttaaatattcttttgattttccatttcttcttatattaattttgaaatgttttctttttcttggaatttatcttttacatttttatgtgctctgacatgaagttgattagttttttagagaactaatctttccctgtgttgattctctctcgaatgctaatttctattgtgatatcttccttgacgcatgagttatttaggagtatattgattaatattctaacattgggatcttctatatgtgtttaattctactatggtcagctaacagactccgtttcaatgtttctgaaactctgtgttggaggactttgtttttttctctcaatctctggtgaactgacagcttttgtaaaatacaatgaaaatgaaattatgagaaaattgaagaaaaaagtatgtatataagatccaggttttacaggggtacactgttatttcaaacaggtatattttctaaacacttaatctcaatttccaaacctatctatggtctaatagcagttgtaagtcaacattcatccatggaacacactttaaatagcaccgtttattgttattttaatctttgaagtttgtcgagacttgcttttagcctagcacatgatcagttacagtaaatgttccatgtgcagtttaaaagaagatatgttctgcacttgcagggtggaatcttgtatgtgtgtcagttaaatcaagtttgttgatgttatttaacttcagtgttcttactctttcattttgtctacttgttttatgcattattgagaagaggcatcactcactaaaattgtagatttgtgggtttttccttttggttctctccttttttcctttgtatattttgaggctatcttattaggtatattcagatttacaattgctttctcttaccagtagactgacccttgtaacactgtgaaattggctgttttatttttgcattttaccttaaaatgtactttatctaataattagtataacaatgtcagcgttatttttgatagtgtatatttttttctatttcttaaaagtatagtctcttataacaatatataacctgctggatttttattaatcaactttattgagatataatttatatagaataaaatgcacccatttaaacgcacaatttgacaagttctggcaaatatatatgtgcatgtaatcactaacagtcaagacatacaccatttccataagctccaaaggttcctttttgccccttcccattgccaatccctccccacagcctgggcaatcaccattcttctttctgccacagactatagattaaacatgtcttttctagagtttcatatatatctggaatagtattatatactcttctgtgtctggcttctttgaaggaaaaaagcagtgcagaatgttgggctcatcatagtgcatttccgttatctccaggatcttggccctcaagacctgactgacttggtagccctccagtgcttttatactgatgtgtttatattttatttagctcttctagttgggtgtcagtgggagagttggccttaaacatgatggttcacaatagccagaagcagaagacttctggccatatttagtggtagaagtacaaagatacagaaatactaagggtgaaggtgagtgttctaattaaatggaacccactgaattcccctagaaaactgagaggggttgaagagtgttattttttttgttctttttcttttcttttcttttctttttttttttttggagatagggccccaccctgtcgtccaggctggagtgcagtggtgcgatcaagactcactgcagcctcaacctcctgggctcaagtgatcctccacctcagcctctccagtagttcagactacaggtgtgcaccaccacacccaactaattttttaattttttgtagagacagagtcttattatgttgcccaggctggtctcagactcctgggctcaagtgatcctctcacctcaccctcccaaagtgctgggattacaggcgtgagccactgtgtccagccaagagtattttgttttcattaaatttagggtatgcatcctatcctatgttatcagtcaggattcactgccagcaactagatattataaccaggagagcatttagtacaggttacatattgttggaagatctgaaggagcaagttctacacttggcctacaagaatcattcctaaacaattacagagctactctgtcagggaagctgctgcctcacaggctgccactagaactgtgggagaagcacagttgctgccaccactataccacactcttgcttactagtagtaataatgataaagaggtgcagcaagaaagcctttctctcatttcagccttccaagtcccacaagaatggctctaattaatggaacctaatgtgaatcaaacactacttgaagagactataagaattgtagttttggactgaggaacttttccaactatttagaggtagaatgagggtcaaaagaaccagtccaaaatgtctaccatgtacataaattaaaagccctctaacttagagtgagtggtagagaattcaacgttattctgaataaattgtcatgtcatttttttcctctaacattgctatcaataagtataatatttaataagactctctatcatctgtgcctttgattttttccaactgctgagtgagcatagtatggcctatgatttaaatatccataatgcatatcaattaaaggttatgtttaagttcagttaatattttaatatttgctgaggatatccaagacatcgaggacatcaccctgataactctaagaatttaaacagcttaccacattgacattacctaattcctgattgctagattgtcttcaaagataatcatgaaatcaacatatttcataaccaagtgctttaaacttttatcagctttctttgtaactcttatagcatattcagggacatactatgatatattccataagtgtttatagcaattcagatcttgatatgaaaatgtcagttgtatcctcaagggcaaagaggtaaatatagctttctccagcattaccccttctaccacaacaccatgtttgttgatctattttctttgctttcttttcccttcataagctgggtggtatggtatcaataaaaggccagaaaaaagtcagaacaatttacaccaatactagctagatgctttttggtttgttgtaagctactgagaccttatgatattttcagcagctatagatggtttgcacttaaggggagaatacaaaataaaaaacacaaagagactggtgagctgtaatatgattgttagtctaagcattaaacaatgacagtattgaggactagaagttagaaggtatatgatgtttagctttcatgtgacagtttggtgctagtatttttgtatgtaggttctgtttgtgatttacaatgattctgcatttgaaattcacctcaattttcctcttgctgtttgcattagaaagaattcattgcaaagaactctaaaaaagaactgacttaattttattttttgcactgtaaatccaaaactacactctgtaaatattcgaatagaatcatttcagagaacaaaaaaaattttttgacattatttttatctctcatttattaagattagatcatttatctctattaagtaaataggtttttggcactgggtagtatatagttgcctttttaaacatacattttatttttgtgacattataagacttgattaatactttaaaagaccccttggattgatttaccttcttcaaaaagatacccgttttcacagatgaatgtgtctttaaaaaaaaaaaaacagtcatggaaaagactgttattttacttgcctaaccatccacttaattttagaaaattctctggtcaaatacttgaaaggtgaatgtctgaccagtgcagtagttgaatgttgttcaagttattcctgattataactttctttcatcatttttctcagaggtttttttttattgttgggtagttgtaggacttcactaatcaagtttaatttatactgttttgatttctagttagcttataaaataatttgtcagaggattaatgtgtgagacaatattcaaaaaagagtatttttatattttggggactttaaagtatgtcaatgatgaaatgtattttaattcatttttctttgttctctcaggtggatctccttacgtagcagccaaaataaatgaagcaaaagacttgctagaaacaaccaccaaacattgatgcttaaggaccacactgaaggaaaaaaaaagaggggacttcgaaaaaaaaaaaagccctgcaaaatattctaaaacatggtcttcttaattttctatatggattgaccacagtcttatcttccaccattaagctgtataacaataaaatgttaatagtcttgctttttattatcttttaaagatctccttaaattctataactgatcttttttcttattttgtttgtgacattcatacatttttaagatttttgttatgttctgaattcccccctacacacacacacacacacacacacacacacacgtgcaaaaaatatgatcaagaatgcaattgggatttgtgagcaatgagtagacctcttattgtttatatttgtaccctcattgtcaatttttttttagggaatttgggactctgcctatataaggtgttttaaatgtcttgagaacaagcactggctgatacctcttggagatatgatctgaaatgtaatggaatttattaaatggtgtttagtaaagtaggggttaaggacttgttaaagaaccccactatctctgagaccctatagccaaagcatgaggacttggagagctactaaaatgattcaggtttacaaaatgagccctgtgaggaaaggttgagagaagtctgaggagtttgtatttaattatagtcttccagtactgtatattcattcattactcattctacaaatatttattgaccccttttgatgtgcaaggcactatcgtgcgtcccctgagagttgcaagtatgaagcagtcatggatcatgaaccaaaggaacttatatgtagaggaaggataaatcacaaatagtgaatactgttagatacagatgatatattttaaaagttcaaaggaagaaaagaatgtgttaaacactgcatgagaggaggaataagtggcatagagctaggctttagaaaagaaaaatattccgataccatatgattggtgaggtaagtgttattctgagatgagaattagcagaaatagatatatcaatcggagtgattagagtgcagggtttctggaaagcaaggtttggacagagtggtcatcaaaggccagccctgtgacttacactgcattaaattaatttcttagaacatagtccctgatcattatcactttactattccaaaggtgagagaacagattcagatagagtgccagcattgtttcccagtattcctttacaaatcttgggttcattccaggtaaactgaactactgcattgtttctatcttaaaatactttttagatatcctagatgcatctttcaacttctaacattctgtagtttaggagttctcaaccttggcattattgacatgttaggccaaataattttttttgtgggaggtctcttgtgcgttttagatgattagcaataatccctgacctgttatctactaaagactagtcgtttctcatcagttgtgacaacaaaaatggttccagatattgccaaatgccctttagaggacagtaatcgcccccagttgagaaccatttcagtaaaactttaattactattttttcttttggtttataaaataatgatcctgaattaaattgatggaaccttgaagtcgataaaatatatttcttgctttaaagtccccatacgtgtcctactaattttctcatgctttagtgttttcacttttctcctgttatccttgtacctaagaatgccatcccaatccccagatgtccacctgcccaaagtctaggcatagctgaaggccaagctaaaatgtatccctctttttctggtacatgcagcaaaagtaatatgaattatcagctttctgagagcaggcattgtatctgtcttgtttggtgttacattggcacccaataaatatttgttgagtgaatgaa

SEQ ID NO: 1509 - DNA, 36542 bp, Homo sapiens
gtccagtgagttgcaagcctaatgctcacctgcagagacagaattcctgagtgaacgaacagagcagctcctcttccatctccaggtaagaactgctcgtgtcctccttgagggtgctggccaccggggcctgaactaccttctttcttttccttttccctttttctttttccaagccagtagctggctgtctagggcagagaagagtcccatggggaggcagccaggcccctttggcggtggttgggggtgagagatgatccacgctctgagattctttctgctggagatgcccctcacctttgtaggctagggtctgcttcacaaagaaattggtaaaccgacctcagaaaaagccttcccggggttgtgtgggggtttgatgtgcagccaaagggagtgagacaactgacttcacaggtaaccaggcggatatgcccgggaccttcctactgatacaggggccttgggtagcagagaagactcttctggaagcagcctttaaaggatgcagcctaacttagcttgcccactagataataaaagcaggcatctttcctctctgtatcacactgcagcactaagacatgagaaaaaccagtggatttccaggctggctgaattttaaaacatacattccccaggctctcacctttggcatttctaagtctccaggccttgtgtgaattgaaagatctttatttgaaaactctcccagaatcattctgatcagtgcaggtaggtttgggaaccactagtagtttatttcttaagcagaagactcatgagacttaagtatgacacttacctaagggttcactcgctatgaagactcctggtctgggttgggtccagctatgaagatttgggcgttggctctgagaaacacattcttctttatttactaaaatctctgcaatgtgtcaccagggcagctttcagtcttgtatctagaaggcaagagggggtagcagggactgcctcaggccatgattgtccagtcatctgaagtctgcagcaaattactcagggtctttgaatttctgtgttatgatagtaacttgtgcttatctttgacttttgtatgttctctgcaccatagggtgtgaagttgctggtaatgatgtcttatattcatagaccactggctaggcagctacttctcccccaggggaaagaacataggactggaatacaaatcatcagagttttgattcagttgctagtgacaggccattagacaaactacttagccaactggagcctcaatttcattattgatcaagtgaaggtctgtcatcttttccccaagagtgtactgaaaataaaattataagtacaaatgtgtggtcctgcatggtggctcatgcctgtaatcccagcactttgggatgcccaagcgggaggatcacttgaggccaggagttcgagaccagcctgggcaatgaagtgagacccccgtctctacaaaaaataataataaattaatcctgcatggtggcatgtgtctgtggtgtcagctacttgggaggctgaaatggaagggttgcttgagcccagggggtcgaggctacagtgagccgtgattgcatcactgcactccagcctgggtgacagactgagatcctgtctaaaaaacaaaaaaccatgaatatgttaaaaacacgatgtaagatgcctagatttcaaatgtgtatatcgaaagtctctgtagaatagtaagaagaaacaaattgcagtcacttgggaaaccttgtcctagtcttttaatctcattgagcctctgtttgctcacttacaaataagaagttgagaccagatcatcattaatgtctttttcagttggccaagtataaggtagatcctggagccttgaagggtagctccttgtcattggggtatgaattaaaatgtcacctcccaggaaggactttctaaatcagcctcccacctccatgccaccagtatctctatcattcacagcgtgtaccatcagaaatcatctcatttgggctgggtgcagtggctcacatctgtaatcccagcactttgggaggctgaggcaggtggatcacctgaggtcaggagttcaagaccagcttggccaacatggtgaaaccccatctctactaaaaatacaaaaattagccgggcgtggtactgcctgtctgtagtattagctacttgggaggctgaggcaggagaattgcttgaacctgggaggtggaggttgcagtgagccaagattgtgccattgcaccctagcctgggtgacaaagtgagactccatctcgagaaaaaaaaaatcatctcttttacttgtcacctttgccagatgttaagcttcaagactgcagggatcttgtcatttgtgttacttgctgtattaccagccccttgagcactacctggcatagaacatatttgcataaatggaattagtgtggcagggaaggagctagaagaatagatgcagatggcgatggctttgatgaagtgttcctcaggaaaggaggttgaaggactccaatcctctctcagggcatctgaagtccagggtctaatcatatgggaatgggtttctctggtcacttcttagtgaaatgattcttgcattcgttgcatagggatgcaatgagagtggcaagctggagctagacgtgttttcctcaagatctcagcaacttctttctttggtccttcatgagggactgcccagatttccttaatctctttgcctgatgggtatcatggctaagtgattaagaaaatgagcactgggattggaaacctgcactctagatcaggctctctaagcttctatttccttgtcagtcaaatgggcatattagaacctagttccggaagttatgagggttaaatgaatgcacatagtgtctagcacatcttaagtgctattgagataatcttcagacagctttgctattacatgacccccggaaatgaaggaacccagggaatggcaggagttttggaaagtagaaaagatagccctagcccacttagtggcaactagagaaggtttgcttttggtctgaggtggtcactggtttctgaggtgccaagcctggttggaggcacagatagtcagcattcataaagctgcgtagaaccatggggtcccaatggggacatgaaactaaatgatccagaaaagcccgtggactttccaccagttgtattgaatacatacctgatggtgtgagaatacagaaaggggctgtggtgcctgctcttaagaaagcttatcttggctgggcatgatggccacgcctgtaatcccagcactttgggaggctgaggagggtggatcacttgaggtcaggagtttgagaccagcctggccaacatagtgaaaccccatctctactaaaaatacaaaaagtagccgggtgtggtggcgggtgccttcaatcccagcttctcaggaggctgaggcagaagaattgcttgaatccaagtggcagaggttgcagtgagccgagatcgcaccactgcactctagcctggaccacaagagcaagattccatccctcctggccaaaaaaaaaaagcttatcttgttggggacacacgacatggatcctgaagctcctctatagtctactggactgagtccagtgctcacagtctaacctacttctttttttcaacatataactgtgctctgatctttctgaaccattcaccattctgggaatgcatctcctgctgttccttctgcctgggatgacttcctcttcctagtctgactacttgtatttccagaatacattctacacctcaggcctgggaggcagggtagatggtggaaggaatccagactcaactgggtttgaatccagactctgcttatccaaatagtcaggggaaaccaagttaacttttcagagtctcttttctttttccttgtaaaatggcccatcaggattgaatcagaacccataaaaagtacctaggctggttcctaatcctagtagggagctcaataaatatatataacaataagaaagcttttgtatttaaatattccagcacccacaacgttgttcagcagttaaacttcataactctccccactggactccaggctctttcagggcaggacggtagctattctgggttgagccctgatacctgcctcgcagtaggtattacatagaacttgttaagtacatgagcgataactgaaattcagaagatgaaatgataccttcagactgtggtggtcatggaaggattcgtatataatctaaaatttgaactgagccttgaaaatggtaggtcttaaattcgttcacttggaacaaatgtttacttagcacgtactatgagtaagtgctcatggggcatgagcaaagggcaggctcgtgtgggtgaccatgcatagaccaattggggcttgctgaggagctgggggcctgaggtagggctggattatgctgagcctcagtgcctgagcaagaagcttgaacttctttttttttgagacggagtcttgctctgttgcccaggctggggtgcagtggcacgatcttggctcactgcaagctccgcctcttgggttcacaccattcccctacctcagcctcccgagtagcttggactacaggcgtccgccaccacacccagctaattttttgtatttttagtagagatggggtttcactgtgttagccaggatggtctcgatctcctgacctcgtgatccgcctgccttggcctcccaaagtgctgggattacaggcgtgagccactgcacccggccgagcttctttttcttgaattattattattattatttttgagatggtagtataataaaaccagggttagaaagtttgtctcgaggcaagactcttgtagtagtttaaacataccaaaaaaaaagtgggggggtagaaatgcaagttcaaaaagtcacaaaatgtcgatttggggaaagcacttgtctcagctggcactcaaggcggttgagctgtctatcagcagcatgagggtgtcctctctctgtgggtgcctctgtttccacacaatattggctctatccctctcccaactcatagaactcttagataagcaatcaaactgtgaaaggccttgaactccagcccagagtcttgccatataggacaaagtattgtttatggtggctggaggtagggaaggtacttagtatcagcaggccaaatgaactttgggataagtagattccattcttgatcataaatgagaaataaaaactactcagtgggtctgggatcactcttctccagataattctcaatggaatggatttcattgatttctcatatttgaaatttatccctggctaagaccaaacagtaactatcacaatgggaaagtacactaggcaaatacatattttagaatcttgcttctccttctatttttgatattaattatttaaagtaaatatacttgagtatttgaatttccatatgctttgcttttcagaggagaaatccaggcagccttaaatatgatctgcataaaaatataggatctgttctaggtaaaatatatttgaagaagggtgaaattgagttgtctttatctcttccttgctagagacatctgtcagtagcagctcagatacagcaggatttttttgcttatgctgttggaaggaacagcatgtgccaaggctctgtggcaggctctgaaggaggccagccatggctggtgtgaggcatgaagccttggagtcagggctgatgcctgtagggaattctcagcctgtctatagttgctggcttaatgttgcacagtctccaccaactgtattttcctaacaaaagtctagtgggtttgttttcttctttcttgttacacagatgcacacaagtgctgcaagaacagcattcctcaaagtgcacactgtggtcaagcgtcctgagaatgtggcttttttcttgctaaagttcagagtgttttataggcaagcatggagttcagtggaaagcaagtaatgtctaggtttaatgttgccggagagaccctgccctttcttttccttatgcctcaacaaaacagaagtaacttactctatggtttcatactagattatacaatcagatacccttccacagtcagagtaactagggttaaacattcctcaccagcagtcctgctaagtgtttgttttttttttgagatggagtctcgctctgttgcccaggttggagtgcagtggtactatcttggctcactgcaacctccacctcctgggttcaagcaattctcctgtctcagcctcccgagtagctgggactacaggcatgtgccaccacacccagctgatttttgtatttttagtagagacggggtttcaccatattggtcaggctggtctcaaactgctgacctcaggtgatcctcctgtctcagcctcccaaactgctgggattacaggcatgagcccccgcgcccagcccctgctaagtttttagtgtttagtgttttcatggattgagtgttggttatgtaagtgccttgtggggagaggctctgttgtcttcgtggtgtgatactgacggcataattgattcctagttactattagataaggtgatggtgggttcaggtgtagatgactatatttatggaataatcctgccacttctaagtcccagaccttggaagatgagcagagatgacagtacctgggctgtttctttcctgatggtatttcattgcatctggccatcgctggtgacagcccccttctgtctttctccctccaagcagaatgctgtttatcccatgccctctctctgatcttttggcatttcagtgatgctgtctggtgagtgagcctattcactagctactccttggctatgaaggtccctctctgggccaggtatctatagctaaggtaatgcttcactcactccatcttctccactgctgtctgttccttgggtccctatgttcacttctgttagagcttatccactccaggcggtggaactctctggccagcttagtcttgaaattctgttaaagctccctggactcttttacctccttgatacacagcatttggttctattttgtaattccctggcttttagacttacaggatacttttgagtccagagtttattatttgagctttctttcatggggaacaaaatctccagccctgacttttcagcagctaaaattagcttcgcagaagtgatctggactgagtagatagagaatcccttgcctgatcattgaggtgcctgcccattcttagtctgtaatttcttcctgtcttctgcaaaaagaaaatcaggaaaaatttcaaatattctcacagaaaatgggattcccattgcatcaggcgtttcatcagaggacaggaaagagtaacttggatggagtggacttctatgctccagaaactgtgctgagaggccttgcatgctctactgtgagccatcttcacggcatccacatgtgcttcctattctaggggtattctatcttcagctcaaaattaaggaactcacccatgttcttacagttaacaagcggtgaagccaggattaaaaactaggtttggctctaaaacccttgctctttctactctaccttactcagaatcgatcctgggggaagatggaaacaaaaatacagattcccttttgtatacacatctggctcctttagaattgcatcatggggaactattctgctctaaagatcttttcagataacttttcctgtgtcaacccactaacttttgaaactgcttccacagtcccttcttctttcttcccaactcatgctgctaagctagtccctgaaacatttcatcttcccaatcccaaactcctagctcctcttatctgccaattcatgttggccccacagtctgacattccagctctgtgccccttgtaaatctagaaatcctcacatcctactcttatgggcttgttagtttgagatggagtcttgctgtgtcactgaggctggagtgagtggtacaatcttggctcactgcaacctccacctcccgggttcaagcgattcctgtgcctcagcctcctgagtagctgggattacaggcacgcacaaccacgcccagctaatttttaaatttattttatttttttttaaatttgagatggagtttcactcgttgcccaggctggagtgtaatggcgtgatctcagctcactgcaacctttgcctcctgggttcaagtgattctcctgcctcagactcctgagtagctgggattacagatgcccaccaccaagcctggctaatttttgtatttttagtagagacagggtttcgccaagttggccacgctggtctcaaactcctgacctcaggtgatccgcctgcctcggcctccaaaagtgctgggattacaggcatgaaccactgtacctggcctttattttttattttttgaggcagactctcgttctgtcgcccaggctggagtgcagtggtgcaatcttggcttactgcagcctccgcctcccgcctcccgggttcaagcaattctcctgtctcagcctccggagtatatggggttataggtgcctgccaccacacctggctaatgttttttgtgtttttaggagagatgaggtttcaccatgttggccaagctggtctcgaactcctgacctcaagtaattcacccgtctcggcctcccaaagtgctgggattataggtgtgagccactgcgcctggcctacccttatgttttaaaaatatgttagccccaacttagggtaaaagttaccactttccttttctattcttgatgtatattactgtaagaaaaatccatgggaacccatgctgctgcaagtttattatatatatatattttaacctaagttgtttcttagacattttaattcaattcattgactctttgtagtgagctaatgctgtggccattagttcactgtcttagttcaccgccagctcgggggctccattctcttttggtttacatagaatttcttttaagtttgaaatagctgtcagtttttttaaatggggacattttatgtaaatctagatttccagagtctcttgaaaattgaaaggtggcatgctggcctcctcttcctcaggcagttgtcttctcatgaaaagcagcagcttttcctccgtcccctctcggccaccttcgctgatttacctgtttgaccctagagattatttttctgtggtacttttgctccatattctccaagttcctgatttttgtcagctacttcgtaggagagattgaggctgaggtaagtgaccttgttttcttctttatcatatttttttctacttctcttctgcccctggagaagaggtatttcctctcaccaaggctaaccccagtttccatgttctccatatcatctcttgatacagaaacatgctgatcgtttccttaatgttaaaaataaaaacatccaggctgggtgcagtggctcatgcctgtaatcccagcactttgggaggctgaggcgggcggaccacaaggtcaggagtttgagaccagcctgaccaacatggtgaaatcctgtctctactaaaaaaaaaaaaaaaaaaaaaaaaaaaaaaaaaaaaattagctgggcatggtggcgggtgcctgaaatcccaactactcaggaggctgagcaggagacttgcttgaatctgggaggcagaggttgcagtgagctgagatcgcaccactgcactccagcctgggtgacagagcgagactgtctcaaaaaataaaatatcaatattcgttgcttctgttacttggtatccacttgcttcttagtgttttatcaggcccagacttccattttctgaatgtcagtggcattttctgttttcattctctctacctcttagcattatttggcattgttaactatcccatcttaaaattcttcttttagttttgatgacactaaaattttggcattttgttttctgattattcctttttgcttcctctttcttttctctctttctctttctctctttcccttccttccttccttccctcctttctgtctcactcactctgttgcccagactagagtgcagtggtgtgatctcggctcaccgcaaccactgcctcccgggttcaagcgattctcctgcctcagcctcccaagtacctgggcttacaggcacgtgcctccatgcccggctaattcttgtatttttagaagagatggggcttcaccagttggccaggctggtcttgaactcctaacctcaaatgatctacccgcctcggcctcccaaagtactggaattacaggtgtgagccaccgcatccagcctcctttttgtttcattttcctatcacttagatacaggtattgcaaaggctttatccttggctcccctctttttgtaatctcattgatgggcttcatgtagtgctgctgtgcagatggtcccaaacctcgactctagtccagcatctcctaagctctaggtgatgttccgtcaagtcctctaattgaaacctacctcaaactgacattgccatctcattcctcatgactacaccatcttttaatggcatcacatttctgccagtcatcaaagcatgaattagtttcctttgacacattccctttcaaacacacagcctgggtgggcagcattcctcagaaggtgctagagctgctgtaatagaagaccacggaaggtgtggcttaaataacatttattttctcatgattctagaggctggaagtccaaggtgtcaacaggtttgggtcctcggaggcccctctcctgtcttctccctgtgtcctcacatggctttattctctgtgcaagtgcctctctgatgtctcttcctcttttcttaagggcatcagtcctgttgaattagggtcccacccttatgacctcatttaacctttgttacttctttaaagttcctgtctccaagtatagtcacattggggattagggcttcaatgtatgaattggaagttgggggcaaaaatcagtctataatagaaggggagttcggggcttgaagtaggaaagctatccaggctggttagtagaaaatactgagccagggttatcagttcagggaaagtatacagctggcccttgcggagaagcaggcagataagtgagtggctacagagctacagtgtccttgcaacccctggactaagaggagcccaaagcacagttgtgttcgaattgagctgtggcctcagaagacttaactgtgcatttgccactctgcgacaggggatctttcctcatgacagtgaaaccagaacaaaataactacatgccaggggagtaagccatcattaggaagagtggcaggagcctgtgggccctgacactgggtgctgcacacctgttgttcctcctggacacttgtcatggtgagtgtaaagaagtgttttggacatctgtgttgtcacagctgttctgtctgagataatctctgcatggagaaatctgagggaacaaggctgaagacttactacaatgtcacttagtcctctctgtagttcctccacctctgtcaccttcattctattctgatggctgctatgtgggtcaggcaggccctttatcacgtgtgagtaggattttgacaacagcctcttacctggcctctctgcagtgtgtctttgcttgaatccagcctacctgcccttcttggaacccaactctgatcctgttattcctctgcttaaaagccttgagtggtgcccctttccaccaagctaaggccagatcccttgggctgatattaaaggcctttatagtctaatttgtcacccatgatttcccttctgttggctgtccttcaaccacattgggttttagctcttccttgacgacacccaagctttccctctttctttctctctctcttgctctcctctttctctctctctctctctcctctttctctctttcgacagtgtctcactctgtcacccgggctggagttcagtgcactgtctcggctcactgcaacctccgcttcctgggttgaagtgattctcctgcctcagcctcctcaatagctgggactacaggtgcccaccaccacgcctggctaatttttgtattttttggtagaggcagggtttcgccatgttggccaggctggtcttgagctcctgacctcaagtgatctgcccacctctgcctctgcctcccaaagtgttgggattacaggtgtgagccaccgcacctggcaaactttcccactttcataacatggtgtccacactgattggtgtctaaaatggtctcgtccttcttctgcacttgttgaaatgtcatccatatgttgttaaggctcaaatcaagtcctgcctaatttttgaaggtttccttaatttgtttcatattgtaggtcttacctcacttatactctgctcacaatgatatttttctttctttctttccttttttttttttttttttttttttgagacagagtcttgctctgtccccaggctggagtgtactggcgcgatctcagcacactgtaacctccacctcccgggttcaagcgattctcctgcctcaacctcctgagtagctgggactacaggcatgcaccaccacacctggctaatttttgtatttttagtagagacagggtttcaccatgttggccaggatggtctagatctcttgacctcatgatccgccctcctcggcctcccaaagtgctgggattacaggtgtgagccactgcacccggcaagttatttttgttctaaaactttttcttaactttattcaactataaaggctcttgagaataggggtggtgtataactttatcctttcaaccacttgacagtgttttgcatataagtgaggggcagatgcctgtggcatgaacaaatgaaatcaggtttgggtagtatgtcttcttgatgctgaaatggaaaatagaaggaactatgttcatgatcccaaacagatttcacctgccccagcatgctaactgaagaaactaattgtttgggaaagggaagagattggtagggagcaaagaactgtggagtaaatctggcaaccatcactcatcctccagggttcacgggatgactggtagggcctcagtcctgaatggattctgcccataggtttggaggaggatgaggaatggcctcagcttttaaggtgtttaggtttgggaggtggggagcaatcccctagacttaattaagagcataaagagtccatgagaacagtgaaaggttgttttatctgcttggttctatgctcccccgactcagaactagaacttggggagggaggcacaaggaacagattgcaggttgtgacacactcctatcctgctggctggggcactgattgtgggtacacaggatcccgaggactgcacggtgtgaccaagggcttctcctaatcaggctgccaccttggcctgtcaagttggataaaggtgagcccagggtggctgtgattagttcattcaatctcaacattcctctgtgacccatgagggagggagttatcctgaggctgaggggagacaggaggagtcgaggcagcctagggtgattttttttttttttggtggagtctcgctctgtcacccaggctggagttcagtggcctgatctcagctcactgcaagctccgccttccgggttcacgccattctcctgcctcagcctcccgagtagctgggaccacaggcgcccgccaccacgcccggctaattttttgtatttttagtagagacggggtttcacggtgttagccaggatggtatcgatctcctgaccttgtgatctgcctgcctcggcctcggcctcccaaagtgctgagattacaggcgtgagccaccgcgcccggcacctagggtgatttttaagctctagttcctttgatctggtttaggtctttaggtctgctttagacctgaggtggggcctaagcatcgatttttctaaatctctacaggtgattctgaggggcagctaggattgagaatcaaacttgtaaggtgattgcgagcattaaatgagataatgtgccatagagagttttcaaatgacatgatttattattgctagcatcacctgacacggtctacagagttacacaatttcaactaaattcttctgctcactcagatgagacagctggagcctttgggcatgggtggacaactaggactgaggagatgaaggaagatcttgtcattctgctgacttcactcctcaaggagttgccatttattttccttcttcagaagaagaatttacttacccctggcccatgttttgtctggtctctagcagcttcagaattccttttcttttctttttcttgagacagagtcttgctctgtcgccaggctggagtgcagtgacgcaatcttggcttactgcaagctccacctcccgggttcaagcgattctcctgcctcacgccgccaccacacccagctaatttttttttttttgaattttaggagacaaggtttcaccatgttggccaggatggttttgatctcctgacctcgttatccgcttgccttggcctcccaaagtgctggaattacaggcgtgagccactgcgcccagtccagaattctttttctttctttcttcttcttcttttttttttttttgagacggaatctcactgttgtcgagctggagtgcactggcacgattttggctcactgcaacctctgccccccaggtccaagcgattccccttccccagcctcccgagtagttgggattacaggtgtgcaccaccatacttggctaatttttgtatttttagtagagacggggtttcaccatgtttgccaggctggtctctaactcctgacctcaggtgatccacccaccttggcatcccaaagtgctgggattacaggcgtgagccaccatgccaggcccagaattccttttcaaaataacacctggaagctcataggagttacacaaagagcactcaggaacagctcccagctcagacttccagctttctgtgcagaggagttggtgagggtggtgctgaggatctcatatatcaatcctgttgatggccgtctggggcctgagagtccttggcctgccttgggctgggaagaagtcccctaggtcccaccagctatttctttcctatggaaaatagaccagtggctttagttctttctactttgccagatccagaggtcataccaccctccttttcattaccaagccttcctaacttctaaagggtatttaatgtttcttcttgaccacggccacattattctctttcctggcagcaataatctaatcattttggaaaaaagcaaaatttaatggtataattagctttttcatcaataaaattggtgaaaaaaaaaatctcattggctctcacccccgagcggttcctgtctgccagccaacactttgttctctttcccacagataaacaactttgttgtcaactattgatttttcccccccgagctcaggaatggttatagctttctttcatctccagtttttttttctttttttgaaacagggtctcattctgttgcccaggctggagtgcagtggtgcgatctcggctcacagcaacctctctgcctccaggttcaagccatcctcccaactaagcctcccgagtagctgggactaaagatgtgtaccaccatgtattttggctgtttgaactggggaacaaagcctgctggatttaatggactccaacttcaaatgattgctgctaatgatattctagaaatccataggccttcatttcttctgtgtctatccaccagaggggtctgatctctagattttttcaggaggcagaagatgaggtggggttaaagaagtaggaaagagtatccttaaatacaaagatccttcctaattaggccctgtgttccagagtcccaggcatccttgtcatggagcaatgacagagtcttgcgaaagagacataccccagctctgaattaggggacagagtaacaccaggatgtggactagacagaacaaggcctggaggtggaccagagcccagctcccttggctcctagatgaatcatctttctgcaagatggcaaaggaaacaaatagttttaggttcccatgtaagaccaggcttttgaggtttaggtctgctttccccattggtgcagctgggggcgttaaatatttaatcagtttggcctgggtacatgcagatcgatggccatagcattaatccattaatggctgtgtggtggggagtacacagtggcagaaggcagttgggggcttgcagcagtagctgtttccccaccagtatggtagcatttcactattggtataaagtggctctaattttctggcttcaaccagacaaaaaagaaactgaccttgaatgcttgagccttcaaagccatagatgcagatctgagcgattaccatctggctgtttgaaaacttcaaacaaaaaagtcaacttgagattctgccaagaaacagtgatttgtgtttctttgtatgtcaggctcacaggtctccagtgagacataggaaaacctttgcctcttcccctctctccaaacacagggctggttctcctagtgaggaggtttcactttctatccttggcctacaaacaaagagattaagagtttgtggttgacactgcagggcgtgagattgttgagtcttgggtgtgagtgccttagaaatgagcattcatatgctgatcacaaacagcctcatctcttgatgaaaacatagtatctgttggccttattctgattataaggacatattttaaattttgtaggatttgaatgaggttctccaataattactcccaactttaagagggctttgcatgttttgtttgacattgttttattttcttcacagcaaatatcattatctgaaatgatcctattcatttatgtaattactgtctgatcctcccagtaaagtacattgagacctcgtctttcttttctgattttttttcttttggggtcttttggccctatgaaatggaaaggtgtagggatctacaggtgagcttggacatagatgtgaactcaagctgaaactgaactgatgctcgcaggttgggatcagcagaaagaggagtgaaaggtgagggagctggaatgggccacaaacaggtgcctggatgtgactcaactctggtgatgccatattttctcctttcatcccagagtggtgttttcctggcagctggtcatggcttttgataaggcagagctgcctagctctcccaaggtgctggtgttgaccactggtgagtggctttgctgttttcttgcctcaatgctcgatggggagtctatttgtttgcttctttcttcgctacttagtcactcgtgccactggtggcgtggggcttcagactttgcggagactgcaggagaggcctggtattgggcagctgggggctctctgtctgatttgtactgtacgtctctgtgggcatgaaggtcagggatggctatcttcaatcaccatgccatggcttctagggtgcctggagcactttgtggcctattcttcaccctcccccatatcctgtgtggtcatccgttcttgtccctccaggagggaagggataggtggtttattctgatttgtaggtagggaactgtgatgagaggaacttgagggcttgccttgcaggtggtgtgaagagcagactccagtgctctgttgtgagccttctgccttctgtatcagcctcttgctgttctggcccctgttcttattctcctataaaagaaaaagctttcagccagcaggtgtcggggcactggcagaagtcttacccttaataataactgtgtgccggagccctagctgtcggttttacacttgtcctgtcttcctcctatggctcaggaccttgcccctgcaatggggcaacaggaggggcaggatgaatggaaatagaagctgcttcaggccaggcatgggggctcattctgtaattccagcactttgggagcctgaagcatgaagatcacttgagcccaggagtttgagaccagcctgggcaacaaagcaagacactgtctctaaaaaaattagttagcagggcatagtgatatgtgcctgtagctccagctattcaggaggctgaggtgggaggatcgcctaagcccaggaattcgaggctgcagtgagctgcgattgcgccactgcactgcagcctgggtgacaaagcgtctgggagggagagccccaacctagccactggaatcccttttctatcgagcatctcttttctgctgtggctagagacttcaggggccagaacagccttttctagtgcatctccaacatattggaccagctctaaggcctggtgtcctttttttttgaggcagagtctcactctattgcccaggctggagtgcagcagtgtgatctcggctcactgcaatctccacctcccaggttaaagcaattatcctgcctcagcctcccgaatagctgggacaacaggtggctgccaccacgcctggctaatttttgtaattttagtagagctggggtttcaccatattggccaggctggtctcaaactcctgaccttgtgatctgcccgcctcggcctcccaaagtgctgggaatacaggggtgagccactgtgcctgccttttttaatggtttaagctcttccttgtcctgtcctacctcaccaagcttctactaatccttcagttcttggaagtgtcattccttcaggaaatgttctttgttcttcccatcccgctccctattcccaagaccctttgttattttcccccttatcactgcattcttccccagcatgacactcaccacgtgtggttataggaatgtaataatgttccccaatagaagaggcaaggtatgggtccatcttgtctacagatttaacctcgattccttgaacttgaaaagctcttcaaatgtttgaatgagagtgggcttgtcataaattttttgggtcatgtatttggacttaatttctttaggtcagaggacaaagaggagtttggttggagatactgaaatggaagcatctgtgtccagtactcagtaaaaaatacgtgggtctgaaactctagtaaaaaggttgtccttggggaaacagatttggaaatcattagcaagttctggaaggtgtcctcctgtgcccccagcattactacccaagcagtctagatttggtgattggaagaacagaattataggagatggaggatggggttctcactccaattagattctcttttccatggttttattaatttatttttttcatcacagaaatgacctccaccttcaacccccgagaatgtaaactgtccaagcaagaagggcaaaactatggcttcttcctgcgaattgagaaggacaccgagggccacctggtccgggtggttgagaagtgtagcccagcagagaaggctggccttcaagatggagacagagttcttaggatcaatggtgtctttgtggacaaagaagaacatatgcaggtgaatgagacatttggggcttttcttccaggatctcttcagcccccacatcttctctgctgattataattttgggggttggtagagtttggttctttcctggctgccactggcaaggcaggacacctttattgctgtaccttgtgttggccaatcaagtcccctatgaggaaccaagaactgtacacattactcttggatttgaatagcgttaggtctaacatgaattgcatgttcactatataccaaaaatggtgctaggtattttttttttttttttttttttgagatggagtttcgctctttcacccaggctagagtgcagtggtgcgatctcggttcactgcaagctctacctcccgggttcatgccattctcctgcctcagcctcccaagtagctgggactataggcacccgccaccacacccagctttttttttttttttgtatttttagtagagatggggtttcaccgtgttagccaggatggtctcgatctcctgacctcgtgatccgcccgcttcggcctcccaaagtgcagtgattacaggcatgagccaccacgctcggccagcaattttatattcattatcttgttaagtcctcatcatgacctcataaggtatatgttacaatttcacagattaggaagctaagtacagatatcttagcttgctaacatgttcctgctgaggatatatgggagagtctggccttaccttattctgcctgactccaaaagcatggtcttttccttacactgtgctgtccccatgcacacgggaggaatggttacaatctagggcagcgctcctctctagaaaggaccagtcttgtaagaaccctctgggctggggttgaaccacactctatattccagcagtgccagaagctcagcctaatctgcacctggatctcgggagggcagggatggaggtggctgaggaactacctgcttctacttgggtgtcaagggtcaactagcagcatctccagggccagatattgagccagatggtcagcatttccctctggcagttggcagagggttattaaagttacctttttcttcttccctcctaggttgtggatctggtcagaaagagtgggaattcagtgactttactagttctggatggggattcctatgagaaagcagtgaaaacacgggtggacttgaaagagttgggtcaaagtcagaaggagcaaggtttgagtgataatatactttcccctgtgatgaatggaggtgtgcaaacttggacccagccccggctctgctatctcgtgaaggaaggaggcagctatggcttctctctgaaaactgtccaaggtgagaattttttggggagcagggggaggcaggggcagggcacagacaacaggcttccagaacaaagatgctactggttaatgacttttcttctttgactgacttttcagttgctatagatagcttgcaacagcttgcctccctccgtctctcactccctccctgccctttcccttgccttgcacagttgtgcaatgggggagggacactggacagcagtgggggtggggggcactgggtactcctgtccctgagtgtttgtcaggctggcacttgaggactctttgaggtcagggggccagagggttgatgcttctagccctcttagggtgaaaatgaagggcagaataaggaataaaaggcaagaaaaatgagattcttcataatagctatttttgagtaagattggtatcttttttttatctgagtgcccagatagtcattcatttattcaacaaattcttgagcacctgctgatgtgccaggcactgttacctttgctgagaataccgcaaaaatttccaccctcctgtaacattttgatagtaccctcagctgcggctcagccccacctgttctgaggcgcatctttgagctctggctaagaggtacatagtgatttgagaaaccctgaccatcaggaagcaccagaagttctatttctagaatttcagaggtgcagactaacctgtgttcagttgaccgtggctctggggtattggttggaaccagaggagctgtgttagctggtcaattccttcttgaacactgcctctgcctatgttctttctggggctggagaagcactggtggtaggtcatgatttggcaagtgatacagcagcagaccagtggtaaatttaaaatagtttctaaggcttatttaacctgtaccaagagatgtaaactcacgataaggggtatttctcaggtctgtcagttattaaacacagtggtgtgtatagtcaaaggaagcttggcacgtcttagaagcctattatcagtaaagtggtaaaaaaaagaaaatcataattcagattctactcatctggctcatgtgctaatgcacatggtgaatggtttaggttagctttatgaggaaaatggtctcttcatgacaaatatataacaaggtagcaggagaaatgctgagtgtttaaggaagcagagtttaagttattgtcattccttacaagtgatttatgtagtcattagcaagcgatcccttgcctaggttgacatacaagagtccccccttatcctgtttggctttccatagtttcagttaccttacctgcaggcaactgtggtctgaaaatattaaatggaaaattccatacataatttttgcattgtgaaccattatgagtagtgtaatgaaatcttgtgctgtcctgccccgtcttggacatgaatcctctgtttgtctagcatctccacgtggcatgtgcttacctgcctgttagtcttactacttactactcagttaccaggtcaactgtcacggtattaaagtactgtgttcaaataatccttattttgcttaataatggcccagcacagaaagaaaaatatcacatattctcatatgtgggagctaaaaaaggtgaatctcatggaggtagagagtagaatgagagataccagcagctgggaagggtatgtgtgtggggtagggtggggatgaagagagctaggttaatgggtacaaacccacagagagaaggaataagttctaatgtttgatagcacagtggggtgactgtagttaacaacaatgtattgtacatttcaaaatagctgtaagaagatttgaaatattctcaacacaaagaaatgataaatgttcaaggatggatgtcctaaatattacaccctgatttgttcattatatgctcttggtatcaaaatatgacacacaccctataaatatgtacaaatgttatgtatcaataaaaaataatagctcaggccgggcgcagtggctcacgcctgtaatcccagcactttgggaggccgaggcgggcagatcatgaggtcaggagatcgagaccatcctggctaacacggtgaaaccctgtctctactaaaaatacaaaaaattagccgggtgtggtggtgggcgcctgtagtcccagctactcaggaggctgaggcaggagaatggtgtgaacccgggaggcggaggttgcagtgagctcagattgcgccactgcactccaggctgggcgataaagcaagactccgtctcaaaaaaaaaaaaaaaaaaagccaaaaatgcaaggatagtgatgctggcagttcagatatgacaaagagaagctgtaaagtggccgggcacagtggctcatatctgtaatcctagcgctttgagagtgcgaggcgagtggattacctgaggtcaggagttcgagacaagcctggccaacatggcgaaaccccatctctactaaaaatacaaaaattagccaggcgcggtggcaggcgcctgtagtcccagctactcgagaggctgaggcaggagaatcgcttgaaccggggaggcagaggttgctgtgagccaagattgcggccctgcgttccagcctaggtgacagagcgagactccatctgttaaaaaaaaaaaaaaaaaggctgtaaagtgcttctattaagtgaaaagttctcgatttaataaggaaagaaaaaatactgtatgctgaggttgctaagattagctcagttattgttaatctcttactgtgcctaatttataagttaaactctattgtaggtatgtaagcacaggaaaaaacatatagggttcggtatactatcttaaagtttcaggcctccactgggggtcttggaatgtatcccccatggttaagggggaactgctctattaatatctttgaagaattgacagcatttctataagtagcacctaaatctcaccacctaaatgcattcgggttcttccctccctcctgtgcctgtccttgttagcctacattggtgagatgactccacagcatacgatggctaatataatagtacaaactgaagaggagagaatggtaaagatgctttctgattctacaaatgcaaagaaagggcgtatgacacaataatgcagtgtgggcatgttttagcgctttctggttcaaggggccaaggccacccaagattccatctttgcatttagctgacctcagaaattctattcaaatcaacaaatacccactgagtaaaggctgtgtcaagttcagtgccaggacctataactgtgattttagatcagaagccaaaggccgagttagctctaaaatcggaagtttgtttcacattattgggagaaaagtctttaccattggatttcgagtttttctttgcaatggagtgttctgtgaaagggtggtgtatgcaaagcagtccctcaaaggccaaaggagctgagaaaccaaaggacaaggcaggcaaatccagtttgttggtacattggaatttatcaggggaacttacgaacagaagcatggtcttggacagccacaaaacatgtagatctctgtgttactccccagacccaaggctgatataccatagggaaagggtatatgtgctccagcaagacaatcgaaggcagccctccgcaatagccaagaatgctatagtgcatcatagcctataatttgcgtgataacattaaggttgacatgttcttagactagggacagtaaatgaagtagaaatcgggaggcaatcacaggactggggctaatcagaagtcaacatcacagattaccatccaagagggagtcacttgtgtctccacatggagtttacccctactctcttccaggtaaaaagggggtgtacatgactgatattacacctcaaggtgtggctatgagagctggagttctggctgatgatcacttgattgaagtgaatggagagaatgtagaggatgccagccatgaggaagtggttgaaaaggtatgccccaaagggtacttttcttaccctatcttccactctattctcattggaggtgacaggaagacaggggtggtaggggacagcatgagtttatgatggaaaaaatatccagttgagttgccccttcatattaagggtgaacagactcacactagtggtataagcagtgttaatatagggttttggaataaagccttccctagtttcacatgaggtctacaaaattattaactttaccttttggatcttgtttgtatctgattgggagccccctctgaactgtttgattgagacagggtctcactctgttacccaggctggagtgtagtggcacaatctcggctcattgcagtctcggcctcctgggctcagatgattcttctacctcagcttcctgagtagctgggactacaggtgtgcaccaccgcacctggctaatttttatgtgtgtgtgtgtgtgtgtgtgtgtgtgtgtgtgtgtgtgttttgtagagatagggtctcactatgttggccaggctggtcttgaactcctgagctcaagtgatctgcccgccttggcctcccaaagtgctgggattatgggcgtgtgccactgcgccctctgaatttacaataagttcactgttgagccgttaatactgaaatgctttaataggaagtgggagataaccgagattttcctttgaggtcatatggaaccttaaaaattgaccaaccttctctttgtagaatgattttttgacgtggacccttactttcttttcttttccaaactccctttctagcttttatctaggtacctttatgggttttctgaattccagctcctacttgggctcagttagcacctatgtgggtaggtcatacttaaataagggaaaacaactatagaagtggagataggggccgggcgcggtggctcacgcctgtaatcccagcactttgggaggccgaggcgggtggatcacgaggtcaggagatcgagaccatcctggctaacaaggtgaaacaccgtctccactaaaaataaaaaaaaaaaaatttagccaggtgcggtggcgggcacctgtagtcccaggtactcgggaggctgaggcaggagaatggcgtgaacccgggaggcagagcttgcagtgagctgagatagtgccactgcactccagcctgggcgaaagagtgacactccatctcaaaaaaaaaaaaaaaggcgataaatacatatcagttagctggtagggcatagtgtaacagcttaaactcaggcctttcatcccctatcttttgttgaacctagagactgtgtgcctttatacagaaactttcttattccccagcattgttcttgggggttgatgtcattcctcatctgtgtgtgttgttacaggtgaagaagtcaggaagccgtgtcatgttcctgctggtggacaaagaaactgacaagcgtcatgttgagcagaagatacaattcaaaagagaaacagccagtttgaaactgttaccccaccagccccgaattgtggagatgaagaaaggaagcaatggctatggtttctatctgagggcaggctcagaacagaaaggtaaggtacaagagcaggaaacttggcagtaaccagcaaattcctcatcccattctgactccagagttccattaggttcccaactcccagccagatgcatgagcggcatagcatagaaggcacagctgggtcagcgtctatgtcacatgagggtctgatgttgggcatcaaaagtttccatagcattatgataaggcagaatttgggatctgggcaacggtatcctggtaagttagctctctggggcgggggtggggggaaatccaaattggtagcgtttgtttttggtaccaaattggtagtattttgtgatgtaaatactcctcccatgtccagtttcaacttactaacacgatgtcactgaacacaatgaagtgttgcacagaattggcttttgtgagccggtgtgagccagtatagcacaccgctggacctgaggccgaggtgtgggtgaggatttgggactcagaaccaggagtcctccttccttgcaactcaataggaagaacactaggttctttcagggaaggtaaatacataaaagaacatgagttcgggccgtataaactgctattcgcccataagttgttattttcttttcactctctgtttacattaatttatcaaatattaatttggtttgtgttttgtaaaaacatcctcagtgccttggagaaagaatatcatatgaagcagacaggaattctttagtgaaggagtctaccatttagtagataagagatatgtccataatgaagggagatagaggttaagtaccttcatacaggggcagatcaagcactgtgataattcaacgttagagtaagcttttctcactaaaaaggtaccagaagccctcatagtaggggtggcacttgagttcaggctttgtaacatgaatagatttgggaaagtagacagagctgggataaggaagatcattccaggaaggtgggaatcatgtgaacacagtcaggagacactggcacagtttaattggcacatgatgtgtagtacaagaattcgttggaaaggtaggttggagagaggtgacaaggggacttctatgcaagactgatgagtttgaacttggcttatcagacaatggggagttgttttttgagcagtataagggagaagaacaaaaaccagcctataatgtcttgggggctttgcacatctcaattactcctaacaattatgcaagaagaactgctgaaattgagggcttggagaagatacagtaattatgtaaggtcaaatagttgtttagttccaaagcccatgctcattctgttgcaccaggaagtgacttggttaggaatgtgcaccaagatggatctgaaggcagatctgtatcagacagaaggactggggaagggaaagcagtaggtaaggtgctgtaatagtttaggtagaattctaggcaggaactaatacaaactgcattcagggtagaggaagtgggatgtgtaaggtattatggtagcatcagaggacttagcaatcgtctagatatggggactggatgctggggaagaatcagttgccaagtgttggtgactgggatgatgttgctccactaacaggtaaccaagaggaggggctttgggatggagaatgggcagagctgatttttggcttgaatacattacagttgagagatctatgagatattttgttggagatacccagcagctagctggaaaagtgaaacaggaacttgttaaaaaaaaaaaaaaaggcagcatctggtgaagataccagaaggccaaagcacatggaggcatgtatatacaaatatattcaaaaccgaacacacccaattgctactaaaatgccagcctgggtttcttaaggtccaaagttttgggttttgttctttattcttccccatcttttatgacagcttttacataagacgcgtggctacaagtatgcccactgactttctgggaacttgcagccttttaatatgctattttgccaaaatcaaatgtcagacgcttttagtaacaggattattttcgttaagaccccttcattgttaattgctgggttagtttctggggtgagttctgagcaggaaacgagcctagatagtgtgcttataagcttcctgggatgctggtggaaggggtggtagttgtactcagcatgccttttttatctgtttcatcagggctttgggctccagcagaaaatctgttttatttttttaggggacttactgataattttattttttggggttgggggagggtaggtcaaatcatcaaggacatagattctggaagtccagcagaggaggctggcttgaagaacaatgatctggtagttgctgtcaacggcgagtctgtggaaaccctggatcatgacagtgtggtagaaatgattagaaagggtggagatcagacttcactgttggtggtagacaaagagacggacaacatgtacagactggtaagtaatacaaggccatatattcatgcattaaggctgggcccattcactcatgacctcaacttttgcactgagttaggactttgttcctcaaactggaagaggcataacaatcatcattaaggctaaactgaagctcaactcaaattggtagtgataagagaatgccaaatgattgataaatgagttttaagtccttggtcttaagattttgaaagaatttgtgaatataactgcaggcttactcttggtgatctgagaaaatctatggagaatataagcctggaaataaaattgttcccaaaataggaaacaattagattttaagctttaggtcagttaagtgctatcaactgcacataaaagcctagaaaggattattaaacaacttgtaagcccttagcaaataaaaaagaaacacagatagaccaagaccaacctgaatcaaactaactttattttctcttaacagctctttatcataacacccactactgcatgttttaaggttttttttttttttttttttttttttacttttaacacaagaactgaggttgtctagtttaacagataacctggggggccttctaagtaccatctgtcttgctaagtgttgattgtaaagatgaacaagataaatgtcctctgtgatatacaatgatagtagaatctaaaataagcggtacagaggggggaatatgatgggtggtgatatcttaggccctcctcatagattaggaaaccgaagcttagagagactaagcactttgctaaagtcacgcagcttagtaaagactgaaggtggtatctgaacccaaattcttggacccgtaattcattataccatactccccagcacattttttcaagataatcttgtaagcaggattaaacaattaattagattaatggctttttttttttagctacttgaacaatcatacctagaaaatacttgatatcaacctgaatatcaacttgaatagaagtctctaatggcatgctacttgttcctaaccgtttatgtgcttaaagttgaaaggagatatggaaaatatattaacatacttaaagtggcactagataattcatttgctggatggtgtaattaatactcaaaatatttagttaggatagaaagaatgaaaactaaagaaataagaataaatttcagatgtactatactaacctaaaagtaaattgtatgaataccacatggtgagacctgatttgaggactacagaaaaagaccagaaacttcatagtccaagtggttgccccatccaaatatggtaatttaaaaattaactgacagacacttggcttctagagatgaccatcttactgtacttacttggtcagaccatacttggaatacctggtaatatagttaccacctctctctgtgcttcagtttccttagttgtaagagaggggtagtagctacagcgaagggtggctatgagggttgaattggaatattcagagcatgtagaataatgcctcacacatctaaatgttctatttgttcaatcaatattgtgtccggtttcaagaacttcactttaagaaggcaatgacaagggtaaccagggaagaggttttggaagccaccatgtgagtatttagcttgagtaaggctttggagaagagagcatcttcaagaatttgaaaggctattacatgtaagaaggagcacactttttttttttttttttgagacgttgtcttgctctgtcaccaggctggagtgcagtggtgccatctcagctcactgcaatctccacctcccgggttcaagcgattcccctgcctcagcctcctgagtagctggaattacaggtgcgcaccaccatgcccagctaattttttgtattttagtagttttaccatgttggccaggatggtctcgatctcctgaccttgtgatccgcccgcctcggcctcccaaagtgctgggattacaggtataagccaacacgcccgggccacacattttttttaaggtgtcctatggggcacaacaggaccagagaagccatagggagctagcttttggcttaagaaccaactgaagctgccagaaatgatgagtcattttgcagttggtggaaagtcaagcagaaatcagaggcggctgctgcagctgtttgttgtaaaggggattctgacccctcctgatcttatcatagaatgatttaattgtaatttttctgttttggttaatagagaactttgatcgaaaaagaagcctgccctcatcatctccttccccgctctccaaagtaagccctgtaggttggggtggagggtagatctttgagatacatcagtgagtaaaacacaaccctctagcagtccctggcacatactagacacccaattatctgaatgaagcatgaataaaatctcattttttttttttgagacagagtctcccgctgttgtccaagctggagtgcaatggtatgttctcagctcactggaacctctgcctcccaggttcaagtgagtctcctgcctcagtctctcaagtagctgggactacaggtgtgtgctaccacacctggctaatttttatatttttagtagagaatgaggtttcaccattttggccaggctggtctcgaactcctgacctcaagtgatccgcccaccttgtactcccaaagtgctgggatttcaggcatgagccaccaagcccggccaaaatctcaagtgttttaatgttattgcactttgcctcgagatgagctgcgactgtcagatacagttgatttgcttgtttgggtagtgttatcagacgtatttttgcatgtaatgagtcacctgataattttccatattttaaagagaaaggctccattgtggaactgttgcaagtatatgactgaaaggtctgaagttagttgaactgggtaactaggaggttctgtgctggtggtattctcacttagaaaggaaggagatgtggtcttgtggttagtaagacacatgataaccagaggactaaaaatctaattttagtcaggctgctaaacagtgcgatttgaagtagagcccacactgtgctcaccttccattgcttgatttcctactcatcacctaacaaatgttccggacacgtgtgggcagccatttagctgctgatccaggatcacaccatacccaggtccacccttctaattgtctcaactaaaacagccagttaggcttgtaattctattacaaaaaaatcaatcctgtttcctgttctatgcctcttcggtattcaagatcatcatttctttacatggatggtctgggagttgatatgaattaggagtatttaaagatgttggagagtttggcataatagaagtgacagctaatgcttacaacaatacatagcaaaataaataagcacagatcccaggtctggaaggggagggtattggcaagcagcaaagggttggaattaacttttgttacaatatgtgaccatataacagctgtcaccctctcaccaattattcctgtgtatatgggttggtctcttctagtagctttgaatctttggatagtgataaaaatagtgttatattaacattctccagagagacagatctagtaggatatagatacaggtatgagaggagattaattaggggaattggcttgtatgattatggaggctgagaagccccacgacaggctgtcttcaagcttgagaccctgggatgccagtagtgtggctccgtccaaatctgactgagccacattactggcatcacccctgattggcagtcctacttgtttgcttctgtgcatttggcctgagaatctggggggctgcggctgtagatcttagagtccaaaggccggagaaccaggaattctgatgtccaagcacaggagaggaagagggtatcccagctctagcagacagactgacacctttgccttttctgtagttcactcagactcgcatgctaatcccctctggaaccaccttcacagacacacaccaaaataatgctttgccgggcttctaggtattccttaatccagtcaagttggcatctaaaattaactatcacaagtgtcttgtgttttactttttctaatgtgtttaaggagctctgaagaccatcttaccgaaaggaaaagccagaagaatgtactctgcatgaggtaccggctagtcggtcagatatgtcatttcccaacagggagattatgtatagcttgttcagtgacttgctcactatcatgaactcactcaaaagaaactagcaattttttagacttcttttgggatccttgtaccgcatcctatactgcttttatgttcatgtgtgcatttgtgtacatgtatacacatattactccataacgaagcacagtcttcttttatacctttcctggttggggtagtagaggaattttacagcctacaatcagacacatccagaagaagagtggaatatgtatgataccttaaaaatcagcacatttaacaaagtataacttactcatggttacaactaagttaatgttttttccctttatttttcaaaaggctcatttttctccatttctctactatcaaagtcaagaactgcccaatggctctgtcaaggaggctccagctcctactcccacttctctggaagtctcaagtccaccagatactacagaggaagtagatcataagcctaaactctgcaggctggctaaaggtgaaaatggctatggctttcacttaaatgcgattcggggtctgccaggctcattcatcaaagaggtatggtaatctggttccagcagcccaacaaacacagccacaattaggatagtctcagcttttcccacccattgatggcttagtagagaggttccattgaaggcacacactgaggggtctcacttgggttcagataaatgttgtcatggtcccacaccctttaggttagctaccagtacatcataagctcacgtttgtttgtttcccaaacatctgttccaaacagtgtgagttgactgaactctagttgacagtcactatcaaccctgattggcagtcatatttgtttgcttctgtgcatttggcataatgccccttaccctgtagggactgataagaatccctaaagctttcaagttgggagtgaagaagggggacctatttatcccccttcatcccagaagacatatgatgctgaaccactatttataataccactaatcatgtgaatatggaagttatagccttcataaatataaaagcattagaacacctttctcaacttctatacctcaaggagaaataataacatgattaaaaataaattcttgagctcctcatctattctcttaaggagagctagtctgatgtccccttctctgtttgaaattgataactcagaacttctgttcacaggtacagaagggcggtcctgctgacttggctgggctagaggatgaggatgtcatcattgaagtgaatggggtgaatgtgctagatgaaccctatgagaaggtggtggatagaatccagagcagtgggaagaatgtcacacttctagtctgtggaaagaaggcctatgattatttccaagctaagaaaatccctattgtttcctccctggctgatccacttgacacccctccagattctaaagaaggaatagtggtggagtcaaaccatgactcgcacatggcaaaagaacgggtgagtgggggcctatttcttttcgtgatctaatttactagagtatgggtacagtccctatgagtatatttaatgtctatgtttgccacagatttttttaaaactagaaaatgaaaatgtaaagataactaacaaatcaagttattgtagaggacaggaggcagtataagaacaacaaatttcttactttcatagcatgcagctgacagcaactgtctagagctaataaatcaagaagtaaaaagtttatcagtattgtaatgggaacccccaaaagagcctgaatcggatgatctagatatgaattctggttctgtcatttgtcagctgtggggaaatggatttatttgttctgttcctcagttttcccacccataaaacaggaataatttgtaggattgttatcaggatcatgttaactaagattaactatattaaagtgctttgaatagtggctggctcatagtgagcatgtaagtggtgacggttaaagacaatattgtttaaaacaactgacaggtaatccagttttattactaggaaagattaagcattctctatattattctctatatatttggattaaatttcttggtaagtctcagttttatatttttgcccaatttttcatagatgaacttgaggtcgaaaagtaaactgacttatccaagttcataaaggaaatttatagcaaagccgagactctaaaaaagtttaattcaatgttgttcttctttccattatattaattctgctaatgggtggaatattcattttaataaactcagtttaatgaacacacacaatgcccactgatttgtattcaggaatgcttaataaatactattagttgtattagttgtcatttaaaaattctgtaatttctctttaggaagtcaatatcctagtcttataaaaaagaaatatacacagacattaaggaatttgttaatgtgtcaaacagcaagttgaaaacaatcaagtgtagaattcaggtcacctgacttctagtcatacccagatcatctgattcaggctcttctgggggttcccattacaatactgataaactttttacttgatttatcagctctacacaattgctgtcaactgcatgctgtgaaagaaagaaattctagtgagtgactctactccccgacttaagtcatgcaactctagaatagatcatccctctttcattactctaccatttgtaaattctttgttttcttatacacaggcccacagtacagcctcacattcttcttccaattctgaagatacagagatgtgatgaaaacaagtaatagctttggctgtttatttgatagctgtttctgggtatttaataggaatcctttctcaaggaatgagttgtgacctgtttactgtctctttagaagaaaaactccactggaaaccattcaccatgtgtgattgtcttctgttatcatttgtcttacaggcggctattgcagacggctaatttatgcttaacttaggaagagataaggcaagagctagatttttttcatgtgatcttttccaagcttcaacttaacttaactacatttctctgtatgatgatgtctcttacttctacaggttccttgagcaccaaagatgattcataactctgtataggtgacagctgcttataaaagcatcttagcagataagcctattaaaattgtgcttttgtaacaatgttgtggttgctagaataaataccattaacaaatgccttttgagtatgcttgatagtgcttttgttttggattcactttttatgctttaaccttcatttgcctctagaaacccaaaacacaataaagtacagaataagaccttagtaataaaattcagaattttcttaa

SEQ ID NO: 1510 - DNA, 36542 bp, Homo sapiens; identical to SEQ ID NO: 1509

SEQ ID NO: 1511 - DNA, 36542 bp, Homo sapiens; identical to SEQ ID NO: 1509

SEQ ID NO: 1512 - DNA, 14153 bp, Homo sapiens
agacagataaaaacactttatttaaaagtataaaaccaggcttactccttcaaactgctcccacccctaattatctccacaaagagctatataaattgggcaggggtatgtgtacagtcatctcagctctaacaaccccagttcttctttcaattctcctttctcccttcatacaattgagatgtttgtcctttgcactttccccaagatagcaaaggtgatacaaatgtggaaggaggggaagtgtagaaaataaactgtcatcatcctctattcccatctccagggaacagacagattatatgaactctgaccaaatgatttgcttgtctgaagaaacaaataataggtacagttactctctgtatcctaaagaaagacacgagggtccagagtccttcttcagtatatagcctcgtccatattgtcatcactgtcaccaccaaagtcctctccattgtcaaaatatgacatgatgtaatcagtttcctgaaatggaaaaaaaaaaaaaagtaaaagtcaatttggcattcaccttccttcctgtgtaccagacccctttcctctcagtcacaccattccaggcctgagacatctcttccagctgtagtttgtagaaggggggcagatgaagtagagagaagcccctaccctggggggcactatctctgttggcatgccaaccctctgaggagagcaaccctagtataaagagggtaaagggagggggactaaggtggaaggagtccccttcacctcttcatgttcttcttcatcatactcttcttcttcctcctcttccttctcttcttcttcttctttctcctcatcctcctctgaagttacttcttcttccttcttctccagggtctcatgtggggatgaataggaatagaaactcaggttcagttcacagaagggaaaaattgaggcacacatgggccaagagagagggaatggatccagggctcaggaggtctctatgcacacttcctcctcacctctagtttctgtattgtttcctccttatcttctgtggtcttagggggcctcttggggagcagaattgtaatccctggtggagggatcaaaaggtaaaccttcagagagcaaattttgccagctttatagcccatcctcatgcaaagaacatgtcactctgctgccctcatgtggccactatgacatctagcaacaacacttggtagattgggtataggaactgggatggaaggtgagaccagcagcagcctcggccctcaggctgatgaaggaaacctctcttctccctccttttttccagatacactcacgttccttctgtagcttccgcactcggatctttagctcccggggtagacgccgccaatctgggaatagtgggaacgtaaatgtcaataggaccctgcctggggtctccagtgaatactgactggttttaaaggggggtgagggttttaaaggagaggaaggaaggggctgggccaaagttgttcagtggcttggatatctcctgagtagtgggaactatttaatagctttttcaggtagaatctgagaatgtgttggaccataactaaggctctagcttgcagatgctggatcggggaatggggtggggtcatgggcgtggtgggaatagcttgaagcatcccatgcatttgaaagaagggcagtcaatgaaagggcccatcacctaccagggttccaatcgatggcattgtcaatcggacctgacatctgatatttgtctgaataacgctccacatctgaggggtggaagggtcaaagttttatcccttcagagacccagaacaggactgttcctgagagtccagccctctcaatactgaggaattatctgtttccttaccccaaacccagagcccagggggtcagcttcagtgaggaccttatcacttttttttttttttttttttgagacagagtctcgctctgtccctcaggctggagtgcagtggtacaatctcagcttactgcaacctccacctcccaggttcaagcgattctcctgcctcagtctcctgagtagctgggactacaggcacacaccaccacgcctagctaatttttgtatttttagtagagacggggtttcaccatgttggccaggatggtctcaatctcctgacctcgtgatccacccacctcggcctcccaaagtgctgggattacaggcgtgaattactgcgcccggccccttatcactcttctaacctgttccttttccacccaaaattacgattttttttttttcagacagaatctcgcactgtcgcctgggctggagtgcagtggcgtgatctcagcccactgcaacctccgcctcccaagttcaagcaattcttgcctcagcctcccaagcagctgggattagaggcatctgccaccaggcctggctaatttttttgtattttttgtagagacggggtttcactatgttggccaagctggtcttgaactcctgacctcgtgatctgcccacctcagcctcccaaagtgctgggattctaggtgtgagccaccacacctggccttttttttttgagacagaggtttgctgtgtcacccaggctagagtgcagtggcaagatctcagctcactgcaacctccacctcccaggttcaagcgattctcatgcctcagcctcagcctcagcctcccgagtagctgagaccacaggcacacaccactgtgcctggctaatttttatatttttagtagagacagggtttcaccgtattggctaggctggcctcaaactcctggcctcaagtgatccacccatgtcagcctcccaaagtgctggccattacaggcgtaagccaccgcacccggccatgatgattttttttttttctgtcccttagttcaaaggcatggctgtattaagaaatagcgtggtgcagtggaaagtatgctagggaataagaaaccaggatttcagtattctcttgttggttggtgcttataatatccagattgttaaaaattttgctgggcgcagtggctcatgcctgtaatcccagcactttgggaggccaaggcaggagaatctcttgagcccagaagttcaagaccagcctggacaacataaggacaccctatctctattttacaaaaaaataaaaaatatataattttttagaaaatacatccccctacttatacacgtgaaatgggattttaatatttaacctcctgctgtcccaagactatcatgagactcaaaacaaaccatgaatactataatgcatttcagatacaggggtaactattatgatctccccagttagatagtatgcttcctgtgcccctctggcccccagtggtgctgagcacagggcactccccatggaaggcactcagaatatgatgctagcattccaactgacctctcttggggacagctggccggatgaagtaggggagctgcctcatggctcctcgtagctcttgcttcagtgccaggacatattccccttcctcgcctgagggcaaaggtactgggcggaactccaagggctaaagaggcaggggcagtggtcagttcagggagaaaatgctagtacaaatttaggaagacccctcctcccaatttagtctaacactcccactgagcagagggccaaatgacaatcgagggagtaacatattattttgaaagctggggagaagtaaaggtggacacttctttgcctgcaaaacatccctgtgcattgggagtatagagagagggccaaagcgaggatggttttatgatggtccaggaggaattcagaatcatgtacagtcagccaggggcacatgagagtctgggaagggagtggagagactcacagggaagagtggagaaggctgcagggtgggtgggggcaaagcatcccctttcccaatgcccacggcctccacgttgaaggtcaactggccccggccacgaccccggcccccaccccggctggccatggtggagggggcctgggtattcagagatccagtgaataaacctaataaagacaaaaacaaagagaaaaagaaatgtagtagaatggacaggaagccaaggaggtacaagacattcaatcttttatctctgggacatgaaaagttaatgtcattcaacaaattttgactgagaaggcacagtgtcagagagagaatttctggaaatataaacatgaatgagacatggtcccccaaacaggtcagataattacaatatagtttagcacaaaggagaaagtgctgacacctttggacaaaactctacatccctaagacaatttgatgtttatctctatctgcatttctttatttttatttttagagatgctctgtcacccaggcttgagtgcaatggtgcaatcacagttcactctagcctcgaacccctgggctcaagatcctcctgcctcagcctcccaaagtgctgggattacaggcatgaaccactatgcccagccacaaactgcatttctacatataacctttgaattctttctatctctggccttccaaacctgaccaggccccaattcaatccaatgcaatgcattcggcgaaacatttattaatcgtctaccatgaaaaagatagtgtgtcaggcactgtgggagcacagggatgagtcatcaatttcattgtaaaccaggggaaaagacacattacaatcaaattgatctttttattttattttatttgagatagggtctctttctgtcatccaggctggagtgccgtggtgtgatcatggctcactgcagcctcaacctcctgggctcaggtgatcctcctgccttagcctcccaagtagctggagctacaggtgtgtgccaccatgcctggctcttttttttttttttttttttttaagagactggatttcattatgtcaagtgatccaactgtctcagcctcccaaagtgctgggattacaggcatgagccaccgcgagaggccaaattgatctttttaaacaccacttggaagcatagaatcttagaattgggaggacccttatagaggtcatctagtctaaacccctcccagtgcaggacttcactctgtaaattgttttgttgttgtttggtgtatgtgtgtgtcttctttttttttttcttgagacagagtctcactttgttgcccaggctggagtgcagcagtgcaatcttggctcactgcaacctctgcctcccaggctcaagtgatcctcctgcctcagcttcctgagtagctgggactacaggcatgtgccaccaagcctggctaatttttgtattttttgtagagacaggatttcgccatgtcacccaggctggtctcgaactcctggactcaaatgatccacctgcttgggcttcccaaagtgctgggattacaggtgtgagtcaccacccctgaccctactttgtgaattgttattcagcttttggtggcatttccctaaagagatggtatccattctccccccaagacagtatattccactgtgatcaacactgatgaatctaaagtttctccttctaccgaattttcactctgtctcttatcatcaatcctgaggaaccagtcagaggcagctaggatgggggaataaaatcaccagatgaaaagaaaacttgagagaaatgatatcccagtagcaatgagcacacctagcacccagatcttggtttctcatacaattttccaataaaaggaaccagggctctctggactactagctgattctaggacagggtaggaaatatacaacatgagtctagagcatcttgaggtgccaaaaagtaaggaggtgctcaaaacaacaaccacactcacatattgatgggttagctgggtgcagcggctcattgctataatcccagcactttgagaggctggagcgggcagatcactcgagccctaggagtttgagaccagtctggacaacagggcaaaacctcgtctttacaaaaaatacaaaaattagccaggcatggtggcatgcacccgtggtcactgggtgatccttccctactgggaaggattgcttgagccggggaggttgatgctgcaatgttatgattgcaccacttgcactccaacctgggtggcagagtaaagactctgtctcaaacaaacgaaaaacaaacaaaaaggagaaaaaacgaaaaaaataaacatattgatgaggctatgtcaaagggacataagagccaactgaaaaagttcccaatggccaaagctgaaacaatttgaggaacaaaataaataaagcagtattagattataaccccaaagtataagataaatatctgtgagtccatagtgatataaataaatgactgaatttatttatatgggggaaaaaagacaaatctctcatgtagaattccaaataaaatatgtagacactccatcctaaaagggagcaggggagcataactccccactttttttttttttttttgagatggagtttcgctcttattgcccaggctggagtacaacggcacgatctcggctcgctgcaacctccacctcccgggttcaagagattctcctgcctcagcctcccaagtagctgggattacaggcatgtgccaccacgcccggctaattttgtatttttagtagagacggggtttctccatgttggtcaggctggtctcaaactcccaacctcaggtgacccacccacctcggcctcccaaagtgctgggattcaggcgtgagccaccgcactggctataacttcccacttcttatgtgtggactgtgtatagggaatttctctctctctctctctctatatatatacacacacacacacacacgtatatatatatatatatattttttttttttttttttttttttttttttgagacagagtctcactctgtcacccaggctggagtgcagtggcgcaatctcagctcactgcaacctctgcctcccgggtgcaagcgactctcctgcctcagcctcctgaatagctgggattacgggcgcacgccactacgcccggctaatttttgtatttttagtagagacggggtttcaccatgttggtcagtctggtcttgaactcctgatctcatgatccgcctgcctcggcctcccaaagtgctgggattacaggcgtgagccactgcacccggccctcattcaataatttaggaaatcaggaggaatatctttacagtggagagaccagaaaaacactacttcaaccagatgaccaaggtcagcatcagtactcataaatcatgttttcggtatgtgcccttaaaattacatgataaaatggtacttcacctctgtgatcatcctcctaaaaacccataaccccacactaataaagagaaaaatatcaaattccagcagaaaggcatcctacaatatacccaactcctcaaaactgtcagtcatcaaaaacagtaaagtctgagaaacccgtcacacttaagaggagcctaaggagacgtgacaactaaatataatgtggaatcctaaatgggattcatgtacagaaaaagagcaataggtaaaaaccaaagaaatgtcaatcaagtatcaaccttagttaataataatgtatcagtattcattcattaattgtaacaaatatacgaatcaattttttttttttttttttttttttgagatggagtttcgctcttgttgcccggctggagtgcaatggcgcgatctcggctcactgcaacttccgcctcccaggttcaagcgattctcctgcctcagcctgctgagtacctgggattacaggcatgcgccaccacgcctggctaattttatactttttttagtacagagggggtttctccatgttggtcaggctggtctccacctcccgaccaggtgatccatccgcctcggcctcccaaagtgctagattacaggcatgagccactgcgcccggcatttttttttttttttttttttttttttttgagatggagtttcgctcttgttgcccggctggagtgcaatggcgcgatctcggctcactgcaacctccgcctcccgggttcaagcgattctcctgcctcagcctcccgagtagttgggattacaggagcccgccaccgtgcccggctaatttgtttttgtatttttagtagagacggggtttcaccatcttggccaggttggtctcgaactcctgacctcgtgatccacccgcctcagcctcccaaagtgctgggattacaggcgtgagtcaccgcggccggccaatctacaatgttaataggggaaactgtgcactgggacaaatgggaactcttggcactatctgctaaatttttccgtaagtcttaaattgttctaaaatatataatctattaattaaaacaaaaacaaaaaacaaaaaaaactcgaggctgggcgtggtggttcacacctgtaatcccagcactctgggaggctggggtgggatgactacttaagtccaggagtttgagaccagccggggcaacatagtgagattccatctctacaaaaaataaaaaaattagccaggcatggtggcacatgccagtagtcccagctacgtgggagactgaggtggaaggatcgcttcagcccgggagataagaggattcagtgagccatgatcatgtcactgcactcaccctgggtgacagagaccttgtctcaaaacaaaaagctaaaacaaaaatcaagtagcaattcaaaattcccaagagattagttggtgaaaaaaatatttaaaaataatatgtagaaggtaatcttctgtcagaaatacatacacacatatgaattaaaaatctgttatagaaggatatgtaccaaaaattaacaacggttaatttgaaggatgagggttttttgaattttttctggtggggagagttgtgtatctttttttttttttttttgagacagagtcttgctctgtcacccaggctggagtggtgcagtggtgcaatctcggctcaccgcagcctccaccttacgggttcaagcaattctcctgcctcagcctcctgagtggctgggattacaggcacccaccaccatgcttagctaatttttgtatttttagtagagagggggttttcccatgttggccaggctggtctcaaactcctgacctcgtgatctgcctgcctcagcctcccaaagtgctgggattacaggcatgagccaccatgcccagccaggttatgtatgctttgtttttttctatactgaatagaatactataacaacattaaaatattaatttaaaaatttttggctgggcatggtggctcatgcctgtaatcccaacactttgggaggccgaggcaggtggatcacaaggtcaagggatcgagaacatcctggtcaacatggcaaaaccccgtctctactaaaatacaaaaattagctgggcatggtggtgtgcgcctgtagtcccagctactcaggaagctgaggcaggagaatcgcttgaacccgggaggtggaggttgcagtgagccgagatggcgccactgcactccagactggcaaaagagcgagactgtgtctcaaaaaaatttttttttaatgggccagttgtggtggttcatggaggtaatttcagcactttgggaggccagggcagaaggatcacttgggcccaggcagtcgaggctgcagtgagctatgatcacaccactgtgcaccagtctgggcaacagagtgagaccgtgtctcaataaatagataaataaaatttaaatgtcgtaacagaatactaaatgagattaataatctgtagctaggagagggtagaaaaatgtatatctgaggaatctgggaagtttcaagcccaactgccataaaaaaaattgaggaaacaatggctgttggttaagatatcaaattgcaatctgtttgaaaagagcatattaagggagagaagatgtctcatggagactagagaaataataagaatttgttggctgggcgtggtggctcatgcttgtaatcccagcactttaggaggctgaggtgggcggatcacgaggtcaggagttcaagaccagcctgaccaacaaagtgaaaccccgtctctactaaaaatacaaaaaattagccaggcgtggtggtgcacgcctgtaatcccagctactcaggaggccgaggcaggagaataacttgaaatcaggaggcagaggttgcagtgagccaagattgtgccactgcactccagcctgggcaacagagcgagactctgtctcaaaaaaaaaaaaaaaagaatttgtcaccgtgtcttcagccccttttaagcgagagaacattctaaccagctggttaagtatctttccacttgacagatatagttctggcagtggagataggagctgctgtgactgcaaagcaatgaagagtcaataaatggccatgagtttgaggttagacaaattccacaccatttctacacattaaatgagtgatcctctaagaatgcaggggaaaaagaagacaaaattttatttaatacaggttgggaaataaaccatccatctgccccattcatcttaggaatctatagggagtctctgctattaaagattgtgatggagttaaaattcttgaggatacttaaggtctcccataatctagtcacaatctgctcctccttaacatcaacctttccagagagtttacccctgtactctgttttactccaaacaacactcatatacactatgctcattcccaattattcatacatatatattgtggtggaagttactgagaggcaggtttcaactaaacatacagaaaaacactaacaattacatcaaatttaaggaaggcagtacatgtagaggttaagaatatggttttgaatcccagttcaatttcctagctacaaaactctggtaatttatttattgtctctaaacctgtttcctcatctgtaaaatgggaataaaaataacaataatagaatcatttcactcaacaaatatttactgagtgcttactaggtgtgccaggcactgttctagattctatggatatagcagtgtgcaaaacagacaaaaacatgctgcacccacggggtttaaatggagctttcattccagtggaggcatcagcaaacaaacaatacttcaagccatgagactaggtgagacccctaaaggagtggatgtggacagagaaaataagaaatccaggcactgaggcctggggcacgctgatgtgtagaatttgctatacatgtaataaataaagcaagaaattaacacccttaaaatcttggaaatccaaattttaaaaaatcatctcaatagaaaaaatgggcaaaggacatgaacaggcaactggcaaagagaatggccatgtctggacatggtggctcactcctgtaatccagggttttgggaggccgaggtggacagatcacttgaggccaggagttcatgaccagcctgggcaacatagagaaaccctgtctctactaaaaatacaaaaaattagccaggcacagtggtacacacctttaattccagctactcaggaggctgaggcatgagactcacttgaacacaggaggtggaggttgcagtgagctgagatctcaccactgcactccagcttgggcaacagagcaagactgtctcaaaaaaaaaaaaaaggagagagaatggccaataaaaccactcttcacctatgaaagtgacaaagatttaaataataagcaggctgtcatgagttttttttcaaatggacactctcatacctcactggaaagactataaacataatatttcaaggggagcaatttgtccagttaaatcaacagcctttgaaatgtttatatccctaatccagcaatcccactttaaaaatatattccaaagacatcaacagatatacagtcacagatataagtaaaaggatattcatcaaagagctatttatggtagcaaaaattctgaaataactgaaacaatctaacaataaatgaatggttaaaaaatacccattttatttatttatgttctttttattttattattttttttttgagacagtttcactcttgtcgtccaggctggagtgcaatggcgcaatctcagctcaccgcaacctccacctcctgggttcaagtgattctcctgcctcagccccccgagtagctgggattacaggcatgcgccaccatgcctggctaattttttttgtagttttagtagagatggggtttctccatgttggtcaggctggtcttgtactcctgacttcgtgatccacccgccttggcctcacaaagtgctgggattacaggcatgagccatcacgcccggcctcttttttttttttttttttttgagacaggttcttgctctgtcgcttaggctgaagtgcagtgcagtggcaattttggctcactgcagcctcgacttctccagctcaagcaaccctccacctcagcctcctgagcagctggaactacaggcctgagacaccatgcttggctattttttttgtagtttttgtagagacagggttttgtcatgttgcctagactggtcttgaactcctgggctaaagtgatctgcctacctcagcctcccaaagtgctggaattacaggcatgagccaccacgcccagccagaaatggcttgcttttaagaatgctaccaattccactgtaaaaggacagatttcctttttttttttttttttttttttttgagagggagttttgctcttgttgcccaggctggagtgcaatggtgcgatctgagctcactgcaacctccgcctcctgggttctaatgattctcctgcctcagcctccccagtagctgggattacaggcatgcgccaacacgcccagctaatttttgtatttttagtagagacagagtttctccacgttggtcaggctggtctccaactcccgacctcaggcgatctgcccgcctcggcctcccaaagtgctgggattacaggcatgagccaccgtgcccagccatatttccctcttttacagtggaagtgtggaatgcatttcctttagctatatatttcttatttagaatatttgtaggatattgactaaagaacaggtatcaaaaaattgaatgatctacaagagagataagagagttcccttactaaagatgtttacatagaagctgggtaaaaatttactacatagggtttgtaagaaggatgcatggctctagtagaggattccctatgatcagcatgatttagcattgtgtctggcatatagtaggtgctcaataaatatttattgaatgaataaatacatcatttctatgggcctttccaaacttgagaaattgtgatccataaagcctcccctcaccattccagttctccttgctttcttccttctctagattgtagaaacaattatgaaacactaatattatgaaccactaatttaatggctcttaattacatactgtattgtcttttattgttccctagttatgttaggagtttaaattctgcctccccaaaaagagtgctagttaccagaaatcaattctatttaactaacgtttattgggcactatatattaactactagcacctgtcctacaaaaccttctattctaaaaggcatagaaacgttaaagagagacagtgcactaagtgtcctaataaaggtatatacaaaacgctatcgtagacgggggaacaattcattttgcaagaaaggcggcccaggaaaactacaggtagcatttcagctagtcttcatagataacaggagtttgtcaggctcttgggataatattaatagattagggggaagttgatgctatagcaaagacagatacaagaggctgtctcgttttctgctttaatgtctctccccatgcgcgatagaaaactgccattctctagtatacaatcaatacagaaatggaagcccaggggagaaacggtagggagccagaagggggctgatccaacaacctgacggaaagcgttgtctatttcgcagcctggccggggtgaacaagtttggcaagtgtcggaccgaaccaggtcaagccttacctgctgcccctccccaaagcggagcccaagccgcgaccaacttgaaatgtactgggcttcctcaag

SEQ ID NO: 1513 - DNA, 18281 bp, Homo sapiens
atcccactgcaaataatgcatccaggcacctcctttattttgctttccatccccccagatcttctgaggaagatgcttcttctggatcactgtctcttcatggtgcactcaatgtaagactccagcaggaagatggtttcgtccacctggatctcactggcatccaacctgagtgaaaagtaaaggcatttgcctagactgaatgttcattagcatatttaagattagaggttagggtgggtgtggccatggataactgcttggttacccttgagagtggatggaaagaaagcaggagaaccagtagatcattttgctatttaccgagcatctttatgtgccagacaccatgcaaactgctaagaatacaaaatacagagcctctgtcctgggggaaggtagtcttcatttgcaatcaggaaaacgaacgtaaaggcacaggtataaaaggacctagtgtgttttaaaatagcaagaaactaagagtgtctgaagcttaaagtgagtggtgattaggaagaaatggaagcttcttcagcctgacaaaagccatctaggaaaaacccacagctaacatcatacttaatggtgaaagactaaaagcttttctcctaagatcagaaacaaaacaaagatgtctgcttttgtacttctattcaaccttttactggaggttctagccagggtaatggggcaggaaaaaaaaaaagtaaaggcatctagattgaaaagacagaagtaaaactctctctattcatggatgacataatcctattataaaaaatctcaaagaatctgcaaaaaaactactagaattaataaatgaatttagtaaagttgtgggatacaaaatcacaacacaaaagttggttgtttttgtataacactagcaatgaacaatctaaaactgaaataagcgaccactaaactagtatccaaaaaaatacttaagaaataaatttaatgaaagaggtgcacaaattgtgcactgaaatgtgaaggtctaggaaagaggtgatgaaggcctgcgtgtggaccaagatgaaaggccagatttgagacacatgactcaagtaaaattaagccagcgcagtggcacttgcctgtagtcccagctacttgggaggctgaggcaggaagactgtttgaacctacgagttcaaggccagtctgggcaacacagccaaaaccccgtctcttaaaaaaaatttatcagtacttgatgaacaagagagtgtatatggtgatggagaagaagctcagaacatcttcagaattgctagtttacaaaaataggtggattaaattctgttaagtgagctggaggagacagtgagtttaggtttgctcatgctaagctggagggttacaggaggtcaaaatggattttctggatggtattctgaaatgcaggtctgaagtttatgatgcttacttgttgacattacgtttcagggtctctagctgctgacgttcaggagctgtgatcatctcctctatttcttgtaactgtgcttcctctgcaccagtagcctgcatagatgcaatgatggcttctaccctctgagatttttctagtagacgcctgtcaaacaaacacaactctgagacatcttccctaacctgggagattctcttaccacgtgtgtctgaggcactacccaccaccctttaccattttcctgatcaaagtagataatgtcaccttctaaggacattttctacaaacttatttggaaatataacttcactcctgaaattcttattgcctctcatttgcacttaaaagtttggtgcttttgtacgtttctcacaaatttaatctgaaaaattatttcactgggagcatgttagaaaagtgtagactaatgcatgatttacactaatctaagccaatgattcaatgcaagtagactggttgctatctctactggttcctacttctcaaaaaaaaaatttttttttttgagatggagtctcactttgtcgcccaggctggagtgcagtggcgtgatcttggttcactgcaacctccactcactgggtttaagtgattctcctgccttagcctcccgagtagctgggactataggtgcccgccaccatgcccagctaatttttgtatttttagtgaagacagggtttcaccatgttggccaggttggtctcaaactcctgacctcaagtgatccacccgcctcagcctcccgaagtgctgggattacaggcatgagccaccctgccaggcccagcgtctattgattcctatttctagaggaaatttcccctgaggcccttgatcttgaaagatgtaaataactcaactgaaaatgttacttacttattctctttggtttcaaattgcctcctttctatcaagttggctatgctctgaggaaagagaagacagacaaggaatgcacatagttctatttcagcagctcagggcgaagtgggcacatgaggggtacttgaccgtatggaggaaatggggagaaggtccagattgagttaccttgtagcacctgtgcaacaacattcgggcagctgacaggatgttcacagtatataaatagaaggtcctggatggggcatggtctggtgttttgggaatttcctatttgtccaatagaaagaaaaatagcagaaattatactgttttagaactggcaaagcacacactcattctacctggagttacttagccctcctttttacttacactttcctgtttcctagtcattcagtacctgtgtttattttatttatttattttgagactgggtcttgctctgttacctaggatggagtgcggtggcgtgatatcagctcactgcaacttccacctccggctcaagcaatcctcccacctcagtcccccaagtagccggaactacaggcatgcaccaccatgctccgctaattttttaatcttttgggggtggtggagacatggtctcactatattttccaggctggtcttgaattcctgggctcaagtgatcatcccgccttggtttcccaaagtgctgagaatacaggtgtgcccggcccagtctttgtggtttatgtcataatcagtcaaatggagagctgggcttccctgttttttccatttgactgtcagcatcctgagctggggaagaaagggagggcaactaacatttactgaacaactctatgtgccaggtaaattctatttgatctttacaaaaaatcgtattattattatttttgagacagagtcttgctctgttgcccaggctggagtgcagtggcacaatgttggctcactgcaacctctgcctcccacgttcaagcaattctccttcctcagcctcctgagtagctgggattacagacacacggcaccacgcccagctaatttttgtatttttagtagagacagggtttcaccaggttggccaggctattctcgaattcctgacctcaagtgatccgtccgcctaggcctcccaaagtgctgggattacaggcatgagccaccgcacctggcaaccatattatttttattatcaccatccatcactgttttatagatgggaaacgtggtaacttgcttaatgtaactgggtaaggcagagctgtaatctgactccaaaaatccattctatctatttactcatatgctctactaaatagccctgcaaagactcagttagatgtgttgataaatttaaactataacagaattaaggcttaaggaaggacagaaatgagaagagaaaaaaaggcagggtgggtttggggtgatgtcctggctctgcctcttttttgttttttgttttttttgttttttgagacagagtctcactctgttgctcaggctagagtgcagtggcttgatctcggctcactgcaacctccccctcctgggttcaagagagtctccttcctgcctcagcctcccgagcagctgggactataggcgtgtgccaccaggcccagctaattgttttgtattttattagagacggagtttcaccatgttggccaggctggtctcgaactcctgacctcaagtgatttgcccaccttggcctcccaaagtgctgggactacaggcgcgaaccaccgtgcccggccacctctttctcactagggcagttaaggccccaaattatcctccaagtgctcgctatgtctctgtgaatcatgtttttctgtctcagagctggatatagagtttgcttgggggttcagtatgtttgcctaagaagcttctctcaccctaggccagctttgctggttggcaattattacgcccttggttggttacctggagtgacatgaaattttctgagagcatcttatatagcatatcctttgcctcctttgcaggaatcattgcaaagtcttccacttgcttctgctctatgtgtttcttctgcaaaactagacggaatattctagcacagcgagacccaaatctggaaaggaatgaagaaagcaaatggcatgctaacatagatcagctttagttcccagtcacagatggggtggttgttctattccatgtgtgaagccagtaccagacaggaacagtgatcagaaaattattctacagctccataggttggtgatggtaaggcatcaccaactgctgttaatcataaggcagtcaccaactgctgactcatttgagtgccacagttcctacatttgtaagcaaaggctttagggaggctggttaatttgcatcggtaggaattaaacagtaggttattttaaggtaaagagcagtattacatgagatccataggagtccagtgaaaaaatggggaaaagtatgccaaggtgtggttatattggtggcttacataatgatcaaattacttcactggggataggaagtatgtgatcccaaacccaaccagtgtcccccttacctctcctgtacgacggactccagagtggctgtggctagggatgctaatgccttatggaggtctttatgtagagaattaaggtcactcagtaatgttttggcctagttattgtgatctgagttttattcctaagtttctaatttataattaaattttaaatgctattttgtttttcatgttataatttatggtttcagtcatggtacataaatattccaaaactttaatacaagtgtttaagtaagggttttgcttaactaaaatttggttgattaaaagtcctttttccttttcttttttgagacagggtcacccaggttggagtacagtggcatgatctcagcttactgcaacgtctgtctcctgggctctagcgatcctcccacctcagcctcctgaggagctggactacaagcatgcatcgttacatctggctagtttttgtatttttggtagagatggggttttgccatgttgcttagctgatcttgaactcctgggttcatgcaattcacctgcctcagcctcccaaagtccaccatgcctggcctctttttacttcatcatcaatgcagttcactgaaaattcatagaaaaatttatttaacaattacttcaattttctaatttatttagtataataaacattaccaaatctttctttcctaaggcaccattctgatttataggtcaggctgcctgactctaaggaaataactggtaaggatactgatgacatacattcctccaccactgtcgccagactttccaacaaactctagctattaagaaaaagagagagtgttaactgaacggaaagtccagtgattctgtttccaatggaacaaatctgaccaaaagtctgcagcaggtagccctcctatcaaatgatgtggagaaattgtctgggctggctaggtagagaataactctgcaggaggatgatactaggtatcagtgcagaaataaattatcaacagtacaggctaaagaaaaaagaaaaaaagcaaaaacagacttactggatcatctgccagcagagtgagatactgatcaagaacttgcttagagatgttatagccaacaggtagggatctgaagatctatggagcaaaggacacttaaaatgggtttgggaacttagaactcctgaccttactgaaataaagatgttttaggccgggcacagtggctaaggcctgtaatccgaacactttgggaggctgaggcaggtggatcactttgggtcaagagttggagaccagcctgaccaatatggtgaaaccccgtctctagtaaaaatacagaattagctggacgtggtggcgcatgcctgtaatcccagctatttgggaggctgaggcaggagaactgcttgaacctgggaggcagaggttgcagtgagccgagattgcgccaatggactccagcctgggctacaagggcgaaactccgtctcaaaaaaaaaaaaaaaaaagttttaattttagttaccacaaaactgtccaaaaatattcacagcaggattgtttgtaagagtaaaaaactagaaacacccaaatgaccagtaccgagtacactaaaataaaatatagcacggccattaagtggaatatgatacagtcattatgaagagtgagacaaatctacagaaactaacatgaaaggaagttttacatacactgtcatataaaaaatcaagttatagaacagtatgactaggttgggtgtggtggatcacgactttgtaatgccagcactttgagaggctgaggtgggaggatcacttgatgtcaggagttcgagaccagcctggccaacacagtgaaaccctgtctctactaaaaatacaaaaattagcctggcgtggtggcatgtgcctgtgatctcagctactcggaaggatgagcaggagaatgccttgaacccaggaggcggaggttgcagtgagctgagattgcgctactgcactccagcctgggtgaaagagtacaagactctgtcacaaaaaaacaaaaacaaacaaacaaaacccaaccaaaaagccatatgaatagtcccattttggggttaaaaaatacatatacccacatatatgttagagtatgcaaggtctgaataaagatatataccaaactttttttttttttttgagacagagtctcactctgtttcccaggctagagtgcagtggtgcgatctcagctcactgcaacctcccattcccgggttcaagcgattctcctgcctcagcctcccaagtagctgggattacaggcgcccatcaccatgcctggctaatttctgtaattttagtagagatgaggtttcaccatgttggactatgctggtcttgaactcctcaggtgatctgcctgcctcggccacccaaagtactgggattacgggtgtgagctgctgcgtccggcctttttttttttttttttttttttgaaatagggttttgctctgttgtttaagctggagtgcagtggcatgatcatagttgactgcaacctcaactcttgggctcaagcaatcctcctgcctcagcctctcgaatagctgtgactacaggcatatggcaccacacccaactaattttttaaaaaaattttttgtagagacgggggtcttgtcatgttgcccaggttggtcttcaactcctggcctcaagggatccttctgcctcaacctcccaaagttctaggattacaagtgtgagtcactgcacctggccacagaactttaaaataaacaatataaaaatataggaatatttaaacatagtcatgcaccatataacattttagtcaacaacggaccgtgtgcagctgtggtcccatattatactggagctgaaaaattcctactgctttgtgatgtcatagctgttgtaacatcatagcacaatgccgttgtgaaacacattactcacatgtgtggtgaggctggagtgcagtggtatgatcttggctcactgcaacctctgcctcctgggttcaagcaattctcctgcctcagcctcccgagtagctgggaccacaggcgcatgccaccatgcccggctaattttttttttttttttttgtattttagtagatgggtttcaccatgttgcccaggctggtctcaaacgcctgagctcaggcaacccaccagcctgggcctcccaaagtgctaggattacaggcgtgagccaccccgctcagcctgttactggtttttaataaatacagtgtagcctgagcgtgtagaccatcacattcacattaatctgccattcattcactaactcccacagggcaacttttagtcctgaaagctccattcatgttaagtgcactaaacaggtgtggtttttaatttttcataccatatttttactgtaccttttctgtgattagatgtttagatacacagatgctactgcgttacaactgcctacagtattcagtacagtaacatgctgtacaggtttacagcctagaagccataggctatcccgttcagtctaggtgtgctgtagggctacaccatctaggtttgtgttaagtacaccctatgatgttcacacaatgatgaaatcacctaacgacacatttctcagaatgtatccctgctgttaagtgatgcatgactgtattactatgaaagtaatataaataacacatattggatatattaaatatcgatattttaagtacagggggtcaaataatgtcctgaatgccaaggctctcagagtccaaattgtggattcttaaaataattaggaataggctgtacttgacgaatagatactttgactaagtgaatagtgtagatttttaaaagctggatcctaagagaccaaacatttcagtgctcatcacttgaagataatccctgctccacatcaaatgcccttctctttcaaggctcagacctcaacccaaactcaggatctgtgtataataaacgttgataacacccaagaatctgtcagaaagttagtgcaagaacatgaaactcacctcattggaagacaatggctgggtgaagggagcactagaggaagtggtaatctcactcattcggagcatggttcgcacaatctcgctgcttgtctgtttgaaaagtaaactagaattcagaaatcacagtgctgcccctggctctatgtgccaatggccatatctgacaaataagtaaatgtccctgatgaccaatgacagacccacttaggtattacctggtccatcctgttagcaactgcgctcacaatggcttggtcacggaagtgttggtggaatctgtcaaggttggcctgccaataaatcccatcatctggaatgggctgaggaagagatttagagaaacatttagctatagtgtaaagttttctggtgaggagcttggatttaatggttcaccatttcttttcctacacagtaacaattacattggttggaaaaaaatcattcagtcatgtagactggtgtctagacaaattccgacttcaaacaggttttctaagctcatctccaatctttctctccctattttattatttaacatttattttaatttttttctgagacggagttttgctcgtcacccaggctggagtgcagtggcatgatctcggctcactgcaacctctgcctctcgggttcaagtgattctcctgtctcagcctactgagtagttgggattacaggcaaccaccactgcgctaggctaatttttgtatttttagtagagttggggttttacaatgttggccaggctggtctcgaactcctgacctcaggtgatctgcctgcctcggactccaagtgctgggattataggtgtgagccaccacatccggcctttctctctctattttaactcttctccattactttcaagtctccaacttgacccttcttccttctcactctcggcagatgactttgcctctcatttcacagagaaaatagaagacactaggccagaactcactcagctctgtgcacatcctcaccacatttcttttttgttcttgattcatattttcactcacttttatcacagctgaaaaatgctccttttacctaaggttaatgcccatattggtattccaaatcttactctctcattcattcttggggatccagctctattttaccctgtcctctaacatcttcaggctttccttctctaccgccttcttatcagcctttaccctgtccaagtctctttctactctagaattctctttcaaccctatgccttctcttcttttccttactgtcacagccaagcttctcaaacagttggccatctcagttgtatctctacctagatttacgcaacccatttccactattgtactgaaatgtcaattgtcactcgcattccagtgaaattccacaactgtccttaaggattctatgttgttaagttcaaataataatttccacttctgatcttatttaaccttttggaagcatatgacatggttggacattttttccttcttaaaactttatgtggctccttggttttatgacaccattttttttttccttttaaagacagggtctttgtcacccaggctggagtgcagtggtgtgattgtagctcactgcagccttgacctccctgggctcaggtgatcctctcatctcagcctcccaagcagctgggaccacaggtgcgtgccaccacgcttgggtaatttttgtatttttctgtagagacggtctcaccatgttgctcaggatggtctcaaattcctaggctcaagcgatctgcccgccttggccttccaaagtgttaggattacaagtgtgagccactgggcctggccgacaccattttttcttggcgttactttgaacctttctggctacctttcctcagtatccacagattcctctttcagatcccaactgtaatcctggtgttttgtcagggttctgtccatacctttcctttctttttactctacatgctctacttgggtaattttatctgctctccaggcttcaactattgatgcatttccaaatctgttactctatcctagaactctctcttttttttttttttttttgagatggagttttgctctttcgcccaggctggagtgaagtggcacaatctccgctcactgcaacctctgccccccaggttcaagcgattctcctgcctcagcttcccaagtagctgggattacaggcctgcgccaccatgcatggctaatttttgtatttttagtagagacggggtttcgccatcttggccaggctggtctcgaactcctgacctcaggtgatccacctgcctctgcctcccaaagtgctaggattacaggcattaccgcacccggcctatcctggaactctctattatgctccagatgcatagactcagctgcctatttgacacttccatttgttccccaaactgttctgttttgtaagttttcaggtaactacactataaccaacccaatttttttttttttttgagacagggtcttgctctgttgcccaggctgtagtgcagtggcaccatcatggctcactgaagccttgacttcctgggctcaagtgatcctcccacctcagcccctgagtagctgggactacaaacatgtgccaccaggtctggtgtttttttttttggtacagatggggtctcactatgttgtccaggctggtctcaaactcctgggctcaagtgattcttctacgtcagcctcccaaaatgctgggattacaggcacgagccactgtgcctagacaacccaatttcttttttttttttgagatggagtcttgctctgtcaccaaggatggagtgcagtggcgtgatctcagctcactgcaacccctgcctcccaggttcaggccattatcctgccgcagcctcccaagtagctgtaattacaggcacctaccaccatggccggttaatttttgtatttttagtagagacggggtttcaccatgttgaccaggctcatctcgaactctgacctcaggtgatccacctacctcggcctcccaaagtgctgggattacaggtgtgagccactgtgcttggccagccaacccgatttcttaagctacaaacttgggtatcacccctagtcccttgctctccataatctaccaccccattaccaagttctatctattctttatatttatcagatgtctacttttctttctcctatcattaccttatttcagactctaaatcttggcccatctggattactacaatagcctcctaactgggtttttttttttccctttaaaacatagcagacactataaaaggagtaactgggttttctccttctaattttgttttgcatcattcttcccatttcttagagtagtgcttttttttttttaaactgttttgggtcacagttcctttgaagaatgtaatgaaaggtacggagagcttcactgaaaaatgcacgtaagtataactggactctctgaaatccatccatggagtagaacaagttaggaactgctgtgctataataatctttctaaaatataaatccagtcacttcatttccctgcttaaaatccatcaatggctctcctttgccttcaggataaagcccaaacctcttagacaaacatgtacacaaataataaataattccagttataaatataaatgctgtgaagtatatgaaatgagaaatgtggtaggaactagtgtaggagtgggcaatggtgcttgaagtctatgaaaacagcatttaagatagaaatgataaaaacagagaccactacatgaagatctggggacaaacatttgaagccggagccaaagtctaaagaccagaaagagtttgacatgtttaagagataaagtcagtagagggaacacagtgagtaagatggagacggggcagaggtgaggttgaagagccctgtctccagcagatcatacgaagacctagatcacgtaaggcttcctagcccgtaccttggatttcttctaaaagtaaaggaaagctattaaaggagtctaatcagtggatgtgttgttttgttttgaacaacttagaaagtcattttggctactaagtaggtaagaatgcagctagggagaccattaacgaaagcgtttgcaaagagttgagagatggcagtgaaaagatgagaaatggttggatttgaggtaattttggaaactgggctgatatgttttactgtgagattagagggttccaaggattttggcttaagcagaaatggtggtgtcctaggcggctggcctacgtggtagtgtcttttactaagatgaggaagtttatgagggagcaagatatttgggaggaggaatcaattattctgttttggccacactaaatttgagatgcttactgacatctttataggtacgctaagaaggcatttgaatatgagttcaggcctatgtatagtttttagacccatttttcatcactggcccctgtaggtctttaggttctcgccatattgagcaacctaaactttttctaggcccctttttacataagctgttacctctgttcaatgaaagaattaagttaaggctcagaagggagacagtaatggttcattctttgttagtctattcctaatatttaatgaggttcataatcctactgcttcttagctcaggaagctttaagctctcttggggcttgttatctgagtgctctttctggcctgcttcagggtgaggacttctaatcaagaagccccattacctccttgttatctgtagtatattttggtctcttggccttgggctccccagcagcatcttcatcagatgatctcctccttttacctttccctgccaaacaaacaattaaacacttagactatatctcatatgatgacaggaaatgaccaaacatgagagcaggtgtctttcattccaaagacatctgtagctgcctctagatcagagttgcttagggggctgaagagctataagaaactcaagtaactgatgaaataatctgaaactcaacatgttcaaaaagagtcttatagtctttctcctccaatgctctctttcatggccagtgatatcatcctcccacatgtgcaagtcagacacacagatgtcactcttagtacttgtttccttcaccctctctctttcattttccaccagtctgtcaacatttacctttgccccattctcccatcctttctgtagacaaaaaatcttttgaaagtgcaaattagatcatgtcatttccttaaaaatccttcagtggtcttcctttgctcttagcataaagaacagatgctctataaggtcttacttgattcagcccctgcctgtctcccatccaagtactaagcaggttgatcctgattagcttctgagatcagacccctgcctagctatgtctctaaccttacctcatgcctctcttgctttgcttacaatgctttagctatactgacattctttcatttcctcaaatgctatttttttactacatactattccctctgccaaaaatgcttttcctgttacctcactgttagcttctacttcaaatcttagctcaaatgccaccttctcaaagaaacatgaggcctaaactcccagatgaatcccgtctctcgttatatattttcttttcttttttttttcccgagacagagtctcactctgtcacccaggctggagtacagtggtgcaatcttggctcactgcaatcgctgtctcctgggttcaagcaattctcctgccccagcctcccgagtagctgggattacaggcgtatgccaccatacctggctaatttttttttttttttttttttgagacggagtctggctctgttgcccaggctggagtgcagtggcacgatctcggctcactgcaacctccgcttcccgggttcatgccattttcctgcctcagcctcccaagtagctgggactacagatgcccgccaccacacccagctaattttttgtatttttagtatagacggggtttcccggtattagccaggatggtctcgatctcctgacctcgtgatccgcccaccttggcctcccaaagtgctgggattacaggcgtgaaccaccatgcccggctacctggctaatttttataattttagtagagatggggtttcaacatgttgcccaggctggtctcgaactcctggcctcatgcaattcgcctgcctcagtctcccaaagtctccattatatattttcataacacctcatacttttccttcatggcacttattacagtttaattatatactgatgtgattttctgattaatgcatgtctcataatactatgacagttccttcataggaatatttccttcatagtacttatcaccgtttaatgatatatcgatgtgattttccgattaatgtatgtctcctatactaaagccccatggcagagaccatgattttttcattgttatacaccacgatgtctggcacatagcaaatacttggtaaatacaatcacatttcatacacttgacaatcaagaagaatccacaattaaggcaagtcacagttccaggggttaaaattccttacctatcaagctgagtttaggaaccaggtacatgtccttttcattaatgacaagtgtgggggcaggtggtggtggcccagggtctgaattctcagtggtaggtaccgaagggcagcgttgtacaaagtgtgtgtctgccagtcgcacaaatgtgtttgatacttcagcatagtccatggtcttgccatctgtataacaggaggaaaaaggcagatgagatggcctaagatagctcagggttcactcccatagccagctgatctatgcttttgttaacagctatggataccatactgaccctccatggtctctgtgagccggtctgccactttcttcacaacagctgacattgtcagtttgccgttcaacagaagctcctcaacaatcagctctccagtgtcactgtacagagttttggtagtatagatgtaccggggatatctaagcattcgcaatacccggctgcactgggcttcatactccaccacaccacgtttgtgcacttgataactcaccaggttatgttggacgaggacacacagggctttcttcacctaaatggaacataaagagaagaaagagaggaaagacctgaagatatagctcattactgctggcaattttttgtccaacagcttagtaagcatcagaaaatggctagataatttctgcacttatttcctctctccactggaggagctaataagaatcacacatcaatacaataaatcaggaagattccttgctatatttcctctgatccttatctctcaaaacacaatttactttcatcattctcattccttaaaggcagtactgagattaatagacttattgtgaataaatgaggtacggcatgggaagagcaaagatttgcctaaaagctgtgatgaactaggaacactttgagaaacaaaatgttgatgtctaagtctcatccttttctccccgaaataacattgttctgctccaagggcaggctttcttcatttttccttttctggggtgagaagaacaatattcaaaggtgggtgaaataaattagtgaaagaaatgagagaaaatgaatgtcatttagacatacctgatccagtgatgttcctgtgtcatgggcaattactcttagtggctggctgccggttcttatcagatggactccaattttttctacaatctctccaaaatgctcttgcagcaacaaagaacagagcttaatttctgcttgagtcattgtactggggagtctgagagctagggaaaaaacaccaaaatggtacaatagaaagtctttcacgctggaagcagagctgctgagtgtaaattcatgtattctttctggagggcaatttgacaatacatatcaaaaagccttaaaaatcttgcatatctttgaaacaacaatttctttttggatattgtgtccaaagaaagaaaaagctaataataatgaagtcattagttctctttataataccgacttagtggaaacaatctaacgtctaacaataaatgatgccatacccatacaatggcatactacaccaacatttaaagttatttagtacgatgcgtattcatgtagaaaattattcataataggctggcgcggtggctcaggcctgtaatcctagcactttgggagaccgaggtgggcgtatcatgaggtcaggagtttgagaccagcctggccaatatagtgaaaccccttctctactaaaaacacacaaaaaaattagctgggcgtggtggcgggtgcctgtaatcccagctactagggaggctgagacaggagaatcgcttgaagccgggaggcagaggttgcagtgagccgagatcgcgccactgcactccaacccgggcgacagtgcgagattctgtctccaaaacaaaaaaaaccaaaaaaaattactcataatatattaagtgacagaagcaagctgaaaaaatataaaaattcaattattgtaaaaaaaaaggaaaaatgtatgcataggaaaagactatgcatcaaatttatctctatgggattatgcgtgattctgattttccttaaagattgggagatgattttgcggtctgtcacagaccttagtttctacacttccctgcttggaagaattaaggtcactgttcacagctcggtgggagtgaacaggcagtgttattctcagtccataaaggaaatgataatttcgaaaaagaaatttaggaggtaaaggactgcttctcaacagggtgtgtcaaacaggagatgaggttacgttgtttgcaggacagtattcaattcttaaacttctactccttgacaaagttgacacaatcagaaacggacgtagttaattttatgattacttccttattacaaattgctaccaaacattgtttacttatttcttccaattcctaagaagccaagtctttgcctccccgtccccaccccgcctcagtatcaccagagacctatttcgtccatccacatatctttggagaagcattcccagatcctttgccatcctcggaaagggcttccaaggcgcttggctcctagctctacacttcctttacacaggttcccgtttcggacgtggtctcttggtccagtcagtgccgccacgttcagacagcattttccactaacctcagggtcagcgcaatccgggggctccaactccaattcggctgagcttcccgcgacggcttcctacggctcccgctggccttctaggccgaggtggagcccaccgccctttctaggacgcggatcgccaccgaagaagac

SEQ ID NO: 1514 - DNA, 4168 bp, Homo sapiens
tatatagagacgtttccgcctcctgcttgaaactaacccctctttttctccaaaggagtgcttgtggagatcggatcttttctccagcaattgggggaaagaaggctttttctctgacttcgcttagtgtaaccagcggcgtatattttttaggcgccttttcgaaaacctagtagttaatattcatttgtttaaatcttattttatttttaagctcaaactgcttaagaataccttaattccttaaagtgaaataattttttgcaaaggggtttcctcgatttggagctttttttttcttccaccgtcatttctaactcttaaaaccaactcagttccatcatggtgatgttcaagaagatcaagtcttttgaggtggtctttaacgaccctgaaaaggtgtacggcagtggcgagaaggtggctggccgggtgatagtggaggtgtgtgaagttactcgtgtcaaagccgttaggatcctggcttgcggagtggctaaagtgctttggatgcagggatcccagcagtgcaaacagacttcggagtacctgcgctatgaagacacgcttcttctggaagaccagccaacaggtaagcggcccaattcattgttggagggtgaaagctgattagagaagagaattgaatacacaaaacctgtacgaaatgttttaagttgctcagtttgagtggtttgaattacgtgttgttgcttccttttttctgttttaatttgcagacattctcctccccccccaaaaaaaagggtgatttgtacaattttttatggtgctgtgtcctaaaggggatcctgaggggcgttgcctcgggtagttaaagtcttatgtgtgcataagttgcttattctttgtctacttcctatttgagatgttagtagagaactgtcctgggtgaatctttcagtattgcagggcttggcaacttgctgcccgacaaaatacatcagaatttctctttaagaacaatatgggatggattaaaaaatatatatatgggatgaaattgggggtacttcaataccttgcatgccacccaagcattccttatcacacagatgcattttaagtgtaacagcaagcctaatggctactcgattttctttcccttcaggtgagaatgagatggtgatcatgagacctggaaacaaatatgagtacaagttcggctttgagcttcctcaggggtaaatatcagctaaatgcatctttgaacttttctgtctaaaatatcttgccctcctttgatcacttactgttcttggagagcgttttaaaattttcattttcttgacacaggcctctgggaacatccttcaaaggaaaatatgggtgtgtagactactgggtgaaggcttttcttgaccgcccgagccagccaactcaagagacaaagaaaaactttgaagtagtggatctggtggatgtcaatacccctgatttaatggtgagatccattttaaagattctattctcctgggtcatgaggatgataaatcagacgtcttgggcattagattgaagcatctcaaaacacctttttatccccttctatataggcacctgtgtctgctaaaaaagaaaagaaagtttcctgcatgttcattcctgatgggcgggtgtctgtctctgctcgaattgacagaaaaggattctgtgaaggtaaaatcctagtgcttatggcagttaaaacaggaactgggtttaggggcaagggcatgggactggggtagaggaagtgtcattaactatactgagtatcagtaagttttcatctttctcattgctaggtgatgagatttccatccatgctgactttgagaatacatgttcccgaattgtggtccccaaagctgccattgtggcccgccacacttaccttgccaatggccagaccaaggtgctgactcagaagttgtcatcagtcagaggcaatcatattatctcagggacatgcgcatcatggcgtggcaagagccttcgggttcagaagatcaggccttctatcctgggctgcaacatccttcgagttgaatattccttactggtgggtagatgcagggtggcttcagcagagaaattgttcatctgttaccacagctgtcttgtttctccagacctctggtgtaataaactgccatcttcctttctagatctatgttagcgttcctggatccaagaaggtcatccttgacctgcccctggtaattggcagcagatcaggtctaagcagcagaacatccagcatggccagccgaaccagctctgagatgagttgggtagatctgaacatccctgataccccagaaggtgagccagacctaatgtcttttctttgtttctggtctacctgggtttgtaaaattgtgatggtccagcatttcttgggcaggattcttatgtggccatattttcttttctagctcctccctgctatatggatgtcattcctgaagatcaccgattggagagcccaaccactcctctgctagatgacatggatggctctcaagacagccctatctttatgtatgcccctgagttcaagttcatgccaccaccgacttatactgaggtgaggattgtcatctttactgttaaatttgtcctaagctttctataagaagttgacttagacggattgctaaactggtttgttctttttgttcttacctgaactgaaatagtctgtttctttctttaggtggatccctgcatcctcaacaacaatgtgcagtgagcatgtggaagaaaagaagcagctttacctacttgtttctttttgtctctcttcctggacactcactttttcagagactcaacagtctctgcaatggagtgtgggtccaccttagcctctgacttcctaatgtaggaggtggtcagcaggcaatctcctgggccttaaaggatgcggactcatcctcagccagcgcccatgttgtgatacaggggtgtttgttggatgggtttaaaaataactagaaaaactcaggcccatccattttctcagatctccttgaaaattgaggccttttcgatagtttcgggtcaggtaaaaatggcctcctggcgtaagcttttcaaggttttttggaggctttttgtaaattgtgataggaactttggaccttgaacttatgtatcatgtggagaagagccaatttaacaaactaggaagatgaaaagggaaattgtggccaaaactttgggaaaaggaggttcttaaaatcagtgtttcccctttgtgcacttgtagaaaaaaaagaaaaaccttctagagctgatttgatggacaatggagagagctttccctgtgattataaaaaaggaagctagctgctctacggtcatctttgcttaagagtatactttaacctggcttttaaagcagtagtaactgccccaccaaaggtcttaaaagccatttttggagcctattgcactgtgttctcctactgcaaatattttcatatgggaggatggttttctcttcatgtaagtccttggaattgattctaaggtgatgttcttagcactttaattcctgtcaaattttttgttctccccttctgccatcttaaatgtaagctgaaactggtctactgtgtctctagggttaagccaaaagacaaaaaaaattttactacttttgagattgccccaatgtacagaattatataattctaacgcttaaatcatgtgaaagggttgctgctgtcagccttgcccactgtgacttcaaacccaaggaggaactcttgatcaagatgccgaaccctgtgttcagaacctccaaatactgccatgagaaactagagggcaggtcttcataaaagccctttgaacccccttcctgccctgtgttaggagatagggatattggcccctcactgcagctgccagcacttggtcagtcactctcagccatagcactttgttcactgtcctgtgtcagagcactgagctccacccttttctgagagttattacagccagaaagtgtgggctgaagatggttggtttcatgtttttgtattatgtatctttttgtatggtaaagactatattttgtacttaaccagatatatttttaccccagatggggatattctttgtaaaaaatgaaaataaagtttttttaatggaa

SEQ ID NO: 1515 - DNA, 4356 bp, Homo sapiens
aaccgtcaactcagtagccacctccctccctgctcagctgtccagtactctggccagccatatactcccccttccccccataccaaaccttctctggttccctgacctcagtgagacagcagccggcctggggacctgggggagacacggaggaccccctggctggagctgacccacagagtagggaatcatggctggagaattggatagcagagtaatgtttgacctctggaaacagtaagtcaaaatgaaattgcaattcctttaataagcttttatattgaagttagacttttataaaattacaaacacctacttggatgtctctcgtccaaatgctgggatctctccctaccaaggtgccccaatctccatttctctttctgtcttatttctttctggcctctggcctctagctttttgaagtttaattctctgtctctcctctggcagtcttagccctctctttaccttattacctcaagactcctgatgaagttttagaaggagttccctacgtcctctattctgtagttttcttaccaaggccaaatatgacctcagatgatgagtcactgatacccttctatcctgcccccacttagcaatgcccttcacattgagattccaagcatgggggctgctccctgtaaatgatttctccccacaactctagtccctccattctattctccctcttgcaggactcttcccccaatcatatccttacccataagataggggagttaggcaggagggatttagcccctctccaactcctgtcatcataaaagactgagaacttcagaatttgaaaagaagagattaatggaaggagtgatatttgggaaaatacaagaactgttgacttagaaaaaacaaatattgatttgcatgtttggtttgcatcccattattccatgagagagggagattaaaattgcagctctctagagctgatgaaaagagattggtttccttttcatttgaatactgatattctagacgggatgggtatgccacccttaatccttcttgtgttctgacacaaaggaggaaaagaaatgtatgactcctagagggcatctcctcctaatggagagggacaaataagaagtatgtttctgaaatattttcaggtcctaattttactagggtacccactaggattactggtatctgatctagccccatgattcctccatctttgacatacctgctgtttggtagctcagaatggagcaatacagtggactctgcccccttgagttcactcaaccttccctccacccccacctaggggtattgcacaagggccctaaaagtggccacaggaacagggcaaagaggcttaactgccacacttatagtttgaggaactccaatctccccaaattccagtctgttcatccttttcttgatctccccagattcactccacattatccttaccaatcttcaattcttctctctctccatgtccagccaaatttcttttttcagtcacttacagggcttccggtcaaaattcactaggtaggagggtcatcagctgggaagaaccggcgcctgggaaacctggctggataggtatgggggagccaggccagtcccctagtcccaggtcctcccatggcagtcccccaactctaagcactctcactctcctgctgctcctctgtggacatggtaaggaagggccagggaagggtttggggaaatctagagggtaggctgctatgtaggggtgggcatgtgagcctgaatgagtgaggagagataggcgctgagagtcccgatcactcgccctgctctcaaatactaatattttatttcccgttcagtctggggaaggccactggggaagcccttggtcgacaggcagaagagatgtggcaggcttacacacttttagtaagacagccgagagaactagggactagggggttgggggctggggaaggcccttagttaggttttaggaaggctggaaacccctgatgagatttggaagagttatgagcaaactacactccgatagagcagaggtctgaggaccgtctcacaatcctctcccttctgtctttagctcattctcaatgcaagatcctccgctgcaatgctgagtacgtatcgtccactctgagccttagaggtgggggttcatcaggagcacttcgaggaggaggaggaggaggccggggtggaggggtgggctctggcggcctctgtcgagccctccgctcctatgcgctctgcactcggcgcaccgcccgcacctgccgcggggacctcgccttccattcggcggtacatggcatcgaagacctgatgatccagcacaactgctcccgccagggccctacagcccctcccccgccccggggccccgcccttccaggcgcgggctccggcctccctgccccggacccttgtgactatgaaggccggttttcccggctgcatggtcgtcccccggggttcttgcattgcgcttccttcggggacccccatgtgcgcagcttccaccatcactttcacacatgccgtgtccaaggagcttggcctctactggataatgacttcctctttgtccaagccaccagctcccccatggcgttgggggccaacgctaccgccacccggaaggtcaggcactcaatcttccttccgatccacctcatgagattcttccacgggcaccattcctccccatccccactattcaacagcaatgctccctaattcccttttcttcctcaacctctcccccatctcgaatcactcccttctaccaaacacctggagctgtaaatcacttccccttgatgggaatttgactcaaatgcagaaaaccttgaagagacagtcggagagggcggacctgaggagtttcagaagggaaacttttccctctcctaggaagttgccacgattaagtagagagggggttaagtagggatgaggtaatactggaacataaataggagaagggatcaaggattgagggccatagtagtcctgcatctctacttggatcagatctctaactatgtatgaggtctgattggggggaagatgcactgaacccaaaatgaactgttttccctcttgtcctcacagctcaccatcatatttaagaacatgcaggaatgcattgatcagaaggtgtatcaggctgaggtggataatcttcctgtagcctttgaagatggttctatcaatggaggtgaccgacctgggggatccagtttgtcgattcaaactgctaaccctgggaaccatgtggagatccaagctgcctacattggcacaactataatcattcggcagacagctgggcagctctccttctccatcaaggtagcagaggatgtggccatggccttctcagctgaacaggacctgcagctctgtgttggggggtgccctccaagtcagcgactctctcgatcagagcgcaatcgtcggggagctataaccattgatactgccagacggctgtgcaaggaagggcttccagtggaagatgcttacttccattcctgtgtctttgatgttttaatttctggtgatcccaactttaccgtggcagctcaggcagcactggaggatgcccgagccttcctgccagacttagagaagctgcatctcttcccctcagatgctggggttcctctttcctcagcaaccctcttagctccactcctttctgggctctttgttctgtggctttgcattcagtaaggggaccatcagtcccattactagtttggaaatgatttggagatacagattggcatagaagaatgtaaagaatcattaaaggaagcagggcctaggagacacgtgaaacaatgacattatccagagtcagatgaggctgcagtccagggttgaaattatcacagaataaggattctgggcaaggttactgcattccggatctctgtggggctcttcaccaatttttccagcctcatttatagtaaacaaattgttctaatccatttactgcagatttcacccttataagtttagaggtcatgaaggttttaatgatcagtaaagatttaagggttgagatttttaagaggcaagagctgaaagcagaagacatgatcattagccataagaaactcaaaggaggaagacataattagggaaagaagtctatttgatgaatatgtgtgtgtaaggtatgttctgctttcttgattcaaaaatgaagcaggcattgtctagctcttaggtgaagggagtctctgcttttgaagaatggcacaggtaggacagaagtatcatccctaccccctaactaatctgttattaaagctacaaattcttcacaccatc

SEQ ID NO: 1516 - DNA, 4356 bp, Homo sapiens; identical to SEQ ID NO: 1515

SEQ ID NO: 1517 - DNA, 4356 bp, Homo sapiens; identical to SEQ ID NO: 1515

SEQ ID NO: 1518 - DNA, 4356 bp, Homo sapiens; identical to SEQ ID NO: 1515

SEQ ID NO: 1519 - DNA, 5980 bp, Homo sapiens
tagagttagcctttgattggtcagcttgactggcgacctttcccctctgcgacagtttcccgaggtacctagtgtctgagcggcacagacgagatctcgatcgaaggcgagatggcggacgtgctagatcttcacgaggctgggggcgaagatttcgccatggatgaggatggggacggtgaggacagtggagacggctggtgggaagcggggaaggtgcgagagaaggctataataggaaaatttactcttttttcctcggtcgtaaggatgggaatcgaggaaccgggtcttgggtggattagagattccgcccccttcaggagaagggagggcgtgaccgggaaggcactaagactggaggcggtgtgggtcggcttgctggtagtgtattgggaaagagacgattgttacaaatgactgtcatagttacttattcttttatcttctggggttccagagagcattcacaaactgaaagaaaaagcgaagaaacggaagggtcgcggctttggctccggtgagtgtggggaaaatggggtagagtggcctagtagggcaggagctacgggttttggagtccccacccacctcataggaacaatgggagaaaggaggagttttcggtgatctcgtgtatgtcccttatagaagaggggtcccgagcgcggatgcgtgaggattatgacagcgtggagcaggatggcgatgaacccggaccacaacgctgtgagtaataatggaacctgtgaggtatccgtgtctgtggtagtagttagaaaccaataaaatagttaaacgcagtaggaatgggttcagagatagcttaaacaatctgagtccgcactcactctattcctgtgagcctgcttaaagtgtctctcatgtactcatacaacttccccccgtcccccaacagctgttgaaggctggattctctttgtaactggagtccatgaggaagccaccgaagaagacatacacgacaaattcgcagaatatggggaaattaaaaacattcatctcaacctcgacaggcgaacaggatatctgaaggtatcctaagtgacactttattgcctcctttctttcataagccttaggtagcattcgtagttctgtgtttgctgtggttggccaagagcaaagttgaaataaaatgacattggaaatctatgttttgtcagacacgccaaagagacagaaacggagatgatgtatatatacagtagagatatatgatgtacattcattgtttaaagtgtgtagatttttctgagtttagatttgaggaaaaagatactcagtgatacttggggaaataggagggttttcatatctgtcttttcactttccccaggggtatactctagttgaatatgaaacatacaaggaagcccaggctgctatggagggactcaatggccaggatttgatgggacagcccatcagcgttgactggtgttttgttcggggtccaccaaaaggcaagaggaggtaaaatgaagagggcaaatactgtctgggtgaagggaatacgaacgaaacagaatgaggacttagtattatgtccctctaatggactcctctccctgcttctttttccctagaggtggccgaagacgcagcagaagtccagaccggagacgtcgctgacaggtcctctgttgtccaggtgttctcttcaagattccatttgaccatgcagccttggacaaataggactggggtggaacttgctgtgtttatatttaatctcttaccgtatatgcgtagtatttgagttgcgaataaatgttccatttttgttttctacatttaatgttactttcctgtcctaaaattgaaagttctaaagcatagcaaggctgtatggatcattgtgaagatacttctagggactgaactctatgtatttcttttttttcttttttttgagatagagtcttgctgtgttacccagggtggattgcagctgatcatagctcactgcagcttcaaactcttgggctcaagccatccttctgcctcactgtccctagtagttgggattacaggcacatgccaccatgcccagctaaatttttaatatttttgtagagatggggtcttgctgtgttacctgggctagttatgtgagtttctatattagacatagtctcaagtttcaggtagggtttaaagtagagacactggtcagtatttcttttttggggggaactaggagagcaggagtagaagtgagatgttaagatcttatggcactaaagacttactattctgttcctacatactctgttaggatcagatagatgttatagaaatgccttttgtttctcctgcccttcttgatgtcacagttttttgtacttccagctgtctaaaggcatgaatctcctcttggagcattctcccagacccttctttagaagagtctatactaagttcttggtgccctcttcggcagccaagggtgaaggccccatagaggagaggatccaaaggagcattgaggaggcccaagaggaaaaggatgtggctcaggctgggagggacttcagttagcatggtgggggagaaccagtaccacatacccagtaggtaataaggtgtccagcagaggatgaaggtcagcaagataagcagggccagtctcagggcccggagacgaacacggggacaattgtcaaaggagcgggggagggcaaattcaccagcaggggctaggaatttagaaaatatactgtaattcagacactcagcttctgatctgagtatagggtgaattgatggaggggcatagctagtgagacagagctcacctcctacaaggaggagaatgttgcaaaccgttttccccttcccaacctgggactatatgatttcttacccccagggattatgatagaaatatgaagccaccaagtctagacttgatggtgttcaagaataaataatactgattgcctccctagtccttgtccagctaactcagctgtttataattgaagggattcaacaaaattatctctagcatcaggtgctagacatggttagaatctcaccatggtttagtgactggtagatagctattaggtaggtagataaataaatgatgctagaggcaacaggtctagggttaaggattaaggcctgggaattggagtctcaccatggctccccttccttgtctggggcctggacacactgaggacaatgcggctatagcagatggccatggcagtcagtggcagcagaaagaggcagcagaaggtgaagaggttataggtggtctcttgccattgagccttgaagctgcctttggtgacacactgagtgaaagggactgggccagctcagtggaccgtgtggaacaggaacagctggagtggagttgaggactattagaactggttcccctcaccacccaacctacccacctatgtcatactgtctcctcccaattcatccttaattccaagtgaagcagcacagtgctgagaaacagttcatccatggtgccatgttaaagaagttggaaatatatcttgaaaatcctatcttccttttaggcttgaatatgatgctgaacagtaagtttgttaaatcttggaacttaaaacaatcctgctttctcaagtactattctaacattgcgctttataagggatgatatttctaccacctcactcatatttttagctgaaatgattttcctggtatgtctgttattttgtggaaaaagaaatattgtgtaaaatgggtgctgccaaaattccaggccattttgcagggactctgaagtgacctttagtagtaatagtcttatgtgcagtaactataatggtaaagaatgttaaataataaaatttaacattttccaaatgctattgggctgcccctccccctttttgttaaattgctgggttttccaactgaatcagtaaaaactatttctgtttagagctacaaggttaaagtgcctgctttccagtaatggagattgagtcactattaatttgataaaaggtaagctcagtaggcatcagattcctagatacaaggcatttgggaaagtgattttagcagacatgagggacatttaggaaagatgaatagtttcagcctaagagaattttgtgaactgtttggagttacgatcaggctactctgagctagttgggaaatggtctttcctcttcccatctcttgcattcatatatttctaagttttttttttttttttgtttttgtgctctgcctaagaagtgcttgagaattgtgaggagtataaaaatagtcaaagctggctgggcgcggtggctcacgcctgtaatcccagcactttgggaggctgaggcgggcggatcacgaggttaggagatggagaccatcctggctaacacagtgaaaccctgtctgtactaaagatacaaaaaactagccgggcgtggtggtaggtgcctgtagtcccagctacttgggaactcgggaggctgaggcaggagaatgacctgaacccaggaggcggagcttgcagtgagcagagattgcgccattgcactccagcctgggcgacagagtaagactgtctccaaaaaaaaaaaaaataataatcaaagctcttggatttatagtttggtccacagccttgttttgatctttcctttatcctgttttattgccatttaccacgtactgtagaaacatccctttcaactgctgataacttggaaacaagcctacaaaaataagtaatttctaactactcctaatactacctataactacccctaagcccttaccactctaacgtgacattattaaattttttattttattaacactaatattttaactacaattacagcatatgggcaatacagaatttacctaaaaggatactaatttggaacaaaaaaaatcacctttcgcacatgtatcatgtcacaaccagtttgccattgaaacaaatagaggttgcaaatattgtcagattgtcaggctgtaagaaaggatgaaattcatttcccattgcatcatcttgtggcccatggatttcaagtgccttagccaaaatcatatagctagttagcagtagagccgagactcagaaaaaaacaaagtaaaacaggcagactgaaacaaaaagtcttctaattcccagtccacatgtaaaatttgcttcatataaacaaacctaattgtaaatggcactgtagcaacaggcttctttttaacacttggattggtaaaggtcttgtttgcaacatattagaagtattatttttctctttcccccccaccccacccccaacagagtctggctctgccgcccacgccggagtgcagtggtgcagtcttggctcactgcagcctccacttcccaggttcaagcaattctcgtgcctcagcctcctgagtagttgggattacaggtgctcaccactatacccggctaatttttgtatttttagtagagatggggtttcgtcatgttggccaggttggtcttaaactcctgacctcaagtgatccacccaccttggccttccaaaatgctgggattacaggcttgagccaccaggcctttctttgttcttaggagtatagtcagactaacttctagtagttatatttctaataattgaggatgtaagtaaggatcaaatcttaaatcagtataatgcattgtcattccagagataaatcctagacccttcttggcctccttctgacataattctaatcctacagtctcagagatgctgttgtatcctgccccccaaccccatgatagtgatagtggtttttgccttgaaggaattgctttgtatttagcttttccccctctagatttctagttccttttcagtattggattggatttgagatttgattaacctagtactcaggttcagatgctcgcctctttgcaattttaacactcattcgacaataaagtcagtaaaaaacacaa

SEQ ID NO: 1520 - DNA, 10560 bp, Homo sapiens
cggcatttgcggccggcgccagggtggagagttgtgcgccggtccctgggcctgagctccggctccggctggggcgcctgcgatgtctcaagatggcggagctgggcgaattaaaggtaccggccccctccccccatccccatctggactcagcccggcggtacgccgtgtccgggaagcgaccgagactgggtgccggggctcgggtgggcgccgacgacgtggcaggcacgagctgctgaggatgggagagaagtagctgagagcgaggaaggggctgcggcggggctccgggggcggggctgcggggcagatgtaggggtggggccgaggggaattgcagctgttgggggctgaggcgcagggggcggggacgaggggtagaagtcggatttagtagtaggggcggttgttggggtagggccagggggaaaaggtgctgtagaggcactgggggcgagtcgatcaaggccaagagatgcaacagtagggggcacatgcagggatgggaccgcggggcagacgtaggggaggctccgggggaaaggcagctgagaggatagggtctttggggtactctcgggatccgagctttgggaaataccagtaggctgctgagatgcagggggcggggctgtgcgggccgatacctcgaggggtggggcagaagcatcctggaggctcagaggaaggtcctgccgtagtgaatcgcggtgtttgggaagaggcagaggcatgtgaaactatgggatagaaaggtgggaagttataggggaagctaatggagaaaaaaagacaggacagaggagataaggatggggagaaagaggagcaagtttctcatcacattccataaaaggggtccaagacaaagcctcctatgagaagaattgtgtagggctagcaagccctgcacatgacaggatctcctagagattcacagaagggagtcttctaaggagagcgctcccctcctgctacatagagtttggagggtgaccacatctgaggacatctcatagaacctcaaactaccgagttcatccgcctgcctcctggttttcttctgccctttgaaatgggagctatggtcctgggaaggctggaggtctagccactgggcccagctaccttcaggggatttgcgattctgtgccctgactcagaggcttttccttcatccacccagggtctctgtttagagctctgccctctcctcttccacccctataggggggcgctgtaagttgtagaggagtattaatttctctgtgtaggagagatgccagattatggttcctggcagatagagtaaacaggcaggatacttggactcagtgattcactgttaatctccccgacccaagttttggtcctgtttcccttccagaaaaataggactaagttgtggggagggggtggttatataaacgattccaagaaaggatctggggaagttatgagcattgaaccctgacctgaaaaccctggccacagaagcttcagaggcttgggggaaatagctgaggtgaattaaggtggttgggaggggtgggctgaagggcacaatcctccagccacctagcccctttcttcccctggggctgtctggcttgaatcctcttgtctctccctccttctccctgtctcctatcctgttcccaggaggctgggatgggtttgagagtctgagaaagggcaagagaggagataagcagcttaaagcagagtccagggatggaggcgggaggctgcatggactcggaggtgtgtctgagggtggcttgctgtctgccattccctgccccactctggctgcttccaggcctggggaaatagtgttgctcaagctcgggggtggtggtgatgatgctgacctgatggttgctaaagtgggactgagatgtccctttggataggtcgactacctggcagtaatccactagctgcgaagcatcatctttcccatcagtgctggagagaaaggcactgcccacctggtagctcagcccatgtcttggcagggcaggcctgtgcaagggaggatgctcaagcttctctgtttttctccacagcacatggtgatgagtttccgggtgtctgagctccaggtgcttcttggctttgctggccggaacaagagtggacggaagcacgagctcctggccaaggctctgcacctcctgaagtccagctgtgcccctagtgtccagatgaagatcaaagagctttaccgacgacgctttccccggaagaccctggggccctctgatctctcccttctctctttgccccctggcacctctcctgtaggctcccctggtcctctagctcccattcccccaacgctgttggcccctggcaccctgctgggccccaagcgtgaggtggacatgcacccccctctgccccagcctgtgcaccctgatgtcaccatgaaaccattgcccttctatgaagtctatggggagctcatccggcccaccacccttggtatggctctttgtggtcccttagtcttctggactccctacctgttccccaaacatttcttaggctttagtcctatgggatcagtgacctgggatgggggcgatttctgtggctgcctgtgcatgggcttggaataactgcccctttgtatcctcagcatccacttctagccagcggtttgaggaagcgcactttacctttgccctcacaccccagcaagtgcagcagattcttacatccaggtacatctcttccagtcttcctgcctcatccctggtctctgctttctgactttcttctcttctgccctgtgctcttccctatccctcctcctatacctacttgtctcttgttcttctgtgtgtctcttctctatctcctggacatctgactttcagcctttctgtgcattcacccttgccctctgggggctacatgctgacatctcttcatctccctccctgttacagagaggttctgccaggagccaaatgtgattataccatacaggtgcagctaaggtgagttcatcctccctgcctatcctgggtacccactgggggtaggagtgaagtaggggtatgacagatacccttacgagatgtccctgctctgccactgcctactgcagccctgcgactcttgttggatgctgagggcttcaggcatctatgactgattttctggggttccctgtctctctgccagattcaagttaagaaatttcttcccactctttcttcctttctcatctcttaccaggttctgtctctgtgagaccagctgcccccaggaagattattttccccccaacctctttgtcaaggtcaatgggaaactgtgccccctgccggtaaatgctctccccttcttctgtcagtaatcccttaccgtttcagttcataaatattaactacaaacctattctgaaagagacatgcctagcacagtgcgtggcacatagtaggtgctcagtttactgactgaatcaatagaatctcgagagtattaagatagggctgaacaaaggttttgtgagaactcggaggaggacattagttcaacccgagatgtaagaaagacttcttttttgttttttttttttgagacagagtcactcgctctgtcactcaggctggagtgcaatggtgcaatctctgctcactgcaacctctgcctccctagttcaagcaattctcttgcctcagcctcccaagtagctgggattacaggtgcccaccaccctgcccggctaatttttgtatttttagtagagacggagttttaccatgttagctaggctggtctcgaactcctgacctcaggtgatccacccacctcggcttcctaaagtgctgggattacaggcatgagccagtacacccggccagaaagacttgaccccagagctgagagttagaaaaggtgaggcatccttattcctcctcctcagggactcagtgagttccttttttctcagtcaataaataagctctcctttctccccaggagtgaaccccacacataaccctagacagtgctccagttttgtgagccactgaatgggcctccatccccttggtcagtgagtgagcgagttggccttccctccagggattgaataacccgagacaagatatcttttgttcaaagagcagagccccttcccagagccacttctccactgaccaatccctcccttctccagggttaccttcccccaaccaagaatggggccgagcccaagaggcccagccgccccatcaacatcacacccctggctcgactctcagccactgttcccaacaccattgtggtcaattggtcatctgagttcggacgggtgagcacagctaaagcaggtgcctggaaaagcctgctgagggtgaaggggaaccatccagtgtcctgggttggggaagcattttcctctttatgagtctgtctctggtcctcatggaacaaaagtgggcagtggtggtatgagaagcagaggctaattgtctaccccctgcctccaagtagaattactccttgtctgtgtacctggtgaggcagttgactgcaggaacccttctacaaaaactcagagcaaagggtatccggaacccagaccactcgcgggcactgagtgagtaacatctttcctctcttccccacctgatctggattcaagtcttcctggccctccagccttcataattaaacccatacctcttttttgacaacttactccccttctcacatgaaccccaaccctccccctctacccctgaccagtcttccagtctttatagttgaagttggaccactcccaggcacccttgaatttccaatcatgtatctgctttgcacctcacagtccctaactccagccctgctagaatatgggctctccggactggaaagaatcttaggggtcctctaatctaaccctcacatgatgcttcaactcctccagatcatctctaacatagccagagtgtcacgctatgtttaagcatcttcagggatgggaaaatcccccacacccagccttcatcatccatatcccagaccacttccatgtgacgtcccactggcccccaaagacgctccacccagcagcctctcagccagagccatctgttcctggccttaccaactcctgggcttcctccagccttgctgaccccatggctctggcctcacttttgtttcagtcaaggagaaattgactgctgaccctgacagtgaggtggccactacaagtctccgggtgtcactcatgtgcccggtgggtaaaaggggagaagggaacagggtgggaagggagttgggtttagcctgtggactttgatgagggttcctagggatactggcgtgaagttttctgggatgaaatcagagtagggcctctgacaagagaacttgcttctcctcagctagggaagatgcgcctgactgtcccttgtcgtgccctcacctgcgcccacctgcagagcttcgatgctgccctttatctacagatgaatgagaagaagcctacatggacatgtcctgtgtgtgacaagaaggctccctatgaatctcttatcattgatgggtagggccattttgcttcctcttacctaggacatccactagaacctcttttcttggttatttctttttctttttcttttcttttttttttttttgagatggaatcttactctgttccccaggctggagtgcagtggcacaatcttggctcactgcaacctccacctcccgggttcaggcgatactcctgcctcagcctcctgagtagctgggattacaggcacccaccaccatgcctggctaatttttgtatttttagtaaagactgggtttcaccatgttggccaggctggtcttgaactcctgacctcaggtgatctgcccacttcagcctcctaaagtgctgggattacaggcatgagacaacatgcccagcctataatatttcttttttcttttagccaccacctccttcagggtttttaattcatatggcttacttcccctcacatgaactgcaattctcaccttatctatcccttttaccagtctgtgtgtgtgtgtgtgtatgtgcatgtgtgtggagggggagggcaacattaaggacttagtatatacaaggcatcttgctgagcactttgcatgagttatctcattgaatcctcacaataaccctatggactcggctcctacctgtaattccaacactggaaggctgagatgggaagatcatttgaggctaggagtttgagaccagcctgggcaacatagtagaccctctctctataaaaaattaaaaaaattagccaggcatgttataatagctcatgactgtagtcttagctgctcaggaggctgaggcaggaggatggcttgaacccaggagtttgaggctgcagtgagctatgattgcattactgcaccccagcctgggcaacagattgagaccctgtctcaaaaaaagaaataatcctatgattggctagtgacactcacccagaaaaaaaaaaagaaaaaaaaaaaccctatgagataggtagtatcattacacatgaggaaactgaggccgagagagattgagccttgctcaaggttatattgttaagtggcagagccagtgtactgaactgtcataatatatcacctataacaactacctgacttcccactgagcattgcaataaggttcttttcagggcctggatgttctaatcttttgatcttgctagtcttaacctctttttggaatctacattatggttcctgttcccagtgctcccccactttttgtttgtttgtttgtttttgagacagggtctcgttctgttgcccagactggagtatagtagcacaatcatagctcactgcagcctcgacctcctggcctcaagtgatcctcccaccttggcctcccaaagtgctaggattgcaggcatgagctaccatgcctggcccctagtgcctttatttatttatttttacacaagtgtttagaaagccaaagacccagtgccttttggagatggtttatggacttctgtgtctctgctccttttgttccttatactacacgtaagtgctcagattttttttttttttttttttgagacggtgtttcactctgtcacccaggctggagtggtatggcacagtctcgtgatctcagctcatgcaacctctgcctcctgggttcaagcaattctcctgcctcagcctcctgagtagctgggattacaggcatgtgccgccacatccggctaattttgtatttttggtagagatggggtttcaccatgttggccaggctggtctcgaactcctgacctcaggtgatccacccacctcagtctctgaaagtgtgattataggcgtgagccaccacgccggctttttttttttttttttttttgaggcagagccttgctctgtttcccagggtggagaacagtggtgtggtctaggctcactgcaacctctgcctcctgggttcaagcgattctcgtgcctcagcctcctaagtagctgggattataggcatgtgccaccacacctggctaatttttgtatttttagtagagatgaggtttcaccatgttggccaggctggtcttgaactcccagcctcaagtgattcacctgcctgtacctcccaaagtgctgggattaaaggcgtgagccactgcacccagcctcagattgtatttattttaaaacctattacttactttgcaaagctcttttacataccttgtgttatttgattccaacaactcagagcggtccagtaggatggataatgttcttattttacagatgaggaaactgagatacaggaaggtgagttacagaactctggctactgttctgctcatctcccagccccgtgaattttcatctctctcttcccccagtttatttatggagattcttagttcctgttcagattgtgatgagatccaattcatggaagatggatcctggtgcccaatgaaacccaagaaggaggcatctgaggtttgccccccgccagggtatgggctggatggtgagtgaccccctgttccccagctaagctaaatcttggatggcctcttctctgagacgtagtcttcttaatacccacaggcctccagtacagcccagtccaggggggagatccatcagagaataagaagaaggtcgaagttattgacttgacaatagaaagctcatcagatgaggaggatctgccccctaccaagaagcactgttctgtcacctcagctgccatcccggccctacctggaagcaaagggtatgagaaaataggctgagtctacagcaaaacggacaggggaagaagtcaggattgctttctgatcattggacaaagcctggggcaagagaaatgtggaggggacagagagggaacctggggacctgagctgggtgagggcatctgtggtttgctggctgcctcagctcctctctacccacagagtcctgacatctggccaccagccatcctcggtgctaaggagccctgctatgggcacgttgggtggggatttcctgtccagtctcccactacatgagtacccacctgccttcccactgggagccgacatccaaggtatgacatgggtcataagatggaccctgcactgccacaccctccccagagctacatcagaacccctgttccttctcaaagcctcctgcttctcctgcaaggggccacagtccacagtgctttgtcttttggtggtaaaggggtcagataggaggttaattttgatttttcttttcctgccaggtttagatttattttcatttcttcagacagagagtcaggtaagtggttctttcttcagaaggtctcagatctctgaagcttcctttctagacactgatggggcccctccctctcttatgatctctggggatgtaaatctgctttcccgtgagggcagtggggtgtaggtatcttattatctcctcagccccactggtagttcctgagattcctacttaggcctccttcctagatcccctgttacttttctgccctggcctactcacccctacccccgtgtgcacttagagcaccatgcctgctctaaccggacattccacacatttcagacgcccacaaagccaagaacctaacaagttggaggagctctctcaaggcagggaaaggggaagggtgtagggaagtaggggaaagagggagaggctctcctgcttctcaagagaataccttcggatccacaggggttgattgctctcatacggcatttctgagatgagtgactgggaggtggggaagtcaggattgagatcttaaactatgcccttgattcttcctagcactatggcccctctgtcatcacctcactagatgaacaggatgcccttggccacttcttccagtaccgagggaccccttctcactttctgggcccactggcccccacgctggggagctcccactgcagcgccactccggcgccccctcctggccgtgtcagcagcattgtggcccctgggggggccttgagggaggggcatggaggacccctgccctcaggtccctctttgactggctgtcggtcagacatcatttccctggactgagttccctggattatggaaacttcgctgtcccccaacactgagcaagtatgctgtggagtcccaaccccagctactctgatccctctgggggctctggccaagggccagacagaccttcacagatgcctacttttggcctcatctctgcctgacaaggccagcacccaaagggttaatatttaacctctttttaaggacactggggtctgtttctggaaatgttctttagatggtggcacattcctttgggtatgttaacctaggcagtgggaggcaaatgggatggtatgtgagctaggagaagggctgaaccctcagccttgactatgtctagagcctcttggggaaggggcacctctcttgaaccccaaatgctctctcttcttattacccaaacccatggctctatttcttcttcacatccattgtctcttcatgtctattccattcccttcggccaaacagacaggtggaaaaactgagacaggcagtttcagagatggacagagaactttattttggattgtggatgtggacttttttgtacataaataagaaaaaccaaaatactccaaagatgacttcccctgcctcctactccagtatgacagaggaggatgtaaggccttagccatgatctgcaggggtctgggagtcaggcccggcctattgcttgggtctctctccatttatatatctaagttcacagtgtttcttattcccccctaagcttctagaggctcatggccctgtagttaggcctggctcattctgcaccttgccagggaggtggaaggaccctgtgccctccttcccaatcttctttttcaggctcgccaaggcctaggacctatgttgtaattttactttttatttctaaagttgtagtgaagctctcacccataataaaggttgtgaatgttc

SEQ ID NO: 1521 - DNA, 19319 bp, Homo sapiens
tgctttttgacagctgtctcttgcacagccgcagccaagtccggtgggttcgggaacctgtggcccggctctctgcgcgtccccatcccccgtggccccgaccccggccatgaagcgtatcttctcctgctccagcacacaggtggcggtaggtgccaaaatgtgtgggaggatggggttgggatcccagctctgtggtgacagaagtctttagtcccgtctcaatgcatcatcgccttttctttttatcagtctttctagctcttctagtcttgcaaggaagcccgccagctttgccttcctcaagaccctgccctgcagcttctgacttgccctgctcacctctgccatccccaaggccctttccccggcccctttcttgtcctcctagcatctacacccccgatttctggttcgttttctgcaactctgtccccttcccatggccctgaccctacttctgctccgtctcccagtaccaaacctcccccaagcatcttcctcagcccctgcctggcctcaagctccattctacaccaccaagtcatgccccagagccccatatttcatccctgccctgtccccgcaatcttgccttccacgtagctctatccttgctgtttcctgttagttcaacaagcactcccagccctgtgccttctgctaaccctttttcacaatctcctctgtcattgcttccctcctgccccatgccactttcactcccatctctcaccagcactgctgttcctcaaacatcactccaaacctttttccaattgatgctcccacaacagcaaccttctgttctcccctccaacctctgccctactctgcccagtggtcgccagtcccacttttcctcctgcctgcttgctgtgagttaatattgcagtctggtcagcctcacaggcactgccagaggatgcacagttgcctgactgctccccagaggactgggtgagttgcctgcagagtccaccccagccagttcactgcagtgtctgatcatcagactggttcttgggccagtcaaggctcaaggcctttctgcctgcttttccccagattattcatttcctgaacccttgcccagttgcttaggaatgatactctctgtttcctttggttgaggtgggggaaagtgatgatgagagaagaggatagagcagactcagagttcccagcagaagtcactctattccccatgttctcccagaaaaaaaaaaacataagattatagaaggtggtggcttagggagggtattgcttcttcttctctagagatctcttacagagagcccccttatttggaaatggaattttctgtagaggttggggttacggctaatttagaagcaaattagccagctacttgtagcaatattgctttgctaacttgacttagtagtatcgttcataagaaaatatcagaaatgttcaattagctcattctgcatgggcaggttacagaatcctggaagcaagctatgaggcaagagtatgaactctgttgaggcctgtccttgtcccacttacatttgcatctctacttagtttccacacattgatcaaccaatcaaaaggtatttactattatatgcaccagaaactgaggctgcccagactcagtcttaactcataatgactttttagaaattcatatggactcttccttagttactgaaagtattcaatgttgcctttcccttacaggtttgtggagtctgcctgcttcttaggaatggggaaactatttcattctttctgatcccccaatccttgggcagtacctcctttccaaggtgctggaatgagtgggctggcttttggaatttggaaccatccctctgtcctccttgattctagctgtacagaggtttgaccataaagaatgaccacccattctaaacttttagtataacaagatcttactataatgagattatgggaagtaagttggatgggtttagaattatctagctggaaagaaaactgtttcttcagacagattggagtcatagaaagcttgcaaatagggcagtttcagctgcagattggttcctcatgaaatttccccacacttctcatgataaattcctccactgttttgggtggcaaactactctggaaccatttgtcagagaagtagtgtggcagtctttatggccactccaaaagcctggcttcccagtcacactggaagactgcctctacccatctccactcacacatttgggtccagggccagagccctgcactgtcagtctgagtaaggactgaaaaagcagtgatcattttaaagctaatctaagttaccagtatataggaaaatccacacacaaaaaaaccccaactcctataatcccattttattttagtcaagtagaggatatccttgagggtatcttacctatgagcttactctgcctaggtagaccagaagtagaccagaagagagctttaaataattggcactggatcatctgggcgcagtggctcacgcctgtaatcccagcactttgggaggctgaagcgggtggatcacctgaggtcaggagtttgggaccagcctggccaacatggcgataccctatctctactaaaaatacaaaaattagccgggtgtggtggcaggcacctgtaatcccagctacttgggaggctgaggcaggagaatcgcttgaacccgggaggcggaggttgcagtgagccgagatggtgccatcgcactccagcctgggcaacaagagcaagactccgtctcaaaaaaaaaaaaaaaaaaaaaaaaattggtactgtctactgcaattacaacgttgagaattaggtcctggttcccctttctgtttccactcacctgacctacagcagaagtcattccttctctctctacttgctggtgtgcttccatgttataggatgcttataggtacacagccagagatataaggagaaggtacaattacttctacaaaagtcctctaatctcagctatggaaatacaaagcttatacttattgagtctgctgattaatttggtgattgctcccttgaggctgtgatggtaatctagtgcctcctttccaaggtgctggggtaagctacagactggatcttgacatttgaaagcatctctctgtcctttacttcagctctgcagaggcttggccatgaaaagtttctacccattctaaactctacttagtataatgagattataggaagtaaattgggtggatttagaactatctagctggaaagaaaagtacccaggccaggcgtggtggctcacacctataatcccagcactttgggaggctgaggtgcggaggatcacttgagcccaggagtttttgagaccagcctgggcaatgcagtgatacctcatctctaaaaaaaaaaattacctgggtgtggtagagcatgcctgtagtcccagctactcagaagactgaggtgggaggatcacctgagcccagaggtcaaggctgcagtgagccatgatcatgccactgcacttcagcctgggcaacaaagcaagactctgtctcaaaaaaaaaaaaaaaaaaggaaagaaagaaaaagaaaaaagaaataaaaagaagtggaaagggccaggcgcggtggctcacgcttgtaatcccagcactttgggaggccgaggagggcagatcacgaggtcaggagattgagaccatcctggctaacatggtgaaaccctgtctctactaaaaatacaaaaaattatccgggtgtggtggcgggcgcctgtagtcccagctactcgggaggctgaggcaggagaatggcgtgaacctgggaggtggaggttgcagtgagccgagaccacgccactgcactccagcctgggcgacagagcaagactctgtctcaaaaaaaaaaaaaaaaaaaaaaagaaggggaaagaaaagtatctatattgctaagaagcatctttaccatctgtacagcttggctgttattcgctggctagtatcagcaagatcccttccactctcctggctggagaattctgagcccaggaacatctaaaatgtgctcaggaaggatggattgtgcatctactatgtggcagacaccgagctagatgccttataggttgttatagtattaggaaactgaggttcagagatgttgttacatgcctaaattcacagaggcagacagtgttagagtcaagacttgaaacatttcgagaactgcaggttgacgtcagctgatggcagcaccctgtcgtggggcatagttctagctctctgctttcctgggggtgacctggtctccaaaggccattagaaaatgcgttcttacatgtcagagtctgttagtatgtgaaggagtcattttgcttattttgtcctttgagagttaacctgtttggagactccatgagacagtagagtctgagggtgggtggctttgccctggaggcaacttgagactgtttatctggaaataagtaaacctgtttctatagcttgtagtagtgtggtctggtggggagagctaggatttggcatcaggtggactgggttctttttttgtttgtttgtttgtttgagatggagtcttgctcttgtcacccagactggagtgcaatggtgcaatctcagctcactgcaacctccacttcccaggttcaagcaattctcctgcctcagtctcctgtagctgggattacaggcaccggccaccacccccagctaattttttgtatttttagtagagacggggtttcaccatgttggccaagctggtcttgaactcctgacctcaggtgatccacccgtcttggcctcccaaagtgctgggattgcaggcgtgaaccaccgcacccagccatggcctggattctaattccaattttgccactctttttcgtgatcttgaatggttatctaatcttggtatacttctgtttcttctgtcaaagagatggaataatagccctagctactttccagggatgttgagagactaattgaaatagcatgtgaaaggactgtgagaagttacaacttctgtacaggagtattacctcagaatccatctaccttagataattttatggtttggatatttagagctttcctgtggttgattaataatttgccctggctacgtaaacagtgtttgaaaatgagttactgggcttccacagaccctatttttcttcacccctttctatagcctcttgttgagattataccttataaaatgctatgtgccaccaccaacaccccactacttcctgttttgttacaaggatgccatatatttgtatggctctttacagtttataaagagattttgtatatattagcttgtttaatagtcacagcatgatgaggtagttgttattagccgtattttatagaagaggaaacaggttaaaggtgtttaatggcttactttaggtcacatagccgagaatgtagctgaactaggtcccaaactcaggccagccagcgaaatatttgtctggcagcctttacatcagaccacagatctttgcatctgtctcttccttttcattcccttctctggacaaaaccaggcttttctgtactttcagccctgggtgtttttacatagctgtctcttttatgccctataacacttcaattattataattaccctaccacccacaaaacccaagctggaatgatagaacaatgcatgcccaggtgtggctgttgtctagacagctgctccctgccagggaaactgggagggaggagaaggggagctacctcttgctgcttcctcaaacataactagaaacctctttgccttttggttgttgttgccatggaaaggagagagacggtcgccaaagggcctagatatgatatgggaaaacagaaactctagtttcctcttttaactgtggggcccaaagccaatgaaaagaggtggaatggttaggtattggaactcctagctgtaacctgaagctcggtcggtgccttaatgtacttctcaaacaactgacaacaaaaagcagagcagcagggtttcaggggtggaggcggtggtgagaggcaacatgagtcctcaaaagtggtcacgttggttccatttgctccagcaagacctagagagcaaaagggaaaggattgctctgaggttgggcactgaacaacaactctaatcatgatgacaaaaggacatttgaaatactgtgcattcagcactcaaatgatttttaattcagtggtccagggtccttctggctcagggctggaaataaccagcaatagttcttggtggcatattagctggttaagatttagctaggcccacctaagaaggactaaatgatctaggatgtgtgacttgtggaagagaaaaagggatgttccttttctctcatttggcatcctaaccatttgcctcttttctttctccacactacccccatgccctatattcacacaacctgtggctctggaccaggtggagagatggaaccgccatgatcagaagctgctggaggcagtgcacaggggggatgtgggacgcgtggctgccctggcctccaggaaatctgcccgacccaccaagcttgactcgaatggccagtccccgtaagtcagtcctcctgcccctgccccttacatgtggctcccttttgaagcccccaaatccaatataacataggaccagggaatgcctacaacttcagagctcttttcattgtcttaattagcaagtatatcaatagttttttgctacatataagttctacacaaagtgaggaaagaaaatattgttcctgagctccatccattgcacaacccagattgacaccactgacttgtaaagtacataaagcccattaaacaaacagaaaatgaatatatacactaagtagagtgtttcttcattgcacaagtaggagggtgtgtatgcatgggaaatttgaaatgaagtggtagcatgggagtcacatggctagagggagtagtgattaagtcaaaggaaatgttatcccttgtctctacccaaagccttcgaatgtccagccttcactctgctctggctgactctttctgtgacacttccacttccgctaaggttctgtgctcagagaggcaggtaattatgtgttccctagacacccctgcaatagtctgagattccttgagacctgtagctcttatttcttccttgcttttagcatcctttgtgattggaggccatatagacttctctttctcagaaattcaagctaggggagcttcttttcctgcttttaggattggctttggggtagggagcatagcaagaagggcttatcaagattctcccattcctcatccctggtccctttatcctttggcctctcggccttgattctggcaggtttcatctggcagcctccaaaggcctgacagaatgtctgactatcctgcttgcaaatggggctgacatcaacagcaagaatgaggatggtgagtgagccggagcactgggccacgctgcttgcttgcccctggtacagcagcagtcgggggcggtgctgggccctgctggacattcctactgtggccccttgcttctctccttagtaagttctggccagcatccttccaggagttcccctccccgtaagctgggcacacctcacccccactcccaccttcatcacaggtaccaggcacttggggaacaggaatttctggccccgtgtggctgaaagcttctctccctaatctcctgattatctgtgcgtctcttgccttccctccctgtgagtcatcagcatgcatggggccacctaccctccttctccccttctttctgttccaggaagcactgccctacacttggccaccatctcctgccagccacagtgtgttaaggttctgcttcaggtaagagcagtcccttgataccactcttatgaagggaagaagtggtcccagagttttctaacttcatttcatacttaaaaggaatagttggccaaatgtactcgcctcatccccaataggagggctgataatcatttgtttgccaacatttatttaactactatgtgcaggcaccatgtttgatagtgcctttgagggcaggttataaagcagagttgccaggcactatcgattttgtcattagcagagccactgcagagacttcctgctatgatgaggggcaagaggaaggaggacagagatgttcaaattaaaccaaagccctactgtctgtttctgaagagtttatagtctagtagtataaagagaaatatacatgtaaaatgacatgtggatcatttataaatgagtctccaaaagcacaaaaggcagttactggccgggtgcggtggctcatgcctgtaatcccagactttgggagatggaggtgggcagatcacaagatcaggagatcgagaccatcctggctaacacagtgaaaccccatctctaataaaaatacaaaagattagctgggtgtggtggcacgtgcctgtagtcccagttactcgggaggctgaggcaggagaatcgcttcaacccaggaggcggaggttgcagtgatccaagatcgcaccactgcactccagtctgggaaacagagagagactctgtctcaaaaaaaaaaaaaaaaaatcagttatcttaaccggccatcaggcaaatggatgttctactttcgttcttcctaatcctttccaaatttcacaattatgtttctaaagtaccagccacggggacattgggtgtcattttccctaacacgtttattaccatctgatttttcttagccccttggtttagaaaccagggctgatattcaaggctgcctatcatcagcaatggatgaactgggcttgcctagtagatagccttctccaaagtggacctcctgcccctcctcatattaccatggaaattggtgacccaatgggggtatgggatgaggatgttaacaccaagctccatgctgcttccctttgtggccatttgcagcatggtgctaatgaagatgctgtggatgcagaaaaccgtagtccattgcactgggcaggtgtgtgcaggggactcatgggaacagggctgcagagactacagggtgggaaaggggaggcgtgaggagggaagggcagccagggccaaccaatgaaatggtcggaggggatgttgggtcatagtctgagtaggctttcttcatgcttccccttaacccaaacatcttctccccagcctcctctggctgtgcctcaagtgtgctcctgctgtgtgaccacgaagccttcctggacgtgttggataatgtgagtgtcagatgggcaagtgggcagtgtcctacacagaagggctgctgctctctctcagcttgactggccaacttccatgacctagggctgtgttagcaccacccttctcttccttctcctcctgcttctcctcttcttcctcacagagaggttaagccttatcttctggagagcttctaaccctccaaaagggagtgttcagacccaagatctgggcttttattttttttggacaggtgtgaggggaggggagccggtaggattgtcaagcctctgcagtccctggctgctcatgaacctcttcctacaatctgtgcaggatggacgtacacccctgatgatcgcatcgctgggtgggcacgcagctatctgctcacagctgctgcagcgaggcgcccgagttaatgttacagacaagaatgacaagtgagcccccctcgtctatgcaccccaattcccatgcctgaccaatttagaaagaagccagtgggcaacgtgtgtgtgtgtgtgtttgtgtgtgttggggaagaagtcaggttggtctttgtgttcttgggaacctcattccttcccagtggaggttctgaagagctctgcctgctgccaccaccatcttcatagatagatgaccccagaagtagaatcgacacttctggacccgttggctgaatttactggttgtcaaattatcttttatgcaagaggatccttttttccaataaaaaatgtatgtagaatccctgtgatcccagcactttgggaggccaaggcgggtggatcacgaggtcaagagattgagaccatcctagctaaaatggtgaaaccccatctctactaaaaatacaaaaaattggtcgggcatggtggtgggtgcctgtagtcccagctactcgggaggctgaggcaggagaatggcatgaatccgggaggtggaggttgcagtgagccgagattgcaccactgcactccagcctgggcgagagaggagcgagactccgtctcaaaaaaaaaagtatgtagaaccttgatatacagagcagataaaaatggagctcatccagttggccccctaatttctgttcctgcagctctaaggaatggcatttgaaaagcctagtcctggcctggtgcagtggctcacacctgtaatcccagcactttgggaggctgtggagggtggatcacctgaggtcaggagttcaagaccagcctgaccaacatggagaaaccctgtctctactaaaaatacaaaattagccgggtgtggtggtgcatgcctgtaatcccagctactcgggaggttgaggcaggagaatcgcatgaacctgggaggcagaggttgcagtgagccgagatcatgccattgcactccagcctgggcaacaagagtgaaactccgtctcaaaaaaaaaaaaagagaagtctagtctggtctaatgttggtctgttgttctcctgaccccactgaatgagagcttaccctgtgagtggaatgtctggaaccaggacttctgggttccatgtggaaagtctgtgctcagatttgtctcaacccacagatcggctttgatcctggcctgtgagaaaggcagtgccgaggtggctgaactgctcctgagccacggagctgacgcgggggctgtggacagcacagggcatgatgctctgcactatgctctgcacacacaagacaaggcactgtggaggcacctacagcaggccctgagccggcggcggcggggcggtaaaggcccttgtgtaacttccacgttctctaagaatcagagaagtttcttagagtcccatttgtttccatggaagtaatctatctgacaaataattgtcacctgggttgagagtttacgtatttattgctgctactgtgagaggaccccaaatccccatcccaaaagtatgatcacaaaattctttaatgcagcctggtctctcactgaggacagctctggctagtgttgtttctggcgtttgtgagttgtaattgtacatctatttgtgtgatttgttggtcactctctctttcctctaccagattgtaacccccttaggtgacaggccatttctgttttgctcaccattgaagttccagtgcttattaaagtgctggacatagtgaccaataaataaatgagcgaacaaaatgaatgaagtggcccatttctgggataggaaaccaaagttgctggatagttagggatccactaaacaagattggcttctggcaccaggaagatgtgcagtgagattgatcacagagaggccactcctctcagaaaaagtctgaagataagaatgtgggctggaagtacatggaacctgtcttctctctcattttcctcatatcttttcttataggtcagaggctagtccagcacccagatctcgcatcccaggtaagaccctaagtgcctcccccttttgcttttgacacaccccaggctatcccactgtgactattcctagtggtccttggggtgtcaagacatttaagagaagaaaggcactcctagggctcagttcgttgcctagtggccacactttactattctgtttccaacataggcctctccatctgagccccaggcaggttctcctcctaagagctcatggagagcagagcctgaagaggagcaagaggagaaggaggatgaagacccgtgctcggaggagtggaggtggaagtatgaagaggagcggaggaaagttgttcggctggagcaggagctggtgcaaaagacagaagagtgtaagactcaagctgcagcctatctggaccttgagaaccagattcgagagcaggcgcaggagctaggggtcctcctatcctgggagcccagagcttcaggaaagcaaggctctagtctccggcctggaggggatggcatggagcagggttgtcctaaggacctgctggctgagagtacacaagagctaaagaagcagcagcaggcagcagccacagtaaatccagtattagctccaaagaaggctgaggactcagccccaggaaagatccagtatgaagtccatggaaggtcccaaccagaagaacaggggccaccccagagcccagcgtctgagaccatcaggaaagccacaggacagcaactgactaccaatggggcacagacctttggccctgatcatgctgaccagctgcctgctggtcagaaggagagttcccaggttctaggagttgaaccaggaggcacagtggctgaaccagtgggcccagcagccatgaaccagcttctgcttcaactaagggaggagcttgctgcagtgtggcgagaaaaggatgctgcccggggggctttgtcaagaccggtcatggagggagccctggggactccccgtgctgaggcagcagcagctgcctgggagaagatggaagcccgactggagcgggtgctggcaaggctggaatgggcaaaggcaggactacaggtgaaacctgaggttccttcccaggagtccagagagggagccctaaaggcagccccagggagcatcaaacaggatgaagagaaggagaaaagggttcctggggctcgaggagagcctctaggggcccttggaggggaaaaggccctaggaggcctggcaaagggacagctggagaaggagatgtcagtactgagactgagcaacagtaacttgctggaggagttaggggagttggggcgggagcggcagaggttgcagagggagctacagtccctgagccagcggctgcagcgggagtttgtgcccaagccagaggcgcaggtccagctacagcagttgcgacagagtgtggggctgctgacaaatgaactggccatggagaaggaggccacagagaagctgcggaagctcctggcctcccagagcagcggtctccgagggctgtgggactgcctgcccgcagacctagtgggcgagaggagtgcacaaagcaaagcagcggagtccctggaggagctgcgggcctgcatcagcaccctggtggatcggcaccgggaggcccagcaggtgctggctcggctgcaagaagaaaaccagcagttgcgggggtccttgtccccgtgtagggagccaggcacctccttaaaggccccagcatccccccaagtggccgctctggagcaagacctggggaagctggaggaagagctgcgggcagttcaggccacgatgagcgggaagagccaggagatcggaaagctgaagcagctgctctaccaagccacagaggaagtggctgagctaagggcccgggaggcagccagcctacggcaacacgagaaaactcggggttcgctggtggcccaggctcaggcttggggccaggagctaaaggctctgttggaaaagtataatacggcctgccgggaagtgggtcggctgcgggaggcggtggccgaggagcgccgccggagcggggacctggccgctcaggcagccgaacaagagcgccaggccagcgagatgcgggggcgctccgagcagtttgagaaaacggcagagctgctgaaagagaagatggagcatctcattggggcttgccgagacaaggaagccaaggtgagcagctgaggtagccctggggagcactggggaaagtttctgtgtatttgggagtttactaacctgaatccagcaacctttattgcagcagtgggtcagattaataccccaaacggagcaccagtcctttgcagggaccacactactatgttctcgtgggtctgagggggttggtgagattggaggtgaggtaaggtataagtggaagagagaagggggcttaggtactaaaatttggcacccagattcagaagcagtgtgctcagggctgccaccagtgcagcaccatcgtttattagcatttggacttgaattgcatattagcctgggaagaggcctaatagcatgatgggttgctgtggttttactgaagttctgaggaggtcactcaagaactaatgagttaagaaaagtagacccagcgagagctgctcttctcgcctccacttcagggtgggttctacaaaacgatgtccattggcaaagagggcaccaatgcaaagaaaaaaatcttgaggccgggcgcggtggctcacgcctgtaatcccagcactttgggatgccgaggcgggtggatcacctgaggtcaggggtttgagaccagcctgaccaacatggtgaaacccggtctccactaaaaatacaaaaattagctgggcgtggtgcgggcacctgtaatcccagctactcaggaggctgaggcaggagaatcgcctgaaccagagaggcagaggtagcagtgagccaagattgcaccattgcactccagcctgggtgacacagcaagactctgtctcaaaaaaaaaaaaaaaaaaaaaaaaaaaagaaaaaagaaaagaaagaaagaaagaaagaaaaaaagcttgaaaaccactattagataccagagtttcctaatgcttgctctaaatgtgagtctacatgtttctatgagacatgttttatgaactctaaatatcaatttacacatggatttagtacttccagacttaaccgtgaaatgaatgatttcagacttcttattaaaacttggatacatggtcaaatttagaatgattaaaaaatataaaaaggccgggcatggtggcaaaaattagatgggtgtggtggcatgtgcctgtaatcccagctcccaagaggctgaggcaggagaatcactggaacctgggaggtggaggttgcagtgagccaagatcgcaccactgcactccagtctgggcaacagagcgagactcctccttctcctcaaaaaacgttatatatatatatataaaagaatgtatgttttctatagtgtggagtacataaaaatagaaggaatgttatccagaataggaatcagtgcgggttgaggttaattaaagaaagtatttttatgttgcattgaaggagaagttgaaagtagacaatcgggtgaaagcaaacatagtgtcatggttaagaatgtgttctctggaccaagattgtctgatcttgggcaagttatttaacatctctagtcctcagttttcttatctataaaatgaggataataaaatggttgtgaagattgcattaaataagaaattatatttatttaaaagatttggggctgggtgcggtggctcatgcctgtaatcccagcactttgggaggctgaggcaggcagatcacgaggtcaggagatcgagaccatcctggctaacacggtgaaaccccgtctccactaaaaatacaaaaaaattatccgggcgtggtggtgggcgcctgtactcccagctactcggagaggctgaggcaggagaatggtgtgagcccgggacgtggagcttgcagtgagctgagatcgcgccactgcactccagcctgggcgacagagccagattctgcctcaaaaaaaaaaaaaaaaaaaaatttggaactcttggcccatggtaagtactcagtaaaaggtagctatcattattcctactaccactattcctattactgctagttaccattaactgcatttgtgcctctgcctcaataagccataaggactcatctccatttcccttagtggtcagtagccaggagtaggttaggatctgataccaagttaagagcatcggccaaggagtcaaagagattgtggttcaaatcatgatttcatcacttattagctgtgtgattttgacaaattacttaatttagtctctttatctacaaaacgtagattataatacttccctcaggcggagcacagtggcttatgcctgtaatcccagcactttgggaggccaaggtggatggatcgcctgagcccacgagtttgagaccagcctggacaacatggcaaaaccccaactctacaaaaaaatacaaaaattagctgagtatggtggcatgtgcctgttcctgtgctactcaggaggctgaggttggcttgagcccaggatttagaggttgcagtgagctgagatcacatcactgcactccagcctgggtggcaggtgagaccctgcctccaaacacaaaacaggctgggcgcagtggctcacacctgtaatcccagcactttaggaggctgaggtgggcggatcacctgaggtcaggagttcgagaccagcctggccaacgtagtgaaaccccgcctctactaaaaatacaaaaattatctgagtgtggtggcgcatgcctgtaatcccagcttcttgggaggctgaggcaggagaatcacttgaacctggaggcggatgttgcagtgagcagatggtgtcactgcactctagcctgggtgacagagcaagactcagtctaaaaaacaaacaaacaaaaaaaaacaaaaaaacaaacttccttcagagaagtattgttcctcccggaagaaaagctgttttttttttaaatttttttaagttttcaatgttttatcatattggatagcagctttttttttaattggttacaaaacctaagcccatatacaaaattaggaacacatttagatgcctcttttgaaagaacattttagtctttttaaactgagttttaaaaaaataaaaacaatgcaatttttaaacactgttttgaaaacttaaaagtgcagcaatatagttagtttcctttatctacgaaatggggcaattccaattcagaactggtaaggtcacaaattgaatcaaggaaatgcatacaaatgtctgcactacttgatgctaatgttcacttaaatgttagtttgcactttaaaacatgagaggaaataggaatcatcacagtagaggcccacttttaatcataatgtgtgcaaattttaaaaggtaactgacaagtaaggaaagtccagaagaaactaaactggaaggggtatagttcacaatatcaaaaagatttggacttttaagggtttcaccgaagtttgtgaccttaattagcttttacgttgttattcctacttttagtgaacaccacacagaagaaaagctgttttgagtgttaaatgagacaatttgtataaaattggcacatattaaatactcagtaaaaggaagctgaccttgacccttgtgggagaaatgacttggagcctcattggttgcctctttcctcttggcctcagatcaaggagttgttgaagaagctggagcagctttcagaagaggttctagcaattcggggagaaaatgctcgccttgccctgcagctgcaggtatgttttggctgtcagggatggtgctggagaagaaggtcagcagtggaagtgatgtatatgtgggagacattctaggaattactgagggagacattctaggaattacagaggcctggctaggcagtggtccaggatgggccagtgatgggccaacgagcccacctggtactgctgaccacttcattgtgttgctcctcatgcttgggtgactgagggtggacatgtgacttcccattgatgttcattcccaggattcccagaagaaccatgaagagatcatctccacctacaggaatcatctactgaatgctgctcgggtgagcatggtggagttttgagggaggtatagacataaagctgagtatagggtattgcatttagggtccctctctcttctccagggtccctgtacacacttgctgtttctcggaaagctggatccagtgctaggtctctgatctcatttggtagatcaagagaggttgtgcatgaatgtgagaaggagaggtgtttccccctctgtttcaattctctggcctatagtaaggacttttcctgtccccaataccctttctcagtctcctcctggagccacttagtcctaaacaaggaagaagaggtaggtgtcttgctcccttgttaggaataataactacaaagaatggaacgaacacctattgtgtacctggtgctttgcttcatattcatggttgtaatcctcagagcaatcctgaaaagtagacatcattatcttccctgtgaagatagggaaaaagccatggagaagttaaatactataagtgaaggtatatagtaaataaatagccttccactgtaccacagaacctctccctcacctctctctctccattttctgttcttcatctccttttcttcctttcctgacatctacagggttacatggaacatgaagtgtacaatatcctgctgcaaatccttagcatggaagaggagtgaggcagcctcactgtgtgccctcagggatacgagattctctgttgtgagttgtgggttaagggtgatgagggaaggagtttgggagaaagggcttgggaaaggtgtatggaatgaaattagtcccttttgcccccgtggtggctgacaatggggagccttttggggcatagagcatttgaggtgactgagaagacagaacatggagaatcactgggtggagtcaggaatcagtgagcaggtggactaagggggctgacttatgagatggagactgaaaagaggggttgggtctggggtagggagatgccagtgaaagatgagtgatggtaggatagtggtagacagttgttccttagggcaggactctacaaaatccagaatctcttcactttgataccattcattcaaagagcagtcatcccccaaacctccccccaccccaatgcagatagtccccttctccagtccagatagatgagggtcccttttagcatgttgatatgagtgggaggagactgaggatatggaagtgggtgcatttcatctttgaatttcttctttcagggaataagaaaccctggttgacagaggcttcatcaggctgtggtgggcgggggtgttggccactaggcaatggtatgggcagggcttcacctgacattatggacctcagacctgagaacctggaccctggaatcagcatggatgagaccagaggaggtatggatggaaacaagctctatggaaaataaagcatgaggcaggacggg

SEQ ID NO: 1522 - DNA, 7569 bp, Homo sapiens
tgctagggagtaggggtcgtctgataaggggaagctgtgacgcagacacgcacagtaatacacagatggaggctcaaaagacacgagtttcgcgtcctgaaattccgcttccagggccaagctttcttttctgatactgtttgtccctcgcgaggcaccgttgggtcgcgcagtaggcgtgactaggggcgggaagtggggcgggagcagggccgcggagcctgggctgcggctgtcatggacgcctgggtccgcttcagtgctcagagccaagcccgggagcggctgtgtaggtgcggcccgaataggaatgggggtggggcgggggagggatggacagaggaagactctagtgaggcgaagtcagtttaggctacaggggggtcaagaagggtcaactccggctacgggggcccgaacggaccgtgaggcgcagatttgagccgctgttgagatgattcctttccgttcgcggaagagatggggaaactgaggcatgagtgggccagcggggaggccgctcagggttgctgtgtccacataagaccgacagtgtcctcactgggcggtgatggaatgaggagcattcgccccacggtggatagccccagactctgcccccagagctgaggaggcactcccagtttccgtgtccccacaccgtgctgccattcgggaactcccctgcctccgccctggcgtttggtctccattcagctagagggccttgaaatctctcagttcacctattctgaggaataaaatgccctccaactgtctgcctccccctcatcgatcacgtacatgctcacgctgatgtgcttgtgatggacccctgcggcctgcactggccccttcaggcctcatcattgtcaaatctctaatttgctcaacattcagtagtgctccccacccctttctagactcttttttctccttatgcctttcccttcctctggcctggagaaatggtgagatatgggcatggaggaggaaggggagtgttctcaaactgggaaagggggaagtctgtctgtgccttttggaagatagttttgagcggaaggttagggaggtctccaccttaccttgcctgccctctcctctagggccgcccagtatgcttgctctcttcttggccatgcgctgcagaggcatggagccagtcctgagttacagaaacagattcgacaactggagagccacctgagccttggaagaaagcgtaagtaactctgtctttccttttatcccccaacctttcctccatccccagctcaccttcctttgtccctccttcctgtaccctctctgttcttctttctcatttggctctgcacttaccctctgcatgagtccagttgagataagagagcaggggtatggaagtaattaggcggactggagagaatgggtcaagtttgagaaaactaaactggcacaaaaattaaatttgaaattgaaaaatggactgtttctgctctttattttttatttttttgagacagagtctctcgtccaggtcagagtgcagtggcgcaatcttggctcactgcaacctctgcctcccaggttcaagcaattctcctgtctcagcctcctgagcagctgggactacaggtgcccaccaccatgccgggctaatttttgtatttttagtagagatggggttacaccatgttggccaggctggtctcaaactcgtgacctcaggtgatccacccacctcggcctcccaaaatgttgggattacaggcttgagccaccatgcccagcctgtttctgctctttaaaaaaattgtcattattattgctcaacttttgccctcttgctttctctgtttctgtttcttgttatctgcctctccacttacaaatccttgctttccctttctaatctccacaagttctacgcctgggtaactcagcagatgcccttgagtcagccaaaagagctgttcacctatcagatgttgtcctgagattctgcatcactgttagtcacctcaatcgagccttgtacttcgcctgtgacaatgtcctgtgggctggaaagtctggactggctccccgtgtggatcaggagaagtgggcccagcgttcattcaggtttgatatcctgttctcctttaagatttttttttgtagcctctatattgcatagcttgtcttatatgagggaaagatatcttaggatctttccagagtatataagtcttgatcagtcacttggcttccaatcacttagatcttaaactatcggagaatatcaaatggggagagatggaagacagatgctcttccataatgaatgactaatattgtgcaaggtaagatattatatcactttaattgtgcttctataccacaggttattccccctcactacctgcttactcattcattccaaagatatttattagatgcttactgtggcgcaggggataaagcaaagagctaaacagataatgtgcctgctcccatgaagcttctagtttagtgagggagttagatactacaatgaataacttctcatatatatttgtggaaaagtatgcggtattatgaaagaatatcacaaggggagctaatttagattggaaaatcaggaaaaaactctttgagaaagtaatattttagctcagacctgatgtctgagtaggaggagttagacaaagccaacagtagcagaaaagacatttccaaacagagaaaattgcacattctaagtaaggctttgaactaagaaagacttaagggaattagagaaatagaaagaaagccagtgtgattgacagtattgagtccatcagttcaaatttgagagatagacaggcaccagatctttcatacagggccttttaggcaatgttaatgtttgttttattttatcctacaatgggacattattgaaggattctgagcagggaaatgacatgattcaaattgtgtttaaaggacatctctttttgagatgttgaaaatggattgcaggccgggcgcagtggctcacgcctgtaatcccagcactttgggaggccgaggttggggggatcacgaggtcaggacttcaagaccagcctggccaacgtggcaaaaccccgtctctactaaaattacaaaaattagccaggtgtggtggcgggcacctgtaatcccagctactcgggaggctgaggcaggagactcgcttgaacccgggaggcaaaggttgcagtgagccgagatcgtgctattgcactccagcctaggtgacaagagcaagactccatctcaaaaaaaaaaaaaaaagaaaagaaaagaaaagaaaatggattgcagtgggtcaagagaggaggagatgccctaatacgagcaagagatgacgttggcttggacaaaggaggtagctgacaataaaggtagagagaaatatgatgtgggagtaaaattctctaacatattatctgtattgtttttcgttttcctatgattgtactttttcattatattaaccttgcttttcccttcatctttctcagtgatttacaactttaacatggcttatgatgtatgaggggtgggagcagaggcatggctggagcagtatggaaaagcaactccctaaaggagtctatatgttatatttattcatttcatccaacagatacttactgagctcttactatatggtaggcaccagtgtacatacagggatacagtggttaaagataaacaaggccggccaggtgcggtggctcatgcctgtaatcccagcactttgggaggccaaggcgggcggatcacctgaggtcaggagttttgagaccagcctgaccggcatggagaaaccccgtctctactaaaaatacaaaattagccgggtgtggtggcgcatgcctgtaatcccagctactcgggaggttgaggcaggagaatcgcttgaacccgggaggcagagtttgtggtgagccgagatcgtgccattgtactctagcctgggcaacaacagtgaaataccgtctcaaaaaaaaagaaaagacaaacaaggcctctgctcctctggaacttaccttgtaatgggatgagataaacataaataaacaataaattaaaatatcagatactggtaaatgttatgcaggaaattaaaacagtgttatggagtagagagtaactgactcagtgctttagatttagggataagggaaggcgtctccgaagaggtgatacttaagctcatacctgaagagcaagaaagagctagctatgtgagggttttggagggagaatattccaggtggagggagaatattccaggtagagggaataggtagtgcaaaggtcctaaggcaagaacaagcttgatgggattaaaatgtagaaggaaaccaacatggttggagcataatgattgcaggaaagaatgatacaaggtaaagttagaggggtagggaccagatgttgagtctgtaagcctctctaaggtatttatattttattatgaatgtgacaggaagaaaaccatggagagctgtggtttgtttatttgtttttggttttttttttttttgagatggagtcttgctctgtcgcccaggctggagcgcaatggtgcaatctcagctcactgcaacgtccatctcttgggttcaagtgattctgctgcctcagcctcctgagtagctgggattacaggcacgcgccaccacacccagctaatttttgtatttttagtagagacagggtttcaccacgttggtcaggctagtctccaactcctgacctcatgatccacttgcctccacctcccgaagtgctgggattataggcgtgagccaccacgcctggccaaccatggagagttttaagaagggaagtaatgatgtgatttatgtttatgctagctattatatgaaaatagattgttgggggtgggggcaacaatggccacagtgagaccagttaaaacattaaagcagaagtccagacaagagatgttagtggcttagagtatggcagtgcggtgtgatagagagatgtggttggttgggttcaggatatactttgaaggtagtacaagttattgagtacagaccaccattgtcagattggattacaaataaaaaacatggattttttactgaagaaatttataatttaacacatttggcaattacttaaacctctgggcctctaaaggaatagggattggatttagatcacctttaatatgtttgagtctctgagacatctgaaatttgttctttcaaaacaagtttgccttgttataggtcaagttgagagagagatggagagtgtgtgtgtgtgtgtgtgtgtgtgtgtgtgtgttgccaagtggaaaatgaaatttgagattgaccttggaagatttcatgatgctcatggagtttaaaccaggatcttaaggtgcacataaacatgtattagttacagaatgttgggaggactttgtttcttcatttttattgggacataattgacaaatagaaattacatatatttaaggagttatagctcgatgtttgtacatgtacgttgtgacatgatcaccacagtcaagctaattaacatatccatcacctcacataattaccttttttcttttatggtaagaacacttaagatctaccttcctggcagatttcaaatatacaatacagtattgttaactatagtcacaatgtagtacattagatctccagaacttactcatcttgcataactgaaacttatacgctttgaccagtatcttcccatttccctcactccccaacccctggcaacccccattctattctgtgcccctatgagttagccttttttttttttttttgagacagagtcttgctttgttgcccaggccggagtgcagtggtgagatctctgcaacctctgcttcctgggttcaagcaattctcatgcctcagcctcccaagtagctgggattacaggtgctggccaccacaactggccaatttttgtatttttagtagggacggggtttcaccatgttggccaggctggtcttaaactcctgacctcaggtgatccacctgccttggcctcccaaagtgctgggattacaggcatgagccaccacgcccggccttattttagcttccacctataagtgagattatgcagtatttgtctttctgtgtctggcttattttgcttagcatagtgtcctcgatggaggacatttctaataggggtaatagcattcactttacttctgatctaatgtgtaatctctttgctacaggaaaagaaaatgttaaaatgtgatgttggatatgttaagtaggtatacatgcccttactgacccttttgctctgtgtatcaggtactatttgttttccctcatcatgaatttgagccgtgatgcttatgagattcgcctactgatggagcaagagtcttctgcttgtagccggcgactgaaaggttctggaggaggagtcccaggaggaagtgaaactgggggacttgggggaccagggactccaggaggaggtctgccccaactggctctgaaacttcggctgcaagtcctgctcctggctcgagtccttagaggtcatcccccacttctgctagacgtggtcagaaatgcctgtgatctcttcattcctctggacaaactaggcctctggcgctgtggccctgggattgtggggctttgtggcctcgtgtcctccatcctgtctattctcaccctaatctatccctggctacgactcaagccctgaccttccggtacaggataaggaggggacctgaattggtgagatggaatcttagatcgtcccccatgtgccagcctcattcgaattctactctttggttaaagttagaaattcagagatttaggggtggaggaagagctttggggaagatgaggtaaggaaagatgactcgtgaagttaataggatgtctctaatttctagatgtgcctgagcttctgttcttttcctctttctttgtgtctctcttgaatatatttactttgtgtctcttaactctgtttaaggttctgtgtctatgcatctctctctttcttttttcaaccttctcattctcctatccagggatttaatcagcagaattactttttgataggggaggtataaggtttggcctgtaaggttctaactgccttcttttttctcacagaggtggcttatggcagatttttcctccttcaaactccaaacataatttttaagactatgtgccagtggactcttcccttatatctctgcaccacaagttgttggatgtttcctcttcctcccttatgtctacctcaccaacctcgctcatcatttggcccttatccttccttgtacacctaccttcagatttctgcttacactttgatttcagagctttattccccagtctgttcttactcctttgtcgcttatccagaatgatgctatgtgtagcatcttgctgtaaatcctgtacaatgattctgtgtaaatagctgtggcctatgccaataatgaagagcaagcctttcaggtaagcaaattaaagttcagtttgctcatcgaca

SEQ ID NO: 1523 - DNA, 6258 bp, Homo sapiens
actaaagacttactattctgttcctacatactctgttaggatcagatagatgttatagaaatgccttttgtttctcctgcccttcttgatgtcacagttttttgtacttccagctgtctaaaggcatgaatctcctcttggagcattctcccagacccttctttagaagagtctatactaagttcttggtgccctcttcggcagccaagggtgaaggccccatagaggagaggatccaaaggagcattgaggaggcccaagaggaaaaggatgtggctcaggctgggagggacttcagttagcatggtgggggagaaccagtaccacatacccagtaggtaataaggtgtccagcagaggatgaaggtcagcaagataagcagggccagtctcagggcccggagacgaacacggggacaattgtcaaaggagcgggggagggcaaattcaccagcaggggctaggaatttagaaaatatactgtaattcagacactcagcttctgatctgagtatagggtgaattgatggaggggcatagctagtgagacagagctcacctcctacaaggaggagaatgttgcaaaccgttttccccttcccaacctgggactatatgatttcttacccccagggattatgatagaaatatgaagccaccaagtctagacttgatggtgttcaagaataaataatactgattgcctccctagtccttgtccagctaactcagctgtttataattgaagggattcaacaaaattatctctagcatcaggtgctagacatggttagaatctcaccatggtttagtgactggtagatagctattaggtaggtagataaataaatgatgctagaggcaacaggtctagggttaaggattaaggcctgggaattggagtctcaccatggctccccttccttgtctggggcctggacacactgaggacaatgcggctatagcagatggccatggcagtcagtggcagcagaaagaggcagcagaaggtgaagaggttataggtggtctcttgccattgagccttgaagctgcctttggtgacacactgagtgaaagggactgggccagctcagtggaccgtgtggaacaggaacagctggagtggagttgaggactattagaactggttcccctcaccacccaacctacccacctatgtcatactgtctcctcccaattcatccttaattccaagtgaagcagcacagtgctgagaaacagttcatccatggtgccatgttaaagaagttggaaatatatcttgaaaatcctatcttccttttaggcttgaatatgatgctgaacagtaagtttgttaaatcttggaacttaaaacaatcctgctttctcaagtactattctaacattgcgctttataagggatgatatttctaccacctcactcatatttttagctgaaatgattttcctggtatgtctgttattttgtggaaaaagaaatattgtgtaaaatgggtgctgccaaaattccaggccattttgcagggactctgaagtgacctttagtagtaatagtcttatgtgcagtaactataatggtaaagaatgttaaataataaaatttaacattttccaaatgctattgggctgcccctccccctttttgttaaattgctgggttttccaactgaatcagtaaaaactatttctgtttagagctacaaggttaaagtgcctgctttccagtaatggagattgagtcactattaatttgataaaaggtaagctcagtaggcatcagattcctagatacaaggcatttgggaaagtgattttagcagacatgagggacatttaggaaagatgaatagtttcagcctaagagaattttgtgaactgtttggagttacgatcaggctactctgagctagttgggaaatggtctttcctcttcccatctcttgcattcatatatttctaagttttttttttttttttgtttttgtgctctgcctaagaagtgcttgagaattgtgaggagtataaaaatagtcaaagctggctgggcgcggtggctcacgcctgtaatcccagcactttgggaggctgaggcgggcggatcacgaggttaggagatggagaccatcctggctaacacagtgaaaccctgtctgtactaaagatacaaaaaactagccgggcgtggtggtaggtgcctgtagtcccagctacttgggaactcgggaggctgaggcaggagaatgacctgaacccaggaggcggagcttgcagtgagcagagattgcgccattgcactccagcctgggcgacagagtaagactgtctccaaaaaaaaaaaaaataataatcaaagctcttggatttatagtttggtccacagccttgttttgatctttcctttatcctgttttattgccatttaccacgtactgtagaaacatccctttcaactgctgataacttggaaacaagcctacaaaaataagtaatttctaactactcctaatactacctataactacccctaagcccttaccactctaacgtgacattattaaattttttattttattaacactaatattttaactacaattacagcatatgggcaatacagaatttacctaaaaggatactaatttggaacaaaaaaaatcacctttcgcacatgtatcatgtcacaaccagtttgccattgaaacaaatagaggttgcaaatattgtcagattgtcaggctgtaagaaaggatgaaattcatttcccattgcatcatcttgtggcccatggatttcaagtgccttagccaaaatcatatagctagttagcagtagagccgagactcagaaaaaaacaaagtaaaacaggcagactgaaacaaaaagtcttctaattcccagtccacatgtaaaatttgcttcatataaacaaacctaattgtaaatggcactgtagcaacaggcttctttttaacacttggattggtaaaggtcttgtttgcaacatattagaagtattatttttctctttcccccccaccccacccccaacagagtctggctctgccgcccacgccggagtgcagtggtgcagtcttggctcactgcagcctccacttcccaggttcaagcaattctcgtgcctcagcctcctgagtagttgggattacaggtgctcaccactatacccggctaatttttgtatttttagtagagatggggtttcgtcatgttggccaggttggtcttaaactcctgacctcaagtgatccacccaccttggccttccaaaatgctgggattacaggcttgagccaccaggcctttctttgttcttaggagtatagtcagactaacttctagtagttatatttctaataattgaggatgtaagtaaggatcaaatcttaaatcagtataatgcattgtcattccagagataaatcctagacccttcttggcctccttctgacataattctaatcctacagtctcagagatgctgttgtatcctgccccccaaccccatgatagtgatagtggtttttgccttgaaggaattgctttgtatttagcttttccccctctagatttctagttccttttcagtattggattggatttgagatttgattaacctagtactcaggttcagatgctcgcctctttgcaattttaacactcattcgacaataaagtcagtaaaaaacacaaatttggttatgtcactctctttttactttagtgtctctccactgcactcagaataaagtacaattttattatttgtgatctggcttgctcttcccctctcagttcattactcaccattttctagtcctcagctttagtagcattgagatcctctatcctccatcctccctagcatttctcctattttaattggtctaacacctatctctgaagaatcaaattttaacatctggaaagcttttcctgactgcacggctgtgtcagacacccctatccactccccacccccattgtcttctttagctcctttagcataacacttttgaatacactatattgtaattgcctaatttctttgtttcttgcagtagtctatacatttcttgaaggcaggattttgctgccctgtccttagcaaaatttgagtggcgctggagatgcatattactttttgaatggataaatgaaatgtaccacaaagttttacccaaaccactgacttcactctcttaatagatccccatgtatgtttttcttccctgccccaatctgaaggaggtgaaattgggaggatgcaaagaggtagaaaccacgtgtaataaaacagatgtaatggaagaggcacagatagaggatactgtttttacaaggcaggctcttttattattattattattatactttaagttttagggtacatgtgcacaatgtgcaggttagttacatatgtatacctgtgccgtgctggtgtgctgcacccattaactcgtcatttagcattaggtatatctcctaatgctatccctcccccctccccccaccccccaacagtccccagagtgtgatgttccccttcctgtgtccatgtgttctcattgttcaattcccatctatgagtgagaacatgcggtgtttggttttttgtccttgcaatagtttactgagaatgatgatttccaatttcatccatgtccctacaaaggacatgaactcatcattttttacggctgcatagtattccatggtgtatatgtgccacattttcttaatccagtctatcattattagacatttgggttggttccaagtctttgctgttgtgaatagtgccgcaataaacatgtgtgcatgtgtctttatagcagcatgatttatagtcctttgggtatatacccagtaatgggatggctgggtcaaatggtatttctagttctagatccctgaggaatcgaaaaggcaggctcttaacagatgtaaattaacatacaaataatcttacagaagagagagcagaggtagcagggtgcggtggctcacgcctgtaatctcagcactttgggaggctgagacaggtggatcatgaggtcaagagatggagaccacctggccaacatggtgaaacctcgcctctactaaaaatacaaaaattagccgggcatggtagcgggcgcctgtagcttctcgggaggctgagggaggagaattgcttgaacccgggaggcggaggttgcagtgagccggcaaaaaaaaaaaaaagcaagcagaggcttactccctgagaattaatggctaatggcccccaagcgcaccctttaactcatgctatggacccaaatccctgtcctgcccggtcctgagtcctaggtcactcacctgggggaaggcaagcaggaaactaagtccccaggctgcccccagaagtttccttacacctgaacgggatccaagcgggttgagtactgctgcctggcggtccaatccaatgaccacaggcaggaaagctgcagaatacgtggccattagtttcaggaacatcagtgtccgacatgcgatgtccacagccagccattgaacagtgatattccaggtggcatctaggggcataaccacaaaagtgactagtaagtcggcggctgctaaatggatgaagagtctcctgaccggagaggggcggagctggctgggttcccgccgtgtcactgaccacaggactgccaggttccctccagccgaagaaacaaacagcacaatggtcactcccactcggaccttggctgctgccgagaaggtgggcagctctgagccctccacctccactcctgatccagcccagacctcctcccccgctgctgaccccaaggggtgccgttgcctgcagacatggtggcctggagagaaactgaggaggatgaagtgtgggtatgaagcggttagctttggccactgattcttcgccctccttttcaggatctggagctgattattgcgaatttcgttcactaaagcctctgcttctggagactctccatctgttctggaggaggtcacttgttcaactgtcaaggttctgcagggaacgaagatctggtaccaatcacgctcctttttccttggacagaccagcctgggcttcaggcctctactgacctagacctctttagcccctacagccctggattcagtcggggcctgcgtgcatgtgtatttgtgaggttctgccaggcgcacacctatgccggcggcctccaagacgtggagatc

SEQ ID NO: 1524 - DNA, 7174 bp, Homo sapiens
caactccggctacgggggcccgaacggaccgtgaggcgcagatttgagccgctgttgagatgattcctttccgttcgcggaagagatggggaaactgaggcatgagtgggccagcggggaggccgctcagggttgctgtgtccacataagaccgacagtgtcctcactgggcggtgatggaatgaggagcattcgccccacggtggatagccccagactctgcccccagagctgaggaggcactcccagtttccgtgtccccacaccgtgctgccattcgggaactcccctgcctccgccctggcgtttggtctccattcagctagagggccttgaaatctctcagttcacctattctgaggaataaaatgccctccaactgtctgcctccccctcatcgatcacgtacatgctcacgctgatgtgcttgtgatggacccctgcggcctgcactggccccttcaggcctcatcattgtcaaatctctaatttgctcaacattcagtagtgctccccacccctttctagactcttttttctccttatgcctttcccttcctctggcctggagaaatggtgagatatgggcatggaggaggaaggggagtgttctcaaactgggaaagggggaagtctgtctgtgccttttggaagatagttttgagcggaaggttagggaggtctccaccttaccttgcctgccctctcctctagggccgcccagtatgcttgctctcttcttggccatgcgctgcagaggcatggagccagtcctgagttacagaaacagattcgacaactggagagccacctgagccttggaagaaagcgtaagtaactctgtctttccttttatcccccaacctttcctccatccccagctcaccttcctttgtccctccttcctgtaccctctctgttcttctttctcatttggctctgcacttaccctctgcatgagtccagttgagataagagagcaggggtatggaagtaattaggcggactggagagaatgggtcaagtttgagaaaactaaactggcacaaaaattaaatttgaaattgaaaaatggactgtttctgctctttattttttatttttttgagacagagtctctcgtccaggtcagagtgcagtggcgcaatcttggctcactgcaacctctgcctcccaggttcaagcaattctcctgtctcagcctcctgagcagctgggactacaggtgcccaccaccatgccgggctaatttttgtatttttagtagagatggggttacaccatgttggccaggctggtctcaaactcgtgacctcaggtgatccacccacctcggcctcccaaaatgttgggattacaggcttgagccaccatgcccagcctgtttctgctctttaaaaaaattgtcattattattgctcaacttttgccctcttgctttctctgtttctgtttcttgttatctgcctctccacttacaaatccttgctttccctttctaatctccacaagttctacgcctgggtaactcagcagatgcccttgagtcagccaaaagagctgttcacctatcagatgttgtcctgagattctgcatcactgttagtcacctcaatcgagccttgtacttcgcctgtgacaatgtcctgtgggctggaaagtctggactggctccccgtgtggatcaggagaagtgggcccagcgttcattcaggtttgatatcctgttctcctttaagatttttttttgtagcctctatattgcatagcttgtcttatatgagggaaagatatcttaggatctttccagagtatataagtcttgatcagtcacttggcttccaatcacttagatcttaaactatcggagaatatcaaatggggagagatggaagacagatgctcttccataatgaatgactaatattgtgcaaggtaagatattatatcactttaattgtgcttctataccacaggttattccccctcactacctgcttactcattcattccaaagatatttattagatgcttactgtggcgcaggggataaagcaaagagctaaacagataatgtgcctgctcccatgaagcttctagtttagtgagggagttagatactacaatgaataacttctcatatatatttgtggaaaagtatgcggtattatgaaagaatatcacaaggggagctaatttagattggaaaatcaggaaaaaactctttgagaaagtaatattttagctcagacctgatgtctgagtaggaggagttagacaaagccaacagtagcagaaaagacatttccaaacagagaaaattgcacattctaagtaaggctttgaactaagaaagacttaagggaattagagaaatagaaagaaagccagtgtgattgacagtattgagtccatcagttcaaatttgagagatagacaggcaccagatctttcatacagggccttttaggcaatgttaatgtttgttttattttatcctacaatgggacattattgaaggattctgagcagggaaatgacatgattcaaattgtgtttaaaggacatctctttttgagatgttgaaaatggattgcaggccgggcgcagtggctcacgcctgtaatcccagcactttgggaggccgaggttggggggatcacgaggtcaggacttcaagaccagcctggccaacgtggcaaaaccccgtctctactaaaattacaaaaattagccaggtgtggtggcgggcacctgtaatcccagctactcgggaggctgaggcaggagactcgcttgaacccgggaggcaaaggttgcagtgagccgagatcgtgctattgcactccagcctaggtgacaagagcaagactccatctcaaaaaaaaaaaaaaaagaaaagaaaagaaaagaaaatggattgcagtgggtcaagagaggaggagatgccctaatacgagcaagagatgacgttggcttggacaaaggaggtagctgacaataaaggtagagagaaatatgatgtgggagtaaaattctctaacatattatctgtattgtttttcgttttcctatgattgtactttttcattatattaaccttgcttttcccttcatctttctcagtgatttacaactttaacatggcttatgatgtatgaggggtgggagcagaggcatggctggagcagtatggaaaagcaactccctaaaggagtctatatgttatatttattcatttcatccaacagatacttactgagctcttactatatggtaggcaccagtgtacatacagggatacagtggttaaagataaacaaggccggccaggtgcggtggctcatgcctgtaatcccagcactttgggaggccaaggcgggcggatcacctgaggtcaggagttttgagaccagcctgaccggcatggagaaaccccgtctctactaaaaatacaaaattagccgggtgtggtggcgcatgcctgtaatcccagctactcgggaggttgaggcaggagaatcgcttgaacccgggaggcagagtttgtggtgagccgagatcgtgccattgtactctagcctgggcaacaacagtgaaataccgtctcaaaaaaaaagaaaagacaaacaaggcctctgctcctctggaacttaccttgtaatgggatgagataaacataaataaacaataaattaaaatatcagatactggtaaatgttatgcaggaaattaaaacagtgttatggagtagagagtaactgactcagtgctttagatttagggataagggaaggcgtctccgaagaggtgatacttaagctcatacctgaagagcaagaaagagctagctatgtgagggttttggagggagaatattccaggtggagggagaatattccaggtagagggaataggtagtgcaaaggtcctaaggcaagaacaagcttgatgggattaaaatgtagaaggaaaccaacatggttggagcataatgattgcaggaaagaatgatacaaggtaaagttagaggggtagggaccagatgttgagtctgtaagcctctctaaggtatttatattttattatgaatgtgacaggaagaaaaccatggagagctgtggtttgtttatttgtttttggttttttttttttttgagatggagtcttgctctgtcgcccaggctggagcgcaatggtgcaatctcagctcactgcaacgtccatctcttgggttcaagtgattctgctgcctcagcctcctgagtagctgggattacaggcacgcgccaccacacccagctaatttttgtatttttagtagagacagggtttcaccacgttggtcaggctagtctccaactcctgacctcatgatccacttgcctccacctcccgaagtgctgggattataggcgtgagccaccacgcctggccaaccatggagagttttaagaagggaagtaatgatgtgatttatgtttatgctagctattatatgaaaatagattgttgggggtgggggcaacaatggccacagtgagaccagttaaaacattaaagcagaagtccagacaagagatgttagtggcttagagtatggcagtgcggtgtgatagagagatgtggttggttgggttcaggatatactttgaaggtagtacaagttattgagtacagaccaccattgtcagattggattacaaataaaaaacatggattttttactgaagaaatttataatttaacacatttggcaattacttaaacctctgggcctctaaaggaatagggattggatttagatcacctttaatatgtttgagtctctgagacatctgaaatttgttctttcaaaacaagtttgccttgttataggtcaagttgagagagagatggagagtgtgtgtgtgtgtgtgtgtgtgtgtgtgtgtgttgccaagtggaaaatgaaatttgagattgaccttggaagatttcatgatgctcatggagtttaaaccaggatcttaaggtgcacataaacatgtattagttacagaatgttgggaggactttgtttcttcatttttattgggacataattgacaaatagaaattacatatatttaaggagttatagctcgatgtttgtacatgtacgttgtgacatgatcaccacagtcaagctaattaacatatccatcacctcacataattaccttttttcttttatggtaagaacacttaagatctaccttcctggcagatttcaaatatacaatacagtattgttaactatagtcacaatgtagtacattagatctccagaacttactcatcttgcataactgaaacttatacgctttgaccagtatcttcccatttccctcactccccaacccctggcaacccccattctattctgtgcccctatgagttagccttttttttttttttttgagacagagtcttgctttgttgcccaggccggagtgcagtggtgagatctctgcaacctctgcttcctgggttcaagcaattctcatgcctcagcctcccaagtagctgggattacaggtgctggccaccacaactggccaatttttgtatttttagtagggacggggtttcaccatgttggccaggctggtcttaaactcctgacctcaggtgatccacctgccttggcctcccaaagtgctgggattacaggcatgagccaccacgcccggccttattttagcttccacctataagtgagattatgcagtatttgtctttctgtgtctggcttattttgcttagcatagtgtcctcgatggaggacatttctaataggggtaatagcattcactttacttctgatctaatgtgtaatctctttgctacaggaaaagaaaatgttaaaatgtgatgttggatatgttaagtaggtatacatgcccttactgacccttttgctctgtgtatcaggtactatttgttttccctcatcatgaatttgagccgtgatgcttatgagattcgcctactgatggagcaagagtcttctgcttgtagccggcgactgaaaggttctggaggaggagtcccaggaggaagtgaaactgggggacttgggggaccagggactccaggaggaggtctgccccaactggctctgaaacttcggctgcaagtcctgctcctggctcgagtccttagaggtcatcccccacttctgctagacgtggtcagaaatgcctgtgatctcttcattcctctggacaaactaggcctctggcgctgtggccctgggattgtggggctttgtggcctcgtgtcctccatcctgtctattctcaccctaatctatccctggctacgactcaagccctgaccttccggtacaggataaggaggggacctgaattggtgagatggaatcttagatcgtcccccatgtgccagcctcattcgaattctactctttggttaaagttagaaattcagagatttaggggtggaggaagagctttggggaagatgaggtaaggaaagatgactcgtgaagttaataggatgtctctaatttctagatgtgcctgagcttctgttcttttcctctttctttgtgtctctcttgaatatatttactttgtgtctcttaactctgtttaaggttctgtgtctatgcatctctctctttcttttttcaaccttctcattctcctatccagggatttaatcagcagaattactttttgataggggaggtataaggtttggcctgtaaggttctaactgccttcttttttctcacagaggtggcttatggcagatttttcctccttcaaactccaaacataatttttaagactatgtgccagtggactcttcccttatatctctgcaccacaagttgttggatgtttcctcttcctcccttatgtctacctcaccaacctcgctcatcatttggcccttatccttccttgtacacctaccttcagatttctgcttacactttgatttcagagctttattccccagtctgttcttactcctttgtcgcttatccagaatgatgctatgtgtagcatcttgctgtaaatcctgtacaatgattctgtgtaaatagctgtggcctatgccaataatgaagagcaagcctttcaggtaagcaaattaaagttcagtttgctcatcgaca

SEQ ID NO: 1525 - DNA, 5141 bp, Homo sapiens
gagcgagtacgcccggaaccgaagcttgcgaagcgggtcgcagagagagatgggcgttgcagaatcagctggggtcacttatttccggtctcactccagatgaaggagccactagccggcgagagttcaccgagggaacgtgacactcatatctcatcgagggaccgtgttgagggagcccctacagagaggccaaaggaggagagggcctacggagaaatgaacctctgtaaaagctgctctttagggatcagtctttttgtgactctagcttcatagcttggtctctccattactccagccttcctttcaatcatacactgcctctctccagcaccaccaatggatacttcttttctaaaaatgtttttctgtgggttgctgccgtgtctgtgagaaggtgggcagagggttcaagaaaggaaggatttgggatcagcgtaccagggttggggagacagggcaggagcccagctttttctgcattttccactactttccacttcctgcgagctccttgggaaagccagcagagtggaaggaggagtcctattttcacagaaagcagaaacaagggagaaaggttcagaatggagatgaaatctaggagttagtcaagaagaacatcccagatgtcagagaaaatggcctgtagactgggaggctgtaggtgtagtggcaagcgcccagtctttgccataggacagaaacatagctgtgaagctttggagagcttgcttaaccttattaagtctgtttcctcatctgtaacaagaagatgatagttcctatcttataaagttgtgaggattgaaaatagtgtatgtaaagcacatggcacatagttgacacgtgtccaagaaataactagtaaaaatgggtagcttcctgcaaatatttctctctctctcccatccccgggaacattattttcagtatcttgcatctggggggcctccagcctctgaattagctcaggaccctgagtgaactttttaaatccttaggatttttctttttctcccacttcccttggtgccttacagctggacacaaactcattcctaaaatatgtggatggaagctatggtaaccatggagacagggcaggtggcaaggagaggcagagacagtgtgagagaccaatagacagataggaagagagaagatataaggaatgtttcagacagagatcgtcaagcaagatggaaaaaataagacgtctaagcaagactgagattaaagagatgcaatgtgagagagtgtattacaaggttcgctcttcttcctgcccctgtcctatctccctgcccacaataatacggggtggaggcacctggaatgtcccttgccttatctaaaagtgctcccatatccaccttcctcatacttatctaagaggtctacataagggagctgaggtccaagtttctctgcgatgggtgttccgtttttgagagatggggcgggggtgtatctgtgtctgactccaggctggaccgtgatctccttcacaattaaactacaggaagaaagccacatctcttgcctctctttgcacagtatggacaccggctgtggatccaaaaagcctttctacacctttcttacacagtgtgccatgtgccgtgtatggcaggtcaggtctggcgcacaggagcgcacaaacacaccaagtgcggagaatggggatctgctgaatctcagcgaagaatctggatgatggtccctgtctgggtcgcggaggagtcccctaaggaacacttaggtttgttggggctgaggggaggtcggctgagaaaaggaagtcaggattggagcctctaggtttttgagggtttatgtgtgcatgagtgggggagcagtttggtgcctgacgcccccacccgcagtgactaggctataaatagcacagcagagctccgccccccccccccccccccccgccaagcttctctcctcccgagccggcgctgtgcccggggcgctccgggaggagggaccaggatccggcgccggggcgcagatactgacaccaagggaatccgggtgccccccccccccacgccatgcgggcccccaggaaactggctccgccacctcggctgccccgtggccacggccccaatcctggccaggcggagattctgcggacattcaggtatctatctgggcacacagcctgggaggggaaagagcaaggagtgatggggaacatcgcaggggcaatagaaccccccaattctccctccacccgttttaggtctcaaatgcaggctgcttccctccccccactcaatttttggggttgtggcaagctaaaacaggttaggaatgagaatacatgtgtgactgtagggtgcatgtatgtgggtgggtggcgttcagcatcctagaaagggggatcccaagtgtggataagacaagggggacagaggaaaggtctgataagccatggggtgagggtgggggtgcggacatccctgcgcgtgcacgaacgcatttgcacgcgcgctagtccttcagtgcgggtgcacccttcccacctcctcaggcatgcgctgcgggggaagggccggctcaaaggcatgagttagaggaaggactgtatgccgtgaaggtctcctccaccccacgctgggtccctgcatctgtgcctcagttttcctgccgaatctatcaatgagatgtctctcttgcagggatcggcttcgtcactgagacctcaggcctctgccagccactccccctccccatacccctagtcatcctcggcaggtctcagtcccggctccatctgtgccctcgccccagccgcagctatgttgcacaccgagggccacgctcttcttcgggcggtgggtcagggtaagctacgcttggcccgtttgcttctggagggaggcgcctacgtgaatgagggtgatgcgcagggggagactgcgctaatggcagcctgtcgggcccgctacgacgacccccagaacaaggcacgcatggtacgctacctcctggagcaaggcgcggaccccaatatcgcagaccgattagggcgcacggcgctcatgcacgcttgcgccgggggtgggggcgccgcggtggcctcgctgctccttgcccacggcgcagacccctcagtccgagatcacgcgggcgcctcggctcttgtccacgccctggaccgcggggaccgcgagacccttgccacactgctggacgcctgcaaggccaagggtacggaggtcatcatcatcaccaccgatacctcgccctcaggcaccaagaagacccggcagtatctcaattctccaccatccccaggggtggaggaccctgctcccgcctctcctagcccggggttctgcacgtcgccttcggaaatccaactgcagaccgctggaggaggagggcgtgggatgttatcccctcgcgcccaggaagaagaggagaagcgggacgtatttgaattccctcttcctaagccccccgatgacccatccccttccgagccgctccccaaaccaccacgccatcccccaaaaccactcaaaaggctcaactccgagccctggggcctagtggcccctcctcaaccagtcccacccactgaagggagaccggggatcgagcgcttgactgccgaattcaatggcctgaccctgaccggtcgaccccgtctttcccgacgtcacagcaccgaaggccctgaggacccgcccccatgggcggagaaagtgactagcgggggtcctctctctcgccgaaacacagcaccagaagctcaggagtctggtcccccttcagggctgaggcagaaactgagccgcatggagccagtggagctggacacccctggacacctttgccctgactcgcctgagtccagccgcctgtccctggagcgccgccgatacagcgcctccccgttgaccctccctccagccggctcggctccctctccgcgccagtcccaggagagtctgccaggggcagtatctccgctaagcggaaggaggcggagtccggggctgctggagcggaggggctcggggacgttgctcctggaccacatctcgcaaacgcggccgggtttcctaccccctctcaacgtcagtccccaccctcccatccctgacattcgcccacaacccggaggtcgggcgccttcgttgcctgcccctccttatgccggggcgccaggctctcccaggaccaagcgcaaattggtgagacgccactccatgcagactgagcagatccgcctgctggggggcttccagagtctaggtgggcctggggagccagggcgctgagaggagtgagaggagccaaggagggtggggattaggaccttaatgggataggtgggagaaccagctcacacacacaccacgaacaaagggatctcttgcatgtgctcatgggtgcacagtgcacccacacatggttaaacatgtgtccataagcacagtactcttattagcaagaaagaataagtactctatttactgggtatatacacacatgtattcatgccctggtcatttcacatgcatatgggattacttgtgtacctacaggcacagcatatcaataaacacacagggctagggtcccaaactctcttgcatttgttcagaagcagtagggaacccttacttatgggcagtctccgatgtctttgccctcctgcagaagcaatcccttgctttccatgtatgccctgaaacacagcctatcatgattttgcacactctctccgtggacatcccagcccattctgcaggtcttgcttctttctccaggcctggctccttattcacaccctgcttctaaccccaaccacttttcaggatatctttttcactcttcttgggggttcctgcagcaacccccagcctcagttctgctgctgtctttactgctctcaacttcacttctcaacttcctgctttttattcccaccctgttcctccaacaactacaacagattgtctcattttcccagggggtgggtcatgggctctaagctgctcttctgtctgtctgagcttatgaacacccccacaggtagaagtggggagaaaccctaaatcactcctctctccacttgacatatcaaataaatgtgttcagaagtc

SEQ ID NO: 1526 - DNA, 2944 bp, Homo sapiens
tttatttctaaagttgtagtgaagctctcacccataataaaggttgtgaatgttctgtgagtgtcatggagatgggctagggaggggattttacacttcactttccagacccctggtttgggggaagagggtccatgttccattcttcctttgctggccctgggtccaggtaagctgcacttttacacggtgggggtgttctgtggaggaattccaagagaggttgtcctttcctgctttcccccgtgcctgtaaaaactagaccattccagcccagtactgtggagctctccagtcctttttcacttttacctgcccagatgttgcagccagagcttgagggcaaacttggttccagtgctgactctctctttgtcctctgccatggttgggatcatccgcaggagggtggacatgtgcaggaccagaggtcgggctcttccatcctcctctagttccactgcactgcatggtgacaactcctgttggggctgtgccttgtagcttacaaagaacttacatatatgttaggtccccgaatcctcccaactaccacaggaggtgggtgggtgttgacctcatttgcagaaaggaaacaggttcaaggagggttaaatgacttgcccctgtgttagaactgacacttagaccttcaatgctagccagttagagcaagaatctttggggtttgatggtcagtgtcttagatttcatgtaccttcttaattatcagctgacccactctccttaaatctcccccacaacacaaaattccatcctgaggacaggatagacgctgaacttctcaacatgaatatgttggtgtattagaggctgagggagaagctcttacttacaggacagagggtggtaggtcctgggggagaagtccgggtgtctctgtcccatcctctgcggcagccactgcagcagctacatctggtgtcagccacataagggcgctcacctcatttgggtttggttggatccgggcctggggtcagacatggtgacccctcagtcattgcctctccctgggctgcctgttcgtgatcaaaacctacccgcaggtttcatggagaaaggcaggagcaaggggaaagggcattgcatattcttcgttatctctgactacccccgccacccccgcccagctcctaatcacagtcagaaccaggttgcttgggctcccctgagccctgtttccttccctcactgccagccctacctgcaactgctgctgtgattcctgggagatcacgagtagatacagaacaatgtgatggtatttgggtaaaccccagctcagcctaggagggtaggcagactaggaaaagaaaacagcaaaagtgagaactttccgtcactttttttttttttttaagatggagtttcgctcttgtcgcccaggctggcatgcaatggcgtgatcttggctcactgcaacctctgcctcctgggttcaagcaattctccagcctcagcctccagagtagctgggattacaggcgcctgccgccacgcccagctaaaatttttgtatttttagtagagacggggtttcgccatgttgtccaggctggtctcaaacttctgacctcaggtgatccgcccacctcagcctcccaaagtgttgggattacaggcgtgagccaccgcacccggccctttgtgtcactttttgagactttgttaatacagctttagggtgaaacaaaatggtggccaaaagctgagggcgtggatggtacagatgacacagcagggacatgggtgagggttatggatttggggattccagcccacttatgtgctattgtttcccttgtagccaaggcaggtaggggctgatctatggaggagcttctcccagctacttgtctcacctcccataaacccagagggacccaagagaactggccctggggcaggtgtagtccactctcctcccaaagttctcgaagccctccgtccagcagctgggagtcagagaagacacatcagaggggccagtgcctgactcttccaagtccttttgcttgcccctccctcagcccacacccaagatggtcccaggcatgggtctcttggctcaggttggatcagctgactggttacctcctcctcaagttccacgtgcccacctgcaacaacagtggggccagtaggtgaatggtggtggtcttggccagggagcccccactcactgttgacactcctctcccctccagtggacacagagggagttgcagtcccttgtgactatgaacatgccacattttggggcccactttatccttctgagactgggaaaaacattgttgcggggaaagggcaaatttcttctctgtacttggggccttgtccccagaatactcacccgggggtacccagaggttgggggaaacgctcagggtgcgtgcccttcgggttagcaagacagtcttgtcgctggactgcagaatgacggccacacccaggtccacacctcgatctgtgggcagctcagccccagggaccctgggccgctcctccagggccgcaaaagggcagaaagggggtcgctggcagaaggaagccagctgggttaaggcttcagaagggcggcactgggtgggcgtgacttccaaaaatggggctacaccgcgcgttgggggcggggtcctcgccgccagttcccacccgatttcagtccccatctttggcccttcactgcccccgctctggggcccccttctgccgacctggagcggaagcctagcggaggcgcctgggaagggcctgctcgagaggacaagccgtcctcgcttcaagctgcagtgaatgggccacgtcccgagccctggtccggctcccaggaggccacacacactccgtgcgaagctcaccgactccggacgccgggacaggagcagctgcacccgcacctcggccataacgcgac

SEQ ID NO: 1527 - DNA, 22008 bp, Homo sapiens
agctgactggggtggttgggaccgttagctcggcaggctggcaggctccggggcgctactccattggcggccgggatggagactatgcgagcgcagcggctgcagcctggtgtgggcaccagcgggaggggcactctccgagcgctgcggcccggagtgactggggccgcggctgccaccgccacaccccctgcgggccccccgcctgccccgccgcctcccgcaccgcccccgccgccgctgctcctgtctggggccccaggactacccctgccccccggcgccgccggcagcccggcagtgctgcgagaggccgtggaggccgtggtgaggagcttcgccaagcacacgcagggctatggccgaggtgagtctgcgggtctggcctcctgcgcgacaccctctgtaagggagccttgctcccacagtcctccggatcgcttttcctggcgtggagccctcacatgcatttccttttggggagtttccttctgggctacgcacacgcacagacgcacacactcatacacacgtttaagcctcctacctcctcccctttactgagttattaatatattctccagggactctttttcagatacaatcctcttttcttcctaagcttttctcctttagaaatggaattcctcctccagcttaataccttaacatctctctgcctttgagaaccagtcctcattgtgtgggatcctgtcttttatttcagatccaatttctcatccataccctctcagtctttcctctgtgatctctgcaattcctggactcacctgttaatttgctccagccccttaaccttgactgttaaattctttacttacttaccttcactctgaaatttcagtgcaacttcagatttactggggaactaggtagtgccttcacaagtcactcatagtaattgtgtatttaaatccggacctgtaccactgaactcacagcagcttcctgtggctcagtaccttactttggtatcttttttagtatggagactcacaactccagcctttctgtctggctgtgttttcctggcccttgcccaggaactgaggataaatcccaggccttggctctttcaatgttaaattctgtggaaatgtgccaggttagaaactctatttcagttagaaaacttcgttaatttctggaaagagggatgtgagggttttctttgttgttttcgtttaactagggtagtttcctgtctgagtttgagttccagatttatagtgtaagtaataaggaatatatagtgaagggtgtggaatacagaatttaagcctggaatttacaagacatcccttctgtctgcttggccaggtcctgcctgacctggaagtgactatatctttaactttctgtttaacaataatacagagaaaagttacagggcttttctgtagattttctttttttaagaaagtttagtgaaaagagcacacacaggctttggagatctttgtcacttaccagccaaatctttggggaagggacttaatttcactgagcttcagtttcttcaagggttacaatatggattgactgagacattgcaaatgacatataacctaaaaatgattattatctcaaatttgttggttcatagttccttaagtagaacatgcttcactttttcccactcttaaatcctaataatgtaaacccaaaaattcctatgaaaacagatttttagagccattttgctatatgtgcctaatgattcattcatcatcaatttccctttgttcttcatacaatttgaactcctattataagacaggaactctgctaggtgctggggatacaaatggatgaatctgaaactcatgaggaaatactatttttccaatgtaatcccaagatttaacaaggctatgtgatggaactgctattagctactatcctgctgcttcaagtctctaagtcaagatcaagggaaggtctttgcctctgggcacaggagtagcctagagtggtcacactaaatctgaagccttcctcttggcaacttacaggcatttattaaaattatagaagagtacaccctttttcttgtctgtgttacctggagagcctctgctttggctcccaaactggacatcctgtaaaaacttccatttccttagcaaggatgagggaacaaggggattgtactgacaaagggcaattaatcaggcttcacacttcgtggtgattttctttcctatctccccacctcccatcgcagtctttctcattattcttgagtttctcatttccagtctgagtgtccagccagtactttaggaaagtctggcagatagttcagcttcaggcaagcagaatctctgcccatttggctcagaagtcctttaccacatggaatcacttattctgcttcaattcttaggcaaagctgccactggcatatattcacatacccttgtgactgatggcatgttatttgggggaatggctgtattcccctgaatacaatttactttagcctctgcctagacaattcattccctcatccagcaatgctttaccacatcatcttcaattaacatccttcatcttcttcctgaatgctccaaatccaccttttccaatcagtctttagatctaccttcactcatgtgggctatcagtatgtatgtatatatgtatgtatgtatgtatttacttatttattttaaaaagctttcctgtcctttatctgcctccctcacccacttacccaagatacacacacagctcagtattctgtaggatcttgataagtttgtagtgcatgggatttgtaatcagaggacctagccctgtcaaatagttggctgtgtgatcttggagaagttgcttaatctctctatgcttcatctgttctcttcattcatttaccaaatatttattgatcaccagatgcagtggtggacaaggcagatatttagtccctatcttgatggagctcacagtttacattacagagcatgtataaagattaatggtgtagtaaagcaggccagcccaatacaaagagggttgactttggagccaaacaaacattgtttctaaatcctggttctgccacttctggcctgttccttaacttgcttactttttgtaaaatgggtattataatacttatcctgatagttttgtgtggattaaataagacaacgaatataaagcatgcagcacctggtactcagtatggttgctactattgtgcatttggaaatgctttggaaactgcaaatgataggtactgttctgcattgccatttcctttgcaccctttttttctatggcatatagtctctttctcatgtttgacatctggcaatctctaaactggcaggatcgagtaactcactttccttgctctgtaattgctacatttccctcttcaaacctgttgttttggaagtattgctatccttttatgttacaatatggctgcatgattggagattttgccctgttatttcactaagttgaacaaatgaatcttgtgtagtattttctatttagttgttccttttcctcagaatcacagatagcttcttttctgtaagactgaagttaaatgggttgggctgaatatttccaatttttggaaatgctggattagttcctatattagtttcctgtggctgctgtaacaaattatcacaactttagtggcttaaaccaacagaaatttgttctctcatagttctggaggccagaagtccaaaatcagtattactgggccaaaatcaaggtgttggcagggccgtgctccctccagaagctctaggggagaattcattccttgcctcttccagcttctggtggctgctgacattggtttattacgtggtttattgctgtatcactataatctctgcctccgtgactcctcctcttcatcaaatatgcctcctttttttttttttaagaaatggaatctcgctgtgttgcctaggctggactgcagtggtgcaatcatagctcaccgcagcctggaactgctgggctccagtgatcctcccacccgcctcagcctcccaagtagctagactacaggtgcatgtcaccacacctggctgattttaaaaaatttttttgtagagatgagatcccacagtgttgcccaggctgatcttgaactcctggcctcaagtgatcatcctgctttggcctcccaaagtgctggaattataggcatgagtcagtgtgcccatcctgcctccctcttataaggacacttgtgaatgcacttagggcccacctatataatctaggtcatctccccatctcagatcatttaaactcatctgcaaagtctttgccagataatgtcacattcacaggttccaaggattaagacatggacattttggcaggtggcattattcagtctaccagagtcccctcccaaagtcactgttactttgcagtctctccttccaaagagactgtggatcgtgggctatttaggggcagatgtaccttctaaacattgaaataggaaatagatgaactattgttaactagcttccctatcttccataataatgtgaatagagtcagtctattctcgccatcctctatgatcaaggagaatctttttactcacctcttaacttcattatctctttattcctgcttccccaccacaaagttgtatttattacttttttcttttatttttgttaattaccttcctggcaaggttgtatttatccttatgatataaaatttttactgtagtttcatatattgttttaatatttttatcctggccaggcacaatggctcatgcctgtaatcccagcattttggaggccagcgcaggaggattgcttgaaccttagggtttgagaccagcctgggcaacatagtgagaccccatctctacaaaaaaatttttttgaattatccaggcatggtggcatgcatcttgtagtcccagccactcagggagctgaggtgggaggatcacttgaacccaggaagtcaaggctgcagtgaggtgtgattgtgccactgaattctagcttcagcgatagagcgagaccttgcctcaaaaaaaaaaaatgttttaggttaggtgcggtgactcacacctgtaatcccagcactttgggaggctgaggtgggaggatcatctgaagtcaggagttcaagaccagcctggccaacatggcgaaaccccgtctctactaaaaatacaaaaattagctgggtgtggtggcgtgcgcctgtaatcccagctactcgggaggctgagcaggagaattgcttgaaccttggaggtggaggttgccgtgagccaagatcatgctactgcactccagcctgggcgacagagcaagactttgtctcaaaaaaaaaaaaaagtttttattttggctgaaaatgatcactacctctcattcccatcctgtccacttagacattcgtatattttatctcctaaaggcaaaaactaaattattctcttttttgttattcaacagcagggtataagcactgaaatattcctatcttggtctttcttgtgagagactttgagaaaacaattatcagatgtgtatatctcagttcttcctaccctcccacctcactgttctttagccatccttatgtaaaccattatatccatggttcctcattgaaaatatgatacaaaatttgggtgctccacatatacccatgcacaaatactcatatgcatacagacacacacataattttacttaacagttttaggaagcttgtgaacctccatgaagctcagctgtggactggaccttggagcctgtgttaagattcccaaattggaaagaatattggcccccggaaatctagattcatgccccaactctgccatagctatgtgacctcaaacaagtcttctgttctttcttagccagcattggactagatgatctctaaagttccttccagccctaaaaatgaataagtctagaagcattttcaaatgcggatcacaattagttgcttttttcttgaccactttgcccaattatcatttcatactcacatttctaaaatcaagactccccatgtcccttggccttgagtaatcattaaaaaatgattctctagtctgtgcaaaggaatgtttaactggatagagactgaacatatgctttttaataggaccttcccaattatggtggtctcctcctcttcctctttattccagtattctccctgttgtgtgcatgtcaagagagctgtcacccagtgcattgtgctaaactgtctcaaagagggaactggagctgaaaagatctcacggaaagaacaaagatggctgagctttctggtcagtattgacctttgaagagccctgccaaaaccaatagaaggaaagagagttttcttttcatgctggatctttttttaaattttaattttaattttttttgcccatgacagagcctcaggaggtcctaatgacatgtgccctcatgctgtcttttaatagaagaatgagcattcttaaaagtcagttaaatgtaggttattaaaaagagtttatgctgcttctccaactcaggctagtacatgggtgtttgtttcagtcacagagcaggcgagataatttattattggccactgatttcaaattccttgcttgctgggcgcggtggctcacgcctgtaatcccggcagtttgggaggccgaggcaggtggatcacctaaggtcaggagtttgagaccagcctgaccaatatggtgaaaccgtgtctctactaaaaatacaaaaattagccaggcgtggcggcatgtgcctataatcccagctactcaagaggctgagacagaagaattgcttgaacctgggaggtagaggttgcagtgagccaagattgcgccactgcactccagcctgggaaacagagggagactccaactcaaaaataaaataaattccttgcttgcaggaactgtgagttattcttttcatgctcaatgcttagaatgatgccatgtacctattaagtgctcaaagttttgctaacgtgtatatgacagccatgaaaatgtgcagttctcattgcctgctgcagggagcataactaacagcctcagccactgcccactctgggtcatccataaccacatttgcaccacaaagtcgcacattcgcatccataaccacatttgaaggaaccacgcttcctgtaggctgctcccagccaatgacctagcacatcaggggtattaacacaggcagatcctggtgagatatgggattcctttggcatgaggacttctcactgacttagccaaatctttcttaaaactgtactacagccgggcgtggtggcttgcgcctgtaatcccagcactttgggaggccgaggcgggcggatcatgaggtcaggagatcaagatcatcctggctaacacggtgaaaccctgtctctactaaaaatacaaaaaattagccgggcgtggtggtagtcccagctactcaggaggctgaggcaggagaatgacatgaacccgggaggtggagcttgcagtgagctgagatcacgccactgcactccggtctgggcgacagagtgagaatctgtttagaaaaacaacaacaacaacaacaacaacaacaaaaactgtactacagtctgagattgtcatatctagacctccttctttccctctcttccacaggcatgagatctttgctgtgctcagaaggctctccctgttgtctcctacttcctccctgataaatctcttgcaattgtctatcccatcttggtgtcttcttggcagatctgaactaaggaaatatgaaagaacgaatgagactttgttgcgattaagagtagaagaggagaggccagacgtggtggctcacgcctgtaatcccagcactttggggggccaaggtggaggaggagcactttgggaggccgcttgagctcaggagtttgagaccagcctgggcaatgtagtgaaactctgtctctacaaaaattacaaaaattagacgggcgtggtggcatgcacctgtggtcccagctactcagaggctaaggttggaggatcgcctgggcctgggaggtggaggttgcagtgagctgagatcgctccactgcactccagcctgggcaacagagtgagattctgtctcaaaaaaaaaaaaaaaaggagagtggtcagtatgttgcaagatatttcagagcacctgggataatttattattatgaggctttagctaaaactatttgaaatgtttggaaccctagagccaatgtgatcctttctaaaagcaaactgatctcatccctccttttttttttaattagttatttttccttggagctgagttagaaagactcccttctttttaaagtcctccaattgcttcctattgctctaggataaagccaatactctaacatggcctaaaaggccctacttggtctggtccctgcctcctcttgcaacctcatcttgcattacacttcccctccctcactctttcatagccatatggtcttaattccctttattcatcatgttccctgccgtcatgagcctttgaacatgctgttccttacgcacagaacactgtcctctcacctcttgcctagtgaattcctagtcatacctaaacttagatattgcctcctcagggtagctttctttgaccttcttaactaggtcagatacgccgacatctatcactcctttatagaacttgatcacagctgcaattttacatttgtttgagatttggttaatatctctttccctctttacactgtaggctacataaggaaaacgtagggatgagaggaagttttctagaatacaatgtcaggtctggagtttgattttagcctacctacaactaataaattagccatttactgtttcatgggtgctggcagaagtcaagagactttgagatttagagacaaaggaatttattattcatagcacagcaagtagcatgagcatcatgtttatattagttctccttgcctcctcccaagtccaatgcagaggactcaggtggatacttgcataggccatgggttgcttcacaacagaggaacacttatagaacccacagcttggggaacttgccattttacaacaagctgaagcaagcaagttctttatctgagtgaaggtagtacctcatccctcaatatttcttgctgcaagcacagtcctgaaaaatagcccaagtaaagagcagtcagggatttgcaatcttggtgtacctagcaagatgtgaaggagcatgagagaccgacccatggaggagtgcttctttttaaagtcctccaattgcttcccattgcattgcttcgcatctcaccatatggctcctccaaaaacatttatacccaggtaaagcctcaaaagagttttctctcccacccccatgccctggcttctctcactcgtagtatgtacatagtattctgggttggaaaaggaatctggcaatggatgtgctcactagaagcacaggctcgagaatggttattagggctatatttccttgagccagcagtattgcataaaagaatattcattggaaccaagactacttgagtttgaatactcaaactgctactttctcctggcataaccttgggcaagttatttaacttctctgtacctcatttccctcatctgtaaaatatggatagtaaaaatatctgcttcataaagttgctgtgattaaacacgtaaagcagttacagaaatgggtgacatacagttcaatacatgttagcacttattgtggtggttattatcatcctgggccagctaaccaactgtggaataatctgcttgtatttcatcaggcagtgataatggtctgctgacattgggaactctgccttcaatatttaagttattctaggactaagttaaaatgtgaactattcagattggaggtgggagtgaaaaaaaaatttaaataaaataaaatgtgaaccagaaaagtggtggaggagggcaggcctactctggtctttctaggcaaattaacttaatcacagtctaggtttattaacttaaatgcttttcaatggcgataggtagggagctaaggggcagactcttaatgtaggtacaggttacaggtactgtattgaagtatagcaccacgtggaggtgttctcattcattgctgaacttaagtacttctcttttgtagtgaatgtggtggaggcacttcaggaattctggcagatgaagcagtcccgtggtgctgacttaaagaatggggctctagtggtttatgagatggttccctccaacagccctccttatgtctgctatgtcaccctgcctgggggaagctgctttgggagtttccaggtaagagttgtgaggtggcagtagcaaaggtaaatgcttagatgttagtaacggctttctccaccactttggccattaaactgcctgaaatcatatatttgaggacctaaagcaattctggggaaattattctggcaagcatctgaggccaatttgaccatagtagaacctcagtagcatgctttcctttcaaaaactcaaacccattttgaatttgagcagttatgaatatccccttgctcagtatatccgactaccagcatccaacccatgttccaatctggcttcagttattgcattccaactttcttccatctcttattgaggatatagaacaatattccttgcctccagtactttttcgtaggcaattactaaagaaagcaatgttggagttctctaagaggtcaaatcggagggactatgtatgctggaaacagtactcatctaagagttaggagatccaaatttacattcttctgaatatcaatggggcaaatctctgggcctcacttttcccatctataacatgaaggagataggttagattatttctaaagtcttttctactactaacattctacaattatgtgaaatacctatgatgatgaaaagaatggttgccattatgaggtagtagtgaaaaattatggactagtacgaatattctcatcaaagatggattttttacattgcagacagggaggcagccttctgaaatgtcaacttaaaagtctcaaatggaatttagagaaaataataaacacctttgttctgttttccatatggtttgtgaaacccttagacaaggttaaaggccctactgtgtgtctgcatagcaccttgaacttcccctatcatatcacttattacaacatatcataattgtttgtctctcctagtggactatgttccatagaggcaaagattgtgtttgtcttctttctcgttaaatccctaccacccatcttagtgcctagcagatagtaggcaaataatacgtctgttgcatgaatgagtgccattgcagcttagtttctgcctcaaacagaagcagtcctaaggaagcttcatttcaaatcaggtgatgaaattttttcccttagaacttcagtcatttcaggccgggcacagtgactcacacctgtaatcccagcactctgggaggccgaggcgggtggatcacaaggtcaggagtttgagaccagcctgaccaacatggtgaaaccccgtctctactaaaaatacaaaaattagctgggcatggtggtgcacgcctgtaatcccagctacttaggaggctgaggcaggagaattgcttgaactctggaggcggagattgcagtgatctgagattgcaccacggcactctagcctgggcaacagagtgagactctggctcaaaaaaaaaaaaaaaaagaacttcagtcatttcagagaaataactatatacccaagatgacaaatgtttatgctttcacttgtttttttttgtttttttgtttttttgttttttgagatggagtcttgctctgtcacccaggctggagtgcagtggtatgatcttggctcactgcaacctccgcctcctgggctcaagtgattctcctgcctcaccttccccagtagctaggactagaggcgcatgccaccacgcctagctaattttttttttttttttttttttggtatttttagtagagacagggtttcaccatgttagccaggatggtctcaatctcctgaccttgtaatccacccgccttggcctcccaaagtgctgggattacaggtgtgagccactgcgcccagcctgtgctttcacttctaagagaataagatctttccttcttctttttttttttttttttgagatagagtctcgctctgttgcccaggctggagtgcaacagcccgatctcagctcactgcaacctctgcctcccgggttgaagcgattctccctgcctcagcctcccaagtagctgggagtacaggcacctgccaccacgctcagctaattttttgtatttttagtagagatggggtttcgccatgttggccaggctggtctcgaactcctgacctcaagcaatccgcccacctcggcctcccaaggtgctggaattacaggcgtgagccaccgtgcctggctgatctttccttcttcttcccacctcattacattgttgaatgacttgaaaattttatgacaatgcccataactgaaacattatagtaatttgatttctgttatttttggaaagaggagaattgtctttcttggccttttagcctaaacttttttttttttttttttgagacagagtcttgctctgtcgcccaggctggagtgcagtggtgtgatcttgactcactgtaacctccacctcccaggttcaagcagttctccctgcctctgcctccggccaccacacccagctaatttttgtatttttgtattatttcaccatgttggccaggctggtcttgaactcctgacctcaggtgatctgcctgcctcagcttcccaaagtgctgggattacaggtatgagccacttcacccagcttttttttttttttctttcttgagacagggcctcactcttgtcacccagactgaagtacagtggcacaataatggctcactgcagccttaacttcatgggctcaagtgatcctcccacctcagcctcctgaatagctggggccgcaggcatatgccaccatgcctggctaatttttgtatttttggtagatatggagttttgccatgtttcctaggctggtcacaaactcctgagctcaagcaatcctttcacctcagccttccaaagtgctgggattacaggtgtgagccacctcgcccagccaggggcagggtgcaataactgaagctagattagaacatgggctgggtgttgatagtccgatatactgagcaagggcatatccataactgctcaaattcaagatgggtttgagtttatacctctttatccactttggcaggtgaaatttctccctctggttttcttcacagatgactttttaagcaacagcactatagagcaggccagcaagctagtaacagacaaatagaaacagacaaattgaagcactgggaagacttaggacttacttaccaagcctcatatgctgtctcagagagcctgtcagttaatagaaattaggaattattgatattagggatgcttaagtactaaacacatcctggtctacttatttattgtttttttaagacagagttgtgctctgttgcccaggctggagtgcagtggcacaatcatagctcactgcacccttgactcctaggctcaagtgatccttccacctcaacctcctgactagctgggaccacaggtgtgcaccacaaccatgcccagctaatttttaaattttttgtagagttggcatctcactatgttgcccaggctggtctcaaactcctggcctcaagtgatcctcctgccttagcctcccaaagtgctgggattacaggcatgagccaccatgcccaacccctggtctactttttattttaagttttcttttagagacagagtctcactctgtcacccaggctgcagtgtagtggtgtgatcataactcactgcagcctggaactcctggctcaagtgatccttctgcctcagcctcctgagtagctgggactacaggcacgtgtcaccatgcctggctaattttttcttttttttttttggtagagacaggggtcttgctatgttgcccaggttattcttgaattcctgggctcaaatgatcctcctgccttggcctcccaaagtgctgggattacaggtgtgagccaccaagcccggccttggtctacttttaaaaactgcaacatcactttcttcctttcctctaattactcataaatgacatagggcaaagaggcctttgagacagccaataaagatgaattataaaggaatactatggtggctagagatctgaagttgaataattttgagacttctgcagatcagacttgttctatgatacctatgttggatacaatataaaaacatgaattaatttttatttttttccttcttaagtcagctttccttcccttagttactcctctcctctttgtttccactgtggggaaaaaagaagtctataaattccttcttcagacttaaacccttctcagggatagctcctttggctcactacgttatttgagaaaatgcctgctcacagctaaaaatgaagtccgagattccaagatgggtgcttctgatagagaccagtggcctctgtagaagcagcctagacacagctttggttctaatcttgggttatctagaggaatccaaaaaaccttacctgtccgcagaacaagatacagatttctattaagccggccagaatctgacttttgagtaactaattctgtcgacagtttaaacgggtatttttcatgaccagtgattatatgctgacttaagcagccttcctcgttctgcattcagtttggtatgagctacagccctctcccagttccttaatgacttcaggatgttgaatcaaaattatgtttccaaacatcccaaccactttaccataaaaaccttggaaagtgtgttgaacacaactgatttatccaaagagcgtccaagtgttttctatctgaagtgtttccctcccactgttccttcctctctctcatatgcacaaatacacatattctcactctttctcccctgcctagttttgccccacaaaagctgaggcccggaggagtgctgcaaagattgcgctaatgaattctgtgtttaatgaacatccttcccgaagaatcactgatgagttcatcgagaagagtgtctctgaggccctggcatcttttaatgtaagttgtatggagctggaaggaaggagagtgggagatgggagaactggctgcttgggaagtcgtaaattactgtgaaacagagcatgaattcttgttttctttctggtccacctctctgttcttttgatttattctctgtcagtctattgtgtcatgtgctccacctgtcgcagtctctagttctgtatctgtgtttatgtgttttttgttgttttgtctctttcattgtgtctctttggtatctagaaacctttaattgcagatttatggaattgtagagctattccaaaatgaaaattgagcttcaattttgcttttgctaatttgggttaagaccttagtttctgcagttctttttttatgactgttttttattgtcacttgtctcctgcctccattacttcatcttattgataaagaagacttttataacaaaacgtctttttaggaacaaggaggataatttatttactctctttatttacaactgttctttcaaatgatgatgataagaataaccataattagccagacgcggtgtctcacgcctgtaatcccagcactttgggaggccgaggcgggcagatcacgaggttaggagatcgagaccatcctggctaacacggtgaaaccccgtctctacaaaaaataaaaaaaaaatagccgggcatggtggggggcgtctgtagtcccagctgcttgggaggctgaggcaggagaatggcttgaacccgggagacggagtttgtagtgagccgagattgcgccactgtactccagcctgggcgacagagtgagactccatctcaaaaaagaagaataaccataattaatcctaattgagtatttaccttgtggcagggactgttctaggggatttatatgcattttacctcatttgatcatcacaacaatcttatgaggtgtaagtactattattacccctattttacagatgaggagactaaaaacacagaagtggaatgttgcttaacatgatatagctagtaattggtcacgccaagattagaacccaagttgacttaatttaattacatcttagaaattaacaccgccatcttccttcctctccacaaattcattaatagtcagaccaagtatctgttctatttgcatttaattaagatgtaattacaggccaggtgcagtggctcatgcctgtaatcccagcactttgggaggctgaggcaggcggatcatctgaggccaggagtttgaaaccagcctggctaacatggcaaaaccccatctctactaaaaatacaaaagttagctgggcgcagtggtgggcgcctgtaatcccagctactcgggaggccgaggcaggagaattgcttgaacctgggaggcagaggttgcaatgagctgagattgtgccattgtactccagcctgggtaacagagcaagaatccgcctcaaaaaaaaaaaaaaaaagatgtaattacatatactaaattacttcagttatctgctttgtggattagttgttgaatactttattgaaagttggtttccctctgttatttaggacccagctgtttttctcccattattctttgccccagtcaacagcatctgcagggaatgaaaacatttttatattaatccaaaccaaataaaaaaagaaaaagccagctaaaattttttggaaagtacatttgctacttttaggtcgcctaatggtattataaaatgaaacagggcgaggcgcgatggctcacgcttgtaatctcagcacattgtggggtggatgccagcagatcacttgaggtcaggagttcgagaccagcctggccaacatggcaaaaccccatttctactaaaaatagaaaaattggccaggcacggtggctcatgcctgtaatcccagcactttcggaggccgaggtgggcagatcacgaggtcaagagatcaagaccatctggctgacatggtgaaactccgtctctactaaaaaaaaaaaaaaaattagccaggtgtggtggtgcgcgcctgtagtcccagctacttgggaggctgaggcaggagaatcacttgaacctggaaggcagaggttgcagtgagccgagatcacgccattgcactccagcctggtgacagagcgagactgtgtctcacaaaaaaaaaaaaaaaaagaaagaaaaggaaaaaaaaaaagaaataaaaaatacaaaaattagctgggcattgtggcacatgcctgtaatgccagctactcaggaggctgaagaatgagactcgcttgaacctgggagatggaggtgcagtgagctgagatcattccattgcacgccatcctgggcaacaaagtgacaccctgtctcaaaaaaaaaaaaaaatagaaaaggaaaggaaaaaaaaagaaactgtggattatggaaagtaggatgtgcagtatttatctgatcatgggctctaaattcattgttggcgcggtggctcacgcctgtaatcccagcactttaggaggcggagttgggcggattgcctaaggtcaggagttcaagaccagcctggccaacatggtgaaaccctgcctctactaaaaatataaaaattagctgggtgtggtggcgggcgcctgtaattccagctatttgggaggctgaggcaggagactcacttgaaccaggaggcggaggttgcagtgagccgagattgtgctattgcattccagcttgggtgacaagagcaaaattctgtctcaaaaaataaataactaaattcattgttattgaaattatggttctaggccaggtgtggtggctcacgcctgtaatcctagcactttgcggggctgaggcgggcagatcacttgagctcaggagttggagaccagcctgggcagcatggcgaaactccatctctacaaaaaacacaaacagttatctgggtatgggggcatgcatctgtagtcccagctacttgggggtctgagacaggagtatcacttgagtgaggaggtcaaggctgcagtgagccaagattgcactactgcactccagactcagtgacaaagtgagaccctgtctcaaaaaaaaaaaaaaaaaagaaaaagaaaaaagaaagcaattatggttcctggctgggcgctgaggttcatgcctgtaatcccagcactttggaaggctgaggtgagcagatcacctgaggtcaggagttcgagaccagactggccaatgtgttaaaaccccatctctactaaaaaatacaaaaattagccaggcatggtagtgcacacctgtagtcccagctacgtgggaggctgaggtaggaaaatcgcttgaacccaggaggtggaggttgcggtgaactgagatcgcaccactgcactccagcctgggcgacagagtaagacttcatctcaaaaaaaaaaaaaaaaaaattatggttccatagtcttcctttgggatctgtgtgggattggttctaggatctctcgaggacacctaaacccaaggatgctcaagtccttcatataaaatagcacagtacagcctgggcaacataaagagacttcatctctacaaaaaaataataaaataattagccgggtatggaggcacttgactgtgatcccagctacttgggaggctgaggcaagaggatcacttgatcctggggagattgaggctgcagtgaccatccactgtactctagccagggtgacagacagaatgagacacagtctcaaaaaaaaaaaaaaaagtacagtatttgcatataacctatgcacatcctcctgaataaatgctttaaatcatctctagagtacttataatacctaatacatgtaaatgctgggccaggcacagtggcttacgcctgtaatcccagcactttgggaggccaagacaggcagatcacctgaggtcaggggttcaggaccagcctggccaacatggtgaaaccccgtctccactaaaaataaaaaaattagccgggcgtgatggcgcatgcctatagtcctagctactctgcaggctgaggcaggagaatcacttgaacccaggaggcggaggttgcagtgagccgagatcgcaccactgcactccatcctgggcgacagagcaacagaatgagactccgtctcaaaaaaaaaaaaaggaaatttttatttttaatttaaaattttatttaattctcaaaacaatcatttaaggtagctctatgattattcccatcttacagaagaggaaactgaagaacagagaggttaagtgactttaccaaggccacgctatttgtaggagctccagtccatgctcttaacttctatgctgtattggtttttttacatgctaggcttgaatgcaggacagtgtgtcttaattctaaccctgcagggttacataaccaatagaagacacaataggccaatgtccaggagaccacactgctacccagaatttccacacttataccacatttcagaaagtcagtacaaaaatgtaaaatatttcattaataatgtttatactgactacagttgaaaaataatattttgaacatattgggttaaataagatatattattaaaattaattttacttgtttttttttttttctgagacagagtctcactctgttgtccgggctggagtgcagtagcccgatctctgcaatctccgcctcccaggttgaagtgattctcctgcctcagcctcctgagtagctgggatttacaggcacccactaccatgcccggctaatttttgtatttttagtagagacacggtttcaccatgttggccaggctggtctcaaactcctgacctcaagtgatctgcccaccttggcctcccacagtgctgggattacaggcatgagccactgcacctggacttacctctttatttttactttaatgtggcagagaggaaattttgaattaaatatgtggcttgcattatatttctactggacagtgctgcttgagatgataatcctggttgaaaatctatttgtcttttctgttcctctactaccagggcaacagggaggaagctgacaacccaaatacagggattggtgccttccgattcatgctggaatccaacaagggcaaatcaatgttggagttccaggtactttcccatgtacttccctggttctaataacatgggtcagcctgctactgtaatatataatggctcctactaattcctaactcattgatactggaaaagaaagaaggttgttacactatttttcaaaaataaataccttcctggctgggcatggtggctcaggcctgtaatcccagcactttgggaggctgaggcgggtggatcacttgaggccaggagtttgagacatggcaaagccccgtttctactaaaaatacaaaaattagctatgatggcacatgcctgtaatcccagctacttgggaggctgaagcacgagaattgcttgaacccaggaagcagaggttgcagtgagctgagattgcgccactacactccagcctgggtgacagagcaagactctgtctcaaataagtaagtaagtaagtaaataaataaataaataaataaataaataaataaataaatatttttcttccccaaaggcctatcagagttagtgatgagagatgcttctacaaatccattttgtaaaaggtttcccatgtaattctgatgcaacctcccaatataaaaatcactgtcctggtacttcctatcctcttcccccaggagctaatgacagtttttcaactgctacactggaatggcagccttaaggccatgagggaacgacaatgctctcggcaggtaagagattttatgagtgggggcgaatgaggggagcacaatctgtcagtggactcttttgaggtggttactatgttagaaataaggtctattgtgacctatggttgtgaatattgaaagccttacctaagtaccctcttcattcctataatctttcctgtgtaaatattagctgtgattcttttgtctatcttgcttcccgtagcaggaagtgcctttaagaatctccttgaagaacttaggtgctgacctcagttaggtctctaaagctgagttcttagtcccagttgggtcagtgtggtatgatatgaacctttaccttctcaatgatgttcacattcccctcccctactaggaggtgttggctcattattcgcaccgggccctggatgatgatattcgccaccaaatggccttggactgggtgagccgggagcagagtgtgccgggggcactgtctagagagctggcctctactgagcgggagctggatgaagcccgactggcaggcaaggagctgcgcttccacaaggagaagaaagatattcttgtgctggctgctgggcagttgggcaatatgcattcttccaactgctaggcatccacccacataactccccaggctttccacagcctttttttatgtctcctttctaagatttaggatgattttttgtacatactttctcatttttatactttaaaaaatatatatgtgtataaattctacacctagattcctatttgctaagagatcccttttcttactaccagtttttggatgtagttttatttgaaacatcttcagtccactttacaacaaagagcagcttgtctttgcagctttgttagctcttaaacttccagattaactgtgtagccatttcagtagcactaaaagattaactcta

SEQ ID NO: 1528 - DNA, 18880 bp, Homo sapiens
agggaaagtgaagaaaacagaaaaggagagggacagaggccagaggacttctcatactggacagaaaccgatcaggcatggaactccccttcgtcactcacctgttcttgcccctggtgttcctgacaggtgagggaagttaacttcttggtttctggtggggatggaagatacatagattgtttggaattgggaccattatagttaaaattctttgggatttaggttaggaagcgaacactggttgtacatttcttgtatgtgtgtctgtgtccttgtgcatttttatgccctcacatatgactgtttgaatattgagactggcaggggctaaagctgcctaggaccttgtgtaagatttgtatctaataattatataatatataattgtataattatatattatatataatatacatataatatataacaattatatattatatataatatacatataatatataacataattatatattatatataatatacatataatatgtaacataattatatattatatataatatacatataatatataacataattatatattatatataatatacatataatatataacataattattatatataatatacatataatatataacataattatatattatatagttatatattgtatataataattattattattttttaaagatagggtctcactttgttgtctaggctggagtgcagtggtgcaaccacagctcagtagttgggactactaggtacgcgccaccacgcacagctaatttttttttttgaaacagggtctcactctgtcattcaagctggagtgcagtggcatgatcatggctcactctagcctcaacctcccaggctgaggtgatccttccaccttagcctcccgagtagctgggactataggcgtgtgctaccacgcctggctaatttttttttttttagagacagagttttgctatgttggccaggctggtctttaactcctggactcaagcaatccgcccccgacagccacccaaagtgccgggattataggcatgagccaccatgcttggctgagatttgtatctaaatatataaaatcttcatcctaagccctataggggtaaggagacaaaaaagaaatgtgatgtgaccttccacgtggctagtctgattcctattatcccctccctaacttcttacccttggtggtccctggggcctgaggcataactgactaactatgtggtcagaactctgggtttatctaaccaatgagctgcagtttctggtcatacagccctgccagttttctggatgcaaaactgctcacatactaaacacctttctgaaaatgagcatggtttgggataaagctatagccattggtaatggtgagggggtagcctgagagggggttgcttagaagtacagagcaagacatagttggggaaaggaccatgggaaggacaagaggcctggaatttttccttggcagtgccctgtaatcattgtttcctaaaataccagctctgattttaaaggcattggggtcaaaagggaagattagctagggtcgggcacctttagaatgggctgaaggctgaggaaaccatggaggtaggtaggggaccagttgggagagtagattagttaaaaaggaagcaggttgtgggaaacttcaggatgatgggacccttggaaaggatggatggcaaactatgtgtgtgggcaggcgagtggccccacccagttaattaccactgagatttccaaggctggaatcaaccagggacctagacattggaaaaagacagtgagagtgtgacaatgacactggaagtcaggaagagatagagaaggagagagccagacatgcagtgctccttagcttcctttcattccccctattttggggagaattggaagcaatggttgttctggggatacagaaaggccctctccctcttttgaccctcacagtttgttgaggagagtgtgtggaaggaatgttgtggaaaagagtagccaggcgcggtggctcacgcctgtaatcccagcactttgggaggccgaggcgggcggatcatgaggtcaggagatcgagaccatcctggctaacacggtgaaactccgtctctactaaaaataagaaaaattagccgggcgaggtggcaggcgcctgtagtgccagctacacgggaggctgaggcaggagaatggcgtgaacccaggggggcggagcctgcagtaagccgagatcacgccactgcactccagcctgggcgacagagagactccgtctcaaaaaaaaaaaaaaaaaaaaaaaaaaaaaaagtaacttgaccttttcagacatgtctgtgaatgaaatttcaggggtgggaatggaaatacagctgtacatcagcatggcagagggccacagtttaggcatctggacacaaacacaggaagggaatcatctttgcctggagctctgagtacatgacactgagagaggccagaaaagcttatgagtgaaaaagcaggcaggcagactgagattaagacgcttcctcacagcttctctcgggctgtgcctctagccattcactacctcatactaacattatgatcctgaccccacaggtctctgctccccctttaacctggatgaacatcacccacgcctattcccagggccaccagaagctgaatttggatacagtgtcttacaacatgttgggggtggacagcgatggtgaggaagaaaccggagtgccaggggattgggactgcagtagtgctaacaaaggggaggcaagatagatgggactctaaactaatctggtcttttgaaagtggctggggctctaaacttaccacctccatgctctttccctttggcctatgtcaagggtcatgtttgccctgtgcttacttacattcacatcctcttcccaggatgctggtgggcgccccctgggatgggccttcaggcgaccggaggggggacgtttatcgctgccctgtagggggggcccacaatgccccatgtgccaagggccacttaggtgagaagatgcctgacccttctcctcctaacccctgactttgatactctagaagcttcaactccctatacctcagctttttcacccctaaaatccgcatactccctgtccccaatctgataccaatccctgctcattctcctccaaaatcacatgaattcaagcaccccatctatgaccccatgatctcattctcttccacctccttccaaccaggtgactaccaactgggaaattcatctcatcctgctgtgaatatgcacctggggatgtctctgttagagacagatggtgatgggggattcatggtgagctaaggagagggtggtggcagtgtctctgaaggtccataaaagaaaaaagagaagtgtggtaagggaaaatggtctgtgtggaggggtcaaggagttaaaaaccctagaaagcaaaaggtaggtaatgtcagggagtagtcttcatgcctccttcaactgggagcatgttctgagggtgccctcccaagcctgggagtaactatttcccccatccccaggcctgtgcccctctctggtctcgtgcttgtggcagctctgtcttcagttctgggatatgtgcccgtgtggatgcttcattccagcctcagggaagcctggcacccactgcccaacgtgagccagaggaaggctgagtacttggttcccagaaggagatactgggtgggaaaaagatggggcaaagcggtatgatgcctggcaaagggcctgcatggctatcctcattgctacctaatgtgcttgcaaaagctccatgtttcctaacagattcagactcctggccaggtgtggtggcccacacctgtaattctagcactttgggaggccaaggtgggcagatcacttgaggtcaggagttcaagaccagcctggccaacatggtgaaactccatctctactaaaaaaaaaaaatacaaaaattagctgggtgcgctagtgcatgcctgtaatctcatctactcgggaggctaagacaggagactctcacttcaacccaggaggtggaggttgcggtgagccaagattgtgcctctgcactctagcgtgggtgacagagtaagcgagactccatctcaaaaataataataataataattcagactccttatcaggagtccatgatctggcctggcacagtaactcatgcctgtaatcccaacattttgggaggccaacgcaggaggattgcttgaggtctggaggtttgagaccagcctgggcaacatagagagaccccatctctacaaaaataaaaaataaaaaaattagctgggtatggtggtgcatgcctgtggtcccagctactcaggaggccaaggtgggaggatcacttgagcccaggtggtccaggctgcagtgagccatgattatgccactacactccagcctgggcgacagagtgagactctgtctcaaaaacaaacaaaatgggccaggcgtggtggctcacgcctgtaatcccagcactttgggaggccgaggccagtggatcacgaggtcaggagatcgagaccatcctggctaacagagtaaaaccctgtctctgctaaaaacacaaaaaattagccgggtgtcgtggcgggcgcctgtagtcccagctactcgggaggctgaggcaggagaatggcgtgaacccaggaggcagagcttgcagtgagccgagattgcgccactgcactccagcctgggcaatagagcgagactctgtctcaaaaaaaaaaaaatgttctctacccacatgcctttcctaatattctcttctccttaaacattttcagtcttcatagttgctaccatgtttcattcctcaccatcagaaccactctgcttttgttcccccaccatacagtcattgctatgttcctacatagcatttaattccttcttgttttttagaacattgtatatataaattatatctatgtatataaatgtgtaggtgtgtgtgtttatatacctatatatacatatatacatatatatacatttatatgtatacttacatacacacaattactaaagattactaaaggaatattttattaatttctacacttacacagagcctggcacagtaccttctttgcatgtaagaagtgccttataaatgtctaaattgaatgtgtcctcctgtgacctctttcccttgttgcccccagctcagtgtcctctacctcagtgttccccttccttctaggctgcccaacatacatggatgttgtcattgtcttggatggctccaacagcatctacccctggtctgaagttcagaccttcctacgaagactggtagggaaactgtttattgacccagaacagatacaggtaagagaaggcaatatgagctgggcacagttgcttgtggcacctacttaagaggtggaggtgggaggatcccctgaggccaggagttcaagactagcctgggcaatacagtgagacctcatctctaaaaatatgaaagaaaaaaaaaatagccaggcatggtggcatgcgcctacagtcccagctactcaggaggctgaggcaagagatcagttgagcccaggagtttgaggctgtagtgagctttgatcacacaactgcactccagcctgggtgaaagagtgagacctcatttcttagagagagagagaaaggcaatatggatgggcttggaaggggagagacagagagagaggggataaatgtaggtgttgtcttcagtagtatccaggtgttcatctctcctctcttatatactttcttcttcctcctctccccccatctcacatacatacatttcatttgaatgcgctttattcccaggtgggactggtacagtatggggagagccctgtacatgagtggtccctgggagatttccgaacgaaggaagaagtggtgagagcagcaaagaacctcagtcggcgggagggacgagaaacaaagactgcccaagcaataatggtggcctggtgaggcattgggaagacaggtgtgggaggctagagcaatgaaggcttagaagagttagggcggggccaggcatggtggctcacgcctgtaatcccagcactttgggaggcaaggcaggcggatcacctgaggtcaggagttcgagaccagcctgaccaacatggagaaaccccatctctactaaaaatacaaaattagccaggcatggtggcgcatgcctgttcagaggcatgctacttcggaggctgaggcaggagaatcacttaatcccgggaggtggaggttgcagtgagtcgagatcacaacattgcactccagcctgggcaacgagagcaaaactccatctaaaataaaataaaataaaatgaaatgaaaatctttcccttaaaaaaaaaaaaagaagaagaagaagagttagggcaggtttggagtgcagtgtgtatatcccaagatgtcttgcatactttctttgtatgtacactaatggtacaaagaggaaggctaagtgggctgtcattgtactccctctcactgcatttctacaaagtatctatgtctgtgtctctccatatttcacagacagaagtctctttctatccctccactccaacaatgatcctggcccacaggttctccactactgatgtcctagcccacgttccaaacatgatccaaaactcatctctaggggcacggtggtaaaattgaaacaaaacaaaacaactcatctctgggaggagtccctgcccagatcattcttttccgttctatatttcatcgatatttcccctcccaagtgcaatatttgttgaatgaatctgagtgtatgaacgttgtacttatttggactgataagctactctgtatgttctatgaccttcaaacatttgagctctcactccatgccatctccatgttaaatactcaggaaatggcctaaaaggcaagatgcttgacctcagggaagtgctgatgttaaatcctgtgtgtgtgtgtgtgtgtgtgtgtgtgtgtgtgtgtgtgtatgtgtgtgtgtgtgtgtgtgtctgcatacatctgatctcacctcactcctttctcttctcagcacagaagggttcagtcagtcccatgggggccgacccgaggctgccaggctactggtggttgtcactgatggagagtcccatgatggagaggagcttcctgcagcactaaaggcctgtgaggctggaagagtgacacgctatgggattgcagtgagaattcaccctggatctggaagagttggggagtggcaggggggcagtgtcttgtgaactgtccaaggactgggaacttgaggaaaacaagggcattaactacttcccagacttcagccacagcatgttagttggctgtgttctgtaccaactctaatgcctcattccttgatcttatgacctcttaggtccttggtcactacctccggcggcagcgagatcccagctctttcctgagagaaattagaactattgccagtgatccagatgagcgattctttttcaatgtcacagatgaggctgctctgactgacattgtggatgcactaggagatcggatttttggccttgaaggtgaggattactctggagaaatggacagggcgggagaagttctggagtgtaggtggggctctggagtgagttcagtaggtcaaaggggaaactgtcttcccctgatattgtctcaatgttttctcatgaccaagggtcccatgcagaaaacgaaagctcctttgggctggaaatgtctcagattggtttctccactcatcggctaaaggttggacagattgaccccttcattacttctcccattctctgactcagataacttcaaccacagggccctccagattcctcctttaaccagcctccatgctcaccttcccatgcctttccaactgagcccagcagaccctcagtgatcttttcactcctggaacgttttttttctctttattccccactgtcttctcagtgaccccatctgcttctgtcccacaggatgggattctttttgggatggtgggggcctatgactggggaggctctgtgctatggcttgaaggaggccaccgccttttccccccacgaatggcactggaagacgagttcccccctgcattgcagaaccatgcagcctacctgggtgagcagcagagagttgcagaggacttacagggtaggggaggaaatacatccctagtgggggcgggtatgaaatactccctcttaactcatgcggtttctcactgacctctggttacttcccttgggacctcctgctatgcctttagggaacccccctactctggaccccatcttcttttcctttacctctgttactttgcccacttctaggttactctgtttcttccatgcttttgcggggtggacgccgcctgtttctctctggggctcctcgatttagacatcgaggaaaagtcatcgccttccagcttaagaaagatggggctgtgagggttgcccagagcctccagggggagcaggtagggcatccaaggaagggtgggacctttggattcccagggacctctgggctgttggggaggagtgtgaagtgggtaagagagaggcctccaaagtctgtgcggaattctggttggcagagtctgtcagggatgtaaggagcagactagcaggctggtgagtgcttcccactgagtccacttgtctacagttaccttcccttttctctggggtcatcatcacccaccattccccagattggttcatactttggcagtgagctctgcccattggatacagatagggatggaacaactgatgtcttacttgtggctgcccccatgttcctgggaccccagaacaaggaaacaggacgtgtttatgtgtatctggtaggccaggtgagacttgctgggaccccctgccctggacttgcattgtgggggtggagggaggaaaggagggaaggtgcacatatttgagggtttgctgagaggttgggtctgccagattagcatcttctatcttctctcctccaccagcagtccttgctgaccctccaaggaacacttcagccagaacccccccaggatgctcggtttggctttgccatgggagctcttcctgatctgaaccaagatggttttgctgatgtggctgtgggggcgcctctggaagatgggcaccagggagcactgtacctgtaccatggaacccagagtggagtcaggccccatcctgcccaggtcaggagtacccaaataaagcaggggcacggttgtaggaagaggaatagggggatgctctttgcttgtcaatagtctccttggcttgagacccaaactgaacaagtgcttttattagtaggcaaaaacataaggcagtggacaggttgctgaactaagaactcctgaacacaggcaagtttctcttattcccaggactgacgggagcattataaagagcaaggcatggccgggtgtggtggttcacgcctgtaatcccagcactttggaaggctgaggcaggcagatcacctgaggtcaggagttcgagaccagcctggccaacatgatgaaactctactaaaaatacaaaaaattagccgggcctggtggcgcacacctataatcccagttactcaggaggctagggcaggagaatcgcttgaacctgggaggcggaggttgcagtgagccaagatcacaccattgcactccagcctgggcaacaagagtgaaactccatctcaaaaataaataaataaataaaaagaaagagcaaggcaggaggcctgagaaactaggtgtatgggtccctgcctcagtattctctctcttcctctcagaggattgctgctgcctccatgccacatgccctcagctactttggccgaagtgtggatggtcggctagatctggatggagatgatctggtcgatgtggctgtgggtgcccagggggcagccatcctgctcaggtgaggggtcccagctcaggtggtggtggacagcatagcatagctgttaaaggcaagggccttaaagtcacagatggagatttggttttcttggtcaacttactctgtgcctccattcttagtttataaaatgacagtagtaatagtacctaccttataggtttattgtgaagattaaatgagataatccatataatgatttgaacacagtgcctagcatgtaagtgcgtattgaagtgaatctagggctgggtacagtggctcacacctgtaatcccagcactttgggaggcgaaggtaggaggatcatttgaggccaggagttcaagaacagcctgaccaacatggtgaaaccccgtctctactaaaaatacaaaaaaattagctgagcatggttgtgggcaccagtaatcccagctactcgggaggctgaggcaggagaatcacttgaacccaggaggcagaggttgcagtgagctgagatcgccccactgcactccagcgtgggccacagagtgaaactccatctcaaaaaaaaaaaaagatcaatgacatgaatctattatcttacttctgtcagagggttcggggtagggtgacatgtgcattcagcccctccttctttgttttgaccatggggaagcaaacactgggcttgcacttctcagagggcttacctcctactgctagaatttcttttccacactgttcccagctcccggcccattgtccatctgaccccatcactggaggtgaccccacaggccatcagtgtggttcagagggactgtaggcggcgaggccaagaggcagtctgtctgactgcagccctttgcttccaagtgacctcccgtactcctggtcgctgggatcaccaattctgtgagtgactaaaatgcattacaggcaactctcaattccttgcatgccttcctcactagacccctttccaccctcactcttgcctccttcattcagacatgaggttcaccgcatcactggatgaatggactgctggggcacgtgcagcatttgatggctctggccagaggttgtcccctcggaggctccggctcagtgtggggaatgtcacttgtgagcagctacacttccatgtgctggtaaggagagggcagtaactgcttagcatcagggcctgagaatgaggagaaagctgggtcagaggaggaattttagctgaatcagcaagaaagccaaagccgggaaaatgagatgattcagactttggagtcagggctgatctgggtttgaatcctagctctgccatttaccacctatgaattctggcaagtccaaccctcagttttcttgtctgcaaaggggtgataataataactgtatcataggagttgtattaaaattaaatttagccgggcgcagtggctcacgcttgtaatcccagcactttgggaggccgaggcaggtggatcacaaggtcaggagatcgagaccatcctggctaacatggtgaaaccccatctgtactaaaaatacaaaaaattagccgggcgtggtggcaggtgcctgtagtcccagctactcgggaggctgaggcaggagaatggcctgaacccaggaggcagagcttgcagtgagccgagatcatgccactgcactccagcctgggcgacagagcgagactctgtctcaaaaataaataaataaataaataaattaactaattaattaaatttagtaatacagttaagatcttaggacagtgcccagcacacagaaaatgcttcataaatgatcactacaattatcacaagatccttgactctgtgactctgtgactctgttttccttcaggatacatcagattacctccggccagtggccttgactgtgacctttgccttggacaatactacaaagccagggcctgtgctgaatgagggctcacccacctctatacaaaagctggtcagcagtgccatgccctgccccttgctcccaacactgccctccttcaagagaaaagggagggagggagaagacatgagatcatggtgaaatctgacctgggctcctctaatcaaaatatacccacttttgtcttttcactttccccctattctattcctttcctccttgctttcctctcaacccttagccccttccctttcttccaggtccccttctcaaaggattgtggccctgacaatgaatgtgtcacagacctggtgcttcaagtgaatatggacatcagaggctccaggttggatggacatgtactaggcaaaccagggtgacctgagacagactggaagggactcgaagggcgggtagggggttgtttcttacccatgataacaaaagtgagacttttggcactcccctccttcaactcctggtctctccctcattcatcattcccaggaaggccccatttgtggttcgaggtggccggcggaaagtgctggtatctacaactctggagaacagaaaggaaaatgcttacaatacgagcctgagtctcatcttctctagaaacctccacctggccagtctcactcctcaggtgcctttggaggagggggtgtgggagaaggaaagaaaggaggaggaagaagattggggtattggcctcagctgtgaggtcctctagagaaaggctcagtgtttagaggctgtgggtaggacagcagttgcagccccagctccagcttctatctccattcccctgccctcagagagagagcccaataaaggtggaatgtgccgccccttctgctcatgcccggctctgcagtgtggggcatcctgtcttccagactggagccaaggtgggttggggtctaggatgaaaagagggctctaggagggcagaggctgggatctgagggtcctgggacttcagggaagggggcgcacaagggctcctgttcctctgtagttgttccatgaggaagactctaccattaccctgtgtcccctgcccctaggtgacctttctgctagagtttgagtttagctgctcctctctcctgagccaggtcttcgtgaagctgactgccagcaggtgagaatgaagggaactttcttccagacctctcctcctactgagtcttgactggaggggtggggaggaacaacattgattcctctattaacagagaagggtgtcttctgaggaggggttgagatgtgagcctctcccctctgaccctacagtgacagcctggagagaaatgggacccttcaagataacacagcccagacctcagcctacatccaatatgagccccacctcctgttctctaggtatgcccagcttctagggtgggacccagttctgacctcagactcatacccttatgctgcttccctccccttccatgtgcctcagtttttccaaaaacccaagcccttgcggctgctcagtctttttgccctcaatcctattcatgctgaatcttcccttttaagcatcttactttcctaggtatagtgttttgccaggccttgggcactggagctgggatgaggggatatgggatgtagccataaagcttgcattgtctgtgtcatgttctacttctgtcttctccatgtacccccacctctttatccatgtgctggccctgcctcctctgaatccacgtctgtgtgctgatcatatgcccctgtgtctgtgttatggctgtgaccatgtacttcctgacttggtgttcacacagtgagtctaccctgcaccgctatgaggttcacccatatgggaccctcccagtgggtcctggcccagaattcaaaaccactctcagggtgagaagctggaggggtcttggcatgaggagaatgtgggggaacaacagctttgtgggaaaaggatgggaagggtctctcttggattttaatggtatctagggtgaaggggaacaaatgaggaagggtcttctgtctcccacttcttcctattcccaaccttcctcttaggttcagaacctaggctgctatgtggtcagtggcctcatcatctcagccctccttccagctgtggcccatgggggcaattacttcctatcactgtctcaagtcatcactaacaatgtgagtctggtctaggagggcatggaatcctgccaccttgagctggtggactcactgaagctggacaccacaccagctccctatctgttgggcctctgctcttggggctcttctctctggggggctttctttttacacatgtggcttattagagagaagaaaaaggtattataaggggaagaactacaagggtgtaggtatgttccaactcagccttgagtggctagcgccaccccatcaggagggtctttcaagttggatcttcctctaggcaagctgcatagtgcagaacctgactgaacccccaggcccacctgtgcatccagaggagcttcaacacacaaacagactggtatgagtcacaaaggggtgtccagagtgggaatgcaagtggagttgggtgacttgggacaagagggtaggaactggagtggggaagaagggatctttccaccccagggtcctgatctggagtgggaatgaaaatggagtcaggtgccttgggacaagactgtgtgaactagaggtggggaaagaggatgtttctaccccagagtcctgatctgtctctctctgtctcttctgttagaatgggagcaatactcagtgtcaggtggtgaggtgccaccttgggcagctggcaaaggggactgaggtctctgttggactattgaggctggttcacaatgaatttttccgaagagtaagcctttccttttctagtactccccacttctgctcctttctggaactttagcataggttttggaggtagacagacccacgttcaagtttcacttttgcctcttactagctatttgaccatgagcaagttatttcatctctctaagcctctttttcctaatctctaaaatgggaagataataccaatttcatggggttgttataaagaataaatgaataatgagctggacatatggtgaacactcagtggaagctagttattatccttgtattttcctccactgaccattacttttttttttcctgaccattccttagtgctgtatcaatcaacatttgcaggatacctaaatttaatcagttaagaatccatcacgttcctattacgtaaaaggccctgtattaggttgacactgagaatatctccaacatttagcctcatgcctaactcattgtaggcgcttaacatatttttgctaaatgaatgaattattgatattacatgcaggatttgtactggggagtggtgggaagtaagattgtataggtgagagggatctagattacgaaaggcctctgaagccagggagaaactgaacttaatatgacaggtagtgaggagtcagtgtgagttcctcctgggcagggaaatggcatcttaattgtaatggctgtttggcactaaggtcaatgttgtgctttcccatatctacctggaataacacaagatccctgggatgtcatcatatgttttagggaagttaagtccaataaaccacccttctccaagtctctgtccttctttggtatctttttttcactagtctattcatgctttcaacaaagatttattaagaaaccactacatggccgggcgcggtggctcacgcctgtaatccctgcactttgggaggccaaggtgggcagatcatgagatcaggagatcgagaccatcctggctaacacggtgaaaccctgtctctattaaaaataaaaaaattagccaggtgtggtggcaggcgcctatagtcccagctacttgggaggttgaggcaggagaatggcattaacccgagagatggagtttgcagtgagccgagatcacgccactgcactccagcctgggtgacagagcgagactccatctcaaaaaaaaaaaaaagaaaccactacatacttggtactctgctatctagtaggcactaaggacacaaaggttagtaaggcacagcctttaacctagaggatcttatagttcaggagtgaaaaacagaagtaaacaccagtgttggtgggggttaggaggaatgatttccctaaatcccagaggggatgacatctaaacttcaatctaaaggaggggtagaggtcagccaaaggaaagaggagtagaatgcatttcaggtaaagcaccagatgtattgattgtccttggaaaacaaacagcagcagcagatgtgaccaggggttttccatctattacccttcctctcttttcccattggtcttcagccttttcttctggtcttgagagccctcaacattatgcctctcagcctcaactttgctgttgggattccaaagaactatatcacctgataatggctcattttaaatgtcttcctatccacttgttccataggccaagttcaagtccctgacggtggtcagcacctttgagctgggaaccgaagagggcagtgtcctacagctgactgaagcctcccgttggagtgaggtagggctggagaccgagtctgagagctgtgaaaataatgatgatgggtatgtggtagggccacccgtgggctttttcagaacgaaggcatctccatcaggcagcaggatcctagtgttccactgccgccattcctgcctcagtttctttcctttaagtagcaggaggttatttattctatttgggggctggctttgatataatgtggggtgaggctagctgggttataggatgcatgtagaaaactactcttctgtccacgcagagcctcttggaggtggttcagacccggcctatcctcatctccctgtggatcctcataggcagtgtcctgggagggttgctcctgcttgctctccttgtcttctgcctgtggaaggtaagcactgctttagtggggagtgtggagcatgatgcccatgagttgagggatccttgattatagcagagagaacaggatttgtgctgggcagctaaccaggctgtggatgtcatgcccagatctccttcactgtaccccacaaatgttggttaaattattctaagccaaataaaataaatttgaattccatttttggaaacagaacaaaagtgaagacctcagataagtctgagagctactggcaaggttcccagtctaggcatttggcagtgacgcttatcttttcttctacagcttggcttctttgcccataagaaaatccctgaggaagaaaaaagagaagagaagttggagcaatgaatgtagaataagggtctagaaagtcctccctggcagcttcttcaagagacttgcataaaagcagaggtttgggggctcagatgggacaagaagccgcctctggactatctccccagaccagcagcctgacttgacttttgagtcctagggatgctgctggctagagatgaggctttacctcagacaagaagagctggcaccaaaactagccatgctcccaccctctgcttccctcctcctcgtgatcctggttccatagccaacactggggcttttgtttggggtccttttatccccaggaatcaataatttttttgcctaggtgcctgactcctttcagattccctctttatcttccctcacagtttggaaaggatgagggttatcttcctcgattcttccaccctctcactttcctgcctgttccccactccacaggagggagctgacgttggcttgaaaggagtaaagtcaacatctgctgctttcctgtggactctggtgattcatagagccggatggggagagtcaacaggaaaaaaggagggaggaggaaaagccacaagagacattctgtacaattccaaggaacagagaagcctttagacaggcaactgccatcccccctgaaacctgagacctgtagtgcactcgaccgccctcaggtgttggtgaaacagagctgcccccaggctcgctgggcataggcttcctgattccaagccttttctgggagcaaagccagggcctggtgcctgattttctgaagccaggagccctcaggtggctggagctggaatagcagggaggactgggtgtacctaggcagtattttctctacttctctcaagtcttatactcactcttgagccctccttggggcctgcttagaaagcagacaggagagagagtactgctacttgatgatgggaaatgctttcactttaccagctttgggaagcagcagccccatgggatctaaaagtgtggagtctgcattaagaaacctacatgggtggcatggggctctggggagcaagcccttacttgctcagcactggttatgtagcacaaatagctcctaggaaaatgtttctggggcaaccctagaaccctggtcatattttgcagggtttctctggtggaatcagtttgccagcccttgcttgatgcttactggaaatctccaggttaatttctatctctgatccctccccaacccactccatatttgggtcatggacagtaaaggcagttggattctcatagacaactgggtaacttatatttctttgtaatcaagacttgagatatcgaagtcagttattggtctccagagtgcagctctgggagccttttgaagaatcagcactcattaagagctgagaagagagaagacctgattgggtggttgactagcagtcacagaacctgtcctcccaggctgttcctgaggcctgaccacagtatttattttggcatgtctctggccttctgcagaggcccaccctcatgggcattgtctctgtttcccagtggggtggacagtatatcagatggtcagaacaaataaagttcagtgtcaaatga

SEQ ID NO: 1529 - DNA, 19769 bp, Homo sapiens
tcttacccctttattcatgtagttcctcctatcaggaatatcctgcccactctctgcttaactatgacaagaggtcatctgtccaaagagaaagaagagagtttgtggatttaggagaaaagaaaatactccaaatactgctatgggcatttatttaaaaagagaaatgaccaaagaggttaacaagtatttagatgaagctgggcagttgtagtctgtggtgctcttggtctgcacaaatcttcctcttcctccagcagtgctgtatggatgttgttgaatgttgaggtctgtctgcattttctcattttcatgccaagtcaatcactggatctggctgtcttcctttctgtcctacctatctttgcttgttttctctctctttcctttgcagtgttaaataaaaatttattcccccaaaatttggtgttctcattttgtttgacttattttactatgttgatgaagagggaggaaaagtttttctggggtacaaaaacgcatatatttatccgatatttgaggactatactacccactttggtgaaagctgttctgtttatttactggagcttaggagggaagaaggcaagtttgccctgatggtgaggagcaaagtcaaggattacactgatttgccccagcttatatttccacagattcttggtatatttagcatctcttcccctgtgccctgttgcattcttctctgtgcctattgtaatgagaaagatactaagccatagtcagactcatcttgctgtagctgttttaaaagtttcttttggcacaaggcttacaaagctgtggaaagaaagtttgtattactgccttataacttagaatagcaacaaaatacctgatataatgaagtctcacctgtcctgagatgcgtgcgtgataggccctcatgactgtaaagggattggaaaaggaaagtgggaactattttatgtattgcatcttattactaaattagggttgtaatcttgagcaaatctgattctggtgggagtgggaagggggctagcctttgatcgctccttgctggaaggaacaatcaaagaagcaatagatgccactcaaaaagttgaaggtaggttttccacgtatagctctgaattgttggcacagtggtaagacaaggatattcactgaaactagttcatgagctgagagaggcacagaggtccaggaaactccctcctccttttccccacatgtaagcatgataacttgacctatgtggtgtttctggacctgaaaaagcatgtgtactattctactgaatactacctctttcaataattctactaagccttgagttggggaagaaggataaagaaaagaaagcttctaagtagtgtatattttctcgtttaatcaaatattgagctttggttttttcctttggttaactttaaagctacttgaattgaatataggagaaaacaaaaaattggattcaaaagctcattctcttcacctgagtggaaaaggaaaaaaaggccagagatgattttttttttttttttttttgctctaggatgacttgggaatcaaagatagtaactagtagtaggttgtatggctagactcaatttcccctttataatttttattctaaaataaaatttattttactggttacagtggcctaaccaagggaatttaaagtcaacaaaaaattatgtctaaaggtcagactgtttcatattcatgtttcctcctgaaaactggcataggcttaaatttggaagatccttaccaaggattacagataaggtctctgttttctttttgaaatctctgttttcttttgatgacttgcaaataagggactggaatagggaatgtttaggtggtcctgtttctggaaaggggaggagtcaatctcagaatgaatggggtggtgaaggatgtaagaggtgctttgcatatagtagatcattactgagtgtaaggttttagagtgagaaggatctgtattaattgctgtgacaggcaacaattaactctttttttttttttttttcctttgagaaagtgtctcaccctgtcacccaggctggagtacagtggcatgatcatggctcactgcaacctcaaccagcctgggctcaggtgatcctcatgccttagcttgggactacagttgtgtgccaccatgcctaatttttgtatttttttgtatagttggggttttgccatgttgcccagactggcctcaaactcctaggctcaaaggatctgcctgccttggcctcccaaagtgctgggattacaggcgtgagccaccgcaccaggccctatttaacttccttgtgtctgtttcctgatgagtaaccaggggatgtttgcttgcaagggttgtataaggttagaatcatcatgtgtaaagcatctgattcatcatacaggttttttaacaaatttattaagagcctgccatatgtgtgggacttttcgttggggtaaagaagacaaagtccttacatatatatagagcttacattctgatgccattcaaaacagtggtagttattgatttgaggaatgcctaaataaaatggagttaagaatgccaaggccaggcaaaaacctgaatcagttgcttgttatgcaaaaacgttatgacaaattattggaagtttcactttttgttatctaatagggaaaacgctaatctatattggtaaatggttttcagaggactcagctacatgtgtttaatatactcaatctggccatcagcctttgctgaggagccgcattgttcaaaacccatctccaaaccaagtctgtctcttgccttttcttcctctaatagctgaaaatctgttgcttcaacttgtagccctctgttcatgcagtgagtagaggtagttgtactaacttgcctctctcacaggccttcattcctaatgagtcttacctcctacccattgaaaagtctgatttatctgtcttcctccttagtgcctttggatcagtgaaactggtttgaactttcctgtggatagccagggcttgagtaacatttttctctccccctggacatcctttccaaccttctcctcctggagaataaccaaggtggcagaaatataatagcaccctcattgcttggggtgcttacggctcttttggacataccttgaagggccacaaggctggtgaccagcattacccagaccttttcttgtaggaagcctgaactgagagtgccttcattatggctgaactcaaggtgttgtctttgtttcaatcccgtcactgtgtagttccctgtctctggttcaaaagagaatcatggatcaggggagggtttcagaaatcatcagtatctccttttgcatcatctcataacatctcttttatgatctccaaggattcctccctctgtaattcgttgcccaaataagtatttttaacattgtgggtaatgatgatgtacttaggcagccataaataagtatagaatctcctgtgtgtcagacactagggatgcagatagatcttaaagtaattctaaagttttgccacagagatagctgaaacagcttagtcgccttggacttgggtatccccaaatagccccattttctagagtggttcaagcaatctagcataagttaaaatcttgcccttttggaatagatctgggttttttttgtttgtttgtttgttttgtttttgtttttttgagacagggtcttgctctgtcatccaggctagagtacagtggcatgatcatgggtcactgcagcctcatgccccgagcccaatcgatcctcccacctcagcttccctagtagctgggactacaggcatgtgccaccacgcccagccaatttttgtattttttgtagagacaggttttcactgtgttgcccaggctggtctcgaactcctgggttcaagtgatgcacctgccttggcctccctaagtgctggggttacaggcatgagacactgcacctggactagatctggatttttatccatcatttactgttggatgaacataaattatcttcaagcttgagttatcacaggacaatagctcaaaagaccatggagattaaataatataatatcacttagcacaatgcctggcccacagtaagcactcagtaaatggcagacattgttttttattttattttattatttctttttttgagacagagtctggctctgtcgcccaggctcgagtgcagtggcgcaatctcggctcactgcaacctctgcttcccgggttcaagtgattctcctgcctcagcctcccaagtagctgggattacaggtgcgtgctaccacactcggctattttttgtatttttagtagagacagggtttcaccatgttggccaggcttgtctcgaactcctgatctcaaatgatctgccagcctcagcctcctgaagtgctgggattacaggcgtgagccaccacccaccctgacattgtttattacctgtctcttcttaactagttttaccttccaaaatgcacctaatttccacacttggggaaccatctagatgtgctgactctaatacttaaatatgctgagaagatgagaaaagcattcttccttagggagaatcttcacaactaaaacaatatattaggagaacaggatttaggttataaggagcaaggactgtgttatacctcattctgttctccaaggcatagcgctgggcctgggatgcacaatacatatttgttagatgaatgaaagaggagtatccactagtgcagtttaactgaagcaatgtattcacataaatagaatgaaatgctatagagtctctagtgccaggctaatgtaatttagactttattccatagacagtgagaagccattaaaactttgagtgatgtggcatgtacaaattagcattttggaaagacaagctggtggtagtatgtagaatggattggaggcagaaacagtatttagagttgctggaccattaggcaacagctcagtgctaggccctgtggtaggtgtgggagatacaaaggtgactagggcacagttgctgaactcaagggactcactagttaggagactataggaatatgttaagtgtgaggtgatgaagacctgaaaaacacctttggaaggaaaggaataacaaagtactgctattcttccccactaagtactgctgtgcggaagaacagcagtacttagtaactctctgaattgggggttaagaaaaaaggaggaaccaaagttgactccgtcatgaacagaaatagggtctcaggaggatagctttgatactgagtttgaggaaatggtgggacatccaggagctaggagtacagtttttagtttaaacgtttaattaaaacttaggaaaggtgttcaagctggagaagttgatttgctggtcagttgcagggagatgctggtttaaatcgtgggtagatgagaactagggagagagagtaaagagaaaaggttgaaggggtgagaagtgagtcttggggaatactcatgtttgagaggtgggaggaggaaatagagaagacaaaagaacagccaggtgggtagaacagccaggggagtacagtcacagaagccactggagatgacagtttgatgaaggagggaatagtcagaagtgctgaatgctatagctaggtcagacaggaagacaccaggaagcaaggaacaaagtcagtcaaactaaacaagttgaaaatttgaattaactaggaaccataggaggtgattagaaacatttgttcaaaggctctgggccagtttttcatggggggagggtggtgagtgggtaatttatacttgtttttcttaaaaagtaagataggccaggcacggtggctcacacctgtaatcccagcactttggctaggctgaggcggatagatcacctgaggtcaggagtttgagaccagcctggccgtcatggcaaaaccccgtctcaactaaaaatacaaaaaaaattagttggatgggtggtggcgtgtgcctgtagtcccagctatttgggcggctgaggcaggagaatcacttgaaccttggaggtggaggttgcagtgagcagagatcacgccactgctctccagcccggaccacagagtgagagtctgtctcaaaaaatcaaagaaaaagaaaaaaaaaagtaagatagttgtaagttcatggagaagtaagatagttgtaaaagttcatagagaataatagcagtgcccttttgtcctcctaggcttattgtctgagacaaccactgtcaactcttcgagatgtcttattatattcctaaataatatgctcatattgctgcttcctagtgataaaatttagacattttctattggctttctgctacagtagatgaagatgtgctagaatatagtagatgaggattatactttcacccattttccttctctgcattcttctaaaaataattgtaccacaaattttatttaaattagtcatgtttacataatttggattctgtgttattttttgcaaaatcaagttgtgcgctatgtttcttttgtaaaatttagttttttctagagcctgattttatttttttactggcagagttttccatatccatttctttaatctttttattgggtctttaatgggcctttagaaagatgatatgtcgattccatttttacctcctagagatctcccttccagagtcgtctttctcttgctctcttctggactaactgcccttttttaattctagaatttccttttttttttcttttccactagagatggtgtctccctgtgttgcccaggcttatctctaactcctgggctcaagtgatcctcccaccttggcctccaaaagtgctggcatgagccactgtgtccagcctagaacttccttgttagactccttgtttcctgtatgtcattttatcccctttatggattcactttcttgttttactgaagcacatcctctggtagcttctttgaaaagatcacatggaaggcaaatttttttgagtcattgcatctcatgatagtgtcttttttctttccttacatttggtttatagtttggctgaatatataattctaggtaaattttttttttcccacagaattttgaaggcttgctctattgtctaggaatatagttacacagagagacactttctgttgggcacaatttgacttaaggaagccacttaaagctggggctggagtggccatatttaggatatgccaaagtagtaatggagcagggggagcatgcatagagtgaaagacagatgcagaagccagaggccttgctgcttcacagtttgaaacggtaactgttttgcgtcctgtcccctttctagtttctgattccaggagctagaactcatgagggccagctgtacttttttattttttcctcctttaatctatggtactttgaattggtttctgtttcctccaactaaatgctccttaagacagacacccatattatctcaaacctaatctcgttgtctgcctgaatttagaaatatagccacatttctgggagagttctgaattgggaatcaggaggcctaatttctttcttttcttttcttgttttttatttttttgagacacagtttcgctctagttgcccaagatagagtgcaatggcacaatctcggctcactgcaacctccgcctcccaggttcaagcgattctcttgccttagcctcctgagtagctgggattacaggcatgcgccaccacacccggctaattttgtatttttagtagagacagggtttctccatgttggctaggctgatctttaactcctgacctcgggtgatctgcctacctcagcctcccaaaatgctgggattacaggcatgagccaccatgcctggccaggaagcctaatttctatctgtttttactttcaccagtgagtagcactggacaagtctcttcaacccctgtgtcaccatctccctgtcagtaaaaatgcaatggccaccccaagtaagagttctaaaattaaagacaaaatgagattatgtttgtgtgtgcgctttgaagaaaggcagcatctgccaatggggatgttggaaaaggattgaggaagaaggaaactgcctttccaggacctgaactatctggttacatctccactgtcaaccctgctcactgtcccacctggtggcattaggagtatttgagcactcacctgtgaatagaatggagaaaaaatggccctgaaggcggatacctgacttctggcttctggcacaacactggtaggtcccactgtgcaacggtgtgacttggcttatggtgaacatcaactgagatgatatttcaccaacaccatctatcccaggatcccttttaagtctcagctgttttaaactggtctcaggagaacagtctccagacctgtccttgcacaaaaacactacaaacccctcagcctcttctttcttatgccatacagtacagattaagtttagtcgcgttccttcctgggaagctgagctggtgatgttaatgcatcctggaatggaaagggaagaattacccagaggtcaggtagcattctgtgaatttcaccgtaactgctccttatcactagaagtcttcaaggaaggactgaagcagaacctggcagtagtgctggcagacaggaaatacaaattccagctctatcgatggctgtgtgactgtaagcaagttacctaactccttgggcagtagtttattcatctggaaaatgaaaattaagggactaaataatatgctcaaagcatccattaattcataggtttatttgttcctccacttaacaaatatgtttaggtattcactctgccaagccctgctggggctgtgaggactaggacgtgagccctactgtcagaacttttttttcccctaaccattagatgaccggggatttttaatttaaaaaatttttttttaaaacaaggtcttgctgtgtcacccaggctggagggcagtggcacaatcgtaactcactgcacctttgaactcctgggctcaagcaatcctcctgcttccgccttccgaatagctaacactacaggtatgcaccactatgcctggctaattttttattttgtagagacagattctcactatgttgtccaggctagtcttgaactctaggcatcaagcaaccctcctgcctctgcctcccaaactgctgggattacaggcatgaaccactgtgcctggccactctcagagtttaaagcctaatgtaaaaacaaattagcaaaaagttacaatttaattccacagttattataattgaggaatcttagagattcctgagtctgaagcatcagggaaacttcacagtgaagttagtgctggagctgacttgaaggatgagtaaaagtttttctaagaaatataggatgagagagaccacagaaataccagagatgattaaaaacagccactgtgtggaaatggagtgagaatggactggagaaacagactaattattgagggaccattgatatccaaagaccatgactctgatggtgccagtctgcccacttgattttccctgtaagtaatctgtaacctggatacagaagtggagaaaatagttgggttaacccaggatgttttggctcgatgggtgtctctgacctaattttgcaatgcattggccctgccaactttgtactgcccctcactctcctcaaacttcacttccttctgtagtttatattttgtagtccattattaataatctctcccttatatccaccctcagctcccttagctttactcctactgtgatggatcctcgcaaaaccccaacctcggttaaatccagctctctgctgaaaactcatccggcagatgctgaggctgccagccccctcccccactcccttggcagcttgatccgctatgacttgcttttccttttaagactccccttggtatacatagtaaactaaattcactctcatgaaaacggtgaagaggcagagatggaggctgccccctgcatattgaatgccattctcctacaagagtaagagatatgggtcttccaagacccatatctgagggagacctgcaatcccagccattgattaactccaaaatggtttatattttatttctactttccagctggaacttctatagggtctctgttagagtgcttttctgtatatcaaatcctcagtatagccatagagggcaggtattactcttcccattttataaatacacaaattgaggcacagagtggttaaactagctgctgaagttaatgaagattgcagtatctggatctcaaacctggatttcataaatttatagtatataagagcctaaaggaatcttaggttgaggcgcagattgccaggctctttgaaacatatagcagagacagagtgtctgatagagaggcaatagtatcagttctaatgaaaaagaaaaagacaatatattcttcaccctttccttaatgtcaaggagagtgagtcagccgggcgcctgaggatcacctgaggtcaggcagagttcgaggccagcctgaccaatatggtgaaaccccgtctctactaaaaatacaaaaattagccggcggtggcggcataagcctgtagtcccagctactcgggaagctgagccagcagaattgcttgaacatgggaggcggaggttgcagtgagccgagatcgcgccactgcactccagcctgggtgacagagcgagactccctcaaaaaaaaaaaaaaaaaaaagagtcctttgtttccccactagagaaaatcacgggatccagcccttcccacaagcccaggatcctccccatggccgtctctgctctagggtctatcctcaccaccagactggatgtccacaattgccagcaggatggccagggcacagcagcctctgccgggttccaacagcatcctgcacgctgtcagcaggcccaggaacttgaagcaaatgttggctctgctggtatccttggcttcagtctcctaaaagcacagggggacccactagacaaagccttccagggttccaagaccatttccccatcccaggctctagctttgattggctagagtatgatggaggtagaggagggcttgggcatgagagtccagctggctgggaagtgaggcggtaaaccaagtgagatacactgggagccggggagggaggggcatagggagacactaaaggctattttctcatatatatatttttaagttaaattggattgctgcgtcaaagaatatgatgattaaaactttttttctactataatcagattgctctccaaaaaggctgttgataatcagatgttcaccaagaatgcttgatagtgtacatttcctcgtgcccttgctagctctgggtattatctgtactttaacatttttgccaatctgatggatgaaaaattagacctgctttatgttgcatttccatgattagtgaagttgaggatcttttcatatgcttattggtcattagtattcccttgtctgtgaattgtgtgttcatattcttcacatttcttaacttttaggcactttctccgtattagagatattaacccatctgccatttttttaggcaaatactttctcccaatttgttgtttgtctcttcactttttttatgaggcttttttttcacaaggaaagtttacattgtatgtaattaaatacaacatatctatcttttcctttaagttgtctgggtttcctgcattgtttaggaaagtttccctccaattgaggctataattttctttcaatatttttattgttttactttttatagttacatcttctaatcctggctaagaaaaattactcctgtttcaaaataaacaaactgaagaaaaacaaacacttgaatttcatcaatagggaaatggtttaataagtttcaattaatctatgtgacaaaatattatatattattaaaagaatgagatacttctataaatatgggcctggagggatgttcatgatatagcattaggtcaaaaagggcaaattgcaattatgtatataaaataaatacatttttattttaaaaaatcctctctatgtgtgtatgtgttttaaaaatatatttaaggttttgtagtttataacttttgaagtggtaattacattcacagcatttaaaattcaaaaggggaaaacaagaatttttctataaatttatttttctgatttttataatcagcttgtctagtcttgcccttcctactgtgtgtaccatcaagaaaaagtcctattggtattttaaaattgggatatgttcaatttatattttaacttagggagaactgaatttgttgtgacattgattcttttgatccgagaatgtgatattcatttttcaaatatgtgtgtctcaggtatgtatagaagttttcttcataaagtcctcgtccatttcttagctaagtttgtttcttgagtaattcatattttttcactattgaaaatgtcatcttttacccattatatcttttttttaatatactttaagttctagggtacatgtgcacaatgtgcaggtttgttacatagttgtacatgtttcatgttggtttgctgcacccatcaacttgtcatttacattaggtatttctcctaatgctatccctcccccgggcccccacccgtggaacgtcatcggtgtgtgatgttccccaccctgggttcatgtgttctcattgttcaactcctacttatgagcgagaacatgcagtgtttggtttcctgtccttgtgacagtttgcttagaatgatggtttccagcttcatctatgtccctgcaaaggacatgaactcatccttttttatggctgcatagtattccatggtgtatatgtgccacattttcttaatccagtctatcattgatggacatttgggttggttcccaggctttgctattgtgaatagtaccacaataaacatacttgtgcatctttatcgtagaatgatttataatcctttgggtatatgcccagtaatgagattgctgggtcaaatggtatttctagttctagatccttgaggaatccccacactgtcttccacagtggttgaactaatttacactcccatcaacagtgtaaaagcattcctatttctccacatcttctccagcatctgttgtttccactcgttgtatcttttaacttattttttcagtctctttatatcattcattatatcttttaatttttcattattgttcatatatgaaaggctatttgttttactagatattaatttcatacccagctcccctcccttaattctatcatttttcagttgattctcttggattttccagttatgcaatcatattatgtgtacataatgataattacttccttttctattttatatctctgatttctttcttctaattgtgttggttaatatctccagaaaaatattaaataataatggtaataatgaatctctgtcttttttctaagtttaatgggggatgcttaaatgtttccttattaagtattatagtagctttgagaatgagatgtattttattatgttaaggaatatacatttatttctattttattaagagttttaaaatgtcaaggatggatgtgaatgttttattaattgcctttaaatatcaactaaaatgatattatttttctttaagatatattaagatggcgatctacattaatagatttcctaaaattgatacatctttgcagtcccagacaaacaaacaaaaactgaagccatttggtcatagtatgttgttattttcttttgagacagagtctcactctgtcgcccaggctggagtgcagtggcacgatcttggcttactgcaacttccacctcctgggttcaagcgattctcctgcctcagcctgccgagtatctgggattacaggcgcctgccgagtatctgggattacaggcgcctgccactgcgctcggctaatttttgtatttttagtagagacggggtttcaccatcttggccagggtgatcttgaactcctaaccttgtgatccacccaccttggcctcccaaagtgctgggattacaggcgtgaaccaccacgcccggcctagtatgttattcttttcatgtgctgctgtattctgttttataatattttatttaaatttttaaaaattgaaaggcccagttgcggtggctcacgcctgtaatcccaagcctttgggaggccgaggtgggaggatcacttgagcccaggagtttgagaccagcctgggcagcaaagtgagaccatgtctttacaaaaaatacaaaaattagccacgtgtggtggtgcgtacctgaagtcccagctactcaagagacttaggtgggaggagcccgggagttcacggatgtagtgaggtatgatcttcactgcactctggcctggttgacagtgagaccctgtctcaagaaaaccaaaatcaaaaattacacacacacacaaattaaccaatcatacaagatattaaaaatataatacaccatgacaaatggaataaggtttcatttttagaaattcttggatgatttaatattaggaaatctattaattaacatactactggataaaaaagaaagtcaatattaccttctgataacatcttacattaattcccactaaaatcctaagtaaaatggtaatggatgaatactattcaatataatggagaaatgtatatctcagataaaattgcagcatcatatttaatggtaaaatatgggataatttctattaatattaggagcaaggcagagatgcttcctattatttctgttatttcacattgttctgaaagtgtttgccattatatttagacaagaaaataaagcaaagggtataaatattggaaatcttaaggcaaatttattactatttatatgtgatataacttacatctagaaaacccaagaaacttaattgagaattattagaaacaataaaagagtatctgaataggcagttcacaaaagacgaaatgcaataaaaagtttttcagttttacaagtattcagggaagtacaaattaaaaattcagagttcagaatttcagaattaccacctgttaagtgaacaaaaatttaaaagataaatcaaattttggtaagggtaagaagaaatatgtgcaatcattcactctaggtagaactatacattgttacggagctttgggggaatactcattatatattaacatttcaaatgcacataccctgtccctttggctatagcttacagaaataaaagcatgagtgtgctagtatagatgtacaaggatattcactgcagcattttttataataccaaaaaaatagaaacaggtgaaggccaggtgtggtggctcacacctgtaatcccagcactttgggaggcgtgcggatcacctgaggtcaggagttcgagaccagcctggcccacatggtgaaaccctggctctactaaaaatgcaaaaattagctgggtgttgtagcaggtgcctgtgatcccacctactcaggaggctgaggcaggataattgcttgaacctgggaggcagagattgcagtgagccaagatcacgccactgcactccagcctgggcaacagagcaaaactttgtcgccttcctgcccccataaaaaaaggaaacaggtgaagacccactggtgagaatggttgaataaattattgcagatccacagaatagaatgttatgtaattatagtttgtataaaacaataaactaaattagtgtatatacatacaatttaataaggtacttattaatacataagattaaaaattttcctggatctaattattagtcagaaaatatggtagaaggaaaagttccattcattatagcaaccaaaaaacccatcaaatgtccagaaaaatgtaacaacattccgaataggacctataggatacaaactatacagtactattaaggaacataaaagaaaatctaagtagagacgattgttaaattcttctgtacttatctatacatttgtcacaatcctaataaaacatcccagcagcagctcatggtatggccccaatgtcctttcctagccttgacctctccttgttccttctcctgtgttatcataccttcatgctacaccagaatgtcctggtgactcttgaaacatggaatattaagtgacaaagaggataaatgaataaaatgacaaatcattttattcaaagaggaagacaaagaaggattgcaattattcattcagcccagaattatggttaaaaagcgtagactctagagccagagtgtttgtgttcaaatcctggtcctaaaacttaatagtggcgccgggcgcggtgtctcacgcctgtaatcccagcactttgggaggccgaggtgggcagatcacgaggtcaggagatcgagaccatcctggctaacacggtgaaaccccatctctactaaaaaaaatacaaaaaattagccgggcgtggtggcgggcgcctgtagtcccagctactcgggaggctgaggcaggagaatggcgtgagcccgagaggcggagcttgcagtgagctgagatcgcgctactgcactccagcctgggcgacagagcaagattctgtctcgaaaaaacaaaaataaaaacaaaaaaaacttaatagttgcatgactcggtcaagtttcttaggctcctgggccaggcgctatgctcagcctttaataaatagacatatttcagaaacacggagcatctataatgtgtcagacaccatggggcacagagagatcactaacacagcagaggcggacgttttagtggttaaatggtctctagagtcagaccaggatgtttcagatctggctttgaaacttaactatctgtgtaatattgggcaagtttcttaatctcttaatgacctataaaatggtgacaaaatattctcttccttgggttgtgagggtcaaatgaggtcacctatgtaaattacttagcacagtgcctggcagagagtaagggctcaataaatgatagctatgattagttttatgctttcttatattggaatcaatggacagtgttccaggcacatctacctgcaagactgtgtttagtccttataaaacactaagccattattattttctaaaatttattatttgtacgaagcatatagaggcttggaggggacttgtgacttgcttaaaatcacagctcctaagttggggagcaggactctaacccaagttatgagagtctttctcttggagtcccctttgtccctctcctcacagccgctcatccattcacgaacagctgttaacacaagaacgactgtactaagtaataaggtcataaagtgtcaaggggcagcacaggagaaattctggatgagggatgtggaaaggctgcaagatggcaatgaagttaggccttcatagttgtttgtgggctctggggagctggtgactaaagaatacggtgggtgaattaaggtggggaatgggctgaggagatctggcttccagtcctggctccgcactaggtagctgtggaatgttgacaaggtcgtgtcccttctctaggcgtgtttcctaagggactggtgcagcgggatgggaggggcgcagggtagggaccgcttccaaggagagagaggacaggcgggaggggctgatgcagctggtcactccgctggagtggccagacttcgcggtgcctagggccgagttgaagaagagcatgtaagtctgttgtgggcccctcaccagcgctggggggcagcgaggtcactgggcaaggatgctctgggaagtgaccttggtgcccgggaggggagcaccctgttgtgatgcaggcggggcagcgcggagccggcggcgctgatttcgcactctggccgctagagggcgctgcctttcagccaaagccgagtgaccccctacctgccccgcgttggcccgcgtcactccagccatgggccatccagcgagcatgggggctagccagggaaagtctaaactaggaggggagatgagggggtgcaaagttgggcctggtgggtcctggggacgcagcatgtactagagcggcacctggccctcaacagaggggagagcgggtggtcgtgagaagtctgggaattttccgggcccactacacgccaggggcgggtctcccctcttaaaacgttgtgagccccagcgcgggcaggggggagggtgcccgtggagttggcatcctcatctttgatggtccccggggctcctgagctgcgctggtggccccagggctcggtgcctctctcaggcgacagctcacagacggcgggaaactcttccctcccgcaccttcggaggcggtcctggagtcttgtggactcctgggttcaaatccaagctttgtgtgaccagcacattgctggacctcactcagcctcacattcctcttgtgtttaaaactacctcataggaatgtggtgacggttagatgacacataaagctttgccagaggttttctggggagggtggggacaagagggcaaggaagagtctccatttcctctgccaccggagcccggatctaacctctcagaggagctggaaggtcagctctgagctccacaaatacctctgtatacagatctcccacgacactgaaaaagatgcccagaaagatctcatttgcagctgtgaaggggcttctttttcaatctccacaaccccaactgccttaaagtagaaccagacttgttagtagacagaggtttgggctggggggcccttgaagctcttgtctgagatctcaggcttcctgctcaacacaccaaagcaggtgcctgacataaaggcgccatggacctctttggtggtctgggaaggcatatggagtcccttctcagaacaacatttaaaaattaataagatacatgggataataaagggaacaaattatgacaagacagttgtcaaaacattagaagaatgtgtggtagagcagtacacatgcttctttagatttgacatcagcctaataactgttgtaattctgtagtagtgctgagcgttaaggacatttggagaaatctataaaaactgtaatgagatttgaaaatatttgtgttttctattgatggcaaattctattgtggttcattgtctacattcataactgaagcaagtgctgactttcaattaaagattagtgaaaataaagatgtatttttccccccaattcacaaatcccatgaataaatctattcacggacctccaagaggtccatgacgtgaaccacctaggacatgaacttcccccggaggtgcctcacagggccagctccaagccccgtggcacctcccggcttgtctcaggccaatccttgaagagctccagcagatctaaactttggtaactttcctctggtaatttgaggaattcctccatttgaggaatgtcagaatggggccaggattcctgaatgcccatggaagaaaagcgagcatgctggtctggcgggcagaaataaccttctccccaggctccagagggcagaggacatttccctccaaaaggcaagtttctcagggacctcatgagaagcctgtcctcacctgagcagttctgtcaaccatcccatcccttcacctggaccccaggtccccagcaggcctttttacctcgagacagaagttcttctttcttgttctcagactgggg

SEQ ID NO: 1530 - DNA, 77742 bp, Homo sapiens
ctctttggtgctgggaggcgggccgcagggtagctgttggcgccgccgcgtttctgggcctggccaactcacgtgaccgacgcgggctctgaagcggtgggccgcaccgaggcggcggcggcggcgacgactgcagctcgggaggtagcggcctggcgagggacgggccggctgccctctcggacggccgcggcggagggcaaaaatggcggaggcttcggcggccggggcggactcgggcgccgctgtagccgcccaccggtttttctgccacttttgcaagggcgaggtcagccccaaactaccggtaagagcgctgtgttctctatacttgggaacctcatagattcctggccccgatttcccggaactgggtctggagctttctgcacatcattgactcgcccgacatcggtctgccgaatacctgctgcccacttctaagccgccggccctaaaccctgggcatcacggcctcggccccgtacctcctgcccacctcttaattcatcctgggctgctccacctgacctcacctctttacctcccgtgtccttaatttttttttttcttagcaagtttccctctgataactctcccctcaattttcttgcattcttttatacctggtctttttcctacgatgacctccccccacacttcttccactgtgtcttctcaccttcctctgtgttcttttccacttttcaccccccaccgcccccgccacctcccttgtcagtgaagcgaaatagcggattgctgaggattgtcactcttcggttttttctagggaaggaagcacagaaagggggttggaaggtatctgtggggcgaaaagggggattttgctcttcagtggtttccagggtccttgtgacagtgaagacagcagcgtactaatgacttgcagacggtctgcactcctatcactgttgaaggaaatggctttaggaagaaggcaggacgtactgtttcaacttcgtttattttggttgtcatgctgccagtgtctttaatatcattgttccgccccccgccctgtccctttcttcacctaagaaaaagagccgggacagaatgttggggatgcttcctctgacgtgaaattggttttcacgagtttctgccagagtgttagccccttgagaggcagtgctgtggttgggaagaaaacacttttgtaggtcaggcgcggtggcttaggtctgtaatcccagtgctttgggaggacgaggcaggaggattgcttgaggccaggagtttgagaccagcctgggcaacagagtgagacccctctctacaaaaacaaacaacatttatgcagcatactagccagcaccagcatcacaaacccagaagctgttttgggttgggttgtagctactacgaggagctcccccagagtgaatgtcaatcctgtccttggccaactgtctttatggttgttcctttccttacaagtgtccaggttcagtcttgtgatagagtggcaacattatgtttctatttatggtgtctcagatacagtgtaggagaaaaccttctgaagtgagtctgtatatcttatttcttagaaacacaaatggagtccagtgaataagtgcttaaagggtgttttatagtcttctctcactcaaaagttttgtttaaggcattatgatacattctttcctctctacttgccgcaccccctacttcagagtcatagtttcatctaaatgctacttagctgtttttcttttttcttttttttttttgagacagcctctgtctatcacccaggagcatgatttcggctgactgcaacctccacctgccgggttcaagagagtctcctgcctcggcctccgggtagctgggactataggtgcacgaccaccgcaccctggctaatttttgtgtttttagtagagatgcagtttcaccatgttggccaggctggtctcgaactcttgacctcaagtgatccacccgactcgggctcccagagtgctgggattacaggcgtgagccactgctccccgcctaaatgctacttagctttgtttgctgattttgctgtgtgtttatgtttttttttttggccatatttcagtgctgggaagagcaggtgtctagtttttttccagccaacatcagagcctgcagaactcttttaccatagagagggagtctggaattcagccagtatgtgtgtgaccagtggtgtgttgttgaatgtgatgccttgttgaatattccatccttagcttttttgatctttaagttgctgttcactattttgcctttaagagtgagaagttggccaggcgtggtggctcaggcctgtaatcccaatactttgggagtccaaggcaggcagatcgcttgagctcaggagttcgagactagcctgggcaacatggagaaaccccgtctctaccaaaaaataaaaaaatttgccgtgtgtgtggtggcatgcacctgtagtcccagctattcaggaggctgaggtaggaggattgcctgaccccaggaagcagaggttgcagtgagctgagatcgcaccattgcactccagcctgggcaatagagccagaccctgtctcaaaaaaaaaaaaaaaaaaaaaagagtgagaagacagtctaaacttccccaattgattatatcttttcttctcacctttaagtccttacttcaaagggataatttgaaaagctgaataggtgtttttctaagccttagttaatgcctggagaagtttcttgatctttttggtgtgatatattatttgtcatatctgatttgtaaattgaggcctaacacaattgagtataaccggattcttcctaaatatatccaaggttctctgctgagtgtcctggaggtgatagggagtgatatgtggctcctgcccttaaggatcttacagcttttggggaaagacaaggcaaacatagaaaaagtaacagcataaagggaatgaggatatgtgctttaggattcagagaggggaatttcatagcgttggtgtggccagtgggatttaaattgagttttgagggatgggtgcatttcagattgagaattccaaagactgtgaggtagcaaaaggaagagggagttgatgaagaagggagaaatatttaataaatcatgtttttttcacaactaaaagttgtatactatattttttatagtgttcagcatgatttgatatatgtatacactgaatggttaaatcaagctatttaacatgcattacctcacatacttatttttgcgtggtgagaacacttaaaatctgtcttagcaattttcaaatatacagtatattccctttttctttttttgagactgagtctcgctctgtcaccaggctggagtgcagtggtgcgatctcggttcactacaacctccacctcctgggttcaagcagttctcctgcctcggcctcccaagtagtggggactacaggcacgtgccaccatgcccagctaatttttgtatttttagtagagacggggtttcaccatgttggccaggatggtctccatctcgaccttgtgatatgcccaccttggcctcccaaagtggtgggattacaggtgtgagccactgcacccggcctctttctttctttttaaatagagacagaatttattctgtcttgttgcccaggctgttcttgaatttgtgggctcaatgtgtcctcccactatatcctcctgagtagtagtagataggtgtgttccaccatgcctggctaatttttttttcttttttgtagagatgggattttgccatgttgccccggctggtctcaaatttctgggcttaagcaatctgcctgcctcagcctcccaaagtgctggggttacaggcatgagctattgcggctggcctgatatgtggtatttgtttttaattctgtttatgtgatgaatcacatttattgatttgcctatgttgaactaaccttgcatcccaggagtaaagactacttgattgtggtagattagcttttaatttttatttatttatttttttgagatggagtcttgctctttagcccaggctggagtgcagtggaacgagctcagctcactgcaacctctgcctcctgggttcaagcgattctcgtgcctcagcctcccagatacctgggattacaggtttgcaccactagacctggctaatttttgtatttttggtagagatggggtttccccgtgttggccgggttggctttgaaatcctgacctcaagtgatctgcctgccttggccccccaaagtgctgagattacaggtgtgagccaccacactggcctgcattagctttttaatgtgctgctggttcagtttgttagtattttatttagaatttttgtgtctgtgttcattagggatattggcccggagttttcttttttcattgtgtctttgccaggttttggtatcagaatgctgctggcctcatggaatgggttagggaagagtccctcctcgattttttggaataatttcagtaggattggtacaagctcttcttcgtgtctggtggggtttggctgtgagtccgtctggtccagggccttttctgattggtaagttttttatttttcattattttttgagacagggtctcactgtgtcgcccatactggagttcagtggcatgatcacggctcactgctgcagcctcgacttcccagactcaggtgatcctcccaccttagcctcctgagtagctggacctacgggtatgtgctaccacacctggctgttttttttttttttttgagagataaggtttcgtcatgttgcccagcctggtcttgaactcctaggctcaagcgatccgcctgcctttgcctcccaaagtgctgggattgtaggcatgagccatggccctggccaggttttttattactgattcaattttggaactcgtcattggtctgttcagaatttcagtttcttcctggttcagtcttgtgaggttgtatgtttccaggaatttatctggaattttaggttttctagtttgtgtgcataaaggtgtttgtaatagtctctgagggttctttgtatttctgtgggattggtggtaatgtcagttttgtcatttctgatggtgtttatttagatcgtctctctttttttctttattaatctagctagtggtctatcaattttattttttgaaagaaccaacttttggtttcgtttatcatttatttgtatggattttcgcatctcaatttcattcagttcagcactgattttggttatttcttctgctggctttggggttggtttgttcttgtttttctagtttctctaggtgtgatgttaggttgttaatttgagatctttctagctttttgatggaagtgtttagtgctataaactttcctcttaatactgctttaactgtatcctagtgattctggtatgctgtatctttgttttcattagtttcaaagaactttctgatttctcccttaatttcattttttactgaaaagtcattcaggaacaagttgtctcatttccatgtaattgtatagttttgagagacctttttagtattgatttctattttaattgcactataatccgagagtgtggttggtatgattttggtttttttgcctacgcacttctcaaaagaagacatatatgcagcccaataagcatatgaaaaaatgctcaggattactaatcgtcagagaaatgcaaaccaaaaccacagcgagataccatctcacaccagtcagaatagctattattagaaagttaaagaataacagttgttggcaaggttgtggagaaaagggaatgcctatacactgccggtgagaatgtaaattagttcagccactgtggaaggcagtttgatttcccaaagaacttaaaacggaactaccattctgcccagcaatccattactgggtatatacccagaggaatataaatcgttttaccaaaaagacacatgcacttgtatgtttattgtggcactgttcacaagagcaaagacatggaatcaacctagatgcccatcagtggtggacttaataaagaaaatgtggtacatatacatcatgggatactatacagctatttaaaaaaaacaaaaccgaaatcatgtcctttgcagcaacatggatgcagctggaggtcattatcctaagtgaattaaagcaggaacagaaagccaagtaccacgtgttctcacttaaaagtgggagctaaacattgagtacacatgggcataaacatggacacgagggcttacttgaggtggtgagggtaagaggaggatgagggtcaaaaaactgcctatcttgtactatggtcagttgctgggtgacgaaataatcagtacaccaaattccagtgacacagtttatccgtgtaacaaatgtacatatgtgcccccaaacctaaaatcaaaaaaaatatgtgtagaaaacaaagagcaaaatgaaggacctaaaacctaaaaaccatttatagtcaatatataaaaaggcttaataccccagttaaaatcagatatggataaattttataaaaacaaagtaaacaaagagggtactgactcttgtgatagttggataccaagaaccatccctcactggggcatgctgtggctcacacctgttataccaacactttgggaacccaaggcaggagaggattgcttgagcccaggagtttggcactagcctgggcaacaaagtgagaccctatctctacaaaaattaaaaaaattagccaggggtggtggtgtgtgtctgtggtcctagctactcaggaggctgagtcggggaagattgctcaagcccgggaggtcgaggctgcagtgagctgtgattgtgccattacactccagtctgggtgacagagcaagagcttatctcaaaaaagaaaaagactccatgatttaatctaatcaacttcaaaaacccaactcattcctccacacgccctgtgccttggccatagcatttacctcaccattctcctatgcattatctatttttagacctctgtctccctttgtttaaaatgttctcccagcctggataacatagcaagaccctgtctcaacaaaaaaaataaaaattagctgggtatggtggcatgtgcttgtagtcctagctacttgggaggctgaggtggaagaattacttgagcccaggatatttgaggttacagtgagctatggttgtgccactgtactccagcctgggcaacagagacccagtctggatgagagagaagagagaggggagagaggagagaaaaaagaaaagaaaagaaaaagaaaaagaaagaaagaacccatcatctatgagtgctgtcctcactgaacaccagaggctgggtattgagtttacatcagcttttaatgagctctcactaggtttcttcacccattcaatgggaaggtctgcttcagagccataattgtgttcaacgggactaggttgcaaggtttaataactcttctcttctttttaaaatttaattactttattatttcacctttttttttaaagccacatgtaggctgaattcatttaatttgacagaataacactccttactgctaatcctgatcaattttagctttgtgtgtctttgggttggatccactcagataagaggacaaaagagggccgggcatggtgactagtgcctgtaatcctagcactttgggaggccaaggtgggcggatcacctgaggtcaggacttcaaaaccagcctggccaacatggtgaaacccctgtctctactaaaaatacaaaaattagcctggcgtggtggtgggcgcctctaatctaagcaatttagtgatttgagctgggctcgggaggctgaggcaggagaatcgcttgaaaacccaggaggcggagcttgcagtgagctgagatcgtgccattgcactcgcaaaaagagcgagactccatctcaaaaaaaaaaaaaaaccattcaaaaagaggacaaaaggttcatttggaaagaggatattaagaaataaggagaaatcatgaagggaattttaaaatgaaaacatatttagtggcattgttttctgttaggtttcaaaaaagtctccattccaagtgagtattggtttaggaatttctttctccttattaaaagtgttttcctatttacagtgaaaataactttagtaaaattttgtgagtactaaacttggattttaaaatcagagatttcgattatatagtctggagcctcaggattttaagtttctgtaggattgggtaaaatgccattgtagattttttggtcatcagattatagaataaatacttaaagtaacttcagattattattttcaaaaccatagcagaaactcttaccttacctatcttattgagagacaatgtgaagccaagactaatggagttagtgtgctacattgatgatgaatgactgggtagtacaccacagagggctgtgtcatggagtgtaaaggtgttattccattcctacaccctaccatccgtctttccccattaaatcaaggtcagggaatgttaccttatgtgattaaatctggtagagtcatcattaaacaggtgagataaatcatatgcagagtaacctacttttggtattgatgagactagggtggttcttaagtattttatggagatcagggtatcttcctaaatccagatgaagagatcaggttaagaactgctcgctttcaggctccacctgaagaaactatgtagtaggcttctctccctctacttattttatcatcttctttgatctaataaaatgttttccttatcaataagtaatgttatctagtttggctctaccaggtgctagagaaggcattcatcattgtattgtacttgcaataactctaatacaggaaaatgttcaaaccacccataataaaagtagctaaaaagcagatttcttaaagactttgtgaccgtttaagctcagctgacctttctaagttgcatgattcttagaaaggtcccagagagatgtctatctggtgctatatagcagttgctaattaaatattttttaattgaatgattgatatgagttgaacacccagtaattatatttaaaaagtgatgacttcagtgttttgacgcctttaaaaggctacagtggtacaaaatgtaggtgctaccatgtgaaatttgaatgtacagtgaagtacatatattcactgcaatatctagaaataaatatgtattcttataggtagaggctagtttatccttgtaattctactgataaatataaatgtatatattggggaaatttgtgggactttttcagtataaggaagaaaaaaatctgaaaattgaactcactgcagaagaaattttttgtattttcgggggaagtaccaactagatgtgctaacactttgtatttctttatgtttagttgcctcttttttttttttttaaacggagtttccctctttcacccaggctggagtgcagtggcacgatctcggctcactgcatcctctgccttacagtttcaagtgattctcctgcctcagcctcccaagtagctgggattacaggcgcctgccaccacgcctggctaatttttgtatttttagtagagacgagggtttcaccatgttggccaggttggatctcttcacatcctactgagcaataaatgagatagcctagagcagtggttttcaatttcaggtagttttgtttcccggggaacatttggcaaagtctgtagacaattttttatcttttttttggagacagagtctgactttgttgcccaggttggagtgcagtggcatgatcacggctcactgcggcttccacctcctgggctcaagcaatcctcccacctcagcctcccaactagctgtaccaccacacccggctaattttttaattttttgtagagacagagtctcactgtgttgcctaggctggtgtcaaactcctggcctcaagcagtcctgcttcggcctcccaaagtattgggatggtaggtgtgagccaccacacccagcctgtagacatttttgatttttgtaactaggggctggaggagggttgctactgtcatgcagtgggtggaggccagagatgctgctgaacatgctgcagtgcacaggatagacccctcaaaacaaagaattatattgggcccaaaaaggtaagagggctgaggttgagaaaccctgggatagatagagggatagtcagtgtcatcttgtgctaattgtgtttaaggttttgttttggtgtaggtttgatttttaattttgggatcccagtgaattttcagtaagaaaattgagaccgtataattttaggcaaacctctgatgggagagagtgtttagaacaggaactagggctcagttagtggctgcaattccattatagcagtatctattggagttactttctgtctttggagttactgagaccagaggaattggattacccctctcaagttacatactgtaagggcaacttataaaagaaaactatccacatttttttgtcagttgggaattaattgagatagaaacactgcatgtaatttagtaagacagctggaaatcccagtttgaaaacaaaatgaaaagcagacaacaagcctaacttttagttttgctttctgtgtttctcttatacctctcagaagtttcataagctccagaaattttgtgtttaaccttttagtttcttcaaattcttggttgagagggtatattggagttattaatctttgttctaaaattcttcgggtgacttctcgctgagtcatctgaccgtctcagtttacctaagtatatcccattgtaaaatgatacttaggtgcacgtatgggaagcttgaatgaggaatggagctgtataatcctaattgaaaggcagtgtaagaatcatgagcaatccttatttgcagagaaatagggccattaccgtattagaagcattttaggttgttgttatagtttcacatacagaagtttaggtgctgaaaaattattcttttttagaaatttcttttttcaattgtttgctgttcagagtttctcagaggtccccagatgcatgtatatcagttagaagtaggacaggtatggtggctaacacctgtaatcccagcactttgggaggcagaggtgggtggataacttgagctcaggagtttgagaccagcctgggtgatatggcgaaaccccatctcttaaaaaaaaattaaaaaaagatagaagtgagttggcgccagtgatttttaaaccaggcatacttttcttgtatgataagtagactgttggtgactcttttcccaaaacagaccagttagattttgttttttgtttttttttgagacctgaagcctcactctgtcacccaggctggagtgcagtggtgtgatcttggctcactgcaacctccgcctcccacgttcaagcaattcttgtgcctcagcctcccgagtaactgagattatgggtgtgcgccaccacacctggctaatttttgtatttttagtagaggcggggtttcaccatgttggccaggctggtctcaaactcctgaccttgcaagtgatgcacctgcctcggccttccaaagtgctgggattacaggtgttagccaccacgcctggccagaccagttagttttgtcttccttgaaaatctgttaagacagattaatctctctccttgataatttgaacaagtgtcacaggaaacttcttagtagacaaggtaatgtttacctccttgccactcactttgatgttgtacagatttgaatagacttttaacccatagtaccatcttccagaagtttcattttgcttacctttcaccatgcttagaatttacattctcaaaagaaaaaacaattatagttacatgctctttcttaccttttgctggattaactgagacctgcaggtatcctacaatgatgctgatcttctagcccgttaattctcagacctctcagattcagtgccctcttcttataagtattttgaaatactctctttagtgaaatgaaatccacaggtaatacagcttttctacatatatgtgtgtgtgtgtatatatatatatatatatatatttttttttttttttttttgtgagacagaatctctgtcaaccaggctgcagtgcagtggcgtgatcttggctcactgtatcctctgcctcctgggtgcttcaagcgatgctcgtgcctcagccttccaagtagctgagattacaagcgtgcatcaccacacctggctaatttttttgtattattatttattctttgtagagacagggtttcaccatgttggccaggctggtctcgaactcctggcctcaagtgcgcccacctcggcctcccaaagtgctggggttataggcgtgagccaccacacccggccctacatatataattaaaaaaattatcttgcagtaagataaaggataaatagaaaatatttctgacagattagcttgacatgacagctacctgagtagactgctataagggtatttgcaacttaaataccaggagaagcaaaccagtacagtgaacaattctttgcaaatgtacaaataaaactcaagtacaacttctttcttcttcttcttttttcttttttttttttttttttttttggtagtgatggggtctcacttagttgcccaggctggttttgagttaggctcaagctgtcctcctccttggcctcccaaagtgctgagattacaaacgtgagccactgcatctgccccaaagtacagttttctcttactttattcagcagttgcttttctggacatttagtgcatgttaaaattatggactgggcacggtggcttacgcctgtaatcccagcactttgggataccaaggcggttggatcacttgagcccaggagttggagaacagcctgggcaacatggtaaaaccctgtctctacaaaaaatttttttaaaaattagccgggcttggtggcacgtgcctgaagtcccagctacctgggaggctgaggtgggaggattacctgagcccaagaggtcaaggctgtagtgaaccgtgatcacaccgctgcactccagcctgggtgacagagtgagaccctgtctcaaaaaataaataaataaataaataaaattatgcagaaggacttggtgcttatacgtagaatgtaattaggttctaggctttggtaattatacagattttaaaaatccagttaactattcataaggaagtttgagaataaagacattttttctttgtgctggacttgcctatgctttcctggcctctgccaattgaatgtcagtaacacttttttttttttctgcaacttttattttaagtcccggggcacatgtgcaggatgtgcaggttttgttatgtaggcaaacctgtgccatggtggttggctgcacagatcaactcatcacctagctattaagcccagcatccattagatattcttcctgaggctccctcaacaggccccagtgtgtgttgttccccaccatgtgtcctcctcatttagcccctacttacaaatgagaacgtgtgatgtgtggttttctgttcctatgttagtttgctgaggataacggcttccagctccatccacatccctgcaaagtaatcactcgtcctttttatggctgaatggtattccatggtgtatatgtaccacattttctttatctagtctctcactgatgggcatttgggtttattccatgtctttgctattgtgaatagtgagaagcacttcttaactgctgtgacaaccaaagcacttccatagatgtcccaactatcccctagatgattgtgttgtcctcattaagaatgacctctagtcatacaggaaaacatttttctgttttatcattcactcttcttttttttttcttgcttattattcactactttagcacagccttttagtctaaaagacaaagatttacttggcctttagacaattcctatatgtctttaaatttcttatttcctcaccactcttattattgatgttttcttttccataagtgttaggacagtgccttggtacatagtagatactcaattagtatttgttgaatgaaggaaacttaactgtaggctttttcttcttgccactttctgctttttgtacctgttgaaaatgatggaggtaccagtgttcataaaaaccttgaaaacaggctgggtgcagtggctcatgcctgtaatcccagcactttgggaggccgaggcaggcagatcactcgaggtcaggagttcaagaccaacctgatcaacatggtgaaaccccgtctgtactaaaaatacaaaattagccaggtatggtggcgcatgcctgtaatcccagctactcgggaggctgacgcagaagaattgcttgaacctggaaggtggagattgcagtgagccaagatcgcactactgcactccagcctgggcaacaagagtgaaagtcttgtctccaaaaaaaaaaaaaaaaaaaaaaattagctgggtctgggtgcagtggcgcacacctataatctcagcactttgggaggctgaagcgggcagatcacctgaggtcgggagtttgagaccagccagcatagtgaaatctgcatctactaaaagtacaaaaattagctgggtgtggtggcacatgcctgtaatcccagctacttgggaggctgagggaggataaccacttgaacccaggaggtggaggttgcagtgagctgaaattgcaccactgcactccagcctgggcaacagagtgagactctgtctcaaaaaaaaaaaaaaaaaatccttgaaaacaaagcacagacctgtagactaatgactaaagggttggctcaaagcagcagtttgatggaccacttgctattagttagtggccagtagagtggagcctcttgtggaatacggctttatttctgcatatgagagcttataagaagaggagtcatcccataattacatgcctttcagataaacagctgatgggctttgtaggcagagttactttaatgaagtcattaatagctgaatttgttgaatgaaagcttcttctagagaatcttttctaatttaggtactactgtgaggtatttttgctctcaaacttattaaactgttggttccctgattttgaatttatggtgccagttattagatcctgatctcttaatatggtcactgctaaatgtttacaggtattagcatacctagttaagacaagttaggttggggaacagaaatttttatatcttagcctcgttggtttgaaaaaaaattagttatttggattgctgatatagtgcaaaaactatttataatggtacatttactttctgtttaataacatgtaaaaggcaaacagcaaattaattttcactgctagtcttgatttgtatgttttagattaaagggttgttgaaactataataaaaaaccaaataatggttgggcaaaggaggacatgattagacatttctcaaaagaaggcatataaatggccaacaggtatatgaaacagtgcttaacatcactaatcatcagagaaatgcaaaccaaaaccagaatgagataccattataccccagttagaatggccattattaaaaagacaaaaataacagatgctgaccagaatgtggaagaaagggaactcttaaacactgttgatgagaatgtaaattagtatggtcactatggaaaacagaatggatatatttcaaaaaaaactgaaaactaccatacaatccagcaatcccgctactgggtagttatccagaggaaaagaaatcagtatatcaaagggatacttgcacttccatgttcattgtagtactattcacagcagcaaagacggaatcagagtatccatcagtggatgaatggataaagaaaatgtggtatatatatatatgcaagagaatagtgtttggccataagaaagaatgaagtcgtgccatttgtagcaacatggatggaactggaggttattatgttaagtgagataagccaggcacagaaagacaaatattgcatattcccactcatatgtgggagctaaaaaagttgatttcatgcaggtagagaatggaatgatatctgaggctgggaagggtgtgtgaaggcagagggggtgaggtatgtggataaagagaggttgattaatgggtataaacataaaattagatagaaggaataagttctgatgtttgatagcagagtagagtgactaaagttaacaacaatgtatatttcaaaatagctagatgagaggatttcagatattcccagcacatagaaatgataaatatttaaggtgatagatgccctaaatgccctgacttgatatgcatgtaccaaaatatcacatgtaccccatgaatatttacagatatctgtagcaataaaaaagtggttgaaagtaatattaataagtgagaatcataaaaatgtttaatttgctgaatttttcaaccttagtttactaatctttaaaattgttggtttattattctctatcaagtgcaggtgctgattgaatggatagggagaagttgttttaatattatattagcatcctattttaatatgcaatcagtattagatggacagattcagagttcctaaggtttttaataagattagcagtataatataggtctatctcgtcctgtaacactagtactgtaaaaggtttccagaagtatatctatttctattcctgagtgtgattgattctggatattttctttgaggacacacacatatactctatttgtgaagtacagcacttcgaatttagtttgtatttgataataacattaaaataacaggcactagattatgcaacagtaacagcagtccatttttatttattcagtaactgtattggtaccttctatattccaggagctgttctaggtacttgggctgttgtcttagtccattttgtgttgcttataaaggaataactgaagctgggtaacttaaaagaggtttacggctgggcgcagtggcgcgtacctgtaatcccagctgctcaggaggctgaggcaggagaattcttgaacccaggaggtggaggttgcagtgagccgagatcctgccactgcactccagcctgggcgacagaaaaagactctgtctcaacaaaaaataaacaaaagaagtttacttagctcattactctgcagacagtacaagaagcttcgcaccagcatctgcttctggtgggacctcaggaagcttccagtcatagtggaaggccaaggggaagcaggtgttccgcaaggcaagagagaaaggggaggggtaccacactcttttaaacaaccacatcactcattcctgtaaggactgcaccaagacattcatgagggatctgcgtccatgacctaaatacctcccactaggccctacctccaacattggggatcaaatttcaacatgagatttagaggggacacatatccaaactatatcagctatattcaggaagaagtacggagattaataaaatgttgagaaaaatgggtagtaaaatcaggatttaaatattttcttctccttttggctttctttaaatttaatatttatttatttatttatctattttatttttttgagatggagtcttcctctgttgcccaggctggagtgcagtggcacgatctcagctcactgaaacctctgcctcccgggttcaagcgattctcctgcttcagcttcctgagcagctgggattacaggtgtgggccacaatgcccagctaatttttgtatttttagtagagacggggtttcaccctgttggccaggctggtcttgaacacctgacctcaagtgatccacccgcctcagcttcccaaagtgctgggattatagtcgtgagccactgtgcctggacttaaatttaatatctcatttaaacattaaattaatgtagctatctctggattagagcaaatgcctttttgcccatttcaggtctgagatattgttgttgtaagaactaacaactagccctcattttgcaactgttgtcagccctttttatagctgattttatttattttaattaattatatataaattgtattctagtactgtgggaaaaaatgttttattttagctgttaaattattgaacctttcagggtcttcattttccttgtctgtaaaatgagatagttgtgtttattcctgctagctacggtttagtgatttgagctctggggtatttttggattttgtgtaagggaattttcttctgtagtttttccacatagatcatgtggtagccactgacatactaggatttaaattttacccctgaaataatctcctttatgagttacaaactattagtgcatattttatcttataatgatgaacagtcttgaaaatgttaggatggaggacataatgcaaagcaatgtcaaaattttccttttataaatcaaacaaagcaataatgctggtaatgttgactgaataaattaaaacttcattttttttttttttgaagacttgggattcagtaacaggtaaacttggcctggataattttttttttagaactattttataaatattctttgtttgctttgaggttgcatttacattgcttttgtttttaaagttgtattcagttaactgattgttttcttaatccaatggtcagtggctactgttaacaaccagtttgtatgtgatctttcctgacttgaatgttcctgctgtgagttgaattagatcatacttgtgaaattctcctatgtcattgatggcaagtcaatgctagaattccaagtattacttttatttcgatgaagagttctcagtcagaagctctgattgctctgtgggtacatggtaaaatagtactttttaaaatgaaatggtgatggtagatggtttttttttaaatatttatacttggcaaaataaaaaagctggcaatccttgcaggtttccaattttttaatttgaaaattgaactgctttatgggaaccaaaagtatggaaatcagtagtctagatcagtgtttctcaaactgtgtgccaggagatttaataggagttcagaattatggtaaaatattgcataccaaattgttgccctatctccatccctccacttccccttttatgacatggaatggcatattaatggttctgaaaaatcattcattaaagcagcatgtttgatatttagttcaggcttttctaaatctagtttttctccccaccttaaccactggttaatatcctgtgaaacgtggtttgagaaatattccatatccaaatcactcagaataatttattagaacctacagtttgttgagaatttagtatattcccagtactatctcatttagatgaagtgagctacccagtgtcacacaactggttggttattctgtgtttccagtccgattgtgtgtgtgtgtgtgtgtgtgtgtgtgtgcatgcatgcatgcatttaaggtggacaacatgatgttttgaagtgcacatacatagttgaaatgattaccagtccagctttgttttgcttcacattcattactctaaccacttaggctgttctgaagcattgcttagttctcatttcgaggctaagtacctaagactaggatattcagaagttcattttatatgccttttgacttccctaactactagaatgtggttaagggaagtatgattttatcagagcatatactttgtaggtgattttagtgacttttaatcccaggttatttttctttctacacaatgcttggaatgtagagcttagaatttttgctgagtgaatgaatgttgtcactttgtcaaagaagattctgtcagcctaagctaaaagcaagaaagtacattttacttctaaactattgtggtacacatcagagctaaacatctatactttttggctcatttatcattttatatttatgccactgggttgttccctttcttgctgcctttagtgtgagcaagccaaaaacactataaatcttttctgctatattatgttgtctgaggttaattaacattttctctggtaattcttgtagtcctgtgtgtttcttccttagaaaatttggcttcttgaccatctgatcaagcttgtatcaagtaacactttgtcttgtgacctgattttctgccttggtacacaatgagctaaagaagcttggttgattatgcactcctgtttggaatctgtaatgtcagtgttcaatcatggcctgaattaaggaacaaaatgataaaggtggctgggtgcggtggctcacgcctctaatcccagcactttgggaggctgaggcaggtggatcacttgaggtcaggagttcaacaccagcctggccaatgtggtgaaacccatctctactaaaaatacaaaaattagctgggcataatggcgggcacctgtattcccacctactgggaagctgaggtgggagaattgcttcagcctgggaggcagagtttgcagtgagccaagatcacgccactgcattccagcctgggcaacagagtgagactcagtctcaaaataaataaataaataaaggttgtgaatgtgaatgttactattcttagggggatgaaaccataaatcaaggtagttttattggcctggaactgaatcacagcccttcaaacagtatttaaattgtataggtatccttgtgtaacactgaaactgtggcctattgttttcctttttagtaaactgattttctttattaatagccaagtgaacaattgcttacaactccttgagctcagagaactaatttcaaaatgtttagactggaaactttctctttcttgtaatgaatgagaggtatgtcttccttaatttcttgaaggagagttgagagaaagaagtcagtgaggacagtatttgtactctagaaagagattttcacagagaccttgaggataatggtggaactgggaacagaactcagaagttctgttgtctttgttttggggttcacttgatgcttttgaaaagggaggaggatgtataacctggcttgaaaagggaaccagtctctttgacctagtgacgagacttagcatcagagtaaaagtatagtgggtactggcctaggagctgtgatgtgtggcaaacattttgtgttcttaatccttctaattagaaatttctgactgtcttgccatgtgatactcaaagagagtataaacaatagaatgtgactaacttaaaattgtggctgtcagactagacagaaaatgggcttcttttttttgacactttaatcaccattggaacttctgttttagataaaataaacactttaagttgataacgaagaggtagaaaaacatagctgtgaaattaggaaaaaagtagtaagtctttatattacatttgatgtactgaataagtattggatacaaacttgtataggtttcaagagtatttaaatttcacattatgtgacctgatataaataggtctgaatttgtagctccttgtcctctaaggtgtcacgtattgtgataactaatcctttgaaatacgggaggcaaaagaaataatgcattaaaaccacccttttcctttccttcctatatttctagtgctttgtgtcctcttgggctgttcttttaagtgggtaagcatcagggctaagctatgcttagggagttgttctcgattcagaacctgccactgagtatcttcactagagttgtttacagtaatcttttagagcctagggggaaagcagcttagtttggtggaaacagttgggttcctgtttccagtgattctaggtaagtaacttaggttttttgttatgcttttcttttacagatgggatgatagaaatgactcggctgggcgtggtggctcacgcctgtaatcccagcactttgggaggctaacatgagaggattgcttgagctcaggagttcgagactagcttgggcaacatggcaaaactccgtctctacaaaaaatataaaaattagctgggcgtaatggtatacacctgtagtcccagctactcgggaggctgaggtgggagaatctctggagcctgggaggcagaggttgcagtgagccgagatggtgccactgcactccagcctgggcaacagagcgagaccctgtctcagtttaaaaaaaaagagagaaatgagttactgaattagaaatgagttactgaaaaagagagaaatgagttactgaggggtaagatttcgtgactgcatacattggaaatattttggggagaggtttgttgtgaagacttgacgtattaataggtaagcgtaggatagatttccatagtgcctgacatataattggcatttgattattattcttgatttagtgttcctccctttaaaagcatagttattttctttctttctttctttttttttgacatggagtctcactctttcactcactgcaacctctgcctcctgggttcaagcaattctcctgcctcagcctgcacagtagctgggattacaggcatgtgccaccacgcctggctaatttttgtatttttagtagagacggggttttgccatgttgggccaggctcgaactcctggcctcaagtgatcctccctccgtggccttccaaagtgctgagattataggctgagccactgtgcctggcctaaaagcatagttattttcaatcagcatggtataatgaaaagaagatggaattttggattcaagaaagaccaaggtttaaagctccttttctttttctttttttttgagacggagtcttgctgtgcgctctgcgctgtgcccaggctggagtgcggtgtcgtaatcttggctcactgcaagccctgcctcttgggttcatgccattctcctgcctcagcctcttgagtagctgggactacaggctcccaacaccacgcccagctaatttttatgtatttttagtagagatggggtttcaccgtgttagccaggatggtctcgatctcctgactttgtgatctgcccgccttggccctcccaaagtgctgggattacaggcatgagccactgcgcccgtcctaaagctccttttcatcccttgggcaatgttctgattttctattattgcctaacaagtctatccaaaatgtagtggcttaatacaataacttattattatctctcatgtttctgtggattgacagggttcagctggacacttctccccttaaggtctttcatgtggttgtggtcagatagtacctggagatggggccatctgaagactctgccctaggctggatccaagatggtgttttccttttacttgtctgatgtctcagtgctctttgagatggcctctttatccagcagagtagcctaaacttatgtggctgctcagggttccaagagttaggaagtagaagttgccaggcagttaagggctttggaactggcatagtattgtatctattaaagaagtcacagggcctcccagattcaaggggcttgagaaataaactgcatgtctttaaagggagtgggaaggtcacattgcagaagaatatatgggctgagaggtcttattggggctgtctctggaaggccatctgggcacaattttttttcattttcttgtttgtaaaatagcaataacaatatttacctcacagagtggttaagtggaatagcacagtgtcaagcacatcatgtgtttagtaaatataagtagacttccccccttaattctctaatgtaacaaattacttctgatctacttttattttaaatggccgcaagtttgctcagtatatggtttggttaactgtttcttcacccgactatgtttctcagactgttgtaacttaaaacaaactttatcatggaaaatttcaaacacatcaaagtaaagagaataccacattaacagaataagggacaaaaactgcatcatcatctcaattcatgcagaaaaagcatttgatagatccagcatactttcatgataaaaacactcaactaggaatagaaggaaactcagcatatcaaagtgtatttatgaaaagcccacagtggctgggcctgttggctcatgcctgtaattccagcactctgggaggccaaggtgggaggatcacttgagtccaggagtttgagaccagcctgggcaacaaagtgagacctaatctctgcaaaaaataaacacaattagccaggcatggtgatgtacgcctatagtcctagctacttgggacgctttggtgggaggattggttgagtctgcagtgagcaaagatcgtaccatatcacttcagaatgggcaacagagcaagacccttcccaccctcacccaccccctccccccaacaaaaaaaagcccacagtgaacatctcattcagtggtgaaagaccgaaagctttccccctaacatcaggaacatggcaaagatgcccattcttgccactgctatttcaacatagtattaagagtcctggccagagccaatttaggcaagaaaaagaaaagcacccaaattagaaaggaagaagtaaaattatctctgttcacagatgatatgatcttatttgttgaaaacccggaagctggctgcagtggctcatgcctgtaatcccagcactttgggaggccgaggcaggcggatcacgaggtcaagagatcgagaccatcctggccaacatggtgaaaccccgtctttactaaaaatacaaaaattagctgggcatgatggcaggcatttgtagtcccagctactcgggaggctgaggcaggagatttgcttgaacccaggaggcagaggttgcagtgagccgagattgcgccactgcaccccagcctggtgacagagcgacactccatctaaaaaaaaaaagaaagaaaaccctaaacattccacaaaaaaccctgttataactaataaatgaattcagcaaagttgcaggatacaaaatcaacacacaaaaattagttatgtttccatacacagtgaacaacttgaaaaattaagaaaacaattccattaacagtagcatcagaaagaatgaaagttaggaatgaccctaaccaaagaagtgaaaaatttgaatattaaaaaccgtaaaatactgctgaaaagaattaaagagcatacaaataaatagaaagacatcctgtgttcatggattggaagacttaatattgttaagatatgaattcttcccaaagcgatctacagattcaacagaatacctatcaaaatcccaacagcattttttttgcaaatagaagtttcatcccaaaattaatttggaatctcacgttacccctaatagccagaacagttttcaaaaagaaaaacaaagctggaggactcaaactttctgatttcaaaatatattactaagctatggtaataaaactagtgtggtactggcataacaacagacatatagacaatggaatagagactccagaaataaacccttgcatatgtggtcagatgatcttggacagaggtgctaggacccctctgtggagcaaggacagtctcttcagcaaacagtgttgggaaaactggactttcacatacaaaacaaaaatttggactcatattttacactatatataaaaataaactcaaagtggattaaagacctaaatataagacctaaaactgtaaaactcctaaaagaaaacttagaggaaaggcttataacttaaaacttagaggaaaggctttataactttggatttggcagtgatttctggcatatgacaccataagcacaggcaacaaaaggaaaaataggcaaatgggactgcatcaaacttaaaaactttggtgcatcaatgaacacaatcaacttgaaaaggcaacctgtggaatgggagaaaatgtttgtaaattgtgtatctgttaaagtattaatatccagaatgtagaaagaacaacaactcaacaacaaaaaatcaaataaacagattaaaaaataggcaaatgacttgaatagtcatttctccaaagatgataaaccaatggtcaagacacatttgaaaagatgttcaacatcactaatcatcagagagatccaaatcaaaaccacaatgagatatcacctcacatccattaggatggctactattaaaaaacaaacagggaattacgagtgttagtgaagattatgagaaattggaactattcttgtgcactgttgggactgtaaaatggtgcaactgtgatggaaaacagcatggcagttcctcaaaaaattaaaaatagaattactatgtaatccatcaaactcatttctggatatgtatccagaagtattcaatgcaggacctcagagagatatttgcacacctatgctcatagcacattcaggatagctaagaggtgaaaacaacgcagatgtccttgatgaataaataaaatatggtatatacacacaatggaatattatttagctttaaaaaggaaataaatcctgtcatatgcgacagtgtgggtgaaccttgaggatattgtgttaagtgaaataagccagtcaaagacgaatactgtatgctttcacttatattaggtattattactgaaacaccagggatgtgttctaggttatgctgcttgctgcacagaaagccagttgctgagacgatgagttttgccagagaaggaggttttaattgggtgctgtagctgaggagagggtaactcagtctcaaatccatctccctggctgactacaattaagggcttatatagcagggaagaactgtaactacatgcaggaaaataggaattagggagagataaggaagagaagttggtcaacaggaagcaggaggtcacttaggcaatcatgatgggttgaggggtttgaggtttcattgtttagatgcagtgatctggtacgtttcagttccttgatatcatctgggagacctgatggttggtttcctgagaaaggaactcagataagacaaatgtaactttttcaagttttaagactgggagggtcaatttctatctttattcaaaagaaactataatggtcagttctatgggacagttaggttgttggtgtcagtatcaaaaattataaattcatagaaacagaggtagaatggtggttaccagggaatgaaggggagaaatgggttgttgttgtttaatgggtatagagtttcagttttgcaagatgagaaggttctggagatgtttcacagcagtgtgaatatacttaacacttctgaactgtacacttaaaaatggttaatatgggctgagtgtggtggctcatgcctgtaatcctagtattttgggaggctgaggcaggcagattgcttgagcttaggagttcaagaccagcctgggcaacgtggtgaagcctcatgtctacaaaaaatacaaaaattagccaggtgcagtggcatgcacctgtagtctcaggaggcggaagttacaatgagttgagatcatgccactgcgctccagcttgggtgacagagggagaccctgtctcagaaaaaaaaaaaaagttaagatgggaaatttttatgtattttctaccacaaaatgtgtagacagaataatacaacaaatctacatgtatacagcttcaacaattatcaacttataaacaatcttattttatttctgtcctcatctaacaccttgtctcttgattagttggaagcaattgatagagtttttgagctcttagagtgaaggggtggacccttaacatagctggaaatcatgggaaagctagtgacttgtgtgaatccagaagaaaagtggtactagtaagtggagtgatatgaagtctttataaggaaaatctagaaacaggaaatataataactttagagtatcattttggggtttccaagtatctaagaggcagattaaagaaatggaagtgagatagttttttgagaccagactttgttctgaaatcagacttaagatacaaatgtgcattttttactttgataattagagaatgaagatcttgtgtattctaaaaagttctctgtttttcctgtaatgttgattgcaggaggatagtccagggctgtgtggtttgttttataagtagctacttttatcaagaataattagcagagcatttgggaagagttttggcttttcttccctgaaatcaaaatataactatttagaaagcttttattgtcgcttataaatggaaggagtacttgtcacttccaaatgacaggaagaaccatagagcacttctacagtttgatttatatctcttaagtgtcatgttcctgtgcgggagctgtagtggttgacagcctggttcctagaactgagaggtgaagcccgctgagcttctggattgggtggggacttggagaacttttgtgtctagctaaagcattgtaaatgcaccaatcagtgccctgtgtctagctaaaggattgtaaacacactaatcagcactctgtaaaaatgtaccaatcagcactctgtaaaatggaccaatcagcgctctgtaaaatggaccaatcaagcaggacgtgggcggggacaaataagggaataaaagctggccgtaccagccagcagcagcaagcagcttgggtcccttccgcgctgtggaagctttgttcttggctcttctcagtaaaacttgctgctgctcactctttgggtctgcactacttttatgagctgtaacactcacctggagggtctgtggcttcattcctgaagtcagtgagaccgtgaacccaccgggaggatcaaacaattccggacgtgccaactttaagagctgtaacactccctgcgaaggtctgcggcttcactcctgaagtcagcgagaccacgaaccaaccagaatgaagaaaccccagacacatctgaacatctgaaggaacaaactccggacacactatctttttttttttttttttttttgaaatggagtctcgctctgtcacccaggctggagtgcggtggcgcgatctaggctcacggcaagctccgcctcccgggttcacaccattctcctgcttcagccttcccagtagctgggactacaggcgcccgccaccacgcacggctaattttttgtatttttagtagagacagggtttcaccgtgttagccaggatagtctcaatctcctgactttgtgatccaccctcctcggcctcccaaagtgctagaattacaggcgtgagctactgcgcctggtcaggacacaccatctttaagaagtgtaacactcaccgggagggtccgcgcttcatttttgaagtcagtgagaccaagaacccacgggaaggaataaattccggacacagaaccgtgactgggaccatgtgaagtggggacttcacatgatcccaataggagatcgcaccactgcactccagcctgtgtgtcagagtgagactctgtctcaaaaaaaaaaaaaaaaaaaaaaaaaaagaaagagattagatgccccttgccatgcagaaagttagggaaatagtgttctagttacaggaagcttttaggcagtgctgagcttgatgagttcaaagaatcaaaagaagtccagtgtgtggctggaacacactgaaggaggggaggggtgacaatgagattgtcaagttgagcacagaccagccttgtaaatcatgttaaagaatttaactttaagtgtttttgtaaataattgaaatattttaagctgggtaatgacatggtctgttttatgctttaaaaaagatggttcttttttgatttcagattggaaaggactaaaagagaagcaggacacgacttaagagggaagatattcgggctgggcgtggtggctcacgcctgtaattccagcactttgggaggctgaggcaggcggatcactcgaggtcaggagttcgagaccagcctggccatcgtggcgaaacaccgtctctactagaaatacaaaaattagccaggtgtggtggcacatgcctgtaatcccagccactctggaggctgaggtgggagaattgcttgaacccaggaggcagaggttgcagtgagccaagattgtgccattgcactccagcctgagtgacagagcgagacttcgtctcaaaaaaaaaaaaaaaaaaaagaaagagggtaagatatttagtgctcagaaccagtgctggcttgggttaaggtagcagcagcggcacaaggagtatgtagatgtgggaaatgtgtttgtgtttggagtaccaggacttagtggtgggaggtgaaagagaggcgttatgaatgacccctgggtttctagtatgagcaaactgatatgccacctctcgagggtgtgtgtgtgtgtgtgagaaaaagcatgtgagagagcatacatataagagtaattgagtctggaattcagaagactggcctgggatagagatacacatttggggggagttggcatgtagagagatttaaagcaataggaatgagtgagagagggagagagaagaaagagggcctagcactgtgatttcatttttctattgactctgttttttgaatttaattttagacattagaatagataaggttagctttccaaaatcagtctcatttgtattcggcattcagataaactcatatatttgcatatattattgttattattttttgatacagggtctcgctgtgttacccagactgcagtgcagttgcaccatcacagcttactgcagcctcaacttcctgggctcaagtgatcctttggcctcagcctccaagtagctgggactacaggcatgcgccaccatacctggctaatttttaaatttttgtagagacaaggtctcactatgttgcccaggctgatctcaaactcctgagctctagcaatcttcctgcctcagcctcccaaagtattaagattataggcgtgagccaccacgcctgaccagataaattttcagaatgggaaagggatggagttgcagctttctgggagggtaggggatgaaggagtagaggaggactcagggatttatgtggtctccagattacttcatttctggagtagtttacagtatgcccattatgaatgtgtctcatcctttatgtgtgtagtggagaaaaaaggttgagtttctgatcctcaaggtaaagtcgatattaatagttaactaaagtttcctacattctggcccctatctgcctgtctgcatatccacattcataccattcccttccaacctccatgcatgctgttttctatcatcatggtcctagacctagaatttcctttttcattggacaaatattttaggtctctgtttcagtcagagctttccctagttcccccaggcaaactctgtatttgtttctgtttctagtgttcattggttatagcaattattgtattaaatttgctgtttcttggtttgactgtctcctcaagaaactaatctttttgacatgagggattttttttttcttttaaaaaagcacttgagggccaggcatggtgggttttgcctgtaatcccagcactttgggaggatgacttgagcacaggagttcgaggctgccttgagccgtgattgtgccactgcactccagtctaggtgacagaatgagaccccatctctttagaaaaaaagtgtttcagtgtttgaattaccatcctgtctttctttgaagagccaaatacagcttacatcatcttcaggtaaaacaaaatttagggttcagaaactatatggcataagaaaatagttgaactgggcacagtgtttcatgcctgtaattccagcactttgggaggccaaggtgggcagattgcttgagctcaggagttctttcagaccagccagggcaacgtggcaagaccttatctctaccaaaaatacaaatagctggtcatggtatgtgcctgtggtcccagctgaggccggcaggattgcctgagccctggaggtcaaggctacagtgagccaaaactgtgccactgcactccagcctgggcaacagagtgagatcctgtctcaaaaaaataaataaataaaataaaataaaaaataaaaaagaaacaaaatggttgaaaatgtctttcccatgcctttggagtctaggatgaggtttaaaaaaaaatgtgtttctcaggtctattttaataggtagttaaaatatactttaaaaaattattataaggcagtctctaaagtgtattcttatccccaaagcttgatattacttaaaagaaagatgtattactgaaggaaatagaaattgaattaatggaattgttttggttatttgaattgccatttctgtagggtatttgagaattgttaggtcttgtttggaaccattgataaacagaagatagaatagaaatattgtactgcctcattgttcctagtctacaaattgatttatgctgttattcagtttatgtctctctttctctttttttttttttttgagatggagtttcgctcttgttgcccaggctggagtgcaatggcatgatcttggctcactccaaccttgacctcctgggttcaagcgattctcctgccttagcctctcgagtagctgggattacaggcatgtgccaccatggctaatttttttttttttttttaagtagagatggggtttctccatgttggtcaggctgatctcgaattcccgacctcaggtgatctgcctgcctggcctccgaaagtgctgggattacaggcatgagccaccacacctggcccagtttatgtcttttgtatgtacacagtaaaaagtagtagtctctttctttacatagtaaaaagtagcagtttcttactttttttttttgagacagagtctcgatctgtcgcccaggctgaagtgcaatggcactatctgggctcactgcgacctctgcctcctgggttcaagcagttctcctgcctcagcctcccaagtaactgggactacaggcacacgccaccacaccccagctaattttacatttttagtagagatggagtttcaccatgttggcaagggtggtcttgaactcctgacctcaagtgatctgcccaccttggcctcccaaagtgttaggattgcaggcgtgagccaccgcgcccagactaaaaagtagcagtttctatacccatcattattataatgttttactgcgttgatatgtatatagtggagcttttttgttagatttgaagaaaaaattggacgatgaattcattctaattaaaaaaataggccaggcacggtggctcacacctgtaatcccaccactttaggaggccaaggcaggcagatcacctgaggtcaggagttcgagaccagcctgaccaacatggtaaaaccccgtctctactaaaaatacaaaattagctgggcatggtggcaggtgcctataatcccagctacttgggaggctgaggcaggagaatggcttgagcctgggaagcagagattgcagtgagccaagaccgtgccattgcactccagcttgggcagcaagagcgaaactctgtcttaaaaaaaaaaggccgggcgcagtggctcatgcctataatcccagtactttgggaggctgaggcagggggatcacctgaggtcgggagttcaagaccagcctgaccaacatggagaaaccccgtctctaataaaaatacaaaattagccaggcgtggtgttgcatgcctgtaatcccagctactcgggagactgaggcaggagaatctcttgaacctgggaggcagaggttgtggtgagccaagatcgcaccattgcactccagcctgggcaacaagagtgaaactccgtctctaaataaacaaataaataacctaaattttaaaataaaaaaatctttgacactctacctttcagctgtcagtggaaaccacttaggtagctatgaagcaattctgcaaatattttatggaattctatatttgccagagtataatagaaaaaactaggccgggactgggcgtggtggctcgtgcctgtaatcccagcactttcggaggccgaggcgggtggatcgcctgaggtcaggagtttgagaccagcctgaccaacatggtgaaaccctgtctctactaaaaatacaaaaattagccaggggcttgtaatcccacctacctgggaggctgaggcaggagaatcacttaaacccaggaggtggaggttgcagtgagctgagatcacaccattgcactctagctcctgggcaagagagcgagactccatctcaaaaaaaaaaaaaaaaaaaaaaaaagaagtccgggtgtggtggctcacacctgtaatcccagcactttgggaggctgaggcaggtagttcagctgaggtcgggagttcgagactagcctgaccaacatggaaaaacctcgtctctcctaaaaatacaaaattagccaggcgtgttgtcgcatgcctgtaatcctagctacttgggaggctgaggcaggagaatcatttgaacccaggaggtggaggttgccgtgagccgagatcatgccattgcactccagcctgggcaacaaaaagaaaaacaaaaaaaaaagaaaaaaaactaggctgggctcagtggcttatgcctgtaattccagcactttgggaggctgaggcaggaagatcacttcagttcaggagtttgagatcagcttgggcaacatagcaagacctcatcctctacaaaaaataaaaaaaattaggtatgttggcatgtgcctgtggtcctagctactctgaaggctaaggcaggaggatctcttgagcctgggagatggaggctgcagtgagccatgatcataccactgcagtccagcctgggtgacagagtgagaccctgtctcacaaaagaaaaaaaaaaacaaaaactacttgagtcagcgagtacatagaacatttcagagcctcagcttgtatactgcatgttattctgaaactacagataccacgtagctttctaatgaaaaagttttatttgtttcttcctttcttttataggaatatatatgtcccagatgtgaatcaggctttattgaagaagtgacagatgattccaggtattgtacaagctcatgaataaatcagacattctattatcaaaactattttctctcagcatggactgagtaagttgaatttgttttacaacttacactctacagagagagcgagagtgagagagagagagtgagtgcatgagcttgcacaagagagggcagaagaatgggagaggaaaaagaaagaaaaatgggaaaatttggaaagtgatatcatagcagatgtggtgatacgcactgctcctgattgtatgtggcattccatgtacatctgtacgcatgtcagagtaaatctggtaagttttcatttattatctgagacttggggcttctcttagattattagttggtttttagtgaccactctgctgtctgaaggtaaactgctgttatacctctttggcgggttagggagtgacttctgacaaagatacctaatcaggtaaacaggctgttctagccaggaaaaccgattgttactctgctttgaggaggccttgaatctcttgttcttattaaggttatttggccagtgtggtggctcacgcctgtaatcccaacactttgggaggctgaggtgggtggatcacctgaggtcaggagctcaagaccagcgtggtcaacatggtgaaaccccgtctccattaaaaacacaaaaattagctgggtatagtggcgggcgcctgtaattccagttacttgggaggctgaggcaggagaatcacttgaaaccgggaggtggaggttgcagtgagccaagactccagcctgggcaacaagagtgaaactgtgtctcaaaaaaaagaaaaaagaaaagattattgctgtcaaacttaggccatctttccagggtgatattaatatatgggtttgtaatgcttggaatttgttcttattggccttcataaaggtatacagctgataaaaaggggaaatatttctgaaagtgactattacatattccttttttgtttatgtgaacaaaactataaaatcttttttcttttttcttttttttttgagacagagtcttgctctgttgccagattggagtgcagtggttcgatctcggctcactgcaacctctgcctcccaggttcaaatgattcttgggcctcagcttgcccagtagctgggactacaggtgtctgacactatgccctgctaatttttgtgtatttttagtagagatggggttttgccgtgttggccaggctggtcttgaactcctgacctcaagtgatccgcctgccttggcctcccaaagtgctgggattacaggcatgagccaccgtgcccaacctaaaatctttttcttttttttttttttttttgtgacggagtctcactcttttgcccaggctggagtgcaagggcacgatcttggctcactgcaatctctgcctcccaggttcaagtgattctcctgcctcagcctcccaagtagctgagattacaggcatgcaccaccacgcttggctaatttttgtattcttagtagagatggggtttcaccgtgtttgccaggctggtcttgaagtcctgacctcgtgatccgcccatcttggcctcccaaagtgttgggattacaagcgtgagccactgcacctggcctaacttaaaattttaataaattttagaatagcattgataggatggcctcttttggctaaacaaaatggcacatttgttcttttggggctatttggttaaacattcgtctgaaaattgaagaagtaccgactggtcaaaaagaatctgtaatctgaagcctcttaatcttggagtgactttggagattttaatggcagtaggtaattcctttactgttactgttggcagaatctaaagttgaaggtcccttccacaaccaggaaaaactacacattttacagtatgtactattagttttactttactaatgattggtgattatatgtgtaaataagctggagcttctggggcaatatgtggcatgggatctattttgatacagttaaatgtcatcttggttttaaatagtacaataccaacactaaacgtgtaagattagcatgactgcaaaattagcaattttgtgtggatggcatgctaacttgggatagctttttgtttgtgccattataattgcatcaaataacttatttcaggcacttatgctctgcatgtgctaattaaaagatatattggttgtgggagaacaattaatgggcttatcttttgccaacttttcaagtagtaaccctggtttctttaggcagatagtacttttatgcaaatacagttataaatgagaatgattaactgtaggatgaatctttgtctagcagggaactgtggattctgtggtttttgttcttaattcttttatgtgtctttgtagatcaaaggttgtcttatataggtgctattggtagcaatttactcaaatacaaagactctgtggtttgaaagagattagtgttttaaatgaaagaagaaatctttttcttagaatccttgtcttagaggcagtatgatatttccttctataaagttcataaacatttgctgatttaaatacttagcaattgcagtggtaagtagtggagggtaaaaaccagtaagaggagggccttgcatgtaaatattagataatgggctccatctgctcttaaacttccatgtagaggagcaccttgtaagttttcttaagctttgtaacatttctcagaacaatgtggtggtttttattatcccttctctatgattagctctattattctttaaaggaattttaaggaaagggaacggtgaggtagcttcagggagagcagaaccccagaaaataagagttgcggtttcaattaccaaggatgtttgaatccctgaaactgtgtagtaaaggcaggaaggaagagtcttggaagcctgtctgggcttgagcaatcaaatggatacatagccactcaatgtagttttttatggtatgtggtagttcaattagctgtttatttagcatagatgtacaagtacttttgggcttgttatacatttggagtgatttttacaaaagcgtttttctgaaattaatgcaggtattaaatggtttcttatcagggaataaggcttgagaatggttgcataaagagtggcattagctttgctttttcacttttggtttcagactaactagggtgtgtttgtttcctcagtgagctcagcacaatgcctggattggtattgtaatcctacaaatgaaaactatttgtagtagtttgtgaacttaccattggggtgagtgtttgtatgtttgtgtgcttaagtgtgtctcttgaagtaaaagtggtatccagcagttcctgtgattctttccatcccctcttcccggatgtgttaacttgttttctttgttctttgcaaatttcatggggacaatgggatttaatatttctctccactcttcagggtctttgggaatagatagttattttatcattttcacatgtgattaattcaacaacttttgagtgtcaatataggatattgacattgcaggattttaaaaggtgatagtactgtgtaatgtctgacacttaaacactctacatgtatttgaggcattaataaattgcagtctttgccttctgaatttatattaatgaaggagggaaatgggttgaaatggatgtggcaaatcctagatatttataatacaaggtaggttttagaatcaaagtgagagtgcagaagggtgtggaagagtcttatttggttggtgagttcagaagggcttgatggaggaggtagcatttgagatgggtcctgaaaggtgggtagggggagaaatatttattgaatccttttataatgttttaaatacagtaccaggccccttacattactacatttaatcattcctaagaaatattaactattgtagcctcaaatgttgtgttcatctggtggttgaatggttttttagtgaaacattttgttttgttagcgttcttgaggataaatatttgtcttttgataggtcaaatccgaattgcattgctgcctgtgggtcctccttccttctctatggtggcttctccaatttttcactggatttagccttgaaaaccacttgattttgtggtttatgatacttttcatagattaattcacatgccagttattcataatttcctttaataggtgttgtgttgggatgagttatttttccttattgggctttgttctcattatgccattctatatttagcttctgggaggggagcttgttcctgggaatagaatcaccactcattccttttctctttagttttttaggtggtggcggcagtcggatagacaataccacaacaacacattttgcagaggtaagttttcctttagctgtaggaattctttaagaagtggttaggtgttaaaatcatggcagatactaactttccagtgtggcacaacatcagagtttaactgaatgtataagaaaaaatgtgggccgtagtaacccttgggaagatttgtgttttcagtagctggggcttgggcgtgttacctttgataaacccttgattaggagaaagtaatagcctcaaactgtattcttttaaactggtagtgtttttaattcttgttttctactttgttattgtatatacagtgtgagaataagaagcttttgctgtttttgaaataacagtgttgcagactctgctttagtggtgtgacaaccaggtaaagtgcaggccaggataagttgtcgaagtcacaatgaaatagtcttcaaccttgtacagaggtactgatttccagggcttacctctagtcaacacagtagtttggtgtagattaaggatgtttacttgcctttcagatcccaagatggggtctgtaaataatttctatatcttcttataatgtggcgtccatattttttgggaaaaacaaatcttaactgtgatttgaaaacagggcattagtcttcattcttgaataccattttatattgaatccagagtaattttcttttttcacttcgtccattggcctaaagtctctttagttgtgttttttttttttaaaaaaagaaaccattgtaactgttcttaagtgtataattcagtggcattaatactctttgtttttaatcatttagagactacaacccagaaggtaccagtcagcctataaaaaacactgacgtttttcttttgcttgtttgtatgtgtaccctatattgccgtacaacttgttcagctctagaaagctgacagatgctaaaaggaagaaataagttaaatcccataatcaggatttctttatgttttaggatcacattagccttttccagagatagccgaagtgcctagagagatagcaaaatatttcactgttttgtatgtaaattgaaattgtactagtagtatatttgaaaagtgatatttaataagaagcctgtaaaaccctaagcttctctcccttattatttgaaaattattttaagacctgtagcccccacattttgatgttgttagatttatcaacattgtctgggtaatggtcctgttctatttagggtggtttttctgcttatggtctgtgctacttcttaatatacagtattaagagttttggttaactctgaactgcccgggttgattagagtgattccagacagatcgtgttttgaacttgcatttttattttcccattttaatggattgaaaaacattatttaatatgtgttctgggccaggcacagtggctcacgcctgtaatcgcaacactttgggaggccgaggtgagcagatcacctgaggtctggagttcgagaccagcctagccaacatggtgaaaccccatctctactaaaaatacaataaattagctgggcatggtggcatgagcctgtaatcctagctacatggtaggctgagacacgagaatcgcttgaacccgggaggcagaggttgaagtgagtcgagatcgcactactgcactccagcctgggtgacagagcgagactccatctcaaaaaagtaaaatacaataaaatgtattctgtttgccagtcctggaagcctttatgatttcagtattctttcctcttgtgtgtgctatttgtgataacacagattgtcacttactgattaggcatatgcagaagaagaaatttcatttgatttttctttagtgttctcttttaggtaatggaaatagatcggtctgccaattttgtaggtatgactcaccagaaagagatgcattgagtaagaagaaaaacaaatatatgtagtcagtttcctaactttagtaatgctaaatccaacactgatggcatgagttatccttcaggtgttaaagtatttttgctgattcatagcttgtaacttcgtgttctttagatgttgccagggatttttaataaattagctaagaagtgtgtgtgtgtgtgtttttaagagatggggccttattgcccaggctggactcgaacttctgagcttaagtgatcctcccacctcaggttccctagtagctgggattacaggcaggtgtcactgtgcctggctgaaagtatatactgaatgtttcatacatagcactctcctagaaataggggcaggaagtaaatgtcatggttgccttgcctgaaaggaacttaattttgttgtggagcaagtgcaaacacttaagaaaacaaggaaggctgggcgtggtggcttacgcttgtaatcccagcactttgggaggccgaggcaggtggatcacgggaggttgggagttcaagaccagcctggccaacatggtgaaaccccatctctactaaaaaatacaaaaaattagccaggcatggtggtgggcgcctgtaattccagctacttgggaggctgaggcaggagaattgcttgaacccagaaggcggaggttgcagtgagcggagattgcaccactggactccagcctgggcaataagagtgaaactcttatctccaaaaaaaaaaaaaaaaaggaaaagtgtacagagtataataaatttattctggggtatatgtaacaagtatagtagaaggaagagttaaggtgggccagggtcttgaggagaggtcatataacagtgattaagaacacagcctctggaaccagattgcctgagctcaaatcctgtgtctgccacttattggctgtgtaatctgggcaaagttacttagaatctctcagtgcctctcttgtccttgtctgtaaattgggaaataatcatccttccctcatagggatgttacgaggattaaatgagttaatacatgctaggtgtgtagaccgcaatgtgcctaccatctagtgagtgcttgatacattttagccattattaagacttcatagtgaagttagaacttgcactggagccttgaagagtaggtggaatttagataagcaaagatgtgaaaattatctcaaaatagtattcataagctataaggttttatgctcatgtccctgaagaaaaaacttagaaataaaattatatatagaaactaaagttgtttttcttttccctgctttagttggtaatttcggcaaagacttatgctcagttttgctctatttttctttagctggagctgcttgtacaatgaagtggttattttctataagtaacatttactgatagctgaattcttaaaatactgtctatattagaagaggcttattccaagaaaatttctgtcaaaatcagtattgacttttttttaaaaaaatgagactggggtaggagataagagactaatgggatagagagaaggtaggggagggttgccagttacatgggagcagtgtttgaataatgtgtgagggccggtggagagtgaatctgaaaatattgctagcagtttgtagagagaagacattgctatactaagcttcctggtggtaatctagaaagtgagccccatagctacctgaaggtttcattgattacttgcaaacttctgaccacgacctggtgccagtgggtcatctgatcttagagtctcagcttacctgaatggattgcttcagtgcaagagtggctctggctgctgcctcagattgggagaaaataagatacatggctttctggaaaaaagagctctcaggtatgcacaagagggcagggtgctctgagctgatttatatgtatttaaataaaatttgttatttgtttttgttacataagcagcattatagtggcagtaaaaaatttaaaaatatgtatcttgagtttcacttttttttttttttttttttttttagacggagtctcactctgttgcccaggctggggtgcagtggcgcaatctcggctcactgcaacctccgccttctgggttcaagcgattatcctgcctcagcctcctgagtagctgggaccacaggcgcgtgccaccacgcctggctaattttttatatttttagtagagacggggtttcaccgtgttagccaggatggtctcgatctcctgacctcgtgatctgcccgccttggtctcccaaagtgctgggattacaggtgtgagccactgcgcccggccgagtttcactattctaagagctcccttttccatacatttcctttcagattttgtcctaaggcatagttactgaaaaataacaaccttaagctcttttttgtttgtttttttgagacggggtctcgctctgttgcccaggctggagtgcaatggcacgatctcggcttactgcaacctctgcctcctgggttctagtgattctctcacctcagcctcccgagtagcttggattacaggcccccgccgccaaacctggctaatttttgtatttttggtagagatggggttttaccacgttggccaggctggtctggaactcctgacctcaggtcatcctctcgtcttggcctcccagagtgctgggattacgggcttgagtcaccgtgcctgggcctaagcttttttaaaaatgagaaatattggccgggcatgcagatcacttgaggtcaggagttccagaccagcctgtccaatgtgatgaaaccctgtctttactaaaaatacaaaaattagccgggtgtggtggcgggcacctgtaatcccagctattcgggaggctgaggcaggagaatcgcttgaacccaggaggcggaggttgcagtgggctgagattgtgccactgcactctagcctgagcaacagagcgagactccgtttcaaaaaataaagaaatatcccatattgtcattacttgattatagctttatgcattttttagcaaaatacttctcatttctcatgtgcatacctcataactgtttagagttgctgtcataagagtatattgtatttctgcctctaaaaatttacttggtattatgtcataaaccttttacttgtctctctatagttattagaattatagctggacgtggtggctcatgcctgtaatcctagcactttgggagggcggaggcaggcggattgtttgagcccaggagttcaagaccagcctgggcaacatggtaaaaccctgtgtctacaaaaataaaaataaaaagccaggtgtagtggcatatgtgtgtagtcccagctactcgagaagcggaggtgggagaatctcttgagcctgggaggcagaggttgcagtgagctgagctcgtgccactgcaccccagcctgggtgtcagagtgagaccctgtctccaaaaaaaaaaaaaaaattaggacttcatattctttaatggctacattatatttattaaactattatcctgtgttaggcatgtctagttatatatgatggttgatcatcgatcatacttcctttacctgagtctagaacatactgagaaaacatagaacaccagacagatggatataaaaatttaatttttattcagctgaattggaacacaaagttgaactgtggtcaaatggacatcctaagtttatacaggatgacctacctgagaattagaggctgcaaagcaggcacacataatcagaacaatgtactttgcatttgtgcaacttcctaatacatgaactccacttgctggagaaatgcgaaatcactagagattagactttgctattcactaatcagctacatcattcctctgttgaaaagtacatacaatatgatgccctttacataaaattctagaaaatgcaaaccacagaaagatcaggggttgcttggggatgggaaggggcaggagggaaggattacaaaggcacacgaggaaacatttcggggtgatgagtatcttccttactttgctttaatgttttcacaaaatcgcctgtgaactttttcaagattacatttctaaggttaataattataaaattatttacccttaattgactcatctttatacactctaatgttattttttgagatataattcatatactacgtaattcaccctgttaaagtgtacagctaagtggttttagtatattcacagagttatacaactattaccactgatttagaactttttcatcatccccaaaagaatccccatacacattagtagtcactacatatttctccacagttctctcagccctaggcaaccaccaatctattttctgtctctatggatttgcctatataggatatttgttataaatgaaatcatgcaatatgtgaacctttgtgactgactcttttctaattagaatactgttttcaaggttcatccatgctgtagcatgtatcagtacttcatttttatggctggataatactacatggtatggatattccacattttatttattcatcagttgatggacatttaggttgtttacactttttgcctgttatggataataatgctgctgtaaatatttttgtacaagtttttgtgtgatcatatgtttttaattttcttggttatataactaggagtgaaattgctgcgtcatatggtaactgttcaactcattgaggaacagaccataatattttaagaagtgctgatgtgatcatggttagtgtagagcaagttctgccaaatggaagatattgtccatcctgttttttattttgaatgtgtaaatagttcaccccaaatattttcagaaatactgtcattatacttacattcagagtaatgttttcagtttttcaaggcaaaacttgtcaaactgtctctgtgattctttagactgttttagcaaaactctatgatagtgttccctattagtttttacttatgtaagctgtgtcctgaatacccagttttgttgtatgagctattttttttttcttttatgcttatctaagtctactcagagacaaatgacctgaagctatttttatccttagtgctgatttggtataaatttgtgaggtgtgcttttccatcctgtgttctttggtcagggtacactattattttgagattaaaataggccacaaatacattgactgttactattaatttgcactaatttgcactttgtatactagtaggaaaatgcctcatgctgatgttgaagctgtttttaagcatggatcctttagaaattttgtatattattaggtgtggtaacaatttatagtcatctaaagtatgttagtatcaaagcagagtattatgaacttggtgcttgacttttctgccagtcaagattttaaatatttcatttttatattataatgaaactaatggttactttgagagttgtcttctgtgagcaaatgttgtggaattgtatatagtaagggaatcatagatttcttataattcaccttagtgagatagatgattgagaacatggaggagtctgctcgtactttttcacttattgaagacaagtatagttttaggtttttaaatgtcgtgtttactttggaattttgggtcaagagaattcttgtgttctagaccgtttttcagactagaaaccagtgatctctaatagatgaagactataattagaaagtaaagggaaataaggcagatttgataagaagcgcaaatggcagttaaaatgaaaaggtgttttatgtcaccagtatttagagaaatctttttgtttggagacagagtttcactcttgttgcccaggctggagtgcaatggcgcgatcttagatcactgcaacctctgcctcccgggttcaagcaattctcctgcctcagcttcccgagtagctgggattacaggcatgctccaccacgcccagctaactttttgtatttttagtagagacggggtttcaccatgctaggctggtcttgaactcctcacctcaggtgatccacccgcctcagcctcccagagtgctgggattacagatgtgagccactgtgcctggctgagaaatctaattgatgtttttactctgcatattactctttgttcttcagcttatatattagaatttttaaaactttaaaaaaatgttggtcaggctgggtgcagtggctaatgcctgtaattgcagcattctgggaggccgaggcaggtggatctcctgaggtcaggagttcaagaccagtctggccaacatggtgaaaccccatctctactgaaaataaaaaattagtcgggcatggtggcagacacctgtaatcccagctactctggaggctgaggcagcagaatggcttgaacctgggaggcggagtatgcggtgagccaggatggtgccactgcactccagcctgggtgacagagcgagactccttctcaaaaaaaaaaaaaaaaaaaatgttggtcagagtaggggtaaatgtaagcatttatactctggtaggagtctgaattggtacagtagcccccccccttaccctgtggtcaaccatggcctgaaaacaggtgagtatagtacaataagatattttattttatttatttttatttttatttttttgagacagggtcttgctctgttgcccaggctgaagtgccatggagtgatctcggctcactgcaacctctgcctcctgggtttgagtgattctcatgcctcagcctcctgagtagctgggactacaggcatatgccaccatgcccggctaattttttaatttttttagtagagacaaggtttcaccatgttggccaggctgatctcgaacttctggcctcagtgatcccccccaccgccttagcctctcaaagggctgggattataggcttgagctactgcgcccggttacaataagatattttaaagtggggcacagaggctcatggttcaatcccagtactttgggaggccgaggcaggaggattactttaagccagatgtttgagaccagccacaaaattagaccttatctctaaaaagaattttttttttaattagctgagtgtgatggtacatccctgtagtcctagctacttgggagattgaggtgggaggatcacttgagcctaggagattgaggctgcagtgaaccatgatcacggcgttgcactccagcctgagcgaccgagttgagaccttgtctcaaaaaaaaaaaaaaaaggccacattcacaaaacttttattattatatattgttataactgttctattttattattagttattgttgttaatttcttactatgtctaagttataaattaagttataagttataaattaaactttactgtaggtatgtgtgtataggaaaaaacatagcatataattagggttctgtatagctcactgtaaccttgacctcatgagcttgagctcaagatcctgggttcaagtgatcctccccactcagcctcccgagtagctggaacatcaggtgcttgctaccacacttagctaatgtttaaattttttgtagagacaggatctcactctgttgcccagactggtcttgaactcctgggctcaagcgatcctcctgccttggcctcccaaagtgctaggattacaggcataagccactgtgcccagcctgtttttgggttttctaggtacacaaattattaagagttcagcaaattttctgtatactaaggtcaatatacaaaaatcagttgcgtttctgttagcaggaattaactattaaaatatagaattttaaaaaaaagatactaaggcaattagaaagtcagttcaataggaaaatggacaaaagacatgaaacaagataagacataaaagagaaagaatagagatttaaaactgatttaattgaaacaactgatgagtactgaaaaagtaaactcagtgtgatttaacactgagtttaaatttaagaaataaatgtggctgggcgccatggctcacgcctgtaatcccagcactttgggaggccgaggtgggcggatcacttgaggtcaggagtttgagaccagcctggccaacatggtgaaaccccatctctactgcaaatataaaaaattagcggggcgtggtgtcacatgcctgtaatcccagcttctcgggaggctgaggcaggagaatggcttgaacccaggaggtggaggttgcagtgagccgagatcgtgccactgcaccccagcctgggcaacagagcaagactccatctcaaaaaggaaaaaaagaaaaaaaaagaaagaaatgtctggatttctaaaacaccaaaaaaaaaaaaaaaatgttgggggaaagagaagacatatgaatggctggtaaatattacatgacaagatgtttagccttattggtatattcgtatcagggaaagcaaactaaaaccacaatgacagggtgatgtcagcgaaaatggtagagtaggacttctgtgggtcatccctctgcagaaacaccaaacaccttgacagaaaagtcagaatttagcttatcaaaactctggaaaggtaatcaaaggtttacagcagccaagcaaatacttcgccagaagaaagggcactgaaacaaggtaagagatctttgtggcattttagcttaccctagcctcacctcccttcctggtatggctgcagtcttgaagatgacagcctgtgttccccatgctggtgcctgattccagagagtggacactcttcctcctgagggattctgtgttctgttttgtcctttctccaaaggactgccaccaggggcaaaaaacaaacaaaaaaaccaaaaaaagaaaaaaaaaaaaacagggcaaacaataagatattgaaagcctgagaggaaaagctgtagagtgagtttttgtagaggaataggagctttgaaaagctattgtggatgagaaactagaaagccaagtgcacagctcagggcagtatgtgtgctcagaaaagacctgagaaagccattagctttcacctctggcttgtctttaggttcaacacaaacaggaagtgaatattaaggtagatttataaaggccctgggtaagttttgaaggagtgccccaacagctaatcagtagagacctggcgagcattttacttttctttttctttcttttttttttctttttggtttatttgttttgaaatgtggtcttgccttgctcaggctaatcttgaactcgttggttcaagcgatccttccacttcagcttcctgagtagctggaattacaggcacacaccactgtacccatctatttttgtttttattttttacacattataaatgttcagtttttttaaaaaaaattacgaagcatgtgaagaatctagaaaatatgcttcattcacaagaaaaaagaaatgaacagaaactaccccgaggaagcactaatactagaattactagacaaaaactttaaatcagctgtcttaagtatactcaaagagctaaaggacaccatggacaaagaagtaaaggaattcaagataataatgtctcaacaaatagagaatatcaataaagagaaatttttaaaagtaggcaaagagaaattttggagctgaaggttacaataattgaaatgaaaattcactaggggagctcaacaaaagatatgagcagacagaagaatcagcaaacttggagataggtccactgaaattatatagtttgaagagcacacatttaaaagactgaagaaaaatgaacagagtccaggagatgtgtgggataccaacatatatatcatggtaaggagagggagaaaggtgcagaaaacatgtttaagaagtaattgccaaaaccatttcaaatttgacaagacatgaatatacacatcaagaagctcagctaacacccaagaaggataaactcaaagacatccatacaagacacattataattaaaatttccgaagccagagataaagagagaatcttggaagcagcaagagagaagcaacttgtaaaatataagggatcttaaataagatgaatttctgttgatttcttagcggaaaccatggaggctagaaggcagtgggataacatatttaaagtgatgaaagacagacctgccaaccaagaattctaaatctggcaaaactatccttcaggaattaagaagaaatcatgacatacccagataaacaatagctgagggggcttcattgttaatagacctgccctgtaagaaatgctaaaaggagtcttcaggctcaccacagatctattaaattttctttttggcataggaccgaaacatgcattttaattaaacattcgtaatttttcttacacagcaaaaccaaaagccccacaatggaaaatcattttctgttcactgattgttaaaaactttttttaaaaaaagtcctgtgacatcaagtgcttgccaggatgtggcacagtagaaactcttaaacacttggtgggtgtttaaattgctacaaccagtttggaaaacaatttgtcattacccagtaaagttgaagatgtatagatcatgtaatagttttacagaccaaaaatatagaaactctggtacctctgcagaagaagacatacagtaatattcacagtggccatttgtaatataaaaaactgtaaacaatccaggtgtttattgattgatttttctaacatgtgacttatttctggtctttactagctttggggccatttggatcacacgatgttttttcaagattttagaccctttctaagtagcagtccactggaccaagataatagagccaatgaaaggggtcaccagactcacactgacttctggggagcaagacctccacggttgccattgggtcggagatacagatctcgaggaagttctcgtcctgacagatctccagctattgaagggtgagttgttttattttaagttctttttaaggtagtttcaatgaaggacaaattggtataatctaatctttataagggtctcatacttattacctttgtggacaagatggacatatgtagaaaggatgaaagtgaagctaaattgaatgttagtactcacccgatgataaaccagagagtgagaaatgctatgtctctgattaacatttttattaatggctcagattaatttatagatgatatgtgtctcagtccattttgtgcagctatagcagaatacctgagactgggtgatttataaagaacagagattcatttcttatatttctggaggctgggaagtccaaggttgagggatccacatctggcgagggccttcttgctgtgtcattccatgttggaaggcagaagggcaagagagcatgcatgagcaagaaagaaaggtgccaaactcatccttttattaggaactcactcaacaataactaatccacttccaggataaaggcatttaatccactcacaggagattcatctcttaaagtctccacctttcaacactgctccactggggattaagtttccaacacatgaatttttgaggagggcacattcaaactatagcagtatatttatcaaaatttcaaaagggtatcaaatatattaggcattaggattaaatatttcaacagattggaacagtggacttaacatgaaatttaatcaagtatctgctttttgtgaagaaaggaaaaaaatttaataggataaatatgaagtcttgtgactgtaaaaacattcatgtaataaatgtttgttgagtgtcttttgtatgggacactgtactagacactaggaacacaatgatgagtcaaatagatggttttgctcatggatctcatttagttggaataataaacgttaattttaagtgtttaccatatgcagaggactgtgcttcatgctttatctgctttatgttgtttaatttgtgtgaagtaataggtgctattgctgttttcattttataaaataattaactgagtctcagagaaataaagtaacagccattggtggatctaagacttgaatctagggctatatgaatctagtgcgacattgtcttatatggtagctgctagccacatgtagctatatgtttacatttaagttaaccaaaagttaataaaactcaaaattcaaagtacctcaatcccaaatagctatattttgagtgctcattggccacatgtagctaatacttatcatatttgacagaacatattatagaaaatttccattatcttagttctattgaacagtgctgttctagagcctacactccccctttcccccaacacacaccttctaggctttattaacattttactatacttgcgttattacatatctatccattagtgtttctttgttaaacttgtttgcttttggttcctaatatatgcactatcatactaagaaagtttaattttattcataatttattaggggcttttaattaagaatgactaatgattttgtcacatgccctttgcagtcctatcaaaatgaccttagagtttttctcccttaaacagttaatgcattttattaacaagtaggttttctaatgttttctagtgtttttattcaagctgctttgtcaaggagcactaaaacctcttttttaggggtcggggttggggaaacagggtctcactttgtttcccaggctagaatgcagtagcaagatcatgtttcactacaacctcaaactcggtgggctcaagcaatcctcccacttcagcctatgaactaggtaggactacaagcatgtgccaccacgcctggctaatttttcaatttttggtagagactaggttgcccaagctggagtctcttaacacattattggagttgatttgttccttatctttttttttttttttttttaaggatttttacatttattcaaaagaggatgagtctctttatcaagttttggtgtcaggattatattagtttcataaaaggaactgggaaaacttgctgtattcttatgcttggaaatagtttacataacacaggaattacctattatttaaaggtttaatgcaagttacctgtaattccatctggacctggtatctttttgggaactagatctattacagtcttttcagttacttctgtggttgatagtatagggtagtgttttatttatctctgtattctcagcttctagtgcagtatcggttttatagtggctactaaacatgtttgttttgaataagtggataattgtaattatgtctctaaaaagtataaaaaacatatgaattaatagtaataatagctaagagtatgtgccagaaactagtctaaatgctttacaggtattcatttgtttaatcctcactataaccatgtgaagaaggtattgtgaatatctccattttactggagaaactgaggcacagagagtttaggtaaattgtctaagagtataaaggcagttaaatattggagccaggatagtgcaaaaatcaaagtatttgtatttggtgagatttttaactgttcacttatactaaaaaattttagtataactatttagtataagtcaaaaatttaaaattaagtagccttctcacttattttttaaccaaagatttaagcatttccctaattttctcagaaactttccttccaaggcaccagtatatcagtaaatagaacttgaaagtttttaattcagtttcttttctcttttctttcatagaagtataaataaacacagtatatctttggggcctattactatacccagctagcaggcctgcctagattgttccatatggttgttactttacagtaattgtcattatgatgtcactgtatgttttgaaagtacaatttcatgttttatacatttttaaaaattgattgaattttagcatggcttcttcctgataacagttttgtcctcttgctttgagaaggagcatatgggcattccacttatggtttccatgggctgcatctcagattcctgttcattctacgggtttcactgtagacagagtactttgtatttaatggccgggtgcggtggctcacacctgtaatcagcactttgggaggccgaggcaggtggatcacttgaggtcaggagttccagatcagcctggccaacatgatgaaatcccatctctactaaaaatccaaaaattaaccaggcatggtggcggttgcctgttatcgcagctactcaggaagctgaggcaggagaatcacttgaacctgggaggtggaggttgcagtgagccgagattgcgccactgtactccagcctgggcgacagagcaagacctcatttcaagaaaaagagtactttggctggcgccaacagggtccaggtctgtgcctgccattggagaggatgccacagccacaggggtgggcgctggcctggaggcctccaaggggcatctcctgtgagcccaggggatgggcaggatctgagcggagaagagtgaaagtggaggagtgaggccagaacaaaggctttgccgtgaaagaggtggtttcccgcctaggctctgaccttcactcactgtgtggcccaggccaagggcaagcgtctgacctcgctgggcctttgtttctcaggggtaagatgaaacaatggctccctctccctctccctctccctctccccacggtctccctctccctctcttgccatggtctctctctgatgccgagccgaagctggactgtgctgctgccatctcggctcactgcaacctccctgcctgattctcctgcctcagcctgccgagtgcctgcgattgcgggcgcgcgccgccacgcctgactggtttttgtatttttatggtggagacggggtttcgctgtgttggccgggctggtctccagctgctaaccgcgagtgatccgccagcctcggcctcccgaggtgccgggatggcagacggagttgcgttcactcagtgctcaatggtgcccaggctggagtgcagtggcgtgatctcggctcgctacaacctccacctcccagctgcctgccttggccccccaaagtgccgagattgcagcctctgcccggccaccaccccttctgggaagtgaggagcgtctctgcctggccgcccatcgtctgggatgtgaggagcctctctgcctggctgcccagtctggaaagtgaggagcgtctctgcccggccgccatcccatctaggaagtgaggagcgtctctgcccggccgcccatcatctgagatgtggggagcgcctctgccctgccaccccgtctgggatgtgaggagcgtctctgcccggccgccccgtctgggaagtgaggagaccctctgcctggcaactgccctgtctgagaagtgagaagctcctccgccgggcagccacaccgtctgagaagtgaggagcccctccgcccggcagccaccccgtctgggaagtgaggagcgtctccgcccggcagccaccccgtccgggaggtgaggagcccctccgcccggcagccgccctgtctgagaagtgaggagcccctctgccgggccagccgccccgtccgggaaggaggtgggggggtcagccccctgccctgccagccgccccgtccgggaggtgaggggcgcctctgcccggccacccctactgggaagtgaggagcccctctgcccggccagccaccccgaccgggagggaggtgggggggtcaggtcagccccccgcccggccagccgccccgtccgggaggtgaggggcgcctctgcctggccgcccctactgggaagtgaggagcccctctgcccggacagccgccccgtccgggagggaggtgggggggtcagccccccccggccagccaccctgtccgggaggtgaggggcgcctctgcccggccgcccctactgggaagtgaggagcccctctgcccggacagccgccccgtccgggagggaggtgggggggtcagccccccgcccggccagccgccccatccgggagggaggtgggggggtcagccccccgcccggccagccgccccgtccgggaggtgaggggcgcctctgcccggccgcccctactgggaagtgaggagcccctctgcccggccaccaccccgtctgggaggtgtactcaacagctcattgagaacaggccatgatgacaatggcggttttgtggaatagaaagcggggaaaggtgaggaaaagattgagaaatcagatggttgccgtgtctgtgtagaaagaggtagacatgggagacttttcattttgttctgtactaagaaaaattcttctgctttaggatcctgttgatctgtgaccttacccccaaccctgtgctctctgaaacatgtgctgtgtccactcagggttaaatggattaagggcggtgcaagatgtgctgtgttaaacagatgcttgaaggcagcatgcttgttaagagtcatcgccactccctaatttcaagtacccagggacacaaacactgcggaaggccgcagggtcctctgcctaggaaaaccagagacctttgttcacttatctgctgaccttccctccactattgtcctatgaccctgccaaatctccctctgcgagaaacacccaagaatgatcaattaaaaaaaaaaaaaagaaaaagagtactttgtatttgtatttaagaaatcagatgtcagagattagcctttgtgggattattagtgtgttcctcacaccaacttaataagtttccctgaaatgaggtccattttctttgactttttcattggcatgagtaaaacttttttactaacacagagacagggaactctcacattgttcattcattctgcaaatatttattcagtgtccctaaagtatgtgctttatcctctaatctgcagcttttgaatgatagttaattaggtcttgaatagactagctcatcttatctgactttaagtgcatctgacctgtgccagcagattaatttataaatttataactgagggtattctgtttcagtgactataaaactcatttgtttgttagcatactcttgtctttgaatttctcaagtatcaagaaatcaaaagcaatcagatggttgtttagtacatatagaatcagcaaggaaattgcatgatctttaagagaaattccatccagattgtgataaatgctaaggaattactcatatttcacttcaaataatttttttttaattttttttttttttattgatcattcttgggtgtttctcgcagagggggatttggcagggtcataggacaatagtggagggaaggtcagcagataagcaagtgaacaaaggtctctggttttcctaggcagagggccctgcggccttccacagtgtttgtgtccctgggtacttgagattagggagtggtgatgactcttaacaagcatgctgccttcaagcatctgtttaacaaagcacatcttgcaccgcccttaatccatttaaccctgagtggacacagcacatgtttcagagagcacagggttgggggtaaggtcatagatcaacagcatcccaaggcagaagaatttttcttagtacagaacaaaatgaagtctcccatgtctacttctttctacacagacacaacaacaatccgatttctctatcccttccccacctttcccccttctctgttccacaaaaccgccatcgtcatcatggcccgttctcaatgagctgttgggtacacctcctagacggggtggtggccgggcagaggggctcatcacttcccagaaggggcggccgggcagaggcaccccccacctcccggacggggcggctggccgggcggaggcaccccccatctccctcccggatggggcggctggctgggcgggggctggcccccacctccctcctggatggggcagctggccgggcgggggctgaccccccacctccctcccggaccgagtggctgctgggcagagacgctcctcacttcccagacggggcggctgccgggtggaggggctcctcacttcccagacggggcggctgccgggcggaggggatcctcacttctcagacggggcggctgccgggcggaggggctcctcacttctcagacggggcggctgccgggcggaggggctcctcacctcccagacggggtcgcggccgggcagaggcgctcctcacatcccagacagggcggtggggccgaggcgctccccacatctcagacgatgggcggccggcagagacgctcctcacttcctagatgggatggcggccgggcagagacgctcctcacttcccagacggggtgtcggccaggcagaggctgcaatctcagcactttaggaggccaaggcaggcggctgggaggtggaggttgtagcgagccgagatcaagccactgcactccagcctgggcaacattgagcactgagtgaacaagactccgtctgcaatcccggcacctcgggaggccgaggctggcggatcactcgcggttaggagctggagaccagcccggccaacacagcgaaacccagtctccaccaaaaaaatacgaaaaccagtcaggcgtggtggcgcgcgcctgcaatagcaggcacttggcaggctgaggcaggagaatcaggcagggaggttgcagtgagccgagatggcagcagtacagtccagcttcggctcggcatcagagggagaccatggaaagagagggagagggagaccatggggagagggagagggggagggggagggggagggccaaatatttttttaagacggtaaaatattaatgcttgttaggttttttcctttgtgttaggtcaacaccagcacattcatgttttccagacaagtaatagagattaccacccattagtctgcacttactacattaaaacccatctttattttattttgttgtttttgttttgttttgtttttttgagagggagtctcactctgtcacccaggctgcagtgcagtggtgtgatctcggctcactgcaacctctgcttcccaggttcaagcaattctcctgcctcagcctcccaagtagctgggactacaggcatgagccaccatgcctggaaaattttttgtatttttagtagagatggggttttgccatgttggccaggctggtctcgaactcctgatctcaagtgatctgcctgctttggcctcccaaggtgttgggattacaggcgtgagccactgcgcccagccccatttttattttattgtgctttactcttttgtttttttgttacactttagcttggtagtttagtctccttcctggttatataaaggaagcctctttgattttagcagtaagctgtttctgattcgctttgtagggtacattacttctaagaaggtgtcccacctaaataatacgttcttttaaaaatttattatttttattttagattcgggggtacgtgtacaggtttggtttttattttttaatttttaaaaatttgctttcctggtaactcacaaaacagcaggtttattacacgggtatattgtgtgatgctggggtttgggcttctaatgatcccatggcctaagcagtgaacatagtacctataggtagtttctcaacctttgcccttctccctccctctcccttttgtgatctccagtgtttattattccttactttgtgtccttgtgtacccaatgtttagttcccatgtataagtgagaacatgtggtatttctgttttctgtgttaagttgcttaggctaatgacctccagctatattcatgttgctgcaaaggacatgatttcgttcttttttatggctatgtaaagaatatgttttaagatttcccacctagagaatatgttcttctgaaattaaccctaggttcttggaccatagatttctgaccactgatcacatctcagattttgagaactgactttttttggttaacttttttttttcttattaaaaaaaatttgttttggtatggaataaaaagacagccttatccagaaatagccatagttacaccttgatgtataatcttgtagacctttttaaatacatatatatgataattacatctatataattgaaattgaattgattatactacacatattttataatcttttttatcttaatagattgtatatatctttcaagataacatttgattggggcctgtattagtctgttttcacactactgataaagacatacctgagactgggaagaaaaagaggtttaattggatttaatagttccacatggctgagaaggcctcagaatcatggtgggaggctaaggcacttctaacatggcagcagccaaaccatgtcattctgcccctggcccctccaaatctcatgtcttcacatttcaaaaccagtcatgcattcccagcagtcccccaaagtcttaattcatttaggcattaacccaaaagtctgaagtccaaagtctcatctgagataaggcaagtcccttctgcctgtgagcctgtaaaatcaaaagcaagctagttacttcctagatacaatggaggtacaggtatttcgtaaatacggccattccaaatgggagaaattggccagaacaaaggggttacaggtcccatgcatgtccaaaatccagcaggacagtcaaattttgaagctccaaaatcatctcctttgagtccaagtctcacatccaggtcatgctgatgcaaaaggtgggttcccgtggtcttgggcagctccacccctgtagctttgcggggtccaacctccctcccggctgctttcactggctggtgttgagtgtctgtggcttttccaggcgcattggtgcaagctgtcagtggatctaccattctgggatctggaagatggtggcccacttctcacagatccgctaggcagttccccagtagggactctgtgtgggggctcccaccccacattttccttccgcaccgccctagcagaggttctccatgagggctccgcccctgcagcaaacttttgcctgggcatccgggtgtttccatacatcttctgaaatctaggcggaggttcccaaacctcagttcttgtcttcagtgcactcgcaggctcagcaccacatggacgctgccaaggctttgggcttgcactctctgaagccacaacccaagctctatgttggcccctttcagccatggctggagcaactgggacacagggcaccaagtccctaggctgcacacagcacggggaccctgggcccagcccacaaaaccactttttcctcttgggtctctgggcctgtgatgggaggggctgctgtgaaggtctctaacagggcctggagacattttgcctgtggtcttggggattaacattaggctccttgctacttatgcaaatttctgcagctggcttgaatttcccctcaaaaaatgggtttttcttttttgtcacataggctacaaattttccaaatttttatgctctgcttcccttataaaactggttaacagcacccaagttacctcctgaatgctttgctgcttagaagtttcttccaccagatattctgaatcatctctctcaagttcaaagttccacaaatctgtagggcaggggcaaaatgctgccagtctctttgttaaaacataacaagagtcttctttgctccagttcccaacaagtttcttatctccatctgagaccacctcagcctggaccttattgtccatatcactattagcattttgggcaaagccattgaacaagtctctaggaagttccaaattttcccacattttcttgtcttcttctgagcccttcaaactgttccaacttctgcctgttccttagttccaaagtcaattccacatttttggtatctcttcagcaatgccccactcctggcaccaatttactatattagtccattttcacgctgctgataaagacatacccaagactgggaagaaaaagagctttaattggacttacagttccacatgactggggaggcctcttaatcatggtgggaggtgaaaggcacttcttacatggcggcggcaagagaaatgaggaagaagcaaaagcagaaacccctgataaacccatcagatctcatgagacttactgtcatgagaatagcatgggaaagatcggcctccatgattcaattacctcccccagggtccctctcacagcatgtgggaattctgggagatacaattcaagctgagatttgggtggagacacagccaaaccatatcagagcccatctaggggaggtttcttaattaattttttcctgggctcaagtgatcttcccatctcagcttcctaagcatctaggaccacaggtgtgcagcactaggcccagctaatttttaaattttttttgtagagatggggtctccttatgttgtccaggctagtcttgtattcctgtcttggcctcccaatgtgctgggattacaggtgtgagccactctgcctggccccataagaggtctcttaatttattcagcagacattgtgtattactgtgtgccagatgttgggcatacagtagtcaataaatagtcaagaatgactgccctcgtggagcttaagtactaatggagaaagatagatgatcaaaataaatagaattttaagcagtagtaagtgctatggtggaagaaaagcagggatgggagatagggaatatggttgaagtgaagtttcaaaaagagcatagtcagcaaatgtcttattgagaaagtatctgaatagacaccaaggaagtgtagggatggacaaacaaggagagaccaatgtagggcagagaaggtgaggggaatggtaggagaagttgatgggagtgggaatggggaggtgggtattagattatatgaagcctagttggcaattataagagcttctgttccaatggagagttaggtgtcatttatatcttgaaatgattgctctaactgctgtgctgaaaatagaatggggggctgcgaggtgtgcgaggcaaagacacagcagagaaaccatttaagaggctattgcattaatataagctagagatgccagtggtttgggtgagagcagtgaaaaatggtttggtttcagatgcagtttggcaatattcatgataggagttactgacagattggatgtggggtgtaacagaaagaagagttatgacaccaaggtttttggcctgaaaacaagaagaatggagccaccatccactgacatggggaacattaggaggagtaagtttggaggaaaatatttaagagttcattcagtttgggacataataagtttgaggtgcttattatacaagtggaaatgttgaataggcagaggtcttggctggagataatatttggaagttgtggcctatatatgatatttaaaattataaagctggataaagtggtcaaagaagtcaagataggaaatagcagagctcagagaattgaggcctgggccctcgatggttagaagtttggaagataaggaagaataagcaaaggagactgagaagaaacagccagggaagtacaaggaaaacctagagaggctacagctctggaaactatgtgaagactcttacctggttttagcatgtgacttcccttccagacccagtgggttgatttttctcgtctgtgagtttctaaaattaaatgtatacactatcttccttccctccacatcttccccagacatttagctttaacaagaaaagatttttttttaataaacaaaattcattgtaaatactctgtcaactattgttctccgagcaacagctcttatgcattggggccaccctcagcagtctctgttactgctacaaaaacatgggactaacatctgacttccagagagtaagtagccaagaaagagaaatcatcagctgatcagctgctggtgagttgtccctcgtaattccaagcattcatataggattgacttttacagcttcaagaactaggctatctctcaaacttgattattaccatttacttattggtcagtgtaagcataagataatttgcccttcttgtcactgacaaataggtgggtatatattagttacctattgctgtgtaacactttaccccagaatttaacagcttatgacaatatttattatctcaatatttttgagggtcaggaatttgggagcaatttagctagatggttctggtgaagggcttcatgaggttataatcaacatgtcagctgtggctacagtcaaccgaacacttaactggacctggaacatccacttccaagatggctcactcacatgactgttggcaggaggccttagttcctcaccatctgggcctctccatagggctccttgaatgtccatattacttggcagctagcttctcttggagttagtgatccaagagaatgatagaggaagcaggaaaaaaacccataatatctttttatatcctaattttggaagtcacacactgtcattcctgctacattttgtctgtaagaggtgaatcactaaatctagcctacattcaaggagaagagaattagctccacctctagagaatttatggatgtattttaaaatcaccacagtttgccctctagccacaaattatttacacttcttctatgtgcaaaatgcactcacttcctcccgaaatctatcaaaaaagtctccttcttctatagcatcagcttgaaatataggtagctgtccttttaactaggtccaagtgtgggtgtggctccttgggtatagttcctcaggtatagttccttttgttgtgaagacctgtaaactaaagagacaggttaactacctatcacacacccaacatacagtgatatggacaggcagtgattctgaacaggtatagagatttcctgttccaaaagggaaaatgatggcacaaagaagttgctggttcacagcaattctgatagttgtctagacaaatgtcagaagttccttgactaggacttctacttctgcccaggagttcttctctgtgactctggaatccaccctgttagtcatcctttcttttccattaaaagtagttcatatttgtagctgcatagctttcttagcttgcttcttgccagtagaaatttcagggcccagagaccggttttcattttgtactatttttccacctttcagtttaagctggcagtgtttctttttaaaacttcgagtatcctgtgaatctcactgggattcatgccattaggcaaaagccacatccaccaatctcttctaaataggctttttccaccttgggtttctgctgggattgctgagagataccacttgtaatgggtagaattgtgtcccccaaaaagctgtgttcaagtcctaaccctgataaggtcaccgtgaatatgaccttatttggaaatagggtcattacagatgtagtcaagttatagtaagatcacactggatcaggaagggccctaatccaacggttgatagtcttataaggagagaaatttggctgggtgcggtggcttactcctgtaatctcagcactttgggaggccaaggtgggaggatcacctgaggtcagaagttcgagaccagcctggccaatgtggtaaaaccccgtgtctactaaaaatacaaaaattagccaggcgtggtggcccatgcctgtaatcccagctactcaggaggccgaggcgtgagaattgcttaaacctggaggcagaggttgcagtgagctgagatcgcaccactgcactctggcctgggcgagagtgagactctgcctcaaaaaaaaaaaaaaaaaaaaaaaaaagaagctagaaatttggacatgaacacatgaacacagaagacagaagaaagccatgtgatgacagaggcagaggttgtggggggcatacatctacaaatcaaggaatggcaaagattgctgtcaaacatcaccagaagccagagagaatcatggaattgatctccctcagaacttcctgaaggaactaaccctactgacacccacatcagtgaacgaataaattccttttgttttaagctacccagtttgtggtagtttgttatagcagccctaggaaactaacataacacccttaagcttcttagtccgattttctaattgaatgattctttaggtaccattctagatctttgtgaggttgtgttttttttgtttttttttttgagacagtctcagtctgtcacccaggctggagtgcagtggtgcaatctcggctcagtgcaacgtccgtgtcctgggttcaagtgattctcatgtttcagcctcccgagcagctggcattacaggtgtgtgccaccatgcccggctaatttttgtatttttagtagagacaggtttctccatcttggccaggctggtctcaaattcctggcctcaagtgatcctcctgccttgacctcccaaagtgctgggattataggcgtgagctaccgtgcctggccctttctgaggtcttaacaaagaagtgttatagtctgatccttggcttcatctgaaatcagtcttttggcagtgccttggattcgatctttgcttgaaatctcttaattttagtgtcatttactaatctggagatgctgggaattctcagaattatataattctgtcctttttgtttaactgttcttcctttaattcatccctcttttgcattttaaagtaagcagcaagaagccaggaggtactttcaaaagtgaaatcactttagctagattatcaaccagtttttggaccacaacatctactttccatgttatggtaaggccacagctttgccattatataacaaggatccttttccctccagtttctaatcagattttttctgccttttcttaatctctcacctttaacttcctcaaaggccatagtgcttctgtttttttttaaggctcttcaaacttcactgatgctctcctcaaagtccttttaacttctgccccactgctgggttccaaagatactctcaagttttgggtctttattgtggcggcaccggtatccagatatcgaaatctgtatattatctattgccatataacaaattatctcagagcttagtggcttaaaacaacaaatatttattatctcacagattcactgggtcaggaacaggttcagttgggagtagcatggctgagtggttctggcccaggatttcatgagcttatagtcaagatgttggccattgctgcagtataggattgactaggctttacacatattctggcaggtttgttctggctgttggcagtactcagttcctcatcacatggacctttctataggactgcttgatatggcactctcccagagcaagtgattgatccgacagaagtacaaggagaaagcactgccccccgccccccacctttttttttttgaggcaaagtctctgtcacccaggctggagtgtaatggcacaatcttggctcactgcaacctcctcctcctgggttcaagtgattctcctgccttatcctcctgagtagctgagactataggcacgtgccactaatgcctggttaatttttgtatttttagtagagatggggtcatgttggccaggctggtctcgaactcctgacctcaagtgatccacccacctcagcctcccaaagttctgggattataggcaagagccaccacacccggccatttcccccacttttttttaccttgtcttggaagtcacagattatcaattctgccatattctattgttaagtgagtcactaagtccagcccacactgaagggaagattatcaaataatttttggacatatttttaaaacaacacgaagcattctaaaaaaaagaaaacacaatgaattcatagaagcagagaatagaatggtagttactaggagctgtggggcagagggggtggattagagagatgttgaaggatacaaaattttagttaaaagttcaagagatctgttgtacaacgtgggtgacagtagttaataacaatgttttcagccaggtggggtggctcatgcctataatcccagcactttgggaggccaaggcgggcggattacttgacagcccggccaacatggtgaaaccccatctctactaaaaatacaaaaattagccaggcgtggtggtgtgcatctgtaatcccagctacttgggaggctgaagcacaagaattgcttgaacctgggatatagaggttgcagtgagctgagatggtgcctctgcactccatcctaggtgacagagcaagacttcatctcaaaaaaagaaaaaaaaaaacaaccagtgttttgtacatctgaaaattgctgagagagtagattttaagggttattgttgcaaataagtttgtgaggtaatgcatatgttgatagtttgatgtagtcattccacaatgcatacatatttcaaaatatgttatataccataatatatgcaatttttgtcagttaaaaataaataatgaaaaataatacaaaaaagcaagcaaacaaacggaatagtgtagttagctgctgttgaactttagtagcagggaaagtctaatgttggctattgccattgttatattaattggcctaataagtaaagtgggaaccagggacttaaaattgcatatcattgctgggcgtggtggctcacacctgtaatcccagcactttgggaggctgaggtcaggaggtcaagatcagctttgtcaacatggtgaaaccccatctctactaaatctactaagtatacaaaaaattagccgggtgtggtggcaggtgcctataatcccagctactcgggaggctaaggcaggagaattgcctgaacctgggaggcagaggttgcagtgagccgagatcgctccactgcactccagcctgggcggcagagcgagactctgtctcaaaaaagaaaaaaaattgcatatcatccagaacacagaagatccagtgaaacaatttcttcaggtttttcttttgctgaggcatcactccagtatctctttgggtaacaaagactcattcgtgtaaagaactgtgtacctgtgccatcttaagtattcagagtgacaaatgctaagcatgtgtgtgtttatatgtgtttgtgttataatcatctgaaacaaccttaacatagaattattgcttaaacttttttttaaaggactctttaaatgatatcttattcagaaacccaatgtgtacaacatacaaaaatggaactacccttgttaaagggaggtgggtccagagttccactggctcggcatcccttttaacccttccttatgttgatgtcagatattcagggaacatagtttgaaaaactataccataccatcagatccctttccagcttaattcacaaaaatctattaatctgtaagatagcagagctcaggaagatagccataatagcaaaatagcacaccgctgtgtggcaggctgatttctgatgctgtctcttgtgtactagccaatgaaaagccattttggtttagggaattagttggtgattaggcagccatggatatctgtagagtacttttcattagtctgttgtcttatctaattttttcttctgtaacagaatactacaacacatctttgcaggattctttgcaaattctgccattcctggatctccacaccctttttcctggtaagtaactaattgttttctatcttactctattggagtgacatattttaggtgctgtcatttctgtgcagtagagaaaaagagctgcataggccgggtgcggtggctcatgcctctaatcccagcactttgggaggccgaggctggcggatcacgaggtcaggagatcgaggccatcctggctaacatggtgaaaccccgtctctactaaaaatataaaaaattagccaggcgtggtggcatgcttctgtagtcccagctactcggaggctgaggcaggagaatcacttgaacccgggaggtggaggttgcagtgagccgagatcgcgccactgtactccagcttgggcgacagaaagagaccctgtctcaaaaaaaaaaaaaaaaaaaaaaaaaaaaaaaaaagagctgcataggtgagtatgtagatgtaactggaggctgctacactgccattatctgctaagcccaaacttaatcagaacttttttttttattattattcaggctcaggaaggccgtcctggtcccccaggatgtttgggtgctagaaatgtcttgattccttttatattcaggtctgagagttgtattgaggtagagaatgagatggtccctgccaggcttggtatctgatttgtgggtttccccagtagactacacaggaatattttactccttaagaatttctgaaattgaaaacattatgctgaacttcatttttttcaaagtaagaggatttgtcagaagaaacaataggctgtaattcagtatcagagtgacacttatgtatgatgggattaaagatggaatttcttcttgtctgagaaattatttgctgcttctaactgtggcccagaaggtttctttgctcaaaggaacctcagtccttttaggacctctgtcatccagtagtctggacctctgctggtagtgtaccagcagctctgagggaaaataaaaaaaaacggtgttgccaagtcccttttataattgctctaagttgtgattcagagagactgctatggctgcttctctacttgaaagctcctcattgtccagaactgtgggcggcctcttataatgagggatgtttgctgtagattttgaccagtcatgaagggaaaactctccttaaaaagcagctccatctgtgtttaatatcagtgggcacagaaaacacaaatttttgaaaccaacaggcaatgagtcactctttttgttctggcgtgtcatgtggtactttaggtagcttcacattttatgttctagttaagtaaaattcttagagaatgaggtactatctctggatagtctgtttgatcttgaaaatgtacagaattctttgcctcttgatcctggaggactagtgactttccagctctgagagagaacaggatccctctgccaatttttttctgtggtgtaaggcagagcctggtcactccatctaatgctgtctatctcatctcacgtataggagcgggatgctgcactccaaccctggggactatgcctggggtcagacagggcttgatgccattgtaacccaggtgaggagctgccttttgagggtgtctgttcagtgtgtctcatggttccacaggcttcctgctttccttctgctactttctgaaatggcagtcactctgctttctctaatattttgagctttggggtttccattttactaaagggatgaatgatttatggggttagctcagcatccatgcacttcctaggtctgagggaatttctagaagatggtttcacctccataggaagaaaagacttctataacaaatagtattttgtatttttgtctctcttgctcagttctataaggattctattaacaaatatttcacaaaaaaaggagggtttcctcacatgttgaagcagggatttctgctagatggagcaaagtaggggaaggaagcagagaaaaaagtattcccatgccatgtataattgcttccacttgtttatgttcattttaatttgattggtttttcatttccgttgtggatttctgagactagaaagcatgtcctttatattcagtcgtcttataggcagtaatttacctatttcttggctcacgttatgctacttttcatactctcgcttttttcttcttccagaagatgaagcttttggaccagttacattttactttttattaagctatagttttactcgtgacaccacaacccttttgctgcctctgaagttgctttatgcctagaggtgggccttgcaatcatgggtttgtctgtaggcttatacgaacgtcactctgaaattgtaaagcaattatgagtgttctggcagcaggaaaggggaaacccaagcctctcagagccttgcagaagtaagagtaactaacatacctaatgtctgcactgtttgttctcagctggagcagttccctctccagggatattgcgatgtctgccacttcgtctttttctttctctttttttgtagcttttaggacaactggaaaacacaggccctcccccagctgacaaggaaaagatcacatctcttccaacagtgacagtaactcaggaacaagttggtaggttcatttttatacttattctgtcatcttctgatctcggttcaaaatcccggtatcttctgacaggtgaaaagtttaaaaagtgaacaaaataaaaagacaaaaaaataagaaaaaaaatcccaataccttcctatattaaggacctttaagtgaagctatagccctctaaaattcctatctgggtgccaaatctggaaagttcctacccctttattaggttagtcagttggtatttcctgagcaattatgtctcttttttaggtgccattgggaataaagaggtacaaagatagataagaattgattgtaacaagttgaagaaaaactgatcaaatgattaaaaactgtgttggacacatgatactgacattggggaaaggagaagaaaaaaataggctgggagtttgtttcaaatctactttgtgtcaggtacagttaggtatcttagtcatagatactattttatttgtaagcactggaggaatttagtgacaagggacagcattttggtctgggagtttctgttcccatcagttcgggtttagagttagagattttaaagacaaggtgggccatcttaggtcattctatttaaggaaaagtatgaactaatatacgtggtgtgtgagtcaggtaaagtggtctttagggaagattagtctaggggcagtgtgtgaaacattggaagtgagagagagcagaaacagggattttagagtgttgcagcagtccagatgaggttcagttgatggtgacaatgctaacagaaaggaaaggattcagaagatcattttggagaaatgctttcctcactcattgcataatgggatgaagaaggggaaagagtcaaagagaattctgagatttcacagctttgtaactataaacatggtgctgccatcttaagggacagggaaatagtgaatggaccctggtttgggtaaggagatgaggtgatgttttacattttttaatttgttgatttttgaggtgccagctgagaatccaagtgaagaggagctggggattgctgtggagctggtttgagggaaaactaagttgtagcaaagtataggatatatttggagggttaagaccgtggaatttgggatactagctgggaggctgttgcagcagactaggcatgagaagtaaaagaattagggctaaggtgataggaatggagagtaaggagtgaatctattaagtagtagtactgctccaaatgccttatctgctgttagttcatggagcatatcccagccactaggcgtatagactagctgacagtattagccaaatttgggaaactcaaaacttgctgcttggagctcccagtatagttcatgactgtttcttctcagagaagagggctttctgtctcttgatttcgtgacctgagctagacttcgactttgcagttctgcagcaccacttctggtatagcttttctggtatggcttctggtattttcttcttttctggtatagcttttattaataatttttttttttttttgagacagagtcttgctctgtcatccaggctggagtgcagtggcgcaatcttggctctctgcaacctccgcctcccgggttcaagcaattctctgcctcagcctcctgagtaggtgggtttacaggcgctcaccatcacacccagctaatctttgtatttttagtagagacagggtttttaccatcttggccaggctggtcttgaactcctgacctcgtgatccacccgccttcaccctcattaacagtttttacagaggactttaggacagccacactgaaataggatgcttcatcccatgctgaaaagagcatggtgaaagtggcaagtggcttgagacgctgcactgataagattgctgagatgaatcccttggctatggtggacagattcacagtagcaactgactgccagagggctgtcacacattgggaagatgtttttcctgttttactgagcagatcatctaagccccagtttatttcttccaactctttacatcaaaaaataggccttatatagttcctatataggcctttttggagtaggccccattcatcattccttcttttcatgtctctgtctactaccacctttaccctcattttgaaatacaagtcatgcctcttagctgcctgctacttgggtgtacattttcttttgtctcttgtgtcttttctttatgcattcgtagggttggtagagacattgggttagttttttcttctttccttttgcctgtttactttaaaaggcatttccttcttcaacagatatgggtttagagtgtccagtatgcaaagaagattacacagttgaagaggaagtccggcagttaccttgcaatcacttctttcacagcagttgtattgtgccgtggctagaactggtgagtacagcaagtcatggcttctttgggggatgattcagagtaaaggtatagttaacagttcctcgagatccaagtagatcagattttatcccataaatccctggcttactctgatactgttatttgtttggaacttttctgaccaagggttgcaaactatgttctacaggtcattgtgtcctgccacctgttattgtaaataaaattttattggaacacagctatgttcatttggttatagattgtggctacttttgtgctacgtcagcagagttgattagttgtaacagctgtggtgtggcctgcaaagcctaaaatacttattttctgtcccttatgtatttgttttgagacagagtctcactctgtcacccagactggagtgcagtggcgtgatctcagctcactgaaacctctacctcctggtttcaagtgattcttgtgtctcagtctccagagtagctaggattacaggcgtgcaccaccatgcccagccaatttttgtgtttttagtagagacagggtttcgccatgctgatctcaaactcctgacctcaggtgatccacctgcctcggcctcccaaagtattgggatcacaggtgtgagccactgcactcggccaattttcctgtccctttaaacaaaaagtttgctgacctctgctctagaccatattgggaagtaatgggcagttaccctcctgtcatagatcactcactgtttctggttcgttctgtttggtggtatgtattagctgttattaacttgctggcctagaattattcctgtcagttctgcttaaagttctgtttgggagatatcctggtatcacaccttagagccagtgcatgctctatgaggatgcattctctattgtttttctgttccatgtcataatttttgatgtgacaattctcagggttatttaagtgtacaatactcccagcttctcaggccaggatcttcacatagactaatatttttctgtttcagcatgacacatgtcctgtatgtaggaagagcttaaatggtgaggactctactcggcaaagccagagcactgaggcctctgcaagcaacagatttagcaatgacagtcagctacatgaccgatggactttctgaagctaaagaccacacctgaatcagggctgtggtaatcatcttaccatagctgtaaattgtatcaaaacaaaaaattagtagatggatttaggaatatgtaagaaactcaacacataatataaatgcaatgaatgtttttcttctttaaatttaaagttagtatctacagatggaattgtatctacaaccaaatgcctcttatccctgaattcagagtgataattttataagtgtgaaacttaattatgtagggctccccccgtctgaatagaattaattccttaaagtctagttagggtcctgctgtctgtcatgttgccttgtaacggatgtttccacctccttctccaacctctaccccaccattagtgtattttactataaaaacagtggaaccacagccctaaagtcctgctgatataaagtccttttgtcttaattgtatttaaaaaaaaaaaaaaactactcttgatcacattagctatgaggcgaggtcaaattcaggtatctaagactaatgattttgttttgtcttgatccccagagagcaaatcaa

SEQ ID NO: 1531 - DNA, 27077 bp, Homo sapiens
attcagttgtcaaactactaacatctttattttgtcaagatatttaacaatattaaaaagttcagatttcttcatggtcatgtcttttaccagcttttcaaagattcattcagtagtagaaacagccaaatgctgctacaacgcagaataaactgtcctaaaaaataaatacaacacacacacacatccagaatgttagtactaaagagggaatgagagcagcacaggcaactgaaactaacaccatctcagatctttccaattttttttttcttttttgagacagggtgtcactctatcacccaggctggagtgcagtggtgtgatctcagctcactgcagcctcgacctcctacactcaggcaatccttctacctcagcctccagagtagctaggaccacaggtgcctgccaccataccaggctaattttgtttattttttgtaaagatgaggtctcactatgttgcccaggctgttcttgaactcctgggatcaagcaatccacccatgttggtctccaaaagtgctgggatcataggcgtgagccacctcacccagccaccaattttcaatcaggaagactttttccttcttcaagaagtgaagggtttccagagtatagctacactattgcttgcctgagggtgactacaaaattgcttgctaaaaggttaggatgggtaaagaattagattttctgaatgcaaaaataaaatgtgaactaatgaactttaggtaatacatattcataaaataattattcacatatttcctgatttatcacagaaataatgtatgaaatgctttgagtttcttggagtaaactccattactcatcccaagaaaccatattataagtatcactgataataagaacaacaggaccttgtcataaattctggataagagaaatagtctctgggtgtttgttcttaattgataaaatttacttgtccatcttttagttcagaatcacaaaatgctttccagagcccagtcaaattgcttaaaacatttttaggcatttattacaagatttccacctgcctcagcaactcctgcaccactaacctcacctccagcctggtaatgatgggattaaaacaattccaactcaagtacctgatgattaaccaaaagcaaaattctttggtttagcccagctccctggctccttgggtggataactctgaactgtgttctacgacagtgctgtgataaaggacctgctttgtttttaacttccggtccttcatggaaggatgcttttgtaaaatgcaataaaaataggtaactcagaacatgaaatgaaaaaaaggaacatacaaatacagccccaatttttttcttagattcactgcacagaagattactttgtcaaattgctgtaagagtttctaaaccaacccttatactcagtgtattgtttacctcatcatggacctgtaacaaacaggtcacagagccgtgctggtctgtgcaccccactgtgagtggccctgttctacagcaccacccagagttctccaacaggactgagccctgtcatccagcagttttccgctcaataccacatgattttccctcctttctcatttcctctgcctctactaatgtttcctggaatctcccaaataaagtgctttttttttgagacagagtcttgccctctcgcccaggctggagtgcagtggcacaatcttggctcactgcaacctccgccctctgggttcaagcaattctcctgcctcagcctcccaagtagctgggactacaggcgcccgccaccttgcccggctagtttttgtatttttagtagagatggggtttcaccatgttggccaggctggtcttgaactcctgacctcaggtgatccacccgcctcggcctcccagagtgctgggattacaggcgtgagccaccacacccagcctaaagttttttattacatatttgttcatttgagtattgagtggcccccactggatgttaataggcagaaaccatgcctgtcttattcatcattttgtccctagcccctcaggtgcagaagctgacacataataggagctcagaactatttgttgaatgaatgaattgtatcatctaaagatgcattttttggccaggcccagtggctcatgcctgtaatcccagcactttgggaggccaaagcaggcagatcacctgaggtcaggagttggagaccagcctgaccaaatagtgaaaccttgtctctactaaaaaatacaaaaattagccgagcgtggtggcatgcacctgtagtcccagctactcgggaggctggggcaggagaattacttgaacctgggaggcagaggttgcagtgagccgtgatggcaccaccactctccagcctaggtgacagagtgagactccgtctcaaaacaaacaaacaagatgcatttttttttttttttttgagacagagtctcgctctgtctccaggctggagtacagtggcacaatctcgcctcactgcaacctctgcctcccaggttcaagcaattctcctgcctcagcctcccgagtagctgggattacaggcacccaacaccacacctggctaatttttgtatttttagtagagacggggtttcagcatgttggccaggatggtctcaatctcttgacctcatgatccgcccgcctcggcctcccagagtgctgggattacaggcatgagccaccgtgcctggcaaaaaaaaccatcttcttagcttgactattcccccaaagatagctgataaattaagatttacatagtacttcccactgtccagcccctgatccctagggtagttaagcataaaataaaactttggtggggctgggcgcagtggctcacgcctataatcccagaactctgggaggccgaggcgggccgatcacctgaggtcgggagctccagaccaacctaaccgacatggagaaaccctgtctctactaaaattacaaaattagccaggtgtggtggtgcatgcctgtaatcccagctactcggaaggctgaggcaggacacttcaacccgggaggtggaggttgtggtgagctgagattgtgccattgcactccatcctgggcaacaagagcaaaattctgtctcaaaaaataataaaaataaaaataaaaccttggtgagaccatagaattttagagctaaaagctaccttaaaatcatctacataagcagtgtccatatctggcagtcagcagaatcatggggaactttttaaatattctgattcactgatctaacccctggcctatttgatcagaatctatttgaatagggacccagcgtctatattttaaacaacttcccagatgatccttaggcagtcacagccagtctttgggaaaatgtacttcagcttcctaatgtcactgatacaatgtgagaaaaatccaatgacttacctgaagtcattcaattagaaagtgacagaactggagatggaatccccctcttatttctttttacttttttcttttttctttttttaatttttgagacagagtcttgctctgctgcccaggctggaatgcagtggtgcgatctcagctcactggaacctccgccaccaggttcaagcaattctcctgcctcagcctcccaagtagctgggattacaggcgtgcaccaccacacccggctaattttttgtgtgtgtgtttttagcagagaagaggtttcacaatgttggccaggctgctctcaaactcttgacctcaagtgatccacatgcctcggcctcccaaagtgctgagattacaagcgtgagccaccccacctggcctcactctcttaatttactcaatctagtttctgttctactctaactctgactctatgtattcacaacctgggagtagacgaatagaggatgcaatcctttctggagtaaatataaaataataacttcaatgaaacctcttttatgtgtgtgtgtgtgtcacccaggctggaatacagtggcacaatctcagctcactgcaacctctgcctccggggttcaagcgattctcctgcctcagcctcctgagtagctgggattacaggtgcccgccaccatgctcggctaatttttatatttttagtagagacaggctttcaccatgttggccaggctggtcttgaactcctgacctcaggtgatccgccctccttggcctcccaaagtgctgggattataggcatgagccaccgcgcctggcctgaaacatctttttaaagattcctctttatttttgcttaattttaataaatggctttaagataaagtaataaattttactactaaaaaaaaatgacctttgctcatggaatccctgccatccacatttgtttgcaacttagcaaagtgtgattggttcaaatgaacaaataagtgattttaaaattttagttataaattattactttaataaggattatcaggattgagttttagaacactgatttatggaggaagtggctaaaaataatgtttaaataatatgctaactaaataatatgctattcagaaattcaaacccatgaaaaattatgtcatatgtaaacatgtaagtttccttgcctataagcagcactctaggtttctgctttagtaacacaaaaactaacagtaaaatcatttcattcacaagtcaaagatgaatgactaagacagcagtgtctttccatcccaatcaacagtaaatagtttgatttgcggtgcccacgttcttagaaagggaaaagaggtttccaaatacacttacattcatgaaaacatcatgagtatagttgtcagtgtcagcatcccagaaacagcgagaagccatgctaaaaaatccaagaatgaagaattatcaacaatctaacaaggacctaaacgacacatatctgccacgagaaacagtgttccttaatacattctcatagatctgtacttccaaacctttcacaggtaggtacccacagagtattgtatttgtaccagagagtatactgggtaaaccggagaaactagagtcagatgaagctgcttgcaactagaggtgaccagccaggtactctgacagcctcagaccctacctgatggctacagggatcaatactagagatttgtgtgtgacttttaatgagctcagctcctgcacaataacaggacgaggaaggcacagaaagagcccaacagatttagtccaacctgatcattttatagagtcccagaaaaaggagcaaactctgaactagaattcagtcttctaacgaattataactccaaaaatatctctacagaatgctaaactaccttgaaattggctattctcctctctgcaattcttggataagaaaaaaatattagtcaaaataaaagccaattaaaaatggaaacaacttaaatgcccaataggactggattggtaaatgaaattatggtatttctcaggatctgggagaattttttaaaaaaagaaaaaagaaataatgatgttttctggcaatgaaattctatgtagaccttaaagaaaagttttgcaagacacagtgacgtgtccctgtagtcccagcaactcaggaggctgagacagggagtatcatttgagcccaggagttcagggatgtagtatgtgaagatcacacctgtgaacagccactgcacttcagcctgggagacacagcaggaccctggctcttaaaaaaaaaacaattctgcactttgggaggccaaggcgggcagatcacgaggtcgggggatcgagaccatcctggctaacacggtgaaaccccatctctactaaaaatacaaaaaattagccaggcgtggcggcaggcaccagtagtcccagctactcaggaggctggtgtgaacctgggaggcggagcttgcagtgacctgagatagcaccactgcactccagcctgggagacacagcaggaccctggctcttaaaaaaaaaattccaagaacatgaaaagctattcacaatataatgttgagtgaaaaaaataggctgggcatggtggctcacacctgtaatcccagcactttgggaggctgaggtgggcgaatcacctgaggtcaggagttcgagaccagcctgcccaacatggtgaaaccccatctctactaaaaatacaaaaattggctgggcatcgtggcacacgcctgtaatcccagctactcgggaggctgaggcaggagaatcacttgaacccaggaggtggaggctgcagtgagccaagattgtgccactgcactccagccttggcgacagagtgagactctgtctcaaaaactaataataaataataataataagtgaaaaaaaaattacaaatgttttacatttctattaaacgtatgtgtatgatttatcatgcaaacacttattgagcacttactttgtgccattcactagtctaagtgttttacgtgtattaactcactgaatcctatgaggtactataattttacccatttagtgaatgtgacaaatgaggattagagaaattaagtgtacaaggtcatacaactaggtaacaaagcttggctttgcacccaggcagttcacaacccatacccacagagaaacatacacatataccttatattatattggttcttttttttcctgaaacaaaaggtctcacatatttattactgaacccagcctactatcgcagggcatataagcaaagagaaaaaatatattcccaataaaacacgtccaactgttcagacagtggtgacgttttcagcttgctatagtaagatggccgtgaccttgatacagcgtgaatatgtgtgccagctcacgtgcagttccttatagacccagcttggctgttctgcaatgtctcctttccagttgtgcctgattttattaccagttttcaaccagatccactggagaatgggacgatttggcttttgtttcttggccaggaatcgcttactcttaaaagacttgtgagaagacatgacaagaagcagaatcaagcacacaccacaagagagagttgtttgttttttgagacaaaaatataaaatagtgagaccccaattgttttatttatttatattttatttttattttttgagagggagtctcactctgtcaaccaggctagagtgcagtggcacaatctcagctcactacaacctccacctcccgggttcaatgattctcctgcctcagccttccgagtagctgggactacacacgtgcattaccacgcctggctaatttttatattttttgtagagacagggtttcaccatgtgggccaggctggtctcaaactcctgagctcaagcaatcggcccacctcagcctcccaaagtgctgggattacaggtgtgacttggaaaaagtgtaatggtacagtttgtagcaggctaataatgctcccaccaagaacagtaagaaaagctggataaaatgaatcagggagctgccaaagcaaacaggcctagaggagccaaaattccagaaagaggtgaactctaggaggtaagctgatattccgcagcagatttttttcctggaggatttgccaattcagggcacagggctagatgctgagaatctgggccttgctcaggtaaagaacaaattactgagggaaaatttaactagtaggagagttggcagtctttactttttaaaatttttttatttattaattttactttgagacagagtcttgctctgtcacccaggctggagtgcagtggcacgatctcagctcactgcaacctctgcctccccaggccaagcacttctcatgtctcagcctcccgagtagctgggataacaggcatgcaccaccatgcctggctaatttttttttttcttttttttttttgagatggagtttcactctgttgcccaggctggagtgcagtggcacaatcttggctcactgcaaccacaacctcccgggttgaagcaattatcctacctcagcctcccaagtagctgggactacaggcacccaccaccacgcccggctaatttttgtatttttagtagagacggggtttcaccatgttgggcaggctggtctcgaattcttgacctcaagtgatccaccggcctcggcctcccaaagtgctgggattacaggcatgagccactgtgcttggccctaattttttgtatttttggtagagacggggtttcaccatattgcccaggttggtctccaactcctgagctcaggcaatctgcccgccttggccttcgaaagtggtaggattacaggagtgagccactgtgcccagcagagtcggcagtcttaacaaagctaaggaggtaaaatcagattctggagggaagatcccataaaaaaggagaaagtagaactgagcgtatcacatggtaggttttcttttcaagacatgctgaattcaggccgggcacagtggctcgcgcctgtaatcccagcactttgggaggctgaggcaggcggatcacgaggtcaggagatcgagaccatcctggctaacgtggtgaaaccccgtctctactaaaaatacaaaaaattagccgggtgtggtggcgggcgcctgtagtcccagctactcgggaggctgaggcaggagaatggcgtgaacccaggaggcggagcttgcagtgagccgagatggcaccactgcactccagcctgggcaacagagtgagactctttctcaaaaatagaataaaataaaataaagtaactagtatgactaaatcacaagggtccttacaaaagaaagagggagtaggtgggtcagagtcagagagttgaagatgctgtgctgctggctttgaaattggaggaaacggcttatgggctaaggagttcaggggcctctaactggaacagacgaggaaatggattcagtcttagagcctccagaaggaatgcagccctgctgacatcttcattttagttcaatgaaacccattttggatttctgatctccagaactgtaaagtaatatatttgtgccattttcagcactgagtttgtgataatttgttacggcagcaacaggaaactagtacactaaggaaaaagcctctgacatgaagagcaaagttttatgctgaggagacaagatctgaaagtcagcacctgttggaggtagaggcctgcagaggcctaatgaacattcgaggttcttggttgaaagacttggagggctacaattaagaaacaagggggccaggcacagtggctcacgcccataatcccagcagtttgggaggccaaagtgggtggatcacctgaggtcaggagtttgagaccagcctggccaacatggtgaaaccccatctctactgaaatacagaaattagccgggcgtggtggcgtgcgtctctaatcccggttactcaggaggctgaggcaggagaatcacttgaacccgggaggctgaggttgtggtgagccaagatcatgccattgcactccagcctgggcaacaagaatgaaactctgtctccaaaaaaaaaaaaaaaaaaaaaatagaaacaagggtgaggctgggtgtggtggctcacacctataatcctagcacttgggcacttggggaggccaaggcaggagaatcacttgagccaaggacttcaagaccagcctgggcaacatggtgaaaccccatctcaacaaaaacatacaaaaattagttgggcgtggtggctcatgcctacggtcccagctacttgggaggctgaagcaggaggatcacttgagcccaggagccagaggttgcagtgagctgagatcgcaccactgcactccagcctgggcaacagagttgagactctgtctcaaaaaagaaaaaaaaaagggatgaatttaagatagggcctttttaaaaccacaactctcagatgagttggcacaagaaaagaaaattttttaaaaagataaaactgtaacccaacctcaattcagctcagtacctgaagctaagcggccaatactcttcctgcacagcagaagagagagttaagtcctttctggaagaaaataatatcatctggaggtctataattcttttaagcaatatctaagattcaaactaggcatgccaagagacaaagccatatacatgattatcaagaaaaatacaatggaaacaaactcacacatgacccagataccagagtaagcatataacaacataaaaataactactgtggctgggcgcagtggctcatgcctgtaatcccaacactctgggaggctgagcggggcagatcacttgagatcaggagttccagataagcctggtcaacatggtgaaatcctgtcactactaaaaatacaaaaactaggcgggtgtggtggtgggcaccagtaatcccaattactcgggaggctgaggcaggagaattgcttgaacctggaaggtggaggctgcagtgagcagagatggcgccactgcactccagcctgggtgacagagtgagactctgtctcaaaaataaaataaaataaaataattagtatgactaaaatgtaaaaatagagtggggagggttaaaaaagattgaaggataaagccttttactagataactgaaatctataaaaactaaatgtaaattcccaaactgaaagatacaataactgaaattaagaactcaggttatgggtttaactgcagatcagatgcaacagaaaagaggatgattgacctaaaaggccaatagaaaaatatacaaattggccaggcacggtggctcacgcctgtagtctctgctacttgggaggctgaagcacgagaatcgcttaaacccaggaggtgaaggttgcgatgagtcgagatcacaccactgcactccagcctgggtgacagagcgagactccgtctgaaaaaagaaaaaatatataaactgaagcacagagaggaaatagaaaaatcagaaaaaagcataagagacatgtggaatactgagaaaagaccaaacatacatgtaacctaaatcctaaaaagagagcggagtggaaggggcagcagcagtgttttaaaagagaacggctacctctagggccccaagcttagtttctaatgccattctccaacacattgaacaggggctccttggagaaatggctgaattgtagggctggggtagggaatgaacacagtggagcttctgatagtgctggaaagtaaggaagtgctcaaagaaacccacaatagtagagtcagtgggacacaggaatccactgaaagctctcaatggccaagctggaacaattagaactacaaaataaataaagtagtattgaataatcatccaaagtataaaatatccatgagtccatgttgaaataaatgacagaatacataaataaatgggagaggagagacaaatttcctgtgctgaaaattccaaagaatttacgcagatacgatgcccttgaggaggtgggtcataactccctgctctttcagtgtgggctgcacacgatgatttcctcctaatgagtacaggatgaacacggaggaaatgaaaccgcctttgcaaaatgatgactgagacagtgaaagagatccaacctaaccgactccatcttgcgtctaacctccaagctgcccttgttcattcctgggcgtaggctgaactaacttggggggaaacttaatttatagtttaaaacaaagacggtaacagccctttcccaaagcagacctccttcttgccgggggactagactaacattagtcacaagattagaaatgatggtttaggagccatgcagctggaggctacaagattctgaccctccctacactgctcctaagatcagcgcttgagatattttgcagaccctgcacttgatggatcagctggcaccacccagatggataaactggctcatctgatcttgtggccccgacccaggaactgactcagcacaagaagacagctgactccctgtgattccatccctgatcaatcagcactcccggctcactggctctccacacccaccaagctgtccttaaaaactctgctccccgaatgctgggagagactgatttgagtaataataaaactccggtctcccgcacagccggctgtgcgtgaattactttttctctatggcaattcccctgtcatgatgaatcggctctgtctaggcagcgggcaagtgaacccactgagcagttatagaaagagtaagtttatagtaaagaaacctgagaagcattagctcaggcagggaggcaaagttcatatgaacagtaacatgtcatgttgacagtatgtaccattgatatgatatgacgagaatggcgtcttacctctgtgatcttccttccaaaaacctgtaacctcagactaatcattagcagaaaaatcccagtgaaggaacattctacaaaacacctaaccagtactcctcaaaaaagtcaaggtgatgaaaaacaagaaagtctgagaaactgttaccgccaagaagagcccaaagagacatttaatgtggtatcctagatagaatcctaaagcagaaaaaggacattaggaacaaactagaaatcagaacaaagctttatttgataacactgtatcaatattgtttcattaattataataaatgttccatactatgtagatgttaaccatagggagtccgggtgcggtagatgatgcctgtaaccccagtgttttgggaagccgaggcaggaggactggttaagcccaagaggtcaaagctgcagtgagccacggttgcaccactgcactccagcgtgggcgacagagcaagaactgtctcaatagcataattactattcttacagtaacagggaaactgggtgtggagtatacgctaactctgcaacttttctataaatctaaaactattttaaaataaaaacttggtttttttatttttttattttttgagatagagtttcactctgttccccaggctggagtgcagtggcgtgatctcagctcactgcaacctccacctcccaggttcaagcaattctcctgcctcagcctccaagtggctggggttacaggtgtgcaccaccatgcccggctaattttttgtaattttagtagagacagggtttcgccaggttggccaggctggtctcgaactcctgacctcaagtgatccacccacctcggtcccccaaagggctgagattacaggtgggagccactgcacctggccaaaaactgttttttttaaacaaaggtaatggctaagaattttcccaaactgataaaaaaaatcaacctggctgggtgcagtggctcacactggtaatcccaggactttagaaggccgagcatggtgttggcacctatactcccagctactcgggaggctgaggcaggagaatctcttgaacctgggaggcagagcttgcagtgagccaagatcgcaccattgcactacagcctgggagacaaaagcgaaactccatctcaaaaaaaaaacaacaaaaaaatcaatccatagattcaagagactctgagtgctctaagcagaataaatacaaagaaagtaatagtggctagagaggacataccatcttaaattgaataataaaacttacagctgacttctcaacagaaacaatggaaactagaagacaaggtaagcacttatctacctacctacctacctacctatctgaggcagggtctcactctgtcacccaggctggagtacagtggcacaatcacggcttactgcagtctcaaccttcctgggctcaagaggtcctcccacctcagtctctcaagtagctgggaccacaggcgtgtgccaccatgcccggctaatttttgtatttttttgtagagacagagttttgctgtgttgcccaggctggtctggaactcctgggctcaagtgatcctcctgcctcagcttcccaaagtgctgggattacaggtgtgagccaccacgcccggccctgatgggaaactttataatagatggatccatctgacaatatctgaactccatgatcaaccttaacaaagcaaaaagagatgaccagctattttgtaccttctgagaagatgcaataggatgtatagaaaacagtatttccccaacctcaaacctatggctaattaagactagatctaactacttattttcaagaagtacaggaaatagaagacatattaaacaataccataggtatataatcagcaactgccagaatataggaaactctacaggacaaacaaaccaatttcttcaacaaataaatggcaggaaaaaataaataaataaataactgacagggcacagtggctcacgcctgcaatcccagcactttgggaggccaaggtgggtggatcacctgaggtcaggagttggagaccaacctggccaacatggtgaaaccccatctctactaaaaatacaaaaattacctgggcgtggtggtgagcgcctgtaatcccagctactcaggaggctgaggcaggagaatcacttgaacccggcaggcagaggttgcagtgagccgagatcatgccactgcactccagcctgggtgaggaagcaagactgtcataaaaataaaatcaaatggcaggattaaaagaagaaagagagaaatgaggcagcaaaaacaacacattgaagtaaatttaaagccagatgctgtggtgtgcacctatagtcccagctacctggcaggctgaggtgggaggatcacttgagcccaggagttctagtctgtagtgtgttatgatcacatctgtgaatagccactgcactccagcctgggcaagatagcaagatcttacgtcttaaaaaaaaatcctaatttacatattaaccaaatgcaatgtgtggaccttgtttgaatcttaatttgaaaaaattgtaaaaagaaaataataggtctggcatggtggttcaagcctataagtccaccactttaggaggccaaggctggtgaattgcctgagcccaggagtttaagaccagactggccaacagagtgtgacccatctctgcaaaaaaaaaaaaaaaaaagaaagaaagaaaattagccaggtgtggtggtgcacacctgcagtcccagctactcaggaggctgaggcaggaggatcacttgagcccaggaggccaaggctgcagtgagttgtgatagtgccattgcacaccaacctgggtgacaaaatgagaccctgtctctttaaacaaaaaaaaaagaaaagaaagaaaacacatacatacatatatgaggcatatctgaataataacagcatattttatgatattaaggactgacaatattttagagataataaagatattttatttatttatttttgagacagagtcttactctgtcacccaggctggagtgcaatgacacgatcttggctcactgcaacctccacctcctgcgttgaagtgattctcctgcctcagcctcctgagtagctgggactacaagcgcacgccatcacacccggctaatttttagtagagacggggtttcgccatgttggccaggctggtcttgaactcctgacctcaggtgatccacccgcctcagcctcccaaagtgctgagattacaggtgtgacccatcacacccggcccttctcactcttgtaaaggcactcttactgaattgtccaaaggacagatacctcataagaaatatagatgactaaaacaagaaggaaaatccagctactcacaatactccttcacctctttgttctccaatcactacttgcaccaccattttgtatcggtcaaatcccatttctagaaagaaaaaataaggttatttataagcaaatatgtagtaaaattacttattgaagacaaatttgcccagaaatggacataaacattcaatccacaagtacttaatgaatatggtggtaagcttgggggtcaggaggacgtgaaggcagatcctaactataactcagcaagtgtataacctcagaaagtaatttaacttttcagtttaagtctcccttattaaacaggaatatcagtacctacctcccaagattgttataaggttaggtaagatatagtagtatcttttttttgttttgtttttgagatggattctcactctgttgcccaggctggagtacagtggcacgatctcagctcaccggcaacctctgcctccagggttcaagtgattctcctacctcagcctcctcagtagctgggactacaggtatgcatcaccacacctggctaatttttgtatttttagtagaaaaggtgtttcaccatgttgcccaggctggtctcgaactcctgacctcaggtgatccactcaccttggcctcccaaagtgctgggattacaggcgtgagccaccgcgcccggtcagatatagtaatatctaaagcatctaaacagtgctgttaaatactagtccttcaataaaccttagcttccttcctttttcccctactataagtcagctagtgagctgaaccttcaagatagagaaataaataagacgtttttcttgccttaaagaactcacagtaataaagaactcaaaggaaaatagaaaaataggccgggcacggtggctcacgcctgtaatcccagcactctcagaaggtgaggccagtggatcacctgaggtcaggagtttgagacaagcctggccaacatggttaagccccgtctctactaaaaaatataaaaattagccaggcatggtggcagatccctgtaaccccagctactcgggaggctgaggcaggagaattgcttgaacctgggaggcggaggttgcagtgagctgagatcgcaccattgcacactagcctgggtaacaagagcaaaactccatctcgaaaaaaaaaaaaaaaaagaaaatagaaaaataaattataaattgagtatgcttataattcaaggagtggcatgtatgatgtacatcaggaacacagagccagtgggggcagttcctctgtttgtctgggcagtggcaagaaatcactggaaaagacttcttggaagatgtggccggccaataaactgagtcttgagggctgagtaagaggggaccaggtcagccccatctccccacacgtccgagaacgaggggcatgtgcacagcaggagagcatgggatctccaagaaactgtaagctgttcagtaagacagacaagaaaaaaaatgaagattccagagcaaaacgaggtgatccagcaccatttagctgtttactccagaaactacgttgctaaagcagcaaaatcctgaaaattctcactaacaccaagtctgaagagaaaaaaatggaatgggcatttttgaatctttctacttttttgaccaaggaatagtggaaagagttttaaaaaaacaaaagaagtgaaataagcgaagctgaaagagccagctctctctgatgaacgtgcaggttccaagattacactgtaaacgggacaatctgaagactacaggcaatctcccatgtggggcatgaacctgattcagagtgtgtaaagacagagtccaagttatttttaaaaaacactgcacacaactcagctgagcttcctcctttctctaaccaatcccaaattatacagaaatgtgtctagaataatactcagcccttaaatcacggttctgaggggaaaataaaatagtctcagatatggtggggaggggaacttaaaaaaaaaacccacaccatatcagagcaattaaaaatcccccacatcatatcagagcaattaaaaatcccccacatcatatcagagcaattaaaaatcccccacattatatcagagcaattatgatgtatgggcacaacaaaatgaaatgcagccaaatggcaataaacaaagatgcaatagcaaaaacaaaagagtaacaaagaagaacaaagcttctgctgggtgccatggctcacgcctgtaatcccagcaattttggaggctgaggcgggaggatctcttaaggccagaagttcaagaccagcctaggcagcatgacaagaccaccatctccacaaaacaatttttctttttttcttttttttgagatggagtttcactcttgttgcccaggctgaagtgcaatggcgtgatctcaggtcaccacaaactctgcctcctgggttcaagcaatcttcctgcctcagactcccgagtagctgggattacaggcatgaaccaccacacttggctacttttgtatttttagtagagatggggtttctccatgttggtcaggttgttctcgaactcctgacctcaggtgatccatctgcctcggcctcccaaagtgctgggattacggacgtgagccaccacacctggtccacaaaacaatttttcaaaaaatattgaagaaaagaaagaaacttccagtggaaggaaggaagaaggaaggaaagaaggaaggaaggagctgtgtaagagaaaaaatttggctgggcacggtggcccacacctgtaatcccactttgggaggctgaggcgggtggatcacttgaggtgaggagtttgagaccagcctgaacaacatggagaaatcccatctctactaaaaatacattagcagggcgtggtggtgcacgcctgtaatcccagctacttgggaggctgagcaggagaatcgcttgaacctgggaggtggaggttaaggtgagccaagattgcgccattgcactccagcttgtgcaacaagaccgaaactcagtccaaaaaaaaaaagaaaagaaaagaaagaaaaaaatcaacctaggaagtaatacaaatcaaggaacgaagagttattcctcacaattaattcacaatactagaacaatgtaagcttataaactcaatgaaataagtactcaatcaggttatcaaattttttaactttttttttggagacagagtttcgctcttctgcccagggtggagtgcaatggcaagatctaggctcactgcaacctccacctcccagattcaagcaattctcatgcttcagcctcccaagtagttgggattataggcatgcgccatcacgctcggctaatttttttttttttttgcatttttagtagagacgggatttcaccatcttggtcaggctggtctcgaactcctgacctcaggtgatccacctacctcggcctcccaaagtgctgggattacaggcgtgagccaccgcacctggccaggttatgattttgtttgatttggtttggttttttgagagggaatctcgctctgtcgctcaggctggagtgcagtgggatgatctcaactcactgcaacctccacctcctgggttcaagcgattctcccacctgagccttctgagtagctgggattacaggcacgcaccaccatacctggctaaattttatattttagtagagacacggtttcaccatgttgcccaggctggtctggaactcctgacctcaagtgatccacctgcttctgcctcccaaagttctgggattacaggcgtgagccacctcacctggcctgttttgttttgtttttgtttttttggagatagggtctccctctgtcacccaggctggaatgcagtggggcgatctcggctcactgcaacctccgccttctgggttcaagtgattctcctgcctcagcctcccaagtagctggaaccataggcgtgcaccaccacgcctggctaattctttgtatttcagtagagacgaggtttcaccatgttgcccagggtggtcatgaactcctgagctcaggcaatccacccgcctcggcctcccaaagtgctgggattacaggtgtgagccacggcacccagcctcaatcaggttattaagcaacataaagagatgaaaagaaagaccacggccctagggaacaaacagaatacccagaaaagatcattccagaactaataaattcaaaatggcaagaaaaaagacacaaatgaaaacaattactggtttaagaaaatcacaagtaaatggcaataaaaaaggaagaagcctgggcaaaatggcaaaaccccgtctctacaaaaaatacaaaaattagccgggtgtggtggcaggcgcctgtagtcccagctacttgggaggcggagatgggaggattgcttgaggctgcagtgagccaagactgcgccactgcattccagcctggccaacagagtgagaccctgtctcaaaaaaaaaaaaagaagaagaaagaaattatgggaaagaaaaactaataaatatagaagacaaagatggctcaacataacaatatttggtgtcctgaagaaaaggaagtaacgaatggaataggaaacatattcagagatataaggaaatttcctttatatggaaagaataaagtctgcagattgaaagctataaaatgctcattagaaagtcagaatctttagaaaagctactgagcataaaggtgaagatgaggattattttatttatttatttatttatttatttatttatttattttgagacagagtctcgctctgttgcccaggctggagtgcactggcacgatcccagctcactgcaacctccttcaccccccaggttcaagcaattctcctgtctcagcctcccaagaaatcccagcactttgggaggccgagacgggtgggtcacctgaggtcaggagtttgggactagcaagcccggctaatttttgttttgtttttttgagacagagtttcgcccttgttggccaggcttgagtgcaatggtgcaatcttggctcactgcaacctctgcctcctgggttcaagctattctcctgtctcagcctgggattacaggcatgcgccaccacgcctggctaattttgtatctttagtagagacagggtttctccatgttggtcagcctggtttcgaactcacaacctcaagtgatccgcccgcctcggcctccctaagtgctgggattacaggcgtgagccaccatgcccagcccctaaattttgtatttttactagagacggggtttcaccatattgttcagggtggtctcaaactcctgacctcaggtaactcacctgtcttggcctcccaaagtgctgggaatacaggcgtgagccaccacgtccagccaaaggtgaggattccttaagcagagaacatcaagctgggctcagatttcttgacaacaagttaccactgaatgtcagagggcaatgaagcacaagggtcaagaaaataaattattacctcaaaactatgtatattctacttttgggggtggaggggcgggggatggagtctcgctctgtcgcccaggctggagtgcagtggcactatctcggctcactgcagactctgcctcctgggttcaagtgattcccctgcctcagcctcccaagtagctgggattacagatgcccactaccacgcccggctaatttttgtatttttcgtagagacggggtttcaccatgttggcaaggctggtctcaaactcctgacctcgggtgatccacccggctccgcctcccacagtgcctggattgcaggcgtgagccaccgcgcctggcccatagtatattctactttaaaggcaaaaggcaggcattctcaaacacaaaagaatccagggaatacggcatttctgagtcctttctgaaaacaacttacaacaaaatctcatcatctaggagttgaaataaggaactcttcccagctaattgagaggctgaggcaggagaatcacttgagcccgggaggttgaggctgcagtgatctgaaatcacaccgctgcactccagcctgggtgacgaagaccctgtctcaaaaaaagaaaataaggaactcaacaatgaaaatgacatggtcaaggaactaaacaggaggcaactgatccagttacagaatgaatatgacatgactatgggaaacaggtctacaatatcccattgtcatttgtccatgtatatggacatgtagaagtctgttgtaatgtttgcctagtattaatgattttttttttttttttgagacagagtctcactctgttgcccaggttgcagcacagtggcataatcttggctcactgcaatctccgtccctgggctcaggtgatcctcctgcctcagccacccgaatagctgggactacagatgcacaccaccagcccggctaatttttgtatttttctaagagacagggttttgccatgttggccaggatggtctcgaactcctgggctcaagagatccgcccgcctcaacctccaaaagtgctggaattacaggcgtgagccactgtgcctggccaatattaatgattgtttattggtggtggcattcaggtgatttttctcattttatttttctagtgtttaaattttgtataatgaatgtgtaccattttttacaaaaaatcttaacgatgaaccttcattaaaaagtctaaaaacaaaaatgctaatatactaacagcagttaattctgggtgatagaaatacacaggattgctattctttgtacttttctgtattttttaatttcttaaactaaaaacaaattcagaaaaaaacaataaacacaaatattaaatagtaactgcctttggttaatattttaaaactttaaggggccaggcacagtggctcacgcctgtaattccaccactttgggaggccgaggcggacggatcacctgaggtcaggagttcgagatcagcctgaccaacatggagaaaccccgtctctactaaaaacacaaaaattagccgggcatggtggcacttgcctgtaatcccagctactcaggaggctgaggcaggagaatcgcttgaacccaggaggcggagattgcagtgagccaagatcatgccattggactccagcctgggcaacaacagcaaaactccatctcaaaaaaaaaccttatggatacttttttgtattgtctaggtttattacaacgagcatgtattacttttatgaagatattctttctcttcaaaaaatgatgtcttctaagaagagcagatggaaataggccgggcacggtggctcacatctgtaatcccagcatgttgggaggccaaggcttgcagatctcttgagggtcaggagttcaagacaaaattagccacgtgtggtggcgcatgcttgaaattccaactgcttgggaggctgaggcgggaggatcacttgagcccaggaggaggaggttgcagtgagctgagatcacaccactgcactccagcctgggaaacagagcgagactctgtctcaaaaagaaaaaaaaaaaaaaaaagaacttttcagatcagacggtataacattattaacaaaagagagagaccaggcgcagtggctcacacctgcaatcccagcagtttgcgaggcctaggtgggagaatcacttgaggccaggagctcaagatcagccagggcaacatggcaagacaccatctctacagaaaaatttaaaaattaaaaaattagccaagcacggtggcacaagcctgtagacccagctacttgggaggctgagatgggaggatcgcttgagccaggaggtcaaggctgcagtgagccatgttcacaccactgcactccaccctggacaaaacagcaagaccctatttcaaaaacaaaacaaaacaaaaaaaaacaaaacaatcagagagacaaagagaacagggtaggaaaagcacaaaatatgctctacagatgtagtttggtaggggtcgagggttgagtaagggaagtagctaaggattagggaggagagatggactgcaggtactaaatgccaggctgaggacttgacagcttgggggaagaaacaaccaagaaatacaggggaaaggagtccctgtactttctggtctttctgaatactaagattttttggacagtgttttatttcacatcttcactcttttcccccatctgcaaaaacttacatgagtaaaagtcaccaaataattagagaagacaagacactgaagaaaaagttgtctttaatagaatccacagctaacattctatttacgtttttttaatagagatgttttatttttttattttgcttttttttttttttgagacagagtctcactctgtcacccaggctggagtgcagtgacgcgatctcagctcactgcaacctccacctcctgggttcaagtgattctcctgcctcagcctcccaagcagctgggactgcaggcgtgtgccaccacacccagctattttttgtatttttagtagagacagggtttcatcgtgttagccaggatggtctcaatctcctgacctcgtgatccacccgcctcagcctcccaaagtgctgcgattacaggcgtgagccactgcgcccggcctttattttgctttttaatacacatgaggtcggctgggcgcggtggctcatgtctgtaatcccagcaccttgagaggccgaggcgggtggattacctgaggtcaggagtttgagaccagcctgaccaacatggagaaaccccgtctctactaaaaatacaaaattagccaggcgtgatggtgcatgcctgtaatcccaactactcaggaggctgaggcagaagaatcacttgaacccgggaggcggagtttgcagtgagccaagatcatgccattgcactccagcctgggcaacaagagtgaaactccatctcaaaaaaaagaaaaatagacatgaggcctcaccatgttgcctaggctggtactgaactccagagctcaagcaatcttcctgccttggcatgctaaagtgttgggattgtaggcgtgagccaccacacctggccccaatgtcctttgtttaaagatggagagggggcaaatgggtaatactgactctgtgaagagaatgagtcatttccagttatcaccatgattaccttttaatttatctttaatgttttctgataaatgttttgtaagctgaggcatttcttctggagaatattcagcatttgccagttcctccttgagcacagcatggatacagtctttaaccacagagggcctgaacctgaatggaacaatttgtgaacatccagtcggtgactccacaaccccagcttaccttcataccgcaacttctcccatctttttgtcattagtaccacttaatccttctttttcatattttttattataaaatataaacaaattaagacaaatcataggccacatgtgtatcttcaacctggacctgcactgaacttcaacacattccaactcatgctccatatgaatgtttattaggcaactcaatacatccaataatgagcttctcatactcccctctcccccaaaacaaaatatatacttgttgttaattttgttctgcacgctttcacaaaataaaataaaataaaataaaataaaaaaatacggctgaatggcattctgggcattcagaaccttttaccaagataactgagggtatctttctctgtgttcattctacccaagggaaaaatcctgtatgaaatttgtatcactttttctgtgagttaccaagagaataaaaataaacaaagaaatttgtatcacattataatcaaaattcctgttttccatatttgccaagcaaatatggggtgtgtgtgtgtgtgtaaagttagtgatcttacaaacctagctgagtaccctctgctctggcccgtgagcctgacatttttttcagtgtgtgtgtgtgtgtgttgtgtggtgtgtgtgtgtgttgtgtggtgtgtgtgtgtgtgtgtaaagttagtgatctcacaaacctagctgagtaccctctgctctggcccgtgagcctgacatttttttcagtgtgtgtgtgtgtgtgtgtgtgttgtgtggtgtgtgtgtggtgtgtgtgtgtgtgtgtgtgtgtgtaaagttagtgatcttacaaacctgagtaccctctgctctggcccgtgagcctgacattttttttcagtgtgtgtgtgtgtgtgtgtgtgtgtgttgtgtgtgtgtgtgtaaagttagtgatcttacaaacctagctgagtaccctctgctctggcccgtgagcctgacattttttttcagtgtgtgtgtgtgttgtgtgtgtgtgtgtgtgtaaagttagtgatcttacaaacctagctgagtaccctctgctctggcccgtgagcctgatatttttttcagtgtgtgtgtgtgtgtgtgtgtgtgtgtgtgtaaagttagtgatctcacaaacctagctgagtaccctctgctctggcccgtgagcctgatatttttttcagtgtgtgtgtgtgtgtgtgtgtgtgtgtgtaaagttagtgatctcacaaacctagctgagtaccctctgctctggcccgtgagccttaatcctagcgagggctcgctgcggtggtctaagggcctccagatcccacccgggtaggacttcgcacagatgcagctcccgcgccgggagtgagcccatcctggcacccgtgtgcacagtcaccctcgaatcacggctgaacggcatccgacgcgagtggcttcctgcctctattctacccatctccttactcaggacgccatcgcgggtttcccagggccaaccattcccgccgcgccaccctaagacgcgcccggcgcccaaacactgaggaagcgggtggggtcccctgcggcccctgcagcgggaggggcgcccggacgtcacagcagggccgcccgcccgcctcgcggcctcccgcctcccgccccgcggaccccgcgcgtcccccgcgctccttccgtggcccaggtcccaggcgagctccgcccctcagaccagcgcgctcgaggtcgccccgccacagcccgtcctctacccgcctctgctggaaaacaggccgcagaatataggtgttctcgggctcccctgcgttcttctcagcctcaggcaccccgtcgcccaccgagaaggacactccgatggacgtggccatgccggggcttctcggtccgggcgtagctcgcgatgaaggcctagcgggttgcggtcgcggccggcagcagggaaagcgtctccagggcaacagggccgccctcccgcctcgctgaagcccgcgagcgccccgcacagccgcc

SEQ ID NO: 1532 - DNA, 30360 bp, Homo sapiens
ctgtacacagcatgcgctttatttggcttctcttacgcagcgtagtgactttcagatttattcaagctgctgcgtgcgccaacagtccactccttcctagtgctgaggcccccatcacatgagcacaactgtttcttgtgtgtgatgtgttgttctctggctgtgcactgccaaaaaagacatcattaaaaaaaatttaaatataatgtaagacctgccttgtcttaggaaacgtttttctggcagtggctcacacctataatcccaatactctgggaggctgaggcaggaggactgcttgagcccaggagtttgggaccagcctgggcaagagggtgaaaccctgtctctaaaaattagccaggcatggtggctcacacctgtagtctcagctcttagggaggttgaggtgggaggactgctggagcccaggaggtggaggctgcagtgagccgagatcacaccactgcactccagcctgggcagcatggcaaaactctgtctctaccaagaaaaaaacaaaaaattaacagaaggaaaaacaaaagggctttcttatcaaaaatacactttaaggaacaaatttatcatattaagttggtgcaaaagtaatcgtggcttttaccattgaaagcaatagcaaaaaccgcaattacttttgcaccaacctaatattattttctaatgacaaacttggaaataactgtcattgttctctaaaaagaacagcctaaaaataaagcagcagcccatttacttctatgccagttcttttagcatttggttatttaaaccggcagtccctaacctttttggcaccagggactggtttcacggaagacactttttccactgacaagtgtggggatggtttggagacgaaacggttccatctcagatcatcagtattagattctcataagcggggcataacctagatccttcgcatgcgcagttcacgacaggattccactcctatgagaatctaatgccaccactgatctgacaggaggcgaggctcacacagcaatgatatgacagggggcggagctcacacagcaatgatatgacagggggcggagctcacacagtaatgatatgacagggggcggagctcacacagtaatgatatgacgggggcggagctcacacagtaatgctctggcagggggcagagctcacagtaatgctctgacgggggcggagctcacacagtaatgatgacgggggcggagctcacacagtattgatgacagggggcagagctcacagtaatgctctggcaggggggcggagctcacacagtaatgctctggcagggggcggagctcacagtaatgctctgacgggggcggagctcacacagtaatgatgatgggggcggagctcacacagtaatgatgacagggggcagagctcacagtaatgctctggcagggggcggagctcacagtaatgctctggcagggggcggagctcagtaatgatctgatgggggcagggctcacacagtaatgctgacaatgggtggagctcacacagtaatgctctggcagggggcggagctcacagtaatgctctggcagggggcggagctcacacagtaatgctccggccgggggaggagctcacacagtaatgatatgacagggggcggagctcacacagtaatgatatgacagggggtggagctcacacagtaatgatatgacggggcggagctcacatagtaatgatcacagggggcggagctcacacagtaatgctctgccagggggcggagctcacacagtaatgctctggcaggggacggagctcacacagtaatactctggcaggggacggagctcacacagtaatgctctggcagggggcggagctcagtaatgttctggcagggggcggagctcacacagtaatgctctgacagggggcggagctcacacagtaatgctctgacagggggcggagctcacagtaatgctctgacagggggcggagctcacacagtaatgctctgacagggggcggagctcacacagtaatgctctgacagggggcggagctcacacagtaatgctctggcagggggtggagctcacagtaatgctctggcagggggcggagcgcacacagtaatgctctgacagggggcggagctcacacagtaatgctctgacggggcggagctcacacagtaatgctctggcagggggtgcagctcacagtaatgctctggcagggggcggagctcacacagtaatgctctgacatggggtggagctcacacagtaatctctggcagggggtggagctcacagtaatgctctgacagggggcggagctcacacagtaatgctctgacggggcggagctcacacagtaatgctctggcagggggcggagctcacacagtaatgctctggcagggggcggagctcacacagtaatgctctggcagggggcggagctcacagtaatgctctggcagggggcggagctcacacagtaatgctctggcagggggcggagctcacagtaatgctctggcagggggccgagctcacacagtaatgctcactggctggctgctcacctcctactgtgtggcctggttcctaacaggccatggactggtaacgatctgtggcctggggactggggaccctgatttaaagaatcgaggacacactcacctagcaaaccatctgccaagaaaaaggaggaaaagcaccaacattaatttgaacttagaaataaactacaataaggccagacatggtggttcacacctataattccagcacttcgggaggccaaggaggaacgatcacttgagcccagcagtttgagaccagcctaggcaacacagtgagaccctgtccctacaattacaaaataaatgagctgggcgtggtggtgcacacctgtagccccaactgctcagaaggctgagtcgggaagatcacctgagctgcccaggagtttgaggctgcagtgagctgagactgcaccactgcactgatcctgtctcaaaaaaaaaaaaaaaaaagaaactacaacaaaatatctggattttgatgtaacagaatacaaagataattacatttgatttttaggtcaacaaatatgactaaagtcacaacagtaaaatattttaaatggatttggaaataaaagaaagtttgttcatttatattttatttaagagctgtgcccagttttatcttgtcacaagaatgaagcaagggacaaagtgccacgctccccggccactgggtgccaatcccccttcaatgtactccttcttccccagagtgcagaagcgtataaagacagttatgacattgacacatgcatgagctattatacataattacaaaagctgattctgtcatcaccgcatcttgtctcatcagtaggagtgaatggctggggggacagtggcacagtcagcctcattcaaagttttgtcgattatgggtctatattccacagtgaccttgaaaagaagtcagtggtaagttaagcacaaaaatgtacaaaaagccatctcttgtgttccttttgaaaaattttaactataaaagtagatttacggcatgtaaactttaaggtatttgctgcagtattttccaataacaaattcaaaaatgatctacatgcgcaacaggggactgtaaatgacggcagatcggtagagtggaacagagcaacgaaaatgacactgtaccagattctcagtgctttgctttacaaaaatgctcccatcatgaaaagtgggagaacccttgtctataccaagacacttcatgtttaaactatctacttccagtttttctacttcaaagtaaatatttatataggtagaacatccctaatccaaacatctgaaattctcccaaatctgaaactttctgagcaccagcatgacattcaaaagaaatgtgctatggagtcagatcttcccattagggatgctcagacagtaagtgtaatgcaaatattccaaagtctgaacaagcctgaaatccaaaacacttctggtcccaacgatttcagagaaggaatactcaagccgtgtattaaatatgcacacacaggaaaaggtaggcacatatacaaagaaatttaaaccataatgggtcatctctggttagtgagctcttatttcaatctctttgtactttctaaaatgagtacgtatttcttgaaaaatcactgaaactggctgggcgtgttggttcatgcctgttggggaggccaagacaggtggatcacttgagctcaggagctcaagactagcctgggcaacgtggcaaaaccccgtctctacaaaacatacaaaaattagccaggcatggtggcatgtgcccgggaggctgaggtgggaggatcacctgagccgaggggaggttgaggctgcagtgagacgagatcgagccaccacatttcagcctgggcaaaagagatgagactctatctcagaacaacaaaaacaaaacaaaaaacctgaacccggaaacattaaaaatagacttgtgctaagcaagtgtgacctctctatactatcaggaaatggccttcatgataaattctgaaaatgacctactgcctgaatcacagacacactagatgatagtgagagtccaaaggtaacttccacagacacagctaagtgattatacgactctcccttacaagttatgaaaagcttaagggtaaaagctttctatcttcatgatttctgaatctcaatgcccagcggaaatgccacacgggtgaactgtgcttgtgtggaacaagctgcaacccccctaccacaccctcggctggctgttcccaagacgctgtgcttgtgtggaacaagctgcaaccccctaccacatcctcggctggctgttcccaggacgctgtgcttgtgtggaacaagctgcaacccccctaccacaccctcggctagctgttcccaggacgctgctcaccccaaccccgcctccatttctgcccttctctgcttgctcagtgcccaggggatgctaagggctgcacctcatcccctctgctcccctgcagatgcttccagttggcccagcccatgggaggagaggggagggatctcttctgggctcccttggctcgggactggtttctggtagtggctgtgtccccactacacagatgctttctcgctaggtccataatcatcatctcttcccctgccaccaggccttggacacttgctcctgcccagtgacgtccatctggcccacaccacagagcaacccttccttaaggctcctctgaaccacctgcaggcactggattctgtttccagcccgaagcccaactgctgtcagagtgcctttttcagcggtgcctcaaatctgtcgggaggtgatttaaatctggcctgctcctctgcgttcaccatcagcaaggccagcccgcagacctgggcggggccgtgtgggtgctgggctgtggtgagaacgagctccacactgaccttcccagtgctgacgtccacataggacagggtgtgcttcctccagtgctcctcaaagggcttcttctgttgcccctggatgggcttggagtgatcgtactcatcaatccgcacctgagcccagaaacaccatcacatttctcattactctaacagagcaatacagaaaaaacacagcaaacgttaaaatgatctaagagacagatgccctagaacccattccatttccacttcagcccaggaggttggcaccatcaacacgttcagaacgcacagaggccacatggctggccagcaatgtgcagccagcagtgagtccagagtaatccatgtccgcatgttcccttagacatcctttatgtacctaagagtttatcaaatactttgtctttttgctccaagcgctgggagactacctcaatcctttctttcagcctgtttttattaaaaacactttttttttcttttgagacagggtctcgctatgtcacctgggctggagcgtaatggtgtgatcacagctcgccagagccttgacttcccgggctcaatcaatcatcctgcctcagcctcctgagcagctggtacctcaggtgtgtaccaccacgcctggctaattttttaatttttgtagagacaggtttcgccatgttgcccaggctggtctagaactccggggctcaagtgatctgcctgcctcagcctcccaaatgctgggattacaggtgggagccactgcatctggcttctattctaattaaaactcgttgtcaccaactaaatttatgctcctggacaggcacagtggctcatgcctgtaatcctagcactttggaaggccaaggtgggtggttcacttgaggtcgggagttcgagaccagcccggccaacatggtgaaaccccatctccactgaaaatacaaaattagccaggcacggtggcatgcgcctgtaaccccagctgcttgggaggctgaggcaggagaatcacttgaacctgggaggcagaggttgcagtgagctgagatcgcaacactgcactctagcctgggggacagtcagactccatctcaaaaaattaaaaatcataaatttattattattctgtattctggcaaacacggattcatatactttgcaggaaagactcttaatatgtatgaggagacgagcaaattctgagcagtgatcacagccatcagcatattctagtggagggtaaatcagtaaaatttcatggtgaataaaaatgattttcccattcactgtgttcagctgactggaaaggctgccaccagccgcccacacatggccctgaaccagcctgtgcgcctgccttgtggagcctttgtccttttgctgatgtggtttatgctgaacttgcatttgcaccccaagcttccctttccgtcgttttttgctatcatatgtgaaaaactcttaccaggcagaatccaacacgtgtgctctgcacaaaaatcagttcatctgaagaacaagtgaccacagggcaggctccgtaatcaaaccacaggacaggctctataataccttttccaaaccacaggacaggttggaaacagtggcttactcgttatttagtaaactggcatttcctccacagggcaggtctgaaacggtgacttacttgttatttaataaactggcatttcctccacagggcaggcttgaaatggtggcttactcgttatttaataaactggcatttcctccacagggcaggcttgaaacggtggcttactcgttatttaataaactggcatttatttcctggtcatgccacgctggctgcacttctaaccttggccttctaacagcaaagcacattggcttggagatgccactgctggcatcagtggatgccgacccaaagcaaggaacaggtcacagtgatccagaaaatggcgagaacccagggatcaaagttaccagagggaaaaaggcattttttggatatacttttggggaaacgacataaaatgcagagaaaatgcaggggtggggctgagtcccaccaggcgggaggaaaaggcaggtgcaggtgggcgtggcgagaaggcgcaccttgtagtcttccccggcgtgcgcgccccgtgactccttccccgcctctgctccattgacggtctgcagcgcacatagcatcaggttctgcagctccagggtctccaccaggtccgtgttccagaccattcctggggacacaaaaagttccatcaggggcaggtgggacccagtcacacgggccctccgagctgtcagcctgggcctgctagtccatggagtcactggttgtggctttacagctgggggccagcacccatccagacagcaagcatggaactaagtcagcactgacgggacagacaccagcccaccctgcagaaggcagggcccaacagtgtgcacagagcccactgtctgctcaccccggtcaaacgtcttcagatgcttcaggtctccatagagcttgctgattttcccacaaccttcttgcaacaagcttcccacacggaacacggcagcatgattttgcgttgactgtggcacaaaatattatttgtaaacttttaattcatagaagcagccataccaagaactgcttaacttttagacctgttgttttgcatttcattttatttatgtaaattaaacagaaaaattaggaaatttagactatgagtttattactctgaacttaaaaatgaagtcttgactaaagcttctgaataaatgtttctattatatacatatcttagacccacacacatcctttccagcgggatacagccaggatccaggacgccaagcagactgcctgtgaggcaccatgttccatacggctccacggccaaccaggcagcgctgcctccccacacccctggcgggactcctgatgtggggtctggtggtgaacgtgacacgagccagcagccctgtggtgatacacacaaggaggaactgagcagagccctgctgatggtggggttggaaccgaaggtcttcaaggagagggaggggcgtgggtggctggggcccttggcccatctggctactgtcttctgcctattttgtagaagctccttgtacactgagttccttcatagttttactatcacgagaaacgtgctgggagtggacctgaagtttacttaggtatgctgggaactgggcatcagcttttgcttcctgtgggacacacaggcaccacctccgtgatccctcctcctccttgcttctccctctaactgtgctttgctccactgaccctaattgtctcttcctctaccaatgcaccttcatggttcaatttggacatttcatctgattttccttagactcatacataatcgtaacactgtaatgcacatcaacctaacggtttttcaggaagaacaaatgaaaaaaattgcatctcagaatctagtattacattctttcatgtccttcagcagcgacgttttcgtatcatcttttcgtatttctggttacattatttcaaggcattttaaattttttgtttgaaatgcgaatgagatatttactgatgtctgagcagattactgctggcacattgcaaagctactgatttttacatacaaatctcttatccacataccttactacattcttgttttgtttctgttagtttttccatttattctctggaaattttttggaaattatatctgtaaataatggaaactgtatctattccttttcaatatttactgccaagaccagctgggtcatggaaaccctaacccagtggcactagaggaagtaaagacacacacacagaaatatagagtgtggagtgggaaatcaggggtctcacagccttcagagccaaaagcctcaaacagagatttacccatgtatttattgacagcaagccagtgataagacttactgaaagtattccttacaggaaataaagggatgggtctggctagttatctgcagcaggagcatgtccttaaggcacagagcgctcatgctattgtttgtggtttaagaacgtcttaagaggttttccgctctgggtgggctaggtgttccttgccctcattacggtaaacccataaccttccagcgtgggcgtcctggccatcacgagcatgtcacatgctgcagagattttgtttatggccagtttatggccacatttgggggcctgtttctaacaatttacctcatttctttttttgattgttactattaatagccagagtcagcagaaaaatcccttcccccaacgaaatgcatttccgcaagcataggaagctctgtttgttcagtgctgactccggcacctcacggagcctgggatacagcaggcaccaagacacaccttgtttggtgggaacacttctagtattctcacttcaaactatctcagatttgccatttctatatcctaaggcatgttcccattctctaacgcaagggttccttctttcccagctggcctccaaccctacaaaagcactgcagggcatcactcagccttctgtgccttagtcacgctgttcttctcaccgttccacaaagcctccctcaagcccagcctcacctgaagaccgaagggcacgggcctctgaaaatgtcagcagggaacctgttctcttgtgtctaacaccaaatgcctttcagaataggactaaagcagtggacttcttcctagaaaatacgcagcaattcttgcaaatagtagacaagagattctcattcatggacaagaatccttgttattagaggaattcagtttcttagactgactatatatcaggttctccacggccccatggctaatggctgccatactggacggcagtcaacatttccatcatcacagacggtcctactggaccgactcccagcagcacaggccacacagatcactgtccaccggccgcccactctccctctctgctgagtatatttaggggcagcaacaggtccagcttaaagacgtttccgagctgctggaagccaggcatgaagacatgatcaatatctgggcctgagatgtaagcaccagtcttgtgttgaactccaggaaacctctaagagaaagctgccctgctggggacggagcttctccggtggtcctgcggctccctctcctccacgctgtgactcatccatgacagccagcgacggtcagggcacggcggtcatgcccaagcacacacaagtgaaccacagaaggctgtcctggatgctaagcagtcactaattctgccctggcctgctgaccttctatgtggagaagaagtgcacttctggtctctttcatattcttgatacagtgaggagtatgtcctactgctgtttacctccagatactggtgcagcctcgtatgtttattgcagcactagtcacaatagcaaagtcatggaatcaacctaagtgcccatcaacggacgaccagataaagaaaatgtggtacatatataccatgaaatactacttggccataaaaaaagaatgcaatcatgtcttccgcagccagacggatggaacgggaggtcactatcctaagtgaagtgactcagaaggtcaagtgtcacacattctcccttggaagtgggagctgaacagtgagtacacatggacacacggagtggactaacagagactgggggctccaaaaagcgggaggggtggggatgagcaattacctgctgagtacaacacacacgacttgggtgacgggtacatgaaaagcccagactccaccacctcccagtacatccacacaaagctgcacctgcatccccctagatctgtttttaaaaaaacaaaaccagtgcagggccaggtatgcagccagcctgctcactccagagcgagtccaggctcttaccttctgcatgctgagtcgcagttccgatgttcttatgcttcttccatcagcaaatctcaatttgtcaacattcgtgacagattcttccccagcatttggtttaattggagggactttatctcctaaaacaacaacaaaaagagctagaatttaacttttgaaaaccgttttaaaaaaacaaatggatttagtacgacacacaaaaatgtagcatagccgctcaaggagcctggaaactgtgtaagtctcctgagctaacacactgccaacccaccctacatctgaggccatctgttgagttggggccaattttaaagaacagacataaaaggcaaaactgttggcacacagtagatatccattaagtgatcttagagtgaataaactagaaatcatctctaaaattaaaaaattaaaatgtaggccgggtgcagtggctcacgcctgtaatcccagcactttaggaggctgaggtaggtgaagcacttgaaatcaggagttcaagagcagcctggccaacgtggcaaaacctcatttctactaaaaacacaaaaattatctggcatgagaactgcttcaacccgaaagatggaggttgcagtgagccgagatcgcgccactgcactccagcctgggcaacagagcgagaccctgtcttacaaaaaaaaaaaaattaaatgtatacagatttatatacattaagtgtatataaatgtcactccactaacgggaaaaaatgacaccttccagatggtggtcccaaggggccggccgccccactgtccttcacattagggggaggaaggtggctgctgtgtgcttgcaagtcacctgctgatttggactattgtgtgctctcatctatacttcaagatttgcaattttttttttttttgagatggaattttgctctgtagcccaggctggagtgcggtggcaccatctcggctcactgcaacctccacctcctggttcaagcaatcctcctgcctcagactctggagtagatgggactacaggagtttgcaaccatacccggctaatttttgtattttcagtagcgatagggtttcaccatgttggccaggctggtctcgaactcctgacctcaggtgagccacctgcctcagcctcccaaagtgctgggatcacatgtgtgagctgctgcacaaggccaagatttgcaactcttgtgtttccaagatgtcttgaaaaaagttttaaaggtttttttttttttataaaattatatatattttttcttcaataagtaacacatgcaggagataggaggtatgaaatgcaggagtccaacaggccctgtcccgcctaccgcctctcctcgggaccaggctgtgggtctcttgacggtctgctcaaatgcttctaggcttgctggtgtctcttttccttttgtttataacgctttaaaaattgatcatccattaaaattgacttttttctttcggtggacagttctacagtttcttttttcttttttttttctttttttgagacagtgtctcctccctctgttgcccaggctggagtgcagtggtgcgatctcggctcacagcaacctccgccttctaggctccaacaatcctcccacctcagcctcccaagtagctgggactacccaagtgtgagccaccatgcccagctaatttttgtatttttggtagagacggggtttcaccaccttgcccaagctggtctcgaactcctgagctcaagcaatcggcctgccttggcctcccaaagtggtgggattataggtgtgagccactgcacccggcctcagttctaccgattttaacacatggatagatgcatgtaaccactttgggaggctgagacaggaggatcacttgaggtcaggagttcaagaccaccctgggcaacacagggagaccctgtccctagaatacatttttaaaaattagccagatgtggtggcgtgcacctgatcgtaccactgcactcaagcctgggtgacagagggagactatgtctaaaaatacacatatatatattttttgggggggtcgggggttgggggagaagtagggatgctacaagcattttttctttccttttcatttttaaaaattaaagcgtaaagatacagtaaaataaactcatcatttttaatgcaggtttttcaaactttgacacacacagagctgtgtctgtaagcctcagcacaatcaggaaacagcctctggcaaccaccaatcccttttcttccctagatgtgccttgtccagaatgtcctatcaataggaccacaggcgtgcagccttttgagtccgactccacagcattctgcgtgagatgctgcatgtgtgagcggtttctcagatgtcaagtatagggtattctcacaaaatgttcttttctgcattttcaaagaaagagaagctcaaaatttctacactgctctgagagaagtggtatcagacctcactgcgacaaagtgcagggctatggagtgagacaagcacaacctgtggcgtcaggaacgaggcacctgaaccccgccttcgccgatgatcagcaacggctggggatgagacgccggctctgcatgtgctggcctcctgagctgtcgtcagatccacagagacacagtgtctgaagtagctacccttttaatactgcctgtacctttctaactacagatagaaaagggcgcacgtttataaggtacggcggtgctagtttttatttcacttgagtccatacaaaaagcaaaaagcgcctgttctataaaaacagcagaaatgatgctaaacagttaacaccagagaaagctaacgggaagaacatgggcctggggtcccaccatccttgccacgcaaacatccaccagtgcctcatccacctcacactgttctgagcacacgaggctgcataacaaccgtgaggatctctggaggtgggaacgatgctaactgtcctgttcttcgcgccctaagaacagggcactaagaccctgtctcaaaaaaaaagaaaaaagactaacctcctgcgccttctcaaatagtctgggtcctgaagaaaacacttaccaggcctgcacgactctgcgatgctcagggcacatgcctgaccagacaaccaggtccaatagcgagtttgccccgaggcggttgacaccatgtgcagaggcacaggcggcctccccacaggcgtacaggccgggcacaatctgatcctggccattcccgtgcctcaggacctgtggaaaggaagatttcaggtgaaatgtcaagatgcccattcctccacaagcccacctccctcaacagggtgtctgtgctgcaggtcagagaaagagagggaagtaggtcgggcatgcagtggctcacgcttgtaatcccagcactttgggaggctgaggcgggtggatcacctgagttcaggggttcgagaactgtctggctaacatggtgaaaccccgtctcaactaaaaatacaaaaattagccaggcatgatggcgggtgcctgtaatcccagctactcgggaggctgaggcagaagaatcgcttgaacctgggaggcggaggttgcagtgaggcgagatcgcgccattgcactccagcctaagtgacagagcgagtctccatctccaagaaacaaagagacggaagtaaagaccgtatctaagaaggaagtaaggaccatagctactcttcttcagagggaaacttccgaatgtataccccagtttcccctctgcccctgagcacctgctgttacaagcaggtcagaggacctccaatgtcagcatctgcgactgtcccccgtgtcccatgttcccgaggccctcaccacctgtgctccagctcagacccaggagcacggcaggtggaggaacatcagcaggggagactgatgttccagactcttctaccccctgttcacctcttcatctatgcggggaaagtaacagcttccacccacctcgcccaacaaggaggctaagtgactgacaagctctgtgtgaaccgcaaaccactcaaaggtatgaattataaagatccctcgatgtacaagatcattagaaatagcaattataaagatcccttgatgtataagctcattagaaataacacaagatcatataggaaagtaattataaaatgggaaaagctgcaaatgatgtatctatgacagtttacttaggaggaataaattattaagcctccttccatcctccactgatagaaatttcaagtgcaatttagaaaacaatacagtactttctttaaggaaacatctgtctcttcctctaagatctaaagagacaactgcaagatgggccccgttgtcccagccttctttccagctgtgggagagaagccagcaccatcacctgcccctcgtagctggtgggaatgccgtccatgttataatgcacggtggggaggacagggatcggctccttcgtgacgtccacaccagcgaagatcatggctgtctctgaaatgccgggcaagggcatggccagctgctctggaggtaggtggtgcagctgcaggtagacgtgatctttctcagggccacagcctctggtaagacagaacaccatcacataaggcagagaatggcaacggcagcagacctgagaatacgtcatcttggaagcgtgtgagttgcaacatgttttgatactgaggaaaatttcccctcatgtacggccaccctcccatcaaatcttttctaagcatctactgtgtgccagggacaatcctaggtgctgggacacagctgagaaccagaacaaatactctgcccttactgaactcacactcgtctcagggatcacagcctgcagcggctgtccttggtaaaagcattaggcctctatgccaaatagtcgtccctgcgtatccgtggcaggttgggtccaggacccccacggacaccaaaatccgtggatgctcaagtccctaatataaaatggcagagtatttgcatataacctatgcacatcctcctccatattttaaatcatcctcatttcaagttttacatttaagttgtacagcaactccaggattactcatagtacctaatacaatgtaaatgcaggtaaatagctgctacactgtgttgcttagcgaacaatgacaaggaaaaaaaaaagtctgcgtgtttgtaaggatgcaattttattttcagtacatagttggttgaaaccacacatgtggaaccgatggatacggagggccaccatattccaaaaaaccatccgacttcttttttttttaatataaaaatgtaaaacctctaaaggccacaccagataccagcagatatttagcaagtgttatcacattaaagaacagggtcaggcaatgaaagagctgcaaactgttcttctgaaaggcaaatgacccacacactttgaaagctgtcgaaaaacatctgtgggtatcagacaccacacccaaggctcacacgccgacttcaggttgggtgcgtgtctctctcttccatactccgtcacatactcacacacactaagagaaactctgttccacagatttgagaaagaaactggctaaaattttcaaaatgtaggtctttaggaaaatatcgcagactaacagatgcctgccggcagctgagagaggtggctgtgcacatgtgcctgcacacgaaggtgagggcgagtggtgctgaaactcacagaagcaaccccggcccgtgtgcccgctcagacagtgctggtggtaaaccacacgcaccttccttcgcggatctccagagtcatccaccgagacaccacatctctagacgccaggtccttcgcgatgggggcgtatcgctccataaacctttcgccttgactgttaatgagaatgcctccctctccacgacatccttccgtaatgagacaaccagcaccatatgtgcctgcaaaaaaccacacatttataacctaacaattgctgggtctctatttcaaatgcattacttttttttacaagatattttttgggggagagacaaaaaagatatgcagaaggcattatatgcaaaactgaacagaaagaacagttaagatacagtagaaagtctggataacaaaaagcactgacaaggctgacagctgcagcagaggctggggcagagtggcgtccccagagaggagaaaggccggcccacagacctctggccaatactctgattacagcccggtgtacgttggatgcctcaaattttgttttaatttttgaacattcttttgcgctacgatactgtggtgactagttaagaatactagcttggagaattcatatctaagttacccaaacagtggcaaggacagtaataatgattattttagttcatctttacactgcacttgctatgggcagttctagctgctttccacatattaaactcatttaagtcttacaacaactctgggtagtacgaccccctttctcagtgacaagcaaattaacgcttggtaacatccagtcatgcagctgaggacagagctcaaacccaaacctgggcagtccggcggtctgtgccccaaacagcggctctgtgactcctcagtgcgatgagaaacagggcgtgccaagctctcgaattttaacaaaggagatcaaaaaccctaaactaaatgtatttcaaaagctacaatttttattagtatacaaaaagggcaatcttgctttcaaaacaagaatgtgattcttgcatctcacctgccttttgattttctaagtttccatgctctcttttctgtggttacttctcacatattgaagacaaagcatgagaagtggagctctaagcaaattacagagggaattcaggggctcactgacattttactgattaaaaacagtaataaaaaatacaacaggccgggtgcagtggctcatggctataatgccagcaccctgaggggccgaggcaggaggatcgcctaagccctggcgtttgagaccagcctgggcttaaaatggtgacaccctgtctctaccaaaaacaaaaaaaccctcaaaaattagctgggcatgctaacacatgcctgtagtcccagctatttgggaggctgaggtggaaggatcgtttgagcctgggagacaaaggctgcagtgagtcgagattgctccactgcactccagcctgggcaacagagcaagaccccatctctaaacaaattaaaaaaaaaaacctacaacaaatccatttcttattttcatcccttccagggatcagaaagctgacactgacagagaaagaaaagacacaggtctggttctttggcaccacttcaggggtctccatcgtccacaggtcagaaaagcaacccagaaaagtccaggacgagtcacctcaaacaagaggcagacgtgtgtgtgtctgtctctgactcattttgaagaacctcctccaaactcaagacttcaactgtcatttctgagttaatgtctccaaattgcacattcgtaacctcaaccgtcagacgtccccaagacaagctcatcttccccacgacaagctccctcagtggtcacgggggctgagcccagcgcccaacgtcacatggggttctctcatggctgtgtcttaactttacatcccattgtcacggaagctctgtgttgtcctacaaagctgaaatctgcctgtgctgcttcttggttccacagcattcacccagctctcagaatgctcactcagtaaaccccgatggagaccctaccatgtgctgggcgtggagcaccccagttaatgagaagacctgcctgcccgaattgctgacgacctcactgcaaagagggacactgaacaattcctgctttacttttttttttttttttttttcagacgaagtcttactctgttgcccaggctggagcgcagtggtgcgatctcggctcactgcaacctctgcctcccaggttcaagcattcctcccgcctcagcctcccaagtagctgggatcacaggtgcatgccaccatgcccagctgatttttttatgtttagtagagatgaggtttcaccatgttgcgcaggctggtcttgaactcctgacctcaggtgatccacctgccttggcctcccaaagtgctgggattacaggcgtgagccaccatgcccggcctcaatccctgctttactgctggcataagtatcaccaaggcagggtttagggctcttgagaaatgcataagatggtggcccaaactgccttagaggaaggggagtgtgggaaaagtctccttaaggaaatgacattgaagttaggacctgagagctaaggaagctgatcttcaaaaccatgttattacataaaactatggaagagcaatgagtaggcaccacacgcttacaagacacacgagccgaacgctttccgggcaaggcgtcctgccctacctgtggggtggaactgaacaaactcgaggtcctggcaaggaaggcctgccctggtgatcatggccgtgccgtcgctggtgctggtgtgggcagacgtgcagctcaagtagttgcgccagtagcctatggaaacaacagagagcagtgactgcacacagtggcccacgtccggacctcctgtctaatgagatcacagaacggacagggcagcccccgggcaccatcttctcagtgctgtgtgcacacaacccccaactcacgcacaccccacacacatcactgggggccatgccagtggtgctgctaccctgcgcaggtaggatagaagcctgggatcagagaagagacttccatttatattttatttatttattttgagatagggtctaactcttgtcgcccaggctggagtacggtggcacaatctcggctcacggcaacctcaggctcccaagttcaagtgattcttctgcctcagcctcccaagtacctgggattacaggtgtgcaccaccacatccaattgatttttgtatttttagtagagactgggtttcgccatgttggccacgctggtctcgaactcctgacctcaggtgatccacccacttcggcctcccaaagtgctgggattacaggcatgagccactatgcgtctggccctgtttgtattttagatttgtgctgttcaaaaggtttccccagtaagcatatactacttttataatgaaaattttaaaatttttatggattttgtttttttcccccagatttactgaggtatgattgatgaattaaacaaaaaacaatactgtatatatttaaggtgtacaacgtgatgatttattttgtgaactgatgacacaatcaacttaatacacatctatcacctcatacaattatcctttttttttggagatacagacacctaaggtctactctcttcgcaaatttcaagttatattaatgatagccaccgtactgtatgattttaactgtagccaccatgctgtataatgttaactctggccaccatgctctataacattaactctagccaccatgctgtttatcagaccttcagaacttcaccttgtgacgggaagttacacctttaatcagcatcgccacagtctgcattcccccagcccctggcaaccactgtcctactctgtttctgtgagttgtgacagttttagatccacatatgagtgacatgcagtatctgtctttctgtgcctgggtcgtttcacttaacataatgactttgggttcatccacgttgtcacacatgacaggatttccttcgttttcatagctgaataatattcagttgtgtacacacaccacattgtcattaaacaccaaaaatttttaggttgtttccatatctcgggtattgtgaataacgctgcaatgaacatgggggtccaggtgtctctttgagcttctgatttcatgccctttggatatacacccagaaatgaggttgctggagcacatggtagtcctgtgacttttgaggaacctccagagttttccacaatagttgtactaatttacattcccaccaacagcacacagggttcccttttctccacatcctcaccaacactatcttttgtcctcttggtaacagccactctaactggagcgagatgagatgatactcattggggttttaatttgcatttctctggtgcttggtgatgttgagcattttttcatacatcaactggccatttgtatgtcttctctggaaaaatatctattcaagtcctttgcccatttttagtagggttgttttttagtagggtttagtaggttggttttagtagggcttttttttattttttattttttttgctattttagatactaagatatcattagatatatggtttggaaaatatttttttcccaacctgtagttttgctgattttttttcttggctgtactgacacttcttaacttttaaagtggctaaagtaactgccactgtataaaattaaagttttttattttcattatgtggagaagacagacttatctatcccaggaatcagtataaacatagaacccactaaaacaagagggattttgccagaaaaccccatgtgactcttcgggccacagtttcctcatctaaaatcgggagaggtacgctgtgaacctgacggcagccactaccgactactgagggccatgctttctcaccccctgaggcaggtgctgctgtcctcaccctttacaggtgaggaaccacggctgggaaaggccatcaccctcacacggttatatcaaggcctgtgtctgaactgctattctacaatgcctctattttccttaaaataaagacactctaaatggaatttattcatttttacaaaggaaataaagtagaaattagattcctaccctgtggcaacaatagtattctttgctcttatgcgatggatggacccgtcctgtatgcacagtgcgaagacaccacggcactccccattctccatcaggagatccaaggcaaaatactccacaaaacagctggtatcatatcgcagagactaaaagaaagaaaaaaaaagggcaagaagtgttaagccaacctttaaggttttaaggtggtatctgctcatgtgaataggtgaaagaacttgatccaaatggaccaggtaaatccaaggagatcagcaagagtgtcaatgacactgtcagagcccgagaggcattccacgcccagcagtaccaacaaggcaggtgtgctagagaacgcagcagcaacagctcctatgttggtgacacatttcctacttctacacaacccgaagaggcactccacactgtccagtggcagcatgcagctccactcggagtctggtgccagagtgaggtccgcagaccatggggtcacagcccagatgggagctactggcaacacataaccacttaattaattaaaataagtcaaaacattcagctcttcagctacacctgccacattagcaacagccccatgtggctggcagctaccaaagcggacggtcgcagacaagcagattccggcaccgcagaaagggaggcgccagacagcgctgcccgcctggacctgccgttccctcagccagcgcaagttgctctcatgagcctgggccagctccccacatgacagctcctgctccggacggagccgccgtctcctcccaccacacacttgtcgatgcactcagccacagagaagtcactggtgttctaacaacctgcacattactgatccgtccccacgcatcagaaaacaacaaagctcagaacatggattactctgaatcaatactgttcaggatattatttggtcatgccaaagttgaccctgattacccagtcactattgtcacctcaagtctttgtccagtgataacagttaatattaaaacaatccatggccgggtgtggtagctcacgcctgtaatcccagcactttgggaggccgaggtgggtggactgcctgagctcaggagttcgggagcagcctgggcaacatgggaaaccctgtctctactaaaatacaaaaaatcagcaaggcgtggcggcgtgcacctgtagtcccagctactctggaggctgaggcaggagaatcgcttgaacccgggaggcagaggttgcagtgagcagagatcgcgccactgcactccagcctgggtgagagtgagactccgtctcaaaaacaaagcaaaacaaaacaaacaaaccaaaccaatccattcaggaactcagaggtggtaaaagagccttaaaatacttcttctttgtctttttttgagacaggtctcctgttgctcaggctggagtgcagtggtatgaacatggctcactgtctcaagtgatcctcctgcctcagcctcctgagtaactgggattacaagcatgtaccaccatgctcagctactttttaaactttctgtagagacagggtctcgctatgttctccagactggtctcaagtgatcctcctgccttggcctcctaaagtgctgggattacagacgtgggccactgtgcctggcctgcttgctctgttcttacatgctgagtgtcacatatcccaagtgaaaacctggtatataagattatcaattcaacttcccaacatagaggcaacaactcacacattgccttaggggcagcttctcaaggcacacgcctgctcctgtcacatccacagtcgctgcatgtgccccacaccgctgttctctgttgctttttacgcaatctctggctgactcactgggcacgctaacccattccccgctgtcaccacaagccccagcactacgtgtcctgtctcaggtggacggggggcggccttaccctcccgtataaggtgtgcaatattgagtggccggtccgatcagccacacagcagcacccatgggcctgcccgccctttccaaacttgaggctgtgtccgccaaatgcacgctgataaatcttcccatcttcagttctgctaaacggcatgccataattttctacctgtgaaagataaaaacaaacaaaagccttattaacctaaaggagtcaagatattcacagctaatctacactaaacaactttaatacaaatctgcaaacccaaattaacctattttatgaaaatgtcaacacttcatcaaagagaagtttttcttattacatgtaatacatagttcatgacggacaaagacttctctgtgagctttgctaatcaccattctttcggctgccacatctgcctcaactgcttacattttttccaggactcttgtactagaaacagaccaccagagcacccagagcctcccgcccatcaccgcgaccatggcagtgggggcctgctccgtcacgtagtggatggcatcctggtcccccagccagtcggagcccttcacggtgtcatagaaatgccacctccagttgtcctcctccatgttccccagagcagcattgattccaacctggaaacaccaaccactccttacaagccacaaacaggaaccccagctttgtcttccaggcccaaatccacccgctgggggattcagagaaagccaactactcacgcggtgactcccagtgagggctgacctcagcagaggagcagccaggcctgacagattccagatcacaacccctcccagactcacccagtgattccatcccttagcctcagtctcctcatctgtgtggtggagacagagggaactccaggaagggctgactggagcagtgagtgaaaggctacctgtaatatgcttattacctaacgtatctggcacagaaaaggtactccatgaatctctccgcataattttattaacaaatcttcccaacggcatttacgggcatgtgttaaagatcagaagtgcttcctgccaagtaataaactccatactcagagtcgcactcccctgtacccctacttcctttggctgtgtgtgcccaccaccgtcttacccctcagagagtcccagaagacagcagcacagggacaaatgaaacccttgcccttttcttccccaacctaaattctgaatcctcctctttagatgatctccttttcttaaggtgttggggtggcaggggtgggtggggagggtagatggtcagagaaaacccaagtgtgactggagtctgaattaagagtgacaacaaggctcccgcccttcaaagtccccagggaagaggctccagggagagacccctgaatgggtgagctgagtaaggcacagcaagaggccaagtggctggagcacggggaggaggcaggaggctgcccaggtagaaagtgcgaggctgcgcgggacctgcacggagtgggagcacagtggggcacctttctcttacctgcgctgcaacagtgtgtgacctggtaggaaacagcttggtaacacatgctgtatcaaactctgcctcggaaaggccaaatgcagctcgcaaagccggcccctccagcgcctaccaccactgcatcaaattcatgatccactactggatactgagcagaaatctggaaaagaaaaattcacctgtcaatcacaggttccactatgccaaacatgaagactcttgtgccagtgaaagagcttgacaaagataaaaggagcaactgctgggcacacagggcctccatcctgtcctggggctgagccctgaacagtgcggggagaagtaggcacattcgcacctggagaagggactgataatcagattctatgaatggtagagggtctattccatgggatcagactgaggaccacaactctacttcagggccgtgcctatgcttatgcctgagaaggtgccaaggagcattcagtcgctattgtgagcttatgagaaaagaacttctcagcacgtttcagttttccaacagagagagaacaggcacactcaataccaaggaacccacaccggaagggccccacggtcctcttttcagtaggattttatcatctatcacagcagatactgttcattttaatttattgctttacttgacctaaatttaaatctaatttatagatacataacagatacaagtaaaaatgttaacatctatgtttatatttgtacttgcaattaagtattattacactgaaaataatttcagcatgcattggatacctatgagaaatttttcccttatgtctatgactcatatgaaaacaaactggtatagatccttacccccaagccaaaaaaatcatttataatggaacaaaaagcatgaacttacggaatctgaaactttagcagatgccctctcgttccttcaacagtgaagtgaacacctcgggttcctgtttgcaacactgttggccactggagacacagaagacacagatccagagggttagtgtcctgaaggaacaaatgctgtgggggatagtaattcaaacttccccttgcaaactgttcaccttcttatgtacccaggtgctcctgtgcatccagagagctcagctgggaccctctacttaaccctgaagggcagcccaaggggcaaggaaggactgagcccccaggtcctcctttccaccctggcttggcactctagaaaaccaggatgaagcttgtttccaaaaaggatactcactgactcagatacgagatgaaaaagacgcacttcctctgggaagtcttcacttatgctacttagtggaggaggggaaagacatccagatcgtattactgtatgtggtattttgcaaataatgaagcattttaaccggctccatcagagccctttccacattacagttccaatcgtccaggagggcttgcggtcagttcaaaaggcactggacacctgaatcaggagatctgtatcctgcaacagtaaaggctgacagcccagagggaagaggtgtcatcccttcatcacacaggaggatgtcggatgcacactctcccctgcctggttgctgctggctttttcctggccaacgtctacaacttgacatatctcgctgcttaaattttccatcttagaaacctttactcaagaaaactggttttagtgtttagtttttagtggctctgtgtgagagaggtcacactgtcccatatgctaaggttggccagccatttaggggatacgttttccattctgctggcggcattttagaagaccactgaatagtctcagaaatatcatcaagaatagttttaggggctgggcgcggtggctcatgcctgtaatcccagcattttgggaggccaaggtgggcagatcacctgaagtcaggagttcgagaccagtctggccaacatggcaaaaccccctctctactaaaaattagctggtcgtggtggcgggcacctgtaatcccagctacttgggaagctgaggcaggagaatcgcttgaacccaggaggcagaggttgcagtgagccgagactgtgccactgtactccggcctgggcgacagagcgagacaatgtctccaaaaaacaaaagaaaaaaaaaagctttaggaaattatgcactcagcaatcagaagaggggatgtgagggatgtcttcaagtatttagaaatacttgcaattcacaaattacttattatgtgggataaaaaattattcttcatttctccaatttctagtctgtttttattgacataagctaatttagttttttcttttttcagaaaatgagaaagaacgaatattcttctaccttagtataattttttacatggtaaaatcatattttaagaaagaagtctttgaaataattttaataaaaacgttcttgaaaattttgtaaagtgccccattaacataggtaatagcaccaataaaaacagtacattataccaaatgtaagtagaaacagtgagatcactaaatgtttattcgttctttctaggatgttgatgtggaatacacactgcccaccccccaccacacacacacagctggcttaaaaggggcagctactataacacaatcttgaacaaatcatcacgccatccccctggggaaaaggacactaaccctctgcatctaaatctcatctggggcagatatttgaatctggaaagcccaacttcaagtcaatgtcagtctttagataaaactcaaaactacttttgacacaaaactagtcttttgtgccaattattaattttttaggagaaactatcaaacatttcctctaagaaaaaaaatggggaacatataactaaaaggaatacttagaccttgcttaacaatacagaatttcagatgactgaatcaggaggtggagggggaaaagtaacaagtgcagagacattcatatccgaaatctagcaaagtaaggggtcctcatcgaataaaatgcacctataaatcatgagcaagaaacgaatctgcatgtacaacctacacaatcacaaaagcagccaacgaagaacccaaaaacgcacgactttctgtaggaaaagctaccttcatcaagataaaaagacttttacaaaacccaagactaaattttggttccattttgctatcttgccatctggtctgaggtgcctggggccttagtctgcagaaggaacactgggcaccatctgggttggggacaaaggcactggctctatctagcttctctccaaccacaagctaccagtgcccctaaaaagtcccactgaccatgggcttcacctcctgcttgtggacgccctcccagcagctcctaagagcccaagatgcggcgggggtctctgcttggtcagcaccaaccacagcaacacgctagaacggtttacacgctttccgatgttgacaggatggctgtatgactaatcctcacatttaattcaaagagattttcaataactatttcaaaaaggagaaaattgcacaatcacaggcataattcaaatcactattgctgaatgccttggttcctattgagatttttactctgcaatttaaaattactttgtaattaagaggtgggtggctaagttcatttaaaagaaccaaacaactaaacctatccaatttcgcttgattaaataaaatcctagaaggccgattctgaagatgcaatcgtagagggcacactcagacactcagagagcaagggctcagggaagtataaccctgaccatcatcctggactaagccgagcccggccctcgaggtactcagcgcacaggcaagcacaggtcctggagtcctcgctcggtcagtgccctgagctctccgtctgatttttaaaaactggcacagctgcttttaaacaccggcacatttttgtggcacaagggccaccaaacgggacccaaagtacaggtccttaacttccaagatcccgaagtggacatgcacagatttgcgctctctggaaaggggaactgcaagcccaagctcgggcgcgccgcgcttcccaccggacacccacccggccgagcccggccactcctcgcacccacccgggcggtttcacccgccccgccggccccacccacgggctgcgggcggccccgcaggacaaccctcacagacggcggcagaggcccggcccagccaggactccaccccggtgaccctgggcagacacgactcctccccgagtccacccgccaggcagaggcgaggggctacctcagcccgcgaggtcgccggaccccaggcccggaccaaagcggcggaggggacgcccagcaagcccgcggggtcgcgaccttcaccgggacgcggcctacctgctaaggaccgagctccccaggcccccgagtacactccgcggctccccctcgcaccggcccagggctctcccagccccttcccgatccccgggcagggggcgcggggacccggcgcccgctccgctcggacccgctggggaccgtcccgctcctaccgccgcctcgccccccgcctgccctgccccggtccgcggcagggactcaccgccttggccagcgccagcgccaggcgccgagcgcttggcaaccgcgacaggccccggacccccgacacgtctgtagtcgccgccgcgca

SEQ ID NO: 1533 - DNA, 49333 bp, Homo sapiens
attaatgaaaatgacaatttccctgttgagatcacgtgaacataaacagtgaaacaaagcccttgggggggggtaaatggatgcagagcaggcttctaaggtgcagtccccctccttcgtgtgggtgagtgatgtcacttgcaggacaggctgtttgggttcccccagtcctaggtcttctttccccagttgtctttcctttgtagctgtccttaggtttagtgttggggtcacaatttggaattcaacagagagcttctgaaggtaatgggacagaaagggaggacaggaaaggagggaggaaacattagtcttcttcatcctcactgatatcataggctgcagccttgtgcctggagagatttgctggggagcaaggtggggaagtcttgccggagaagggccatcggaaagagggggagggggagcgctcgcgagtagggctgctgctggggctctgcttcgggctgatggcctgcagcatccggcccttcccctctttcagcatatgtttctgcagaaaccgaaaggaagagtcagaaaaacaccgtggatcctacttaatcatcactgaagcatctaggactgggatagtctatgctgtactatttatttaagggttctcccctgctgtcatcacccgggaaattccccattcttcctcaataatctagtctaggattattctaatttatccaaacaccttcacagacagatccttcctgatatctaacctaggactcacttgctcaatcttttatttggttgaaaagactgctactcctcaaagacagaattcccaccttacctggggttcctgctgcagctacttgtagtggaggctgctttctttttattgttctttattctttcctttccttctatctaaaatcataccacagataaaagctgggcaaggcgacttgcttatcttgtcaccagactttaaggttgagagagagctggcaaaattatctaggagaatgtgtaacgtctttctgtaaaggtttcaaaaaccttgctggggacagttgaaagatagttctgcccagataaggggatagactagataacttctcagtgtcgatgccccttcctgctcaatgattctgtcattctttccacaacatggaactccctacattgtccagtgggaaagaacataccagtgctccttccggaccaaacatttccagaaaacttccaatgaattctcgggacttctcctcccacttctgaatgaggtcaatgcttttttcctccaccttctgaacaaattcttttgacttttcctccacatctttcactttcttctttactttgtcaaccctctcctgcaagtggtatttcttctcctagataaagaaataactcttctgagaaataatgctcatcctaaacttctctaccataagagaacgaaaaaacatggctcaagcactcaattgacactgttttcagtctagaattttgctttgctttaatctaccccactctcagcataataacagataagatatgctgtggatgcacacacaagaagtggtaattctaatattgtgggcatttgggaataaactaaaaatataggctatacccagtaacaggcacgtagccaaataaagtcagagttttaaagataaaacataaacttggaacataaacatgcgcagcatggcccgaacctcattccagacggagatacagaggcagctaaaagatcactgcacaatactgccaagaataaactaattacaatagattgaaagagaaaatactagatcttttacttaattaatctgcttattgtactggatttttcccctctatcactggcttattctattattttaaatgaattgtgttttttgctttttgttcctttagtattttaaggtccatttactcatttgcaaaatgatgatactcgttggtcttaccaactttgctaaagataaggaaaatggtataaaccctccggtggaagggaagggagtatttagtcaaatgagaagtatccttggccaggcacagtggctcatgcctgtaataccagcactttgggaagccgaagtgggaggactgcttgaggccaggaactcgagagcagcctggacaacatagcaagacctcatctctactaaaaataaaaatataaaaaataagctgggtatggtggcctgtgcctgtagtcccagctactcaggaggctgagatgggaggagcacttgagcccggaggtcaaggctgcagtaagccaagattgcgccactgtactctggcctggatgactgagtgtgactctatctcaaaaaaagaaaaagaaaagtactctcaaaatttccagatcataaagagaaaagggattatgtttagaatttttaaacacctgatttttatgggaaaaataaagctatagtaagtaaattaacaagagctagggtttatctgcctagataaatcatatttagatgtaatcattttatccattcttatagcacaatttacagagatgggagtaggtcagggagcatggtaaactggttatgtagaagacattaaagttagcagctttcttctttttaaatcgattttattgaggtctaatttacatacaaaatgtatagtgttggctggatacggtggctcatgcctgtaatcccagcactttgcgaggccaagggggtccgatcgcttgaggccaggagtttgagaccagcctggcaaacatggcaaaaccccatctctgctaaaaaaaaaaaaaaaaaaaaaaaaaaaaaaaattagccaggcctggtggcacatgcctgtaatcacagctattcaggaggctaaggcaccaggagacagaggctgcagtgagccgagatcacgccactgcactccagcctcggtgacagagcgagaccctgtctcaaaaagaaagaaacactacatatatatatatttgcatgaatttttttagtttttttgtttgtctgtttgtttagagatggggtctcgctatgttgcccccagactggtctcaaactcctggcctcaagcagtcctcccgcctcagcctcccaaagtacaggcatgaactaccatgcccagaaaaatatatagagtttctaaaaggcaatattaagctaagataaacttaactttcgtcaatccaaatttaaaactcaggtctgtgtgggaagtggtgtgtcgggtgtcactatccacacgaggagggctcatagcctttcgcaggttcccaagacatcatccaaccgaagaagagagaggaagtttaagagacaccgttttccatttattgacagaaatactgcactatataaattactcatttatttagttggctgtatggctttatacgaatgtgttggtaccagaccgtaacggcagaaactgtctgtttcattctttttgtgaacagttaacatagtggtaattcattcactgaacttttgggagtgatcatcaaagccaactgcaaagccagttcagctgagatggagtgggaggtgatatgtctcctacagagtcagggaactctggggtaaggctggaactcacgttgataaagctgacattgagctcctttgctgtgtagcccctctgcaggttccgcctcgcatacacatcataatcccgcacaattcgggtgatgatgtctgatgtggagataccttctgtcctctgtgttggagcaaacatgcctaactcagaaacacatacagacaaacactgtgaggttctggttagctcaggtattaagactaaatggaaattgggggcaacattcctttcctttcctcaaaaagcagaatctgttattactaaatgaaactgaaagatactgatatacagaaggtagaccgaatcaaaggccagaggtaaggcaaagaagagttacatagccctaatattaagaaaaatatgagaaagggtttcctgaaattaagagagatatccaaagtagatgtttagaccaagaattgatggatgtcatgaactgacgacaaagaattgatgggtgctatgctcatctttaccttttatccaaaatgtggcctgaaagaggatgttgaatttctaatgtacacattttcctctgtaaagcagcaacatggctgaacatctgcagctgccctgagatcccctacagtgaggaagcacagctcactcacctgcctccttgatgtgcttataaacatcatcactgccagcagatgaataaggaatatcatcatgggctacaaaatcaatctgaaaataaggaaacatcattaaaacccatgataactgccattcagaaagacccagtcaatgttctcaggcccagaaaaaggacaataggcagaggccaggcctcagtggacttcatatctctctttgctttgctcataaattctacaatctattcacaaaccacccaacctaatgatttatggagtatacatatgaagttagccagctgcttttgtagctatttctcctagtctgctagaactgttaccctcactctgtataccagtcatcttgctgtggtcaatagggccagagggtttgctggtgaaccggttagtgggtggagcctaggaaagaaggaaatctccctgtcctgggtctggaaggatttggtcaaataagggtttctaaaagtatgagaaaggccaggcacggtggctcatgcctgtaatcccagcactttgggaggccaaggcgggcagatcacgaggtcaggagttcaagactaacgtggctaacatggtgaaaccccgtctctactaaaaatacaaaaaaattagccaggcatggtggcgggcgcttgtagtcccagctacttgggaggctgaggcaggagaattgcttgaacccaggaggcagaggctacagtgagccaaaatcgcaccactgcactccagcctgggtgacaaagcaagactctgtctcaaaaaaaaaaaaagtatgagaaagaggttacttctttcttaactagtttctctcagtccgtgagaaaagagggaatataaaaatagcaaccacgagccctctgactggaatagatacatctattggcctgagaaatacaaaccgaaggccataagagaagttttctccctctcccctctcccttctcccctctcccctctccctctccccacggtctccctctccctctctttctatggtctccctctgatgccgagcggaagctggactgtactgccgccatctctgctcactgcaacctccctgcctgattctcctgcctcagcctgcccagtgcctgccattgcaggcgcacgccgccacgcctgactggttttcgtatttttttggtggagacagggttttgctgtgttggccgggctggtctccagctcctaaccgcgagtgatccgccagcctcggcctcccgaggtgccgggattgcagacggagtctcgttcactcagtgctcaatgctgcccaggctggagtgcagtggcgtgatctcggctcgctacaacctccacctcccagccgcctgccttggcctcccaaagtgctgagactgcagcctctgcccggccgccaccccgtctgggaagtgaggagcgtctctgcctggccgcccatcgtctgggatgtgaggagcccctctgcccggccgcccagtctgggaagtgaggagcgcctcttcccggccgcccatcgtctgagatgtggggagcgcctctgccccgccgccccatctgggatgtgaggagcgcctctgccaggccacgaccccgtctgggaactgaggagtgtctctgcccgaccgccacccagtcttggaggtgaggagcgcctctgcccggccacgaccccgtctgggatgtgaggagcgtctctgcctggccgcccatcgtctgggatgtgaggagcccctctgcccggctgcccagtctgggaagtgaggagcgcctcctccccgccgccatcccgtctaggaagtgaggagcgtctctgcccggccgcccatcgtctgagatgtggggagcgccactgccccgccgccccgtttgggatgtgaggagctcctctgcccggccgcgacccggtctgggaagtgaggagcgtctccgcccggcagccaccccgtccgggaggtgaggggcgcctctgcccggccgcccctactgggaggtgaggagcccctctgcccggccaccaccccgtctgggaggtgtacccaacagctcattgagaacgggccatgatgacgatggcggttttgtcgaatagaaaagggggaaatgtggggaaaagatagaaaaatcagattgttgctgtgtctgtgtagaaagaagtagacatgggagactcaattttgttctgtactaagaaaaattcttctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccactccctaatctcaagtacccagggacacaaacactgcagaaggccgcagggccctctgcctaggaaaaccagagacctttgttcacttgtttatctgctgaccttccgtccactattgtcctatgaccctgccaaatccccctctgcgagaaacacccaagaatgatcaataaaaatacataaataaataaaagaagttttatcctcaggatctatcatttcactacttttttttttttttttgagaccgagtctcgctctgtcgcccaggctggagtgtagtggcacagtctcggctcactgaaacctctgcctcctggattcaagcgattctcctgcctcagcctcccgagtagctgggactacaggcgcatgtcaccccgcctggttaatctttgcatttttagtagacagggtttcaccgtgttggccaggctggtcacgaactcctgacctcaagtgatccacctgacttggcctcccaaagtgctgggattacaggcgtgagccacagcgcctggccattttactgctatgaatatcctttgcaagggcaagaagagatgaatgatactggggatcaataatgttgttcggaggcgtgctaaacttcacttactccttcctgtatgggccaccagccttttgctgataattactaagatcactataccatccccgagagaccactgtagtgtgaagcatgttcattgggactatgtcagagactctcagccagcatctcaattactcatgaacaacttgtcagggatccataggcagcaaagtaaagaataggaggccgggtggatcacctgaggtcaggagttcaagaccagcctggccaaaacggcgaaacactgcctctactaaaaatacaagaaattagccgggcatggtggcgcgcacctgtaatcccagctactcgggaggctgaggcaggcgaatcacttgaacccgggaggcggaggttgcggtgatccgagatcacgccattgcactccagcctgggcaacagagcaaaactctgtctcaaaaaaaaaaaaaaaaagaatgggacaagcaaaactcaaggttgagtatatattgttaacaaagagaaaaggggagttagaaattcctctaacttcatacttctgtctgggcctgtgggctgtggtgctgagaataaacttgcttaccacctttggtgccactggctgctaggtgttgatgtagaaaagccagagaattataaaaggtctgtcctaatcctcaatagttttaataaatatcccctcttcaggcctacccacgtattgctttagaagcactttggctgccttcattctttctgcctcactgaacaatttacctacaacattccacgcgcccctgtagagaactgacaacatgcttgctatttcctcaggcttgggggcctctaacctggcctaatcaatccttctcatcttttgtacccaccttttgcaggaaacctgtggcttttttttttttaaagtagagacagggtctcggtatgttgcccaggctggtcttgagctcctgggctcaagcgatcctcccaccttggcctcccaaagtgcttggattacaggcgtgagccactgcacctggctgaaatctgttactttaatgtgggagaattaaaaggaggtaaggggttgataataacttactgagaaacagtgagaaatatccttgatttctgattccacccaatttctagcataagatcaaagccctgaaatgaaacttaagccaagaaaagtctatgttaatccgtcttatttcctggtaatgtgaccgtcttcagagttcacctggggctatggatattctcaggagactggcatgttctaagggtagatgtgcctatggtgtggggggaaggtctcgtaactggtgagttcagttcccagccctgccagtggtgtaacttgtggcgagttcagttcccagccctgccagtggtgtaatttgtggcgagttcagttcccagccctgccagtggtgtaacttgtggcgagttcagttcccagccctgccagtggtgtaacttgtggcgagttcagttcccagccctgccagtggtgtaacttgtggcgagttcagttcccagccctgccaatggtgtaacttggagcaggttatttggtttctctagcccttgttactcatatgtaaagcggaaatgacaaacacaccacaggattgctgtgggcagaaaatggaatagaatggatgtaaaagtgcttgcaaaccatccagccccatataaacgtcaggggtgactgttatcactagtaatatcactgtcatctcctacgaaacttacataagaggtagaagtaaaacacggctagtggaaaaccagcctacgtgccagcagctttgagagttgaggggattctgaaacaaggaatgggaatatgtgtccagtttcttacccggtgttcggccaggaactcgggtgtcagcgtccagggcgcattcctcaccacctcatccacgtagcggcagtgctggactgcgtcatagcgctcattctcgttcatcaccgtgaagcctttgaagttgtgtgtgagctcatcactgcaaactggttcaccacatcataaattgtgtgttggagtcctctttgcttagcacctcctcagccaccgacctctcccatcttctcccactgcttaggactgcaaccatcttccccaactggaaaaaagtcttctaaaggtggttgaacctgggtgataacgcttttcctaatgcagcgtataccttcaggagcaacactcactaaacagtatgttcatactttggagaagggacagtacaacaggtgaccaagatctttgactctgaaataaacctgctgtgcgtgtctgcatcaattaagtccttaaacatgttttcctgttttattcacactggactggaccacctaacatttccttggcagacttttgtactccagttaattcaaaatgataaactgaaatctaaagcaaatgttttaaagtggacaacggaagtcacggctgctcctgtgaccacagaaactcagctacaagcagtgaataaatgccagatggcacagtcgaggagcttgaagctcctctctccaggtttagtttgctggtacccatatacttcatgtgtgttagagaggctgtactacatccttcatttaaaaatggaaacaagagccagtgtactcagctgagaaagacagactgtactatcatctttttctgcacagcacctgaagtcaccaaatgttttcttacctcccacaatgaggtacgtattagggaaaaggttcttcgcttgcatcagagctcgggcgtgaccagagtgaaataagtcaaatattccatcggcataaactctcacaggtcgctcacctaaatccaaatgaaagaattgatcacaaaaatacctttttttttgtcatttttatttttatttttgaggccgagtctcactctgtcacccaggctggagtgcagtggcgtgatctcggctcactgcaacttccgcctcctgggttcaagtgattctcctgcctcagcctcccaagcagctgggattacaggtgcatgtcatcacgcctgcctaatttttgtgtttttagtagagatggggtttttccttgttggccaggctggtctcgaattcctggtctcaaatgacccgccagcctcagcctcccaaagtgctgggattacaggtgtgaaccaccatgccaagccacaaaaatacattgattcgatatcttgtacttggcaaatggaactggctctgtgtgacagttccatgactgtatactcctttctttttttttatttttttcttgagacggaatctcgctccatcacccagactggagtgcagtggcacgatctcggctcactacaacctgcaactcccggattcaagcgactctcctgcctccgcctcctgagtagctggaactacaggcgcccaccaccaagcccagctaattttttgtattattttttagtagagatggggtttcacagtgttagacaggatggtctcgatctcctgacctcgtgatccacccgcctaagcctcccaaagtgctgggattacaggtgtgagcaaccgcgcccggcccaactgcatactcctttctttaggtgttctctgggtattcaccctgattttaggggtaggttgggttatgaaaaatgactataaagaccttttcattttttttttgagacagggtctcactctgtcatccagcctggagtgcactgatgtggtcacagctcacggcagccttgacctcctgggctcaagtgatcctcccatctcagcctcccaagtagatgggaccacagatggacaccaccatgcccagctaattttttttttttttttttgtagagaccatgttgcccaggctggtctcgaactcctggactcaagcaatcccaccttggcctcccaaaatgctgggattccaggtgtgagccaccatgctcagcctataaagagatttttgacatcatcatctgcactaactgcctctgttagcctggttgtaccaaacttttcaggcacaacaaataacagagaactgtcaacttagaagccaggaaatgatttcccggggaacaagactaattccaaagtgaaataaacattaaaaacagaatcagcataatggtccatcatgctttaaataataaatctaaggagtccatgtaacttattccctttctgtgaataaaggaagagctattttactgcagcagaaactgacaggagcatttacatcatttgggaaagataggtcaaagtgtcatcagatacactatgctgaggttgaggatcagatacaccatgccgaggctgaggaccagatacactatgctgaggctgaggaccagatacactatgctgaggctgaggaccagatacactatgctgaggctgaggaccagatacactatgctgaggctgaggaccagatacactatactgaggctgaggaccagatacaccatgctgaggttgagtaccacatacactatgctgaggatcaggtacaccatgccgaggctgaggaccagatacaccatgccgaggctgaggaccagatacaccatgccgaggctgaggaccagatacaccatgccgaggctgaggaccaggtacaccatgccgaggctgaggaccaggtacaccatgccgaggctgaggaccaggtacaccatgccgaggctgaggaccaggtacaccatgccgaggcagaggaccaggtacaccatgccgaggctgaggaccaggtacaccatgccgaggctgaggaccagatacaccatgccgaggcgaggaccagatacactatgctgaggctgaggatcagatacactatgctgaggatcagatacactatgctgaggctgaggatcagatacactatgctgaggctgaggaccagatacactatgctgaggctgaggatcagatacactatgctgaggatcagatacactatgctgaggctgaggatcagatacactatgctgaggctgaggaccagatacactatgctgaggaccagatacactatgctgaggctgaggatcagatacactatgctgaggttgaggaccagatacactatgctgaggctgaggatcagatacactatgctgaggaccagatacactatgctgaggctgaggatcagatacactatgttgaggttgaggatcagatacaccatgctgaggttgaggatcagatacactatgctgaggctgaggatcagatacactatgctgaggctgaggatcagatatattatgccgaggttgaggaccagatacactatgctgaggatcagatacactatgctgaggttgaggaccagatacactatgctgaggatcagatacaccatgctgaggttgaggatcagatacactatgctgaggctgaggaccagatacaccatgctgaggctgaggaccagatacactatgctgaggatcagatacactatgctgaggttgaggaccagataccctatgctgaggctgaggaccagatacaccatgctgaggctgaggaccagatacaccatgctgaggctgaggaccagatacaccatgctgaggctgaggaccagatacaccatgctgaggctgaggatcagatacaccatgctgaggctgaggaccagatacaccatgctgaggctgaggatcacatacaccatgctgaggctgaggaccagatacaccatgctgaggctgaggaccagatacaccatgctgaggctgaggaccagatacaccatgctgaggttgaggaccagatacaccatgctgaggttgaggatcagatacactatgctgaggctgaggaccagatacactatgctgaggctgaggatcagatacaccatgctgaggttgaggatcagatacatctccttcctgtcttcagggcaatgaatgaaggagaaggaaagtagttctcaggaggtttatgaatttttgttttcaaaaagctttactcataaataagtagattttaaaccaagaaatcatacactgctgaaaggagtatcagcaactttcaagaagggcaattaggtcgtatctatcaaaagacaaacgacaaatgcttatagctgtggcccagcttttctaattctgggaattatctcacagtaaatatagatgttattcattgcagtactgtttataatagcaacagtcaggaaacgacctacatttcaacggaagattgaatatagcataatacacccactaaaaggtgggaggatatataaacaatttacttagatattcacagaaatgggtaatattggtggcctgttatagggataccaggtggctgtgagacaggtcttgagagggagacattttactttatgccctttttgtattttatggatattaaactgtgggaatgtattgatttcacttgatttgattttttgagacagggtctggctctgtcaccctggctggagtgcagtggcatggtctcagatcactgaaacctccacctcccaggctcaaatgatcctcccgcctcagcctcccgagaagctgggactacagcgcacaccaccacgccccgctgactacagcgcaccccgccacgccccgcagactacagcgcaccccgccacgccccactggctacagtgcacaccgccacgccccactggctacagcgcacaccactacgctcagctgatttttgtattttttgtacagatggggtttcacatgttgcccaagctagttgtatttttatttatttatttatttgagatggagtcttgctctgttgcccaggctggagtgtggtgacatgatctaggctcactgcaacctctgcctcctgggttcaagtgactatcctgcctcagcctcccaagtcactgggattacaggcgaaagccaccaagccgggataatttttgtatttttatattcgtatcccatgttggccaggctggtctcaatttcctgacctcaagtgatctgcccgccttggcctcccgaagttctgggattacgggcgtgagccaccatgcccagcccaggctggttgtattgattttataatacaggaaataaaaattttaaattaaatataccaatccaatgaaaaactaagaattaattaatggatttaagagtcagaaaggtcatagctcaagctttgaccaagctttccaaccagctttcttcctctgtaaccttaacttccttatgcctcagttttctcatctatgagagaaagcaggctgggtacagtagctcacacctgtaattccagcaccttgggagaccaaggtaggaggactgcttgagcccaggagtctgagaccagcctgggcaacacagtgaaaccctatctctattaaaattattttttactgccagcatgtgtcaactaaaaaaaaagaagaaaaaaatatttttaaaaagataatttttaataagacaaagcaaaataaaacaaaatttgagcatataatcccccttctatgtcccagaaatcactgcattggctctatgcctattaaaaaataatacattaaaaagatttttgggccgggcacagtggctcacgcctgtaatcccagcactttgggaggccaaggcaggtggatcacctgaggtcagcagttgaggccagcctggccaacatggtgaaaccctgtgtctactaaaaatacaaaaattagctgggtatggtggtgggcgcctgtaatcccagctactcgggaggctgaggcaggagaatctcttgaacccaggaggcagaggttgcagtgagctgagatcgcgccactgcactccagcctgcgagacagagcaagactctgtctcaaaaaaaaaaaaaattgaagtatcccagaagtcacgtccatgaagtaactaacatagttccattttccctaaacaagtccagaggggctatgatctcacactattcgatcctgaaacacaagggatagaatatacaaatgaagactactttgttgtttctttgctactagacagcatacagcagggaaattttgctcaagaaacacattgcctggatggtggcaatagcacagaatgctgttgatcaagtggctgcttgcagcacagctaatcatcctatgttaggccaagtagatcactgaaccttttctcagaccaatcccagatgcgcctcttgctctctccagtgcttccccagcctaccaacatctcaactggccaccattccatcccaagtctttggcaaacccaggctgatatattaaccaaacggccagaaggggtcactgttgaactagtctgggaagaaagctagcgttagccattcttttaccaagtggctattggccaggataaacacacccctgatttaatgtatgttatagtatatataatcatatttatataaattatatacttttaatataatttttcctgtttctattatataatgtactatataatacatatttaatatcatttatatattatgcatatattacatatgtatatatgttatatagatagatagatagattttttttttttgagacggagtctcactctgtcgcccaggctagagtgcagtgacgtgacctaggctcactgcaacctctgcctcccaggctcaagtgattctcctgtctcagcctcctgaatagctgggattacaggtgtgtgccaccacgcctggctaattttttatatttttagtagagacggggtttcaccatgttagccaggatggtctcgatctcctgaccttatgatccacccacctcagctttccaaagtgctgggattacaggtgtgagtcactgtacctggcctatatatatatttttttaatttttatttatgtatttatttattttttaagatagggtctctgtcacccaggctgaagtgcagtggtgcaatcatgacttgccgtggtctagacctcctgggctcaaacaatcctctcacctcagcctcctgagtggctgggactatagatgcacaccaccacacctggctaattattaaaatttttgtagagatgggatctcactgtattgcccaggctggccttgaattcctagcctcaagcaatccttctgccttggcctcccaaagtgctgggattataggcatgagccaccacactcaacctctgtatattattaacagcaactccctttcatgctcaaaaccgtcctgatttggatgataaattatatggtttatgtgggttatgaattatacgctgcaccactggtgactaagtaaccatatgtcctcctttaggcagaagaaacctgggtttcagttaatgatctcttttgatagatttactctcccaaatacctaccaccgaaacattctgttcctaacatttccattgcccttcacactctcccttttccttcctttctctgagttaaacatattgctgatttttttcatctcccaaaagattcctagagctgaccttcttgtctctcaaatcatatttgtttttctctaagtagagaatcttctcctagattatacaacctccctcgtaaaaacctggggagcaggagggaggtgttgaaacttcactagagcaggtgcattctttattgctttattccttgtcctgcactggcatgaatgcagttacctacttggtgatttaacataaaacagtcagacaaaatgagatctaagagaaaaaccagagttcaaattaagctggcaaatttataggctaatttgtggctgtttgttccaccaaaaatacaattattttgctgaaggccttctattctaatgcttacaatgagtagcaccattcccgggtgaggtttgagctgcaattctattccactaatcatccgttttactgtaggggaagccttcgcttcttggttactatggaccttaattgctttatgtacttaatgaagaaactataaagtagataatcttgaaaatgacttatttgtaaaatcctataattctaaaattaaaaacaattataccagtcaggacttgttaattataagctttaaaacttggaaacaggcccggcacggtggctcactcctgtaatcccagctacttgggaggctgagatttgagaactgcttgaacccagaagggaaatgttgcagtgagctgagatcacaccaccgcactccagcctggttgacaagcgagactctgtctcaaaaacaaaacaaaacaaaagatcaacttggaaacagtacacatattttcaaattttatgtaccacaaatgatatatagacaaattagcaacaaactggataatgcaacccatcagatcaaatctaaatgaatagctgattgtaaatgtgtgtcattagagagtatgtaaaaagttcttgctttcaatagcctctactatcacatctgaatgtgaaccctgaactatcttctggcgttttgaagttagacctggctaccattacacaatccatagtctctggttttctttgtcattttaccctgcctccaggagcctacctattacccaaataagggaagccaaactcaaaaatcttatcatgaatcagaaggttgtgatcaatatgaactatatctacacattttttcaaaaggaaaggattctctggaattagcctcttttttgttgaggaccccaaacccacaatacatatacccaagataaggccaaaggataggtgttaaaattcccggcattggccggcgcggtggctcacgcctgcaatcccagcactttgggaggctgaggtgggtggatcacgaggtcaggagttcgaggccagcctggccaacatggtgaaaccccgtctctactaaaaatacaaaaattagccaggcgtggtggtgcacacctgtaatcccagctactcgggaggctggggcagaagaattgcttgaacccgggaggaggaggttgcactgagccaagattgtgccactgcatgccagcctgggcaacagagtgagactctgcctcaaaagaaaaaaaaatttcccagtatgacactgtacatcacttctatttgttttttgtttgtttgttttgagacagggtctcgctctgtcacccaggctggagtacagtggcatgatctcagctcactgcaatctctgcctcccaggttcacataattctcgtgccttagcctcccgagtagctgggactacaggtgcccaccaccacgcccagctaacttttgtatttttagtagagaaggggtttcaccatgttaaccaggctggtctcgaactcctgacatcaagtgatgatctgcccgccttggtgtccaaagtgctgggattacaggtgtgagccaccactcctggcccacttctatttgtatttcactgttcttcagttactacagagagcaaacataccaacacaattaagaagtaaccacaaatatactgtatatgctgcaaatgcacagatttgtggctataaatccctcttattccctggtgtctgtctgagtcttagttcagtcctatatttacagggtagagagaacacttagtaatcagaagaagtgaaaaaggattggaaaaaaagggagaattggggaatttacagagaagaaagaatatttgcctataggactttgtattcataacaaatgctcttggaagtttctttttataatgatctctaaaaccaattgccccacataagaaaagcatctcgaatatatattagtaatttatgtgtcaaaaactgctaattaattatgtaaattaagcatgcaaataaagagcaagggctttgaaaataaagtattttttaaaacctggaaaattataatatcagtaaaaataaaattaagtgacgagcatctcccaacttgggatatttttgtcctctatcaatcggcagcatcatagccagctgacagaacgtagagaggtggtggggaattctgaaggctatgaagaatgtgacaccctgacacatgatttggactttatagaaatagataagatcataactcagctcaagctaatataatatcatattgtttctgttttactgtatctcacagctacaacagcagcccaggaaacaggtgcataataataagaaaaaaaatgaaagtttatggagtggagttacccttctaaatagaacatcaagacaggtgagaagaaccccttcgctgctggcctttgcaagtaaacagagggcagtatatagagagcaggtgtgtatttgataaagacaatggaatgctaaaaacaatagtcaaacaacaaattaagaaggtatttacttacaaggagttcctctgctggcttcttccatagttaccctgacatagggcttactaaagtcaacttcaatttcatcagaaaaaggagctggttgccgtaagcccttaagaaatggaaagtgaaggaaaagaaagttcaactcaatggcatacactgtaatactaaaaaaaaaaaagatgagagaaaggagattgatctctctattatagatggcttcgtttaagagatttcgttattcccgcctgtaatcccagcactttgggaggccgaggtgggtggatcatgaggtcaggagattgagacaatcctggctaacatggtgaaaccaggtctctactaaagatacagaaaattagcctggtgtggtggcaggcacctgtaatcccagctactcaggaggctgaggcaggagaatcgcttgaacccgggaggcagaggttgcagtgagccaagatcagaccattgcactccagcctagcccacagggcaagactccacctcaaaaaaaaaaaaaaaagagtttttgttattcctatgtattttattctacttgatgctgttgtgaatggaattgttttctgaattttatttttggattgttccttgatattatgtaacagtgcaattgatttgtatttgtgtttgtgtaactgaaattttctgtatattgatcttatgtcctataactttgctaaagttaattatcagttctagtatccgttgttgtttcatggattccttagcattttctacatataatatcatgtcatctgtgaatatagttttgcttattcttttccaatctggatttttttttttttttgagagggtccagctctgttgcccaggctggagtgcactggcgccatttcagctcactgcaacctccaactccccgactcaagtgatcctcccacctcagcctcccgagtagctgggactacaggcatacactacccgacacccagctgattttttattcttgtagagacaaggtctcactacgtgcctaggctggtctcaaactcctggcctcaagcaatcattccaccttggcctcccaaagtgctgggattacaggcgtgagccaccgtgcccagcctctggcctgggatttttaactatagtttgtttcttgtgatgtttatgtctggctttgatatctggcctcacaaaataagttgtgaagtgttctctttaccttatttttgtgtaagattcgtattatttattccttaaatgtttttgtggtttttgtaaagacactctgtcaccgaggctagagtgcagcggcacgatcatagctctctgcagcctccaactctggggctcaagcaattctctcacctcagcttccctaatagctgggactacaggcatgcaccaccacacccagctaattttttaactttgggcctggacctgtctttgtgagaagatttttaatgactaattccttttttttcttttttaacttgatataagtctattaagattttctcctttgtcttggttagtttttgcaacttgtctctttctaggaaattgtctattacatttaaattgtcaaatttttggcatgaaattgctcccttataatccttctaatttctgtatggctgcagtgatgttccgttctaaaaagatcgtatcatgattgggctgaatccagagactgggaagatactgttttgttttcaggtaagtgtagattttcaaaattgttttaacattaaaacacgttttttttgtttgtttgtttgttttgttttgttttggccaggtgcagtagctcatgcctgtaatcccagcactttgggaggcccaggctggtggattgcttgagcccaggagttcaagaccagcctgggcaacatgacgaaaccctgtctctacaaaaaaatacaaacattagctgggcgtggtgacacatgcctgtagtcccagttacttgggaagctgaggtgggaggactgcttgagccagggaggcaggggttacagtgagctgagattgccccactgcactccagcctgggcaacagagcaagaccctgtctcaaaaaaaaaaaaatcacttatataagtttagtttaagatatacttaatgatataaatggaaacattctttttttttttttttttttttttttttttgaggcaaagtcttgctctgtcgcccaggctggagtgcagtggtgtgaactcagctcactgcaacctccacctctcaggttcaagcgattctcatgcctcagcctcccaactagctgggattgcaggcatgcaccaccacacctggctgatttttggatttttagtagagacagggtttcaccatgtcggccaggctggtcttgaactcctggcctcaagtgatccacccgcttcggcctcctaaagtgctggaattacaggcttgagccaccatgcccagccaagacattcatttttagatgtgtatgtgttattcttctttgaaatacttttaaaaatagaaccaaggacctagatattaatcaaaaacacaaggaaatactacttcatatcaaccaggatggctatgagcaaaaagacaggcaataacaaacagtcttggtaaggatgtgaagaagttagaaccatcatacattgctactgtgaatataaaataatgtgcagctttggaaaacagttcttcaaaatgttaaacatagaattaccatatgacccagaaattatactgctaggtatatacccaagataactgaaaacatatattaagaaaaaaacaactatgtcaggcacggtaactcacgcctgtaatcccagcactttgggaggccgaggcgggtagaccacctaggtcgggagttcgagaccagcctggccagcatggtaaaatcccatctctactaaaaatacaaaacttagccaggtggcgtggtgcatgcctgcaatcccagctacttgggaggctgaggcagaagaatcacttgaacccaggaggtggaggttgcagtgagctgagattgtgctaccgtactcgtctgggagatagagaaagactctgcctcaaaaaaacaaaacaaaacaaaaacaaaaacaaaaaacttatacatgaaaaatgttcacacttgcattactcgtaatagccaaaaagtagaaacaacccaaatgtccatcaatgaatggataaacaaatggtatgtccacacaatggaatattatttacccataaaaaggaataaagtactgatacatgctaccacttggatggatcttgaaaacattatgccaaaaaaggaagtcggacacaaaagtccacaagttgtatgatttcatttacattagatgttcagactaggcaaagctgtagagacagaaagcagattagtggttgccaggaggtagctggaggggtaatagggagtgactgctaatgaatacagggggtttctttttgtggtgatgaaatgttctggaattagatggttgtgatggttgtacaacagtatgactagactataaactactgacttatatactttaaaatggttaaaatagtgaattttatgttatgtgaattttacccaaattttaaaagatacattggccaggtgtggtggctcacacctgtaatcccagcactgggaggccgaggcaggcagatcatgaggtcaggagttcgagaccatcctgactaacacggtgaaaccccgtcactactaaaaatacaaaaattagccaggcgcagtggtgggcgcctgtaataccagcactttgggaggccgaggcgggtagaccaccttaggtcgggagttcgagaccagcctggccagcatggtaaaatcccatctctactaaaaatacaaaacttagccaggtggggtggtgcatgcctgcaatcccagctactcgggaggctgaggcaggagaattgcttgaactcgggatgcggaggttgcagtgagccgagatcacgccactgcactccagcctgggcagtggagcaaaactccatctcaaaaaaaaaaaaaaagagatattttaagtatcttatctttcacaactgtttcttcagtctttctcacatactgtgtatatttccaggtagaagacaaatacagctgtccttcctggctggggtttaggctgaatccgtttctcctaagtatagggagtgaaacctaacgttgtgcagctataacaaagcagcaaaatctttttttctagagttgtttccagctagaaaaggtagtatttttttaaaacactgtgttattctcaaagaacagtgtctctagaagctgaggtttataaaagtaggactaaatatttctgtgttctcctaaaacacatctccttcattttaacctcaagggaatgccacagtatcgctttcaagtcttaagactatctggtagtgaggtataaatgaaagaacatggggttaggacttggaaaatttagatctaaatcccaactctatcatttaatacctgtgaaatcacagcaagtttctaaagctttcatttcatcttctacaaaatagaaaacaacaatacctgccctacaagtttactatgaggattaaacaaagtagcatccgcaaagtaattagcataatgtttcacaaaagtaggcactcgacgaatttgtcgttagctcatttcctcttgtattctatagaacacagatttcagcatgctaacaaaattaactcctattaatctaagaggttagcttctaaaatgctatataaactttccaaatgcatgcatctaaaagttataatggaaatcaacagtccccaaattatgaattgtctctgaatgcaatattgcttccataacaactttttccagactatattcacacacattatttcactattccttaaaatttcagtgaaaacaagagattctggcatccacactaacaggaaaatggacataattcaaataatatagactagaacttgatattgtcttcccagtacactttttactttctaaggattctttttttttttttttggcttttttttgtgagacagtctcaccctgtcgcccaggctagagtgcagtggcgcgatctcagctcactgcaacctctgccgcccaggatcaagcgattctcctgcctcagcctcccgagtagctgggattacaggcacccaccactgcgcctgcttaatttttttagttttagtagagacagggtttcgcgatgttggccaggctggttttgaactcccgacctcatgatccacccgcctcggcctcccaaagtgctgggattacaggcgtgagccaccgcatccaactctaaggattcttaaatatttttcagcaaaaagtttctgaatgccacagaaaaacatttatttccctttcacccaaacattctgtattaatgataaagggtcctcccgagatcccaattgtttctattttttttattttttaagagacagggtctcactgttgcccaggttggaatgcagcagtgcgatccatacctcactataaccttgacttcctaagctcaagagatcctcctgcctcatcttcctgagcagctaggaccacaggggcacatcaccatatccagttaatttttccattttttttgtagggacagtgtctctctataatgcattgcccaggctggtctcaaattcctggcctcaagggatccttccacctcccaaggcgcttggattttaggcatgagccactgtgcttggcccaattctttcaataatgccacgggaaacgctacagagtcaagaggaataccatgtggtatgagaaagaagggacaaagaacagagctgaaagattccaccccccggggatctgtttttttgttttgttttgttttgagacagagtcttgctctgtcgccaggctggagtacagtggcgcgatctcggctcactgcaagctccacctccagggttcaagcaattctcctgcctcagcctccggagtagctgggactacaggcacccaccaccacgcccggctaatttttgtgacttttagtagagacggggtttcaccatgttggccaggatggtctcgatcacttgacctcgtgatccaccctcctcggcctcccaaagtgttgggattacgggcatgagccactgcgcccagccaggatctggttttaaaaatgaaagaaaagcaatcattctccctgactcctattgccatttcagtgaatgtaaacaatgagctcatctgtccaattactatttggatgtcttataggccctctaaattgaacctgtactaagttaaactctttgtcttcctcctaaacctgcttttcctcctggtatttcttatctcaatgggaagtaccccatctacacaacgtacctaagactgaaacctaggagtcactcttaacaccttttgtccttcatatctcagtaatctccaagaactgtccattttacatcttttttaaaaattacaattttaatttaaaatagagacagggtctccctatattgcccaggctgctctcaaactcctgggctcaagggatcctcccaccttggcctcctgaagggctgcgattacaggcgtgaagccaccatgcccagccgattttaccttctagaaatgtgcaaagtttatctcgcactctctgtacctaatgtcatagtttaagccctacttcatgattctgaacttgtaccccatctcttgttcatttcttgaattccttgtatccttcaaagttcagctcagaaataacccttttgatgacgcttttcccaaaccactgcccctacctcttggtcaaagtcagtctcttgcttctcaagattattttggttgaaatgagattgggaggcctatacttagccataagcagaactatggccatcctgacccaccaacccaggcatctaatacctggtatccttcctactccttttttctcaagagattgactttgtaacttccgtctatttggcacttttcatacgtatcataatttcatactgtatcataattatttgctgctgtttctttctcttttttgtctgtgagttttccaagggcaaggtcatcttttcatccttgcatctccaatgcaactggcaagtagaggttctcgaaacattttggttgaaatgagattgtgaggcctactttgccataagcagaactatggccaatttcccccacagtttagatacttcatgactcattcatacatatgatattctttgtaagttattttattttatttattattatttttattttatttatttatttattttttttgagacagagtctcgctttgttgcccaggctggagtgcagtggtgtgatctcagctcactgcaacctctgcctcctgggttcaagccattctcctgcctcagtctcctgagtagctgggattacaggcgcacatcaccatgcccagctaatttttttttgtatttttagtagaaacggggtttcgccatgttggccaggctggtctcaaactcctgacctcgtgatctgcccttctcggcctcccaaagtgctaagattacaggcgtgagccacttgcgcccagcctgatatatattaagataagctaaacgtcttatgttttgtaaatacttttgtgatccttttgattgaacctttagaaacatctgtatcaataaatgatttatacttatcgacaaaatagccataaagtttttcctagtttttccttcttaactcctttgtctcttttctatccatttcatcctgacccaccaacccaggtatctactacttggtgatccttcctattcctttctttacatgcaaggaaagtactttttctaaagctaatgagctccaccgggtgtggtggctcacgcctgtcatctcagcacttagggaggcagaggtgggcggatagcttgagcccagggcaacagagcaagtccccctaccctttttttttcttttttgagacggagtctcgctctgtcgcccaagctggagtgcagtggcgcgatctcagctcacttgcaaactccgcctcctgggttcacgccattctcctgcttcagcctcctgagtagctgggactacaggcgcccaccactgcgcccagctaatttttgtatttttagtagagacgaggtttcgtcatgttggccagactggtctcgaactcctgacctcaggtgatccgcccacctcagcctcccgaagtgctgggatgacaggcgtgagccactgtgcctggcctgcaagtgcccattaaaaaaaaataaataaactaatgagctctaggctatagaattctactctatgctcacatctcataaaaggaaggtcttgtttatctttacacgtctaccacctactgccatactagcgcattgtaaatatgcaataaaggccaggtgcagtagctcacgcctgtaatcccagcactttgggaggtcgaggcgggcggatcacgaggtcaagagatcgagaccatcctggctaacacggtgaaaccccgtctctactaaaaaatacaaaaaattagccaggcttggtggcgggcgcctgtagtcccagccactcgggaggctgaggcaggaaaatggcgtgaacccaggaggcggagcttgcagtgagccgagatcaggccactgcactccagcctgggcgacagagcaagactccatctcaaaaaaataaataaataaaaatgcaagaaaatcttgcttactcaacccaaatgtcaactggagaatgaataactaaaaagtagtatgtgatatatgatggaatgttatttgtcaataaaaaaaaaatgaagtactggccggacgtggtggcccacacctgtaatcccagcacttcgggaggttgaggtgggcggatcacttgaggtcagaagtttgaaaccagcctgagcaacatggtaaaaccccatctctactaaaaatacaaaaattagccaggcgtggtggcggcgcatgcctgtagtcccagttactcaggaggctaaggcaggagaatcacttgaacctgggaggccgagatcacaccgctgcattccagcctgggcaacagagtgagactctgtctcaaaaaaaaaaattgccgggcacggtggctcacgcctataatcccagtactttgggaggccgaggcgggcggattacctgaggtcaggagatcgagaccatcctggctaacatggtgaaaccccgtctctaccaaaaataaaaattaaaaaaaatcagccggatgtggtggctggcgcctgtaatcccagctacccgggagggtgagacaggagaatcacttgaacccaggaggcggaggttgcagtgagccgagattgcgccactgcactccagcttgggcgacagagcgagactcagtctcaaaaaaaaaaaaaaaaaaaattaagtacttgtacatgttgcagtacgaatgaatcttcaaaacaagctcagtgaaagaagccagccccaaagaccacataccgtatgatgtcatttgtatgaatgtccagaacaggcaaatccacagaatcagaaagcagattagtggcttccagaggctggagagactggggggaaatggggagtgactgctaatgagtacaggccttctttctggggtgataaaaatatcccaggccaggcatggtggctcacacctgtaatcccacactgtggcaggctgaggcaggagaatcgcttgatccaggagactgagaccagtctgggtaacatagtgagaccccatccctacaaaaacaaatttaaaaattagccaagcatggtgatgtgcacctatattcccagctacttgggaggctgaggtgagaggactgtttgagcccagaaagttgaggctgcagtgaactatgatcacaccactgcactgcagcctgggtaacagaccaagaccctgtctcaaaaaaaaaaagaaaaaaattctaaaattggtcatggtgatggttgcacaactctgtgaataaactgaaaaccactgaattgtatactgtaaatgatatgtcaattataactcaataaagctgttaaaaaaagaaaaaagtcttgcttgcttttgttatagagttcaaaggagattcagagctagaaagtacaggtgtacagtgagatggcagaaagtttactagcagacattcctcctcactaaggtgggccaggctgttgggtggatctctgaccattcacctatgccaaatagtctgtgtgtttcagggaggaatgtggaataggtagcagcaagtcactgaactgatttcacatgaatatatgaagcaaagtaatttaaagcattaagactccccagaagaatttaaaaaaaaaaaagattcccagagtctaaagaccaagaaatttaagttttctcagagctcattccactgaaaagactggcttcctttgctttattcctagctacagtgattggctgattagctgacagtatcacctatttggttataacttgttcctactccaagtgatgttgctgaattggtacacaccaccatttctttaatctgaattatctaagaaatattcagaaactaacaatgccctgttttgttgattgctgagtcactttctgagcttatttgctgtagtatgcagaataatgcccccctgcagatggccacacccattccctggagcctgtgactgttttaccatacatggcaaaagagactctgcaggccaggcacagtggctcacgcctggtaatcctagcactctgggaggccgagataggaagactacttgagctcaggagttcaagaccagcctgggcaacatagcaagacccttactctaaaaataaaaataaaaataaaaatagtaagccaggcatggtggtgggcacctgcaatcccagccacttgggaggctgaggcagggaaatcacttgaacccaagaggcagacgttgcagtgaaccgggaccgcaccactgcactccagcctgggtgacaaagcgagactctgtctcaaaaatacaaataaaaataaataaaaataaaaatagtaaagaggctttgcagatatgattaaataaaggaagattattctggtttatctgggtataccgaacgtaatcacaagagtccttgtaagtgaaaaggggaagtaggaggttcagaatcagagcaggagacatggcagaagcaatcgtcagagtgatgtgagcactggctggtgccaagcactaagcaatgtgggaaccctctagaagctggaaaaggcaagaagatggactttcccctggaccctccagctctgccaacaccctgattttagccctctgagacccatttcagatttctgatatccagaactgtaagataattcatttgtatatttgtattatggtaatttgttacaaatgcaacaggaaacaaatatatatacttgcccttatgatcaatatcagccctgcaggcacttgtctatttgtagggtattatttgcttttattgctcaagacagagcattcatttggaataagtattaactgtttcagaatagatttttccctttgggctgggaagctctagaactaagcagtggaaactgagtttgatcaatggctaatagtcaatataggtaaagaaacatacaattctgtcactgggattttgaaacacagatttcataataatattaacaacagtagcttcaattgtgtgtaagtgttctctgacatgtttttattatggaaagttttaggaagggtagcaagctgagacaggataggcagtgtggaggaaagctttaggaagggtagcaagctgagatgggataggcagtgtggaatggggtctttcatctaaggtttggcaataattaggaaatacaaagataattttccagagataaaggagcataaggtaggcataaacggaaaaaggttctcatctaagatacaactagtaacaggatggaggaatgatagagggagaaaaaacagcagaaaagacgcactagacaccatgagatgatacgaagatcaaatcactgcctagagccccaatttttctatttcattagttttatttatttgtttatttactttttatttttatttttgagatagggtctgtctctgttgcccaggctggaatgcaatggtgcaatctcggctcaccgcatcctccgcctcccgagttcaagcaattctcatgcctcagcctcccaagcagctgagattacaggcatgcgccaccacgcccggctaattttgtatttttagtaaagacagggtttcaccaggctggtctcaaactcctgacctcaggtgatcctcccacctcagcctcccaaagtgtgggattacaggtatgagtcaccgcacctggccatatttcaatagtttcagcctaatacacatgcaacttccatattttcctaacacttctttttctaaacccaatgtaaagcttctacaactgagctgtgagtcataatccagtaaaaaggcagcagatttccagtgactgtgaaaatacacttactattccttcttttcattatttcagaagacatgtaacactgatatcatcaatgtcatatcggtttctaccctccccctgccaggttaatctccacttaccactgcacagcgctgcactttggaaggaaccccatcttcttctgttgccccgttgggtccgggcgcctcttttctcctcttccttgcattgaccttggctgaacactgtgcatccatcttcttttaactggtcatagaaagtgaaaacaaaaattttctcattggggtgggaaaaagtttgtcaccagtatttcagagacgttgacgtggatacactcagcaaaataccaattctacagctgcacttcaccaagatgagccaatggcatctggcaaaaccagcgaagcttcacaaaacacaggctctagtagaaatactgaaacgcctctctgtgcaacaatggccacagtgaattgcctgaagtcggaagtcattccccctcacagtgcagcctacatactaactgctcattttaaatcctgattgcatgcaaaagattggaataatttggctgagaaagatagttacacagactctcccactatcctccgcatcatcgatatgacaggtataaggcaatgtgaaggtatgactggtgcaggtagagaaaagagccttttgtaaacggatggctctcaccaagtcctggattaacaaaacacggatttcttaactctaattttttttaagacggggtctcactctgttgcccaggctggggtgcagtggtatgatcttgcctcactgcagcttcaacctcgttagctcaagcgatcctcttgccccagcctcccaagtagttgggactacaggcacatgccaccacacctagttatttttttttttaagagacaggcctcgctatgttgcccaggctggtcttgaattcctggcctcaagtgatcctcccaactcaaactcccaaagacttgggatgacaggcatgaaccacatcactgagtgaatttcttaactctaaaagttctatagatttcagtgaccacttcaccagagttacttgcatgaaaattgtggagtagcataatggtttttatttacttttttattgtttttatttttttaggggtcttgctaggttgtccaggctggagcgcagtggctactcacagccataatcatagcacactgtagcctcaaactcctgagcttaagcaatcctcccatctgagcctccagaatagctaggaccagcataatgtattttttaaatgtccttctccttctttcctttttttttttttgagaaagagtctcactgtgtcaccctggctagagtgcagtggcacgatctcggctctcacagccataatcatagcacactgtagcctcaaactcctgagcttaagcaatcctcccatctgagcctccagaatagctaggaccagcataatgtattttttaaatgtccttctccttctttccttttttttttttttgagaaagagtctcactctgtcaccctggctagagtgcagtggcacgatctcggctctcacagccataatcatagcacactgtagcctcaaactcctgagcttaagcaatcctcccatctgagcctccagaatagctaggaccagcataatgtattttttaaatgtccttctccttctttccttttttttttttttgagaaagagtctcactctgtcaccctggctagagtgcagtggcacgatctcggctctcacagccataatcatagcacactgtagcctcaaactcctgagcttaagcaatcctcccatctgagcctccagaatagctaggaccagcataatgtattttttaaatgtccttctccttctttccttttttttttttttgagaaagagtctcactccgtcaccctggctagagtgcagtggcaccatctcggctcactacaacctccgcctcccaggttcaagcgattctcctgcctcagcctcctgagtaggtgggattacaggcacccaccaccacgcctggctaattttttgtatttttagtagagacagggtttccctatgttggccaggctggtctcgaacacctgacctcgtgatccacctgcctcgtcctccaaaagtgctgaaattacaggcgtgagccatggcgcctagccaatttttgtatttttagtagagacagggttttgtcatgttggccaggctggtcttgaactcctgacctcaggtgatccacccacctcgacctcccaaagtgctggaattacaggtgtgaaccactgcacctggcccttccccttcttttctcagtactcatttccctttcctctttcagggtcttaacacctcaagcttgttcacagtttccagctattaaaaccccctcagggattctccttcccccaaaggaacttatttattattgtctcatttagcagagagtttctagcaactagctattacagcaaagttctgaatattctgtatttcatgtttaagtcacagaatacttggggtgtcacttcgctagccagaaacctctgtggccagtggcacctttgcctgagttttgctcaggcccgccgggctcgttccgtccactcagcctggtaggctatgctcagcttgtgttaccagcacagattccatgcatgccaaggacaagccaggcacggagcggcaagaggtgcacaggcgagccagcacagggtccggccactgcgcacagccaggcacgccagctgccagggggtgagcagctcgaggcgccagctccctgagaggctgcagctgaaccaggcgtactacaagcagcttccactgcaggcactggggaacatggtgctgcccagaagcttggagaggccaggaaccacagagctccaaagagggtgtcacagccctggctcaaggagctcctaggtctgggcttcccaaagggctacagctcttctctttctctctcctctcttctctctttctgttgcccacagcgtggcaagcagtgggggaggggaggacgtgtttcggctctgtttgtgtttcagctctttcagtcccaccatttggcagatcccgagttcttgtcccacgtccaggaagaatgaggtatatggacaactggaggacgagcaaggtgaagaggtgctttattgagcaacacaacagccctcaggagaccccaagcgggtagctcctttccgcagcaggtcgtcccagcatctgtgcagccctcagcggagaggagacccagagtggatagctcctatctgcaggcaggtcatcctgacgtctctgcagccctcagtggagaggagacctggagtgggaagctcctatccgcaggcaggtcatcccatcaagtatggctgagtccagggtttctacgggcttcagcgggcaggaagtgcatgctgattggtccatgggcagccacaggcagcccggaaaaagcatcgtaagttctcattccagtccacagaactggcagcctgggccccaggcttcaggccatccctggcttgaaggtggggcttcaccagggacccgcccatttccgcctaggagcctgtctgcctcctgctgtcatcaacctgctgtccacagcgcccaggctattcacgaaggggcgcctgcaggcctgaatggagctgctctcagctccgccttggcgtcccctcctgtgctgctggacacccaaaatccagagggggccaaggcagaagggggctggcatgtcagcactgcccctagcacacgcaaacccagccaggtcatgacagtgcccaggcttggcctcaactttgctccaaaatcagagcaggcaccaggagcaaggagaggccaggcagtgggagcaggcacttcaagcctgcaggggcaggggaggttcctgggcccccaaaagcacagggaagcccgggtatgtagccacggctgctcccgccctgccaacttggaaacgggcagggcttccacctactcccagctcccagtggctccatggagcgtgcagcacagaccatgcctccccgactgcagccggcatcatggcagcagcccatccagacaggccaccgctgccatcatttagatgttggcttttcagccccctgcagggatagttgcgtttttcttaagtaacacaatttgtacaaataaattactttcttgatactgatgaaattttaggaatcagccagaaattgggggtaggggaaactctatgataaactgtcatctctgcacaagatacggttcagagaaaaatcttcagaacaggtggaaaaccaatgccagacagaatgaggacagtctgctctgccctactgcctctcataagcctgactgagatgttcgtctaaacaactgcaactgtgccttactttctttcctccggctcaactccgagtggcaatatgacaagatctacaagaaactggcctaattcttagaagctgaaggtgacaccccatgagtcatggccaacatgaaaaaatgtcagagtcgaaagtgaaagatgagcaccacctagaaacttcctttcatcacaaatgcaaattaaaatggaagaagggttctatacatttcactccgagttctttcagtgatgatgatcagagcttgtcttcactattgttcttaatgattccttcataatattcagaggtcaatactctcatctcagtggtctgagtgaactactcaaaatgcctaatccatccaattaatgattgttttctaatttgcacagtactcttctgtaagtatctgctcaattcttctaagtgtagagagacaaaatccactatgagaaatataatcagcaatttggcatctggcaagtcaataatatcaggcagtcaaaaatatgagtacttactgcttacaaagtactgtatcataatttttaagtacaaactgaacctggaggacattatgctaagtgaaataagccagacgagaaagacaaataccacaaatgacctcacttatttgtggaatctaaaagagtggaactcacagaagtacagaatggaatggtggttacaagagatggacagaagagggtggagagcaaaaagggagatgtcgagtacaaaaattcagttttgaaaggagaaacaggctgggcacagtggctcacgcctgtaatctcagcctttgggaggctgaggcgggtggatcacgaggtcaagagatcgagaccatcctggccaacatggtgaaaccccatctctactaaaagtacaaaaaatagctgggtgtggtggcgcatatctgtaatcccagctactcgggaggctgaggcagaagaatcccttgaacccaggagacagaggttgcagtgagctgagatcgcaccactgcactccagcctggcaacagagtaagactctgtctcaacaaaaaagaaaaaaaaaaagaatggagaaataagctttagtgatctattgcacagaatggtgactataataaataataatgcagccaggcacggtggctcacacctgtaatcccagcactttgggacgccaaggcaggcggatcacaaggtcaggagattgagaacatcctggctaacacagtgaaaccctgtctctactaaaaatacaaaaaattagccaggcgtggtggcgggcacctgtagtcccagctgctggggaggctgaggcaggagaatggtgtgaacccgggaggcagagcttgcagtgagccgagatcgtgccactgcactccagtctgggcgccagagtgagactccgtctccaaaaaaaaaaaaaaccaaaacaaaataaataataatgcattttatatttcaaaattgctaaaagagtagattttaaatgttttcaccacaaaaaaataagtatataaggcaaggaatttgttaattagcttgatttaatcattccacatgtaaacatatatcgaagtatcacattgtatcccataaatataaacaactattatttatcaatttaaaaaattaaaggccaggcacaatggctcacgcctgcaatcccagcactttgggaggctgaggtgggcagctcacctcaggtcaggagtttgagaccagcctgtgcaacatggtgaaactccatctctacaaaaatacaaaaattagccagacttggtggtgcattcctgtaatcccagctactcaggagactgaggcgggaggatcacttgaatctgggaggcaaaggttgcagtcagccgagatcgcaccactgcactccagcctgggcaacagagtgagactccgtctcaaaaaatgaaaaaaaaaaaaaaattaagtacaaactattttctcaaggaagcttcaattaaggcatggaaaacacacacagagctccacctcaaaaatgcttatgatataaaaatgctctacaggattctaaaaccatggggtgaaagtttgctgaggaataggatatttgcagttacgaaaaattgaccaggtgtagtggcacatgcctgtagtcccagctactcgggaggccgaggtgggaggactacttgagaacagcaagtcaaggctgcactgagccatgatcatgccactacactccagcctggacagcaaagtgagaccctttctcaaaaaaaaaaaaggccacatgcagtggttcatgcctgtaatcctggcactttgagaggccaaggcaggcgaatcacctgaggtctggagttcaagaccagcctggccaacatggtgaaaccccgtttctactaaaaatataaaaattagccaggtgtggtggcgggcacctgtaatcccagctacttgggaggctgaggcaggagaattgcttaaacccaggaggcagaggttgcagtgagccaagatcatgccattgcactccagcctgggtgacaagagtgagactccatttcaaaaaaatatatatatttttttctttacctgcttacactattatgtgtttatactattccttatctgcttacatacagttcttctattttctaaagatgacttttgggttttacattatattctacactgttctttaaactgaagtctttagatccttcggatttaaaataaaacacacccactgctttttgggttttagtgtaagacacttctttatctcatccacttctcaggagatggaaaacatctgggtcacagatattccataatgataaccctaaaagaatttagaaattatgcaaagattactcctcatgactttcctctagaactactgctgtttaaacttttactctgggctgggcgcggtggctcatgcctgtaatcccagcactttgggagaccaaggtgggtggatcacatgaggtcaggagttcgcaaccagcctggccaacatggtgaaaccccatctctactaaaaatacaaaaattagctgagcgtggtggcatgcacctgtaatcccagctacttgggaggctaaggcaggaggatcacttgatccctggaggtggaggttgcagtgagcctaaatcgcacgccactgcgctccagcctgggcgacagagcgagactttgtctcaaaataataataacaataataaacttttactctgtaggtctcacaagtttttttcattttttcccggccttcttatgccatcccaatgttctctcacatctactaacttataaccgcagcaccaaagcatacagaataataactgatgtttaaaatcatggaaaaaggtacccccagtctccctcatgttccaatagatgcttgcccggacacatcacctttgctactgagaaagtgtagagaaaaggtgtgtgggaggatgagggcgtactgaagacagtaaatacatcctaacatcgtgttggcttcttaatttgttacactgaaacttaggtgtacctaaagccacaccaccattacaacatcgataactgcccagtaaccatttggaatacctccaacaatgaggaacaatatttcttggactctcagtttatgataagtgcgcctctgtcatcaaccaataccattcaagtaaggtacagtgatggctctggaaaaggaggtggctttaaatatctacattcaaaggggaaaaaaaatacacgcacacacacaggctgccttaatatccctgtttgtccagcgggcaatgggactgggaaatgatcgcgcctcctcagagccaatacagtaggaggcgaacatggggcagtgcattactcaatgccctgcagactgacccttaggaatgagacaggaagaaaagtatttggagatagaatagagaacctccctcaagagccctactaggatgggccaacacttcctgtttgtttagtggttcatcctccagaacactttctttgtcaaaaaggctataacagcccagtacagtggctcatgcctataatcccagcactttgggagaccaaggcggatggattgcttgagcccaggagttcaagaccagcctggccaacatggcgaaaccccatctctactaaaaagacaaataattagccaggagtggtggcacatgcttgtagtcccagctacttgggagtctgtggtggcagaatcgcttgaacccaggatgcagaggttgcagtgagccaagatcgttccactgtactcccgcctgggtgacagagcaagacctcatctcaaaaaaaaaaaaaaaaaaaaagctaggccaggtgtggtggctcacacttgtaatcccaacactttgagaggccaaggcgggaggatcacctgaggtcaggagttcgagaccagcctggccaacatggtgaagcccggtctctactaaaactacaaaaataagctgggcgtggtggcaggtgcctgtaatcccagctacccaggagactgaggcaggagaatcatttgaacccaagagacggaggctgcagtgagccatgatcataccactgcactccaacctgggtgacaagagtgaaactctatcaaaaaaaaaaaaaaaaagggctgacagccagaatacagcaattgttaagacctgatctttccaactgctgcctattcactccctagataagtcaccttatcttaatcactgaaatttgagcacagactctaaatatggacataaaaacccatcccccaacaccctgcctgctaagtacattagtgtctccaaagtgccctcgaaatacagaatgcagtatctgtgcctgtgatttttactccgactcacaaagacctggtttggtttctgctgactcacctaccagtacacactgcttgccttgttcctccacgttccaacacatgcctgctgaggcacatcagctttgctagacaagtggaagatgtgtttgtggagggaggggtggcactgaggagacactaaggatacagctagtcatatttttccaatgtgaatgtcctgaaggagacagaatctaggtgctggcatgtctatgcttgagtctgaaagatgataggctcctacaagtagttttagggactcctatccagtcctttctttttttttttttttttttttttttgagacagagtttcactcctgttgcccaggctggagtacaatggcacgatctcagctcaccacaacctccacctcccgggttcaagcaattctcctgcctcagcctcccgagtagctgggattacaggcatgcaccaccacgcctggctaattttgtatttttagtagagatggggtttctccatgttgaggctggtcttgaactcctgacctcaggtgatctgcccgcctcagtctcccaaagtgctgggattacaggcgtgagccaccgcacccggcctatccaatcctttctattcaacttccttattgcaaacagacctaccaagggaaagaggagttggactttgcttcctgaactatgtaacaatctaaatatagcagagtcctctcttatccacaggggaaatgtttcaagacgccagcagatgcctgaacccctagagagtatggaccctatatggacagttgtccctcagaatctgcagggcactggttccaggatctcctgcagatgccaaaatccacagatgctcaaaagtcccttatatatataaaacggtgtcgaatttgcatataatctataccccctatatactttcaatcttctctacattacttacaacacctaatacaatgtaaatactatgtaaccagttattatacaatattggttttttatttgtactgttttttattgttgtattggtatttttattgtttttttttttttttttttctgaatattttcgatccaagtttggctgaatctgcggatgtggagcccatggccacgaagggctgactctactttgttttctccctatatacacagagctatgataaagttttatttataaattaagcacagtaagagattaacaggaataactaataataaaacaattataacaatatactgtaataaatgttatctgaatgtggctgttctctctcactctcaaaatatcttactacatcatactcacctattttctgaccgtggctgactgtgggtaactgaaaccacggaaagtaaaactgcgactaagggtgagctcttgtagtagcaagttgcaattacatatgctattccacatttcaaaaatctaactcaaacttgaccaattactacaaggaactatttgcaaaaagatgaggcataatttttcctttgcactctattcctgccttccccatctctaggcctacattatcttccccactaaaacccaatgcccagtatttttctatcagcatatcaatgcccagttccaaagccgagtgcgcaagcagactttacatttgggatgtttctctgcttctaccgtggtggtgcttaatgagctggtgctctaagaggcaagctctggaaactcaagggttaaagtgcatctaatattcctggcattcattaatcctatcatcttgctgtacactcaggtctttctggagataacagtgtaaggacattgccccctatgtaaaggcctttgaagcttgaaggagtatatggctaagcgaaagtagggaaaagagctggactcaagaaccagaaaatctagatcaggggtcagcaaactacagctagctggccaaagatggcccactacctgtttttgtaattaaaattcgatcagaacacagccatgttcactcactgatgtgtttattgtccatggctgcttttgtgctacaacagcagagctgagtagtcacagatactgtgtgacctgcaaaccctaaactatttacaatctggcccgttactgaaaaagtttgctacctctcatcctagatgaaatcaggaccagctttattaataatttggtggcaaattctacctaaatttacccaatctaaagtgaaaaacagtgttagaaatagaattatttcgagtacagtggtgcaatcatggctcactgcagcctcgaactgctgggcttaagtgatcctcctgcctcaccctcccaagtagctaggactacaggcacatgccactacacccagctaattttttgtagagatgggggtctcactttgctgcccaggttggtctcaaactcctggcctcaagcaatcctcccacctcagcctcccaaagtgctgggattataggtatgaactatcacaccaggctgagaacttataaatgtaaaagtgaatttcaaaacatgagcttctctgacagattagttctaaactaaagttcaacgttacttgtcatgagccctataaactgtcacatttaagaccttagctttgaactggatctcttccctctaatttcgtcagagaaacccttattcaacaaacactgagcggcacttactctgtgccagaccctgggttagccactggcacacataataaagcttatacttcttcggcctggacatgtagtagaatatttcaggaaagaaaaaaccatgagggacacatgtaatagttcttacagttgaacaattttactctgccactattctaccagaatatttggtgagtaaactcttgtgtttagaatgtgatcttcctagagtgggttatggaactcatatctctgaggcagggtctatgatagaattcaggaagtctgtgaatttggatgaaaaagactgtatctttattttcacttcagtgatgaacataagctacagcagtaatagcagacttattagacaaatggatttgttaccagtagaaatcatggatattttcataccatatcatacttcttaaattttgataactatatatcaatataattcaatataactggttttctttatagttctatgtattttatttttgcatataaaaacatattccaaaaaggaactctaaaagctttcaccacactgccaaaggagtccataacacaaaaaagattaagattcctgttctacggtcaaaaaataaagaaacataatcacatttagggtaattttctgtatataaaaaaactacctgttttttattaagggtcatatgctcattttctatagagcagggaccatatgtcattatttttggcagccttcacttcaaaactggtttgcaagtagttgtgaatgtgatataacagcctagcagattcatgggttcccctggctcactggcagtcatcctagtccaaacatagaaagcctcaaactaatataactttcaacttgtggtacaagagaattcccaaaagaaagcaaggggcaaggcacagtggctcacgcctgtaatcccaacactttgggaggccgaggcggatggatcacttgaggtctggagtttaagaccagcctggcccacatgatgaaaccccgtctctactaaaatacaaaaattagctgggcgtggtggcgggcacctgtaatcccagctgaggcaggagatcgcttgaacccaggaggcagagtttgcagtgagctaagattgcaccactgcattctagcctgggcaacaaggcaagacttggtctcaaaaaataaataaataaataaatagaaagaaaggagggaaaagacacacacagaaagcctgctattaatatatatctattaacctggtttacgaatggtaaaatacaggtaattcaattatttacattaatgaataaggtaggtaacaaacctaaaagaatgccaaatatgagactcatttctttttatcttctgaggtggcgcttcggcacatgctgcaaacgtaaaaaggtacattccttgaatttactggctaaattgtagaaaggaattaggatttaaattctgccacaaataatccacaaagcaattaacaaaacaaatcacagatgaaacatgtgtttaagtactcatttgacaggaatactgtgaaaagagaggtttaggactaaaaacagaaaggtttacgcttaggaaagaggttcaaggacttagggaaaaggagatgccagaagctgccaagcagataagcaggagggttgacaaggcctaaagtgctgatcccctcactctcccaagtcacccctttttctaatatgcttgatgtgtgataatgtcaaagatgtacaagcagccagccacaatcttgagcaaaaaagggactctcacagtcctgtgataattggcaagtgccctgactttagggtttctccaactggaaacaaatccaagaaaaaaatgacttttacaaaaatgtattctttccaatctatttcaaggtaacacaaactttgatgtaagggagacctatttctgcttgattcagaaagggaaatttctattagtagaaaaatcagaaggtctgcttcagatcagttatgtaaatacttagaaaagcatgatgcttaagtaagaactctactattattagcagatattttgctattatccatcattaataacaatggaaaattatgctttttatttgagcatttcaaaaactaattctcatcagcacttataacatctctaggagaggttattcagctccctagggaaatactgtctaacttaaaggccagacagctctgaattataaatggagtcagatggtttacaaactctatgaaattacatacaaaatttggtaagttcacatatatttcagattattaaagggctgtttaatcataagaagagttacctctggccatggttagaaaatctacaacaagagaaagcaataatgctttccatacatagtcacagggcgagtaaatgttaacatcggagaaagtcaccagggactgctaagtccaggctctatctgacgaggtcattcttcttaagggatcacatatccaaaaagcaggtccccagggaaaataaaaccccactgcttatgggaggagagtcatagactgagggggaatgaagctcattctttatcaaccaggccatcatgctagttttcaaagggaatttgcaaagcaaatcttttgtcctacaaaaagattcatttcattcagcaaagaaaaaagaccctagagggagtactgctgaatcccaagcctcttccacagtctgttaccttgaagcatagatgctgttctagaagaaacccctgggtagttccttttagctatgtagaatgtaagtcaagtaaacatctaatgtgctagaaaaaggtgtaactaaccaatttatttagccaagaaaaggctatcccccaccattctcaactcattcccattcaagaacctatctgaactctattcccctattacagagtgtagggggcaggagtggttatcagattaatacactgtacgataaattaaatgacctcatacttctcctattataaaaagcactggtggcacaatcaatagcaccttctaaaaagagctgtaaggccaggcgtggtggtcacacctgtaatcccagcactttgggaggctgaggttagtagatcacctaagctcggaagtttgagaccagcctggccaacgtggtgaaaccctgtctctactaaaaatacaaaaattagccaggcatggtggcacatgcctgtagtcccagctattcaggaggctgaggtaggagaatcgctttgaaccaggaggcggaggttgcagcgagctgggatcgtgccagcacactccagcctgggcaacagagtgagactctgtctcaaaaataaataaataaataaataaaataaaaagggctgtaagagagaaggaagtagtaacattcactttaatttcatctacatcactcacagccctaaagaaagggaatgtgtaggaaataaagtcagcagctaaagcttcatttacattacccatagtgtggtatcattcctagcatgccaggcttggcctcagtgtacaaatcattgaattagagagctaagtacattgaagtctctcccatgtggcatcccaatcaccattattgacactgcgagtgtcatcattttgtccccctttctttctcatcatggtcatagtttactgctattactgcactaaatcccattctcaatgtctttttactagcaattctctgtacttgccaaatcactaaatatcaagataaataggctctggaggtcatatctgccttcctacttccattttattgttggcagattattttctgcccctatcttgagtttccttcccaacccttgttcctacgctcaaagcttcccgttcctcatgagcagtttctcataccacaaacccctaaatcctcactgcctctataaatatcacaaataccactgtccctttttttttttttttttttgagacagagtctccctctgtcacccgggctggagtgcagtctcacaatctcaactcactgcaaccaccgcctcctgggttcaagcaatcctcccacctcagcctccccagtagctgggattccaggcatgcgccaccacacccgcccagtgtccctatttcaatataatttctggttctcccaactgagatgccgagtttcagctctcacagctagtcacctcaattacattcaggaagcctcctccagttaggccaggctaatacagcctgttcccaattgcatctttgtacttccaaagagttccctattcatagaatcattacattttagaaccaaaagaaaactcagaaatcatccggtccaatgtttttcaaacttttaaagtacattttgcttcttacactttgagatgtacaaaatctattttacatcataatctcatacacacataactcaaacaaatcacatgaaacaatacttacccttactatgtaaacacactgaaagtttctattctattccactttttaaaagaaaagtacaggttcaggccaggcgcggtggctcacactgtaatcccagcattttgggaggcctaggcgggtggatcacctgaggtcagcagttcaagaccagcctggccaacatggagaatccccatctctactaaaaatacaaaaattagccgggcgtggtggcgcatgcctgtaatcccagctactagggaggctgagacaagagaatcgcttgaaccagggaggcggaggttgcggtgagctgagatcgcgccactgcgctccagcctgggcaacaagagcgaaactgtctcaaaaaaagaaaaagaaaaaaagtacaggttccatccactaaattggtttcacagctcaatactaggaagaaacccatagtgtgggaggcattaaactagtccaaacttcccattcactgatgaagaaactgtaactcagtggtgaagtttgtccgtaaaaattaaactcaggcctgttaagttccagaccagtgttctttccactaaagaccttctctgcccagtcacggccaatcacaccccgtgcccaaacacaaccctacagcgccatcgcccatcacggatgccatcctcttctccaagtcagcccctcgaagtcactgctctgggtcggagtcccctcgcggccgctgctcgtgttcccttaggtccggatcccccacagtcactaccaatcgatcagagtctccttggagtccttgccccttgatcatagtcccttgcagtcactgcctcatacttcctcggtccaagtgccgtcgcagccccggcctcgcgctctccgaggtcaccgtgtttcgcattcactgctcctgggtcacagtcccctcgctgtcactggccctcggtcacagtagcctcccagcccctggctcccactgccctcgctgtcacttaccactcttcctcagtcacagtcacctcgcggtcccagccccacagtttgtcctctcaaacagagacgcaaagataggcacacacctgcaactcacgctcccccgagcccggtccggtcggatttctggccggcgccgcgtcactgactagggaagttgaggaggttgcggggagacgcccggg

SEQ ID NO: 1534 - DNA, 16920 bp, Homo sapiens
caaattcctccggggtgaactctgagatagaaagttggcccgggaagctcaaggagggagagcggcagaggggaagactctgcaattctgcttgccccccaccccggcccaggcaagccaccctgcccccggcccccacctgcccgccccgcctgcccttcctcaccccggtgcctgcgggattgctggagagaacgcggcgatggagccgggcaggacccagataaagcttgaccccaggtaagtgagggcggcgggccctgggccagtcgctgggcagcggtggcccctatcccgcggcctgtcctctctccctcccagagccctttggcggccgcactcagaatgagacaggactggaaatgctctagctgttcctaggtcctcagggacaacgtgggtttgggccagggtgtgacactccagggcctcggccttgccccccagcgtggggagagaaaggtcgcagagcgggggctgtggaaggcattcgcagaggaaatggcagcatccctcagcagcagggggcccgtccgtctgtaaggactcacccttcctctgggatcctgctcttcctctctggtcagtccctgggctgctgcccgacccgcatggagagaatccacggtgggctcttcaggcacggcagccaggcacagcctggctaggtggcagcttgtcttactcccccacctgggccagttctccactccctctaagaaaagggccctgaggccgggcgcctgtaatcccagcactttgggaggctgaggcgggagtccaggagtttaagcccagttccagtttgagtcctggagttcgagaccagtgtctgagcaacatggcgaaatcctgtctctaccaaaaatataaaaaattagccgggcctggtggcgtgcacctgtagtcccagcttactcatggggatgggggttgagtagatcacttgagcccaggaggtcaaggctgcctgtatgagccaagacagaccactgcactccagcctggacaacagagcaagaccctgtctcaaaaagaaaaaaaaagaaagaaaaaggaaggaaggaaggaaggaaagagaaggggaaggaagagagaaagagaaagagagagcagaaggaaggaaggaaggagaaggggaaggggaagggagagagaaagagaaagagagagtgaaaggaaggaaggaaggaaagaaagaaagagagagaaagaggccctgaggggaaatggacaaagtcctgcactcaggagtggttgagggtccagtgtgcaaccctcccccttcccccagcccccatggttctgagcacaggctggtgtctcgccaggtacacagcagatcttctggaggtgctgaagaccaattacggcatcccctccgcctgcttctctcagcctcccacagcagcccaactcctgagaggtgagtggggaccctcctcagagggaactgagaggagggaaaccaggatagctgagtggagctggggagaggcggccctgagctggtgcacctgggcagccggggagaataactggcccggtgtctgtcatcgtggttaaggctctggagaagggcaatgcctcaaggagtcagtgggtcaaaagggtagcatgagagcctggctccggagagcaaccgtcatgttgggcctccacaaaactggcctcaaagctcattcaaactgcggacactgcgacctggggcgctttttcagaccccagagccatctggggacccaagatggtgcccaagtggtccaagccccatcgggtctcctggagggctgcacggcatccgccctggacccatgtcactctagagggtggttacggtgagtgacgtgcttcacacaggtgaaccagttgtatttgttttacgatccagcctttctgaaaaacctttgtcctcactggagcattctgttgtcgggtttttgtgtgtgtgtttgtgggtatttgcctcattccacccctgagctctcaggtggacagatgggattcaaaaacctgttctacagtgtttattgtagtggagtaatttgtttgcaataataagtcataattgtccactgaaggggagggtgtggggatccccgaggccagctcaagttcagctgttggaagaattccttgactggaaattttacctttgcgttttgtcgctctgtttcctgaagataacttggggtgctcctggtcgtccatctactgctttgattccttggatcccacccattctttcactttaagaaaaaacaagtaattgttgcagaggtctctgttttgcagcttcccttttgcaagaagcactttttccaaataaaacagtaattaaaaaaaaaaaaacataggtgaacctgcaaaagtcctcgcagtgttggccaacaagattctattactgaattacttttgaaagtgaaaggcattggctgggagcggtggctcacgcctgtaatccctgcactttgggaggccgaggcaggtggatcacttgaagccagaagttggagaccagcctggccaacatggtgaaaccccgtctctactgaaaatacaaaaattagccaggcgtggtggcgggcacctgtaatcccagctactcgggaggctgaggcaggagagttgcttgaactcgggaggcggaggttgcagtgagccgagatcacgccactgcactgcagcctgggcaacagagtgagtgagactccgtctcaaaaataaaagaaaaaaaaggaaaagaaaaagaaagtgaaaggcataggatggggctcagcttattccccggacaccaaaaacattgagaatcacggcccgagcatgcttagagaaaatgtgactcacgcctgcgttttattttgttttcctgctgcatactgactacctctgaaatgttggatacaagtctgtgtctctgtagcacatttaacacgtttcccaggcaacaggaagctctcagtgtgcgttctgttgcagacgtgggcgtgtccttgggctgtgtagggcttcatttcagatgatctgaaccagagcggttgccaactgccagtgtccggagatgcctggtggccactctgtggttagtggcagtaggtggctgctacatctagttccagtgaacctcctgttgagagagtgcagctggtggtacaagccttcccttacacagcagctgtccccccagggaatatttggcagtgtcgggagacttccggttgccacactggaaggtgctactggcatctcgtggtcagaggccaggaaagctgctaaacttcctacagggcacgggaagagcccccacagaaaagattattcaggccaaagtgtcaatagtgctcaggttgagaaaccttgcctcacgcaatgaaaacggttctcacattgctttgcttcagaatgtgcaaacggaaaccccaaggctgttcagaacaggccattctgagtctgctagtccagcaagcctcgccgcaggcagagtggggaggatttggccagcgggccctcctgggacagggaagctgcgaggatgagttcggggacgccccaggcccaggggagcgaggtctggcaggattcaaggatcctggtggaagagcaggggacaattgagagggccgggcaggagaggtgaggcccgctgcgcgccgggctggcggaggagctgtgctttatcccgcagcgagaaggagctcgtgaaggctctgaggctgggagtggctggatgaaagtcgtgcttctcggccattcgttagtaatcaggatggactgcagaggaagaggcttaagaagcagggatgcggccggacaccgtggctcatgcctgtaatcccagcactttgggaggccgaggcaggcggatcatctgcggtcaagagttcaagatcagcctggccaatgtggtgaaatcctgtctctactgaaaatacaaaaattagccaggtgtggtggcgcgtgcctgtaatcccagctactcaggaggctgaggcaggagaatcgcttgaacccgggaggcagaggttgcagtgagccgagatctcaccattgcactccagcctgggtgacagaacaagactccgtctcaacaacagcaaaaaataggcagggatgtaaatgagaggtcgttgccccggcctgccatgcgggaaaagagtctgaggcagggcagtggcagggaaagaagaggaagggttgggaaacaggcagttcaaagaaagagcaggcaatctaggaaagacctaggcgtgtaagtgctggttctgggcaatggtgacggcacagccagaaataggagaagcaggaagaagtgcctctgggaggctgtggcgaaactccttcctcgcttcatttgtaaactttgttgttccttaatttttctttttttttttttttttgagacagggtctcactgtgtcactcaggctggagtgcagtggtgcgatctcggcttaccccaaccctccacctgctgggctcaggtgatcctcccacctcagcctccctagtagctggggaccacaggcacatgccaccaagcccagctaatttttgtatttttttgtagaggtggagtttctccatgttgcccaggctggtctcgaacttaaaattaaatgctaagaaaactatttcaggccagtcacggtggcccatgctgcaaccccaggaggtcgaggttgcagtgagctatgattgcaccaccagcctcagcctgggcaacagaccgaaaccctgtctcaatttaaaaaaaagagagagagaaaaaaaagctattattctagaagaatgattgaatcaattttttttttttaattttaaaatcacggctcacggcagctcgagctctgggctcaagtgatcctcccacctcatcctctcgagtagctgggactgcaggcacacaccaccatgcctgggctaactttcaatttttgtagagacagagtctgacttcgttgcccaggctgatctcaaacgctccagctcaagcgatcctcctgcctcggcctcctgaagggctgggattacaggcgtgaatcactgcgcccggccttaaagctactttttattgaacaaatactacacgccaggtgctttgctaagaagcttaaggagaggataagtaacctgtctatggccatagagctattagtaagtggcattttactttgtttttgtttgtttgtttgtttggtttggttttttgttttttttttttaagagacagagtctcgctctgtcccccaggctggagtgcagtggtgtgatctcagctcactacaagctccgcctcccaggttcacgccattctcctgcctcagcctcccgagtagctgggactacaggcgcccgccaccacacccggctaattttttgtatattttttagtagagacggggtttcaccgtgttagtcaggatggtctcgatctcctgacctcgtgatccgcccgcctcggcctcccaatgtgctgggatgacaggcgtgagcccccccgcccggcctggcattttgctttgaactcaagtgtctgactccagtgctctacactgtgctcctaagctactggaagcaaatatgcaagcatggaaataatttttggttagaaagctgggattatgggtgattactcttttttcaaattcttatttaatgttcctgttttcattattttaaaaagtagtctttgctattccagagacagtgggaaatttaatagttgctataagtatgattatattcaaaatggtcaactagacaagcatttcccaaagtctcagactcttaatcccaaggagtccttcatggaaacagagttctgtaggaagttaagttttgtgaccaggcacggtggctcacacctgtaatcccagcactttgggaggccgaggcgggtggatcacttgaggtcaggagtttgagaccagcctgcccaacatggtgaaaccctatctctacttaaaatacaaaaattagctgggcatggtggtgggtacctgtaatcccagctacctgggaggcggaggcagaagaattgcttggatccacgaggcggagcttgcagtaagccgagatcgcgccactgcaccccagcctggcgacagagtaaggctccatctcaaaaaaaaaaaaaaagttaagttttgtaaaaggtgcgttctagaccctccttttggaaatttacaatgtaaattagcagattaaaaatgtcagtatgctctgcaggaatcatcacatttaaccttaatgcatttccaaaaattcttcagctgtggaatacttttgtcccatagtgtctatttagatgcccttttggggaaattgagtttaaccagcaaagaagaggccatctcctaagaagatagtttgatggacagacccagtatcgggctatggatgctaaggaacttttcctttcctaattagagtaccaaaggcaacagttagaagacactgcaaaaccatttgtgttgaacagtcagaatctgccccaccctcaccttcataaatggaacggccctcccagggttgcctttgatgatctctcccatatccacgagtacacacacctggagtcactgtgtgtcatggttaataagagtgtgggcttagtcacgaatacctgcgtttaaatctctgctccttcacttccaggctgtgtgaccctgggagatgtgcttccttctctgagcctcgtttcctgaaaaagtctatgaaatgcagatgatgataggaattctcataggttatttctttcattcaacaaatagttacagagccgttactcctccgggcgtttgagaacagagcacaagcttgacaaggtccctgcctccgtggagtgtgcaccacaaggtggagagccgagaataagcgagtaaacagctgtgtaaatacaaatagccctgatgtgggcggaaggaggacataacgttacccggaatggagattttcacggagcagggagcagttagggaaatgaagactgggaaggactgggttggtggcgtgtgaaagggcagtttttacgctctccaagggctgatgagcacacggggctgggggtaagagaggctctagcaatggcccccgcttcccaaccacagaacattggttttggaaaaccacctgcattaatgttggctttttcctatctggactttgcctattgtctgagtttttttaattaaacatttctattataaaaatcattcaggtttagttaaaaaaaaaaaaagaaagaaagaaaatacagaacagtaaaaagagaaaaaaatcatctacagtcccacccagagacaggcacggcaaatatcttagtgtaatttccttttttttaatgccttttttttttttttttttttcagacagagtctggctctgtggcccaggctggagtgcagtggtgtgatctcagctcaatgcaacctccacctcccagttcaagcaattctcctgcctcagcctctccagtaggtgggattacaggtactcgccaccatgcctggctaatttttgtatttttggtagagatggggttccaccatgttggccaggctggtctcaaattcctgacctcaagtgatccacccgcctcggcctcccaaagtgctgggattacaggcatgagccactgtgcctagccctttctctatgtttttatttaacatttgtagaaatcatactattcctaaaattttatgttctgtttttgtaagcatgatacaaaataaatttttcacatcattgtatatttggaaaaatatgttcttttctaaaaaaaggtttatttttgttataaatacatattcattatagaataattggaaaagaaagacactagggattttcacacaccgagaaaaggccatgtggggacacagtagaaacgcggttgtcggctggacccggtggctcacgcctgtaatcccagcactttgggaggccgaggtgggcgggtcagttgaggtcagttcaagaccagcctggccaacatggcgaaaaccgtctctactagctgggcgtggtggcaggtgcctgtaatcccagctacttgggaggctgaggcaggagaatcacttaaacctgggaggtggaggctgcagtaagctaagatcagaccagtgcactccagcctgtgcgacaagagtgaaacttcgttgaaagaagagaagggggcggggcgggggggggaggagatgggaggggaggagaggggaggagaggggagaggggagggaatgggagaggggaggggaggggaggggaggagaggagagttgtctgcaagtggaggagagaggcctcaggagaaatcaaacctgctgacaccttgatcttgaactagcctccaaaactatgagaaaataaatttaagttgtttaatttttaaaaaagtgactactcagaaaagatagaaaaaagtaagtagaaaagaagacacaaatcatccatagtcccatcacccaaacataagcattgctaacttttttcagtattataggtattttcctttttttttttttttcacccaggctggagtgcagcggtgtgatcctggctcactacagccttcacctctcccggagtagctgggaccacaggcaggcgccaccacacccggctaatttctgtatttttagtagaggtggggtttcactatgttggccaggctggtcttggactcctggcctcaagtgatccgcccacctcagcttcccaaagtgctgggactaccagtgtgagccaccgtgcccagccgagggtcagcgtattttttgacaaattcacccatagtcctggttggtcctgtggtgccaccaggtgcgactgaccgagacaagagctccagctcaagtctgtaccgtggccacctttctccctgttttggtttcagcagtcatattgctcccactgagctgccctcatgttccttagtcaccaaaacacagagcagactagctaatcccttcctcgtgctcaccccgcaaggcaacaggacaatgactggagtgtggcagttttctccctttcttcctcttatctagtcaggtagcaggtgcaaaggagggtccaataactagaaaagacacttagataaatgaccacaggttcactaaggacctagaaccctttctttaaaactaacggctgcattaatgaatcacgtttgttcggaaacacatattgtgactatattcatttttttctgttagcaacggtgaggccagatgaggtctaccagtatttgtcaaagtgtctgctatcctccgaccactatcaggtgagcttgttaaaaatgcagatgactgggcccatctcagatctatggacgcacatgtctgaacgtagggcctgggcagctagctgctttttaacaactcccaaaatgactgcaatatccacgaaagtttgaaaaccttggactatagttcatgtaagaccaagcatgaggccagcgtgcgtcaggtgtccttggggtttttatttgatccgtttctcttttgttgaagttctcccctggccgagtgtggtggctcacgtctgtaatcccagcactttgggagaccagggtggaaggactgcttaagcctaggagtttgagaccagtctgggcaacgtagtgagaccccgtctctacagaaaatgttaaaaattagccggccgtggtgggggtgcacacctgtagtcccaggctacttgggaggctgaggttggaggatggtttgaacccggaaggtcaaggttgcagtgagccatgatcacaccactgccctccagcctgggcgacagagtgagaacctgtcctcctccccacaaaaaagttctctgctaatgtcctggtttcaccatataattttggtgaaatcaacttaaacagatccagaatgtcccataaattatattcggcttcaattatgttaattgatctacattcgctagtgcagcacctggcactggagatagaaaagtgaagtggggttgggcacgggggctgaggcctataatcccagcactttgcagggccaaggcgagtggatcacttgaggtgaggagttcgagaccatcctggccaacatggagaaaactatctctactaaaaatataaaaattagccgggcatagtggtgggtgtctgtaatcccagctacttgggaggctgaggcaggagaatcacttaaacccaggagatggaggttgcagtgacccaagttcacaccactgcactccagcctgggcaacagagtgaggctccgtcttaaaaaaaaaaaaaaaagaaaaagaaaaaaaaaagactatttcttaggttgaatactctaggtctaaaaaatcctcattcctgtgcacgggtgggagcctagatccagtaaggcaatttcgatccgaggaacaagcccaggccttctcccgctcagtcccggtcgtcagctctctgccttctcctcctctagccctgggccctgtggaacttgccctcactagcatcctgaccttgctggcgctgggctccattgccatcttcctggaggatgccgtctacctgtacaagaacaccctttgccccatcaagaggcggactctgctctggaagagctcggcacccacggtgaggcccccggggctgccctgtggggggaactgaaaagaaggcagagaccaaggtgagaattcctctaaactcagcacgtcacttcggcaaagagtgtcctgccacgacccgcggagggccgaggtttgcaggccgacctccccttgcagttaggatcctctgcttggaaggctgtgcagtgtttgcattctaagggctgcggagacagctggagatctgctcagcccaccagccgcctcatccttgctccccgctacagtgttgccacttgaagagcttccttcagtggttcctcagagtgtgggggaaagtctcattccacagggtcacactcagctccacccttacgctgaggcttttgaaacaccctcccacaggtccttggtttgcttgacttaattagtgctttttccagctggcaacgtttaaggaacgctgcctcgaatgtgtaggttttgcctcctgtgtccttgccgcaaaaggcttccggagcctcagggtctccctcccgccctcacctgctcctgccccttctgagcaggtggtgtctgtgctgtgctgctttggtctctggatccctcgttccctggtgctggtggaaatgaccatcacctcgtgagtgccctgcctcgccccacctccaagggcccctctgctcccgctcaccaggactcgagtccgtgtccttgatcccagctgaccatgtatctggcccttcccagcttgtgctagttccgggctcttgcgctcctggctctgctcagggaatgcctcattttggcatctggcacattcctcagccagccctctgttcccacagtctgaaattccccttctcccagtcctgtgggccgtctcctctccctcgcccctcttgggtcacacacccagaacgcccagccctagctctgctcctcagtaagccccacctctccctgctgtctttctctctggcagcagacctcgtaggccctcttctctccccaccccaggttttatgccgtgtgcttttacctgctgatgctggtcatggtggaaggctttggggggaaggaggcagtgctgaggacgctgagggacaccccgatgatggtccacacaggcccctgctgctgctgctgcccctgctgtccacggctgctgctcaccaggtgaggcggggccaaggtgccttccccaggagccggggagcctctcctggacccctggtccccttcaaggctctgggaattaggcgtgaataggccaaagccagtgacggaagggtgggcatcccacggccaggacccacgggcgccaccctcaggggacaggggagcagaggaaggagagctcctcaattgtcatcactgaacttcactgcaccctgcaagccttagccacacagagaaaactggacttggggccattcgcttgccccttctgcccactttggtgaatgaggttgaggtcacactcccagacctcgctccaaagacggaattcttgtctggaggtgagtgggagaccaagagggttcccagcactctcaacattctgcttttttcctctgtccccatccacttaacctggttggtgtttatgacagcagccgagcctcagcccaggagccctgtgaggagccggggcgtcttcctggggcagggggtttgtgggcccatgttcctaaccctcttccccactcaggaagaagcttcagctgctgatgttgggccctttccaatacgccttcttgaagataacgctgaccctggtgggcctgtttctcgtccccgacggcatctatgacccagcagacgtaagccgggagtaagggacagcacagtccaagactcatttagtacctttgtgttctaaaaggaatcaccagagccaacaccccttgacagagggccccagaaaagggtggctgtgggaaaacagaggctcagggactgccagggagagaaccgcaataggccaggcccccgggctttttcattaccgttcctgccgtgggagaggagagctcaaaggaagcaccaggtgccatgatgcatggctcacgaggccgaggtgggaggattgctcaagagtgggagttcaagaccagcctggacaatatagcgagatgccatttctaaaaatgtttttaaaattaggctggacatggtggctcacacctgtaatcccagcactttgggaggctgaggtgggaggatcacttgaagccaggagtttgcgaccagcttgggcaacatagtgagataccatctctttttttttttttttttgagacggagtttctcttttgtcgcccaggctggagtgcagtagcgcatctcggctcactgcaacctccgcctcccgggtttaagtgattctcctacctcagcctcctgagtagctgggattacaggcatgcaccaccacccccggctaattttgtatttttcatagagatggggtttctccatgttggtcaggctggtcttgaacacctgacctcaggtgatccgcccgcctctgcctcccaaagtgctgggattataggcgtgagccaccacgcctggcccatctctattattaaaaaaaaaaaaaagttagctgggaatggtggtgtgcacctgtagtcccagctactcagaagcctgaggcgaggggatcactggagccaggagtgtgatgctgcagtgagctatcattgcacctctgcactttcagctgggtgacagagtgacaccatctcttgaaagagagagagagagagagagagcttgcctgcctcactgactactttctgttgccaccagatttctgaggggagcacagctctatggatcaacactttccttggcgtgtccacactgctggctctctggaccctgggcatcatttcccgtcaagccaggctacacctgggtgagcagaacatgggagccaaatttgctctgttccaggtaactataccctgggagagaaaagatgtttcataaccgagctacagatagttggggttagtaagtgaggccaataaaggctaaagtgggccgggaatctttttcataagcctcacgtctctcatgagatttggaaaatgattcctgtgcttcccgcttttgtctttctgtgctggaattgtttcccagggctgccatgacaaaataccacaaatcagatggcttaaaacaacagacatgtcttgtctcattgtgctggaggctagaagtccacagcgaaggagccagcagggccctgctccctttgagccctgcagggggtcccagcctctccctagtttcctagttgccagcagtcctggaccatccttgaccagcatttgcgtcactcccatttctgcctccattatctcgttatattctccccttgtgtttctgtgtgtcttctatttttttttttttttttgagacagagtcttggtctgttgcccaggctggagtgcagtggtgccatctcaggttaagcaattctcttgcctcagcctcccaagtagctgggattacaggcatgtaccaccacgcccggctaattttgcatttttagtagagacggggtttcgctatgttggccaggctggtctcaaactcctgacctcaggtgatccacccgcctcagcctcccaaagtattgggattataggcgtgagccactgtgcccctccatctcatctatttttaggacaccagtcaaattggattaagggcccaccctattccattatgacctcatcttaactaattacatttgtaacaaactgttcttaaataaggtcacgagtaccggggggcaggacttcaacatagctttttggggacacaatttaacctgtaacacgtgtgttagttaacaaaccttacatttgtctccttgcttcttcctttccttttctacctatgacttcctaaaatcctataacccatcaacaccagcagaagcattagcattagctacaggacctacctacaccatgtgccgggcactttcacacattacacttcaattttcacaaccccaggagtcatttttcccattttacaaaggaagaaacagacccagagatgttcttgctcaaaggcacataaggaacggggctagaatttatacccaggtatgtcttgactcctccacacatctgtcttctccttaccctgcccttcatcttcacaacgcttctgaaaattctctcaaaggcatgttggcccaccttctacgtgctgccttctctaacctcaaagatgacttttccaccaaatgcaatgacttctaacccagtcttgttctccttctctctccatcctgtctccttgctggtcttctactcccaaggcataatgactgccctacagtttaacagagtgagttcacgtacattctcatttgatctacgtacatgcctcccaaatgtgaacttccaggcacataggaggtagaatgaaaggggctatgggaatagagagagaagtccccggaatgagtcagggactgaaggggcagaaaggttctgggtcccagaagtacttgagaccaggccgaaagataaaagccgtgtgatggccgagcctgcccatggttaatgtgggggagcctgggtgagccacgccagccttgaagaagctgaggtttccacacaatgtactcagggagggcaatactaagataaatggtgcttccagggcttctggacagtgatcttcttcttctccccttttgccttctttatttggtgaaatattgataaaatttgccattaatgattttgaagtgtcaggttctgtggcattaagtacattcccatagttgcactaccattaccaccgtccatctccaggcacccattaaacacattccccattgccctctccctgcagtctctgggatggcagagcttccaaagggcattttaatggttaattgtccattattctaggagcagggacctcaggcacttgagctagatggaatgactcttctctaatcacccatctctttatccattgagtgctcattggtagccatggctgagaaagggaattaaaaatgaaccctttaatcagttcttatatcttgtcagaaactctaataaactactgggtagaaaataagaatgtcatttgcctaaagatgaaaatcccacagatttttaatgaagtgagagcctcaaccctctgtgactgcacagatctgacggtgggtggaacctgcccagcggaagggcaaggcccggcagtgggctggctgcgttctgtgccgtgagggcaggcccagtccacccttgcctctcttttatgttccgcaggttctcctcatcctgactgccctacagccctccatcttctcagtcttggccaacggtgggcagattgcttgttcgcctccctattcctctaaaaccaggtctcaaggtgagcacgttaagcctcctgtcccatcgtgggatggatgagacggggagagtcaggaaagaaggggccccagaacagacattaggccagcctgacttctgctcagagtgttcagaagggatcttcgggaaatcccaacagaggctttaaggaaactatgacctctctgatcacacagaagagaagtgaaaccccacagcttgaggccagccctgagggccaacccaggaagccatgggttcagtcctcagctcctgggagaggaatgggaatggttaaaaaacagaagcccatgttgattgaacacacataagaaatggactgtatgccagcctcagagcacagaagtagacagccaacttccggttctggctctaccattaacccgctgtgttatttatgacaatttcgtatccctaagtcctgatttggggataaactggagaaagtgttgctcaactcccgtgcccgggctgctagtaaaataccacctctgtaactcagcataacctacgctgtatttcaccctacactgcagtgatgaattgccacctcctcatactggagacttttctaatgactgtgctgacacgaatgtactaccgaaggaaagaccacaaggttgggtatgaaactttctcttctccagacctggacttgaacctcaaagcctaaggtggatggcttggacaatgaaaggatgctgtactcattagaatacaagattcctttactgtccctcaaccttgaccaaatgggaagcattcccccttgtcaacacaagctggcagatacatttgactctacagatgaaggtgaacaatgttagaataaaattgctttggatcttgcctggaaggtgttttaagttttgtaataaacaagatgatgtctgaaaatgtgtaa

SEQ ID NO: 1535 - DNA, 22337 bp, Homo sapiens
atcaccatgattaccttttaatttatctttaatgttttctgataaatgttttgtaagctgaggcatttcttctggagaatattcagcatttgccagttcctccttgagcacagcatggatacagtctttaaccacagagggcctgaacctgaatggaacaatttgtgaacatccagtcggtgactccacaaccccagcttaccttcataccgcaacttctcccatctttttgtcattagtaccacttaatccttctttttcatattttttattataaaatataaacaaattaagacaaatcataggccacatgtgtatcttcaacctggacctgcactgaacttcaacacattccaactcatgctccatatgaatgtttattaggcaactcaatacatccaataatgagcttctcatactcccctctcccccaaaacaaaatatatacttgttgttaattttgttctgcacgctttcacaaaataaaataaaataaaataaaataaaaaaatacggctgaatggcattctgggcattcagaaccttttaccaagataactgagggtatctttctctgtgttcattctacccaagggaaaaatcctgtatgaaatttgtatcactttttctgtgagttaccaagagaataaaaataaacaaagaaatttgtatcacattataatcaaaattcctgttttccatatttgccaagcaaatatggggtgtgtgtgtgtgtgtaaagttagtgatcttacaaacctagctgagtaccctctgctctggcccgtgagcctgacatttttttcagtgtgtgtgtgtgtgtgttgtgtggtgtgtgtgtgtgttgtgtggtgtgtgtgtgtgtgtgtaaagttagtgatctcacaaacctagctgagtaccctctgctctggcccgtgagcctgacatttttttcagtgtgtgtgtgtgtgtgtgtgtgttgtgtggtgtgtgtgtggtgtgtgtgtgtgtgtgtgtgtgtgtaaagttagtgatcttacaaacctgagtaccctctgctctggcccgtgagcctgacattttttttcagtgtgtgtgtgtgtgtgtgtgtgtgtgttgtgtgtgtgtgtgtaaagttagtgatcttacaaacctagctgagtaccctctgctctggcccgtgagcctgacattttttttcagtgtgtgtgtgtgttgtgtgtgtgtgtgtgtgtaaagttagtgatcttacaaacctagctgagtaccctctgctctggcccgtgagcctgatatttttttcagtgtgtgtgtgtgtgtgtgtgtgtgtgtgtgtaaagttagtgatctcacaaacctagctgagtaccctctgctctggcccgtgagcctgatatttttttcagtgtgtgtgtgtgtgtgtgtgtgtgtgtgtaaagttagtgatctcacaaacctagctgagtaccctctgctctggcccgtgagccttaatcctagcgagggctcgctgcggtggtctaagggcctccagatcccacccgggtaggacttcgcacagatgcagctcccgcgccgggagtgagcccatcctggcacccgtgtgcacagtcaccctcgaatcacggctgaacggcatccgacgcgagtggcttcctgcctctattctacccatctccttactcaggacgccatcgcgggtttcccagggccaaccattcccgccgcgccaccctaagacgcgcccggcgcccaaacactgaggaagcgggtggggtcccctgcggcccctgcagcgggaggggcgcccggacgtcacagcagggccgcccgcccgcctcgcggcctcccgcctcccgccccgcggaccccgcgcgtcccccgcgctccttccgtggcccaggtcccaggcgagctccgcccctcagaccagcgcgctcgaggtcgccccgccacagcccgtcctctacccgcctctgctggaaaacaggccgcagaatataggtgttctcgggctcccctgcgttcttctcagcctcaggcaccccgtcgcccaccgagaaggacactccgatggacgtggccatgccggggcttctcggtccgggcgtagctcgcgatgaaggcctagcgggttgcggtcgcggccggcagcagggaaagcgtctccagggcaacagggccgccctcccgcctcgctgaagcccgcgagcgccccgcacagccgccctccctgcccgcgcctgcgcaccggctgctgggcgggaactggtcgcgtccggacgcgcgacagcttccacccgcctcaggcagtatcagccgcgccgcagtcggaggaaatagacgcggggcctgaggctcctggacttgaggtattaggctggtgcagaagtaattgcggcggccgggtgcgggggctcaggcctgcaatcccagcactttgggaggccgaggcgggcggatcacctgagtcaggaagagttcaagaccatcctggccgacatggtgaaaccccatctctactgaaaatacaaaaattagccgggcgtggtggcgcgtgcctgtaaccccagctgctctggaggctgaggcagaataatctattgaacccaggaggccgaggttgcagtgagccgagatcgcgccactgcactccagcctggcgacagagcgagactgcgtctcaaaaaaagaaaaaaaaaaaaaaaggaaggaaggaaagagacttaggctgcattccccgcttttaaaaatatatatttatttttatttttttaaacgaagtctcgctctgtcactcaggctggagtgcagaggcgcgatctcggctcactgcaacctccacctcccaggttcaagcaattctgcctcagcctcccaagcagcagggattacaggcgcgccccaccacgaccggctaattttttttgtatttttattagagacggggtttcaccatattggccaggctggtctccaactcctgacctcaggtgatcgcccacctcggtctcccgaagtgctgggatgacaggcgtgagccatcgtactctgccgcattccctgcttataagcaccagtccctggtcctgttttagaaggctgttgtatcttggcctctgctagcttcaaaaactaaggcccgatgaggtagctcgtgcctgtaatccctgtttacaggagaggctgaaagggcagggattcctttttttttttttcccacttgagacagggtcttgctctgtttctcaggctggagtgcagtggcacactcaccgctcacttcagcctcgacctcttggactcaagcagtcctcccacctcagcctctggagtacctggaactacaggcgaatgccaccgcgcgtggctaatctttttaatttttgtagagataggatctggctatgctgcccaggctactattgaactcttgggctcaagtgattatcccacctcagccttccgaagtgctgggactacaggcatgagccatcacagccagctgggatattgtttttcgaatcgctgtcatgttctgtactatatgcagttcctgaaagaatggaggcaagaaggagtcagctaaccactgtgaactgtcttagtgccaaggacccacccttctctccttggggtcctgctgacccatcagaatagggctgagccaggatggggcttgtggagatgatgtgtatgagtgtgcatgcacttgtgtgtgcatgcctaacatccaaaactagatataaattctttaaacttttcattagttggccaggcacggtgactcgcacctgtgatcccagcactttgggaggccgaggcgggcggatcatgaggttaggagatcaagaccatcctggctaacattgtgaaacccggtctctactaaaaatacaaaaattagctgggtgtggtggcatgtgcctgtaatcccagctacttgggaggctgaggcaggagaattgcttgaaccagggagtcggagcttgcagtgagccgagatcacaccactgcactccagcatgagactctgtatcaaaaaaaaaaaaaaaaaaaaaaattctgcgtgagttgtgtggaggtgtcagtacctttccccagcaagagaagcttctccatatcaggcatatcctagccatgaccctgaaactaaccagccaagagggaaatgtgagacaagcccaggcaagcttcctggatgttgtatgcaggaataggatgtgctctctggacttggagacttcctgcctgctcaagaggctgtgcctccttgtgtctcccacaggcctctgtgtccaccttccccaccctggcaggcctgctaggccagcagccctggagaggaaagggtgaggtggtgtttgaagggacctgcctcctacgagctctgctggttggactgtcggatgacagaaccgtgcctctgagcctgggagagggaggcacccctgtgttctggaagcccccagtgcttcagcaactcctcactgaggcagaatagtggaggaatcaagctgggatccaggggactgaggaggggatagagcagcacctgggccccacattcccttccaacagagcctggggtgctgtgtttccgggagggttttttttgttttttgttttcccgagacagaatctcgctctgacccccagcctggagtgcagtggcatgatctcggctcactgcaacctccgcctctcgggttcaagcaattctcctgcctcagcctcccgagtagctgggattacaggtgcacaccaccacacctggctaatttttgtattttttatagagacggggtttcaccatgttggctaggctggtcgtgaacttctgacctcatgatctgcctgcctcagactcctaaagtgctgggattacaggtgtgagccactgcacccggcctctttttttttttttttttttttttttgtgagacagagtctctgtcccccaggctggagttcagtggtgcaatctcggctcactgcaacctctgtctcctggtttcaagcaattctcctgcttcagcctctgaatagctgggattaccgacatgcaccaccacgcccatataatttttgtattttttgtagagctgaagtttcactatgttggccaggctggtctcaaactcctgacttctggtgatccacccaccgtggcctcccaaagtgctgggattgcaggtgtgagccaccgtgcccggccagagcctggggttctcaaactcgtttctggggaccgcccaccacttttcttgccagtgcccatcttccaggttcctcccaggctgcttctgcctgccttgtcctcttcctgcctgtcacaccacactctcccaccagcatcttcctcattccgctctgactctcctcaccacccagcccgacctgactgaaaaccccgcagtgggagagcaggaggcccctgcttctaggtgccgtgtgagaagcagctgtgaggtcgggttgggtggctcacgcctgtaatcccagcactttgggaggccgaggtgggcgggtcacaaggtcaggagttcaagaccagcctggccaatatggtgaaaacccatctctactaaaagtacaaaaaaaatagccaggtgtggtggcgggtgcctgtaatcccagccactcaggaggctgaagcaggagaatcgcttgaacttgggaggcagagggtgcagtgagccgagatcatgccactgcactccagcctgggcaacagagcgagactccataaaaaagaaaaagagatttaattggctcacagttctgcaggggttacaggaagcatagcacccacatcactcagcttctggggaggcctcagagagcttttactcatggcagcaggtgaagagggagcaggcgagtcacatagtgagagcaggagcaggcgagagagaggccagaggtgccacacgcttctaaatgaccagatctcgcgggaacccactatcacaaagacagctctgagccgtgagggatccgcctcatgatccacacaccttctgccaggccccacctctagcactggggatcacaattcaacatgagatttgggtgaggacagatatccaaactgtgtggacagaggtgatgctcctctacttgttgaactcttgaacactagtgaagagaatgctggtgtattagtctgccaggctgctgttgcagaataccatgaactgggcacttaagcaactgaaatagattttctcacagtgctggaggctagaagtccaagatccaggtgccagcaggtttggtatctcctgaggcctcgcccctgcgcttgcagacagccgccttctcactgggtccttacagggcctttttctttgagccagtgtagagagctctgttctttcttcctctttttataagcacaccagtcctatttaattagggtcccaccctatggcctcatttaatcatttgttgttgtgttttttttttttgagacgaggtctcactgtgttgcccaggttagtctcaaacccctggtcacaagtgatcttcccacattggcctcccaaagtgctcagattacaggtgtgagccattgcgcccagtctcatttaaccttaattactaatttaaaggtgccatcatggccaggcgcggtggctcacacctgtaatcccagcacttttggaggccaaggtgggcggatcacttgcagccaggagttcgagaccagcctggccaacatggtgaaacccccgtctctactaaaaatacaaaaattagctgggtgtggtggcacatgcctgtaatcccagctactcaggaggctgaggcaggagaatcacttgaacctgggaggtggaggttgcagtgagccgagatcacgccactgcactccagcctgggtgacagagcgagactgtctcaaaaaaaaaaaaaaaaagtgccaccaccaaagactgtcatattgggggttagggcttcaacctacagatttggaggaaacactatttagtccacaataactggagaagttgaatttagaagatgggggttggggccaggcacagtgactcatgcctgtaatccagcgctttgggagaccaaggtgggaggatcacttgaggtcaggagttcaagaccagactgggcaatatagcgagactccctctctacagaaaatttaaaaattagccaggtgtagtggtgtgtgcctgtagtcccagctactcggaggctaaggcaggaggatcgcttgagtgcatgggttgtaggttacagtaagctatgattgtgccactgtactccagacaggggaacagagcaagaccctgtctcagcaacaacaaaacaacagggagatagggggtcaggtgctgacttcaccttaacttcactgtgtgcttttacagcaagcctgttaccctctgtgagcctcaacttctctatgtgtaacaaatggccaactttatgggattgtcaagaagctgaaatgagaccctggctggaggatattttatggactataaattcctaaacaattataataacttagttatttatcctatccatggatcacctggaagtttacaatgtgatttaaaatgcattctatcattccaccgacctgcagtgaattttgttgtcattattactccagggatacctaaaggggaagtttgtttataattcgtacccactccttgtagaaaggattcaagacagccgatgatgaaaacacccatgcttgcaagtgaaggttctgcctgtcacttctcgcagaggctgcagaaaaggcccaggaggctgttgatgacatgaacgaccaccaggagaagctggagcaggctgatgcacagaagggcggagaagagggacacgtgccagacaacagctgcagagggctccaggcagacggagttccagagcgaacggtcatacagataattcctatcccaaaaaataaggagaccaggggtcaggcgataagtaaggaaagccaaacaggcaaccccagtagaaaactggggtctcccctgaccgggtcatgggactgggctcatgagggtgaccgttactgctccatttgcaattttctgagtatcagaggagcaagatgctaggatgtgtgacccaaaggagcttgtagttcgtctgtgtgtctttttgtctctctctctctctctgtctgaaaagaccaagcccaagcctccacccatttacctactatgcaggtctttgaatgggtaaccatatttccaagcttgtgtctgattgaaggatgaaacatcaaacatgcaaaaaggaccatctttcagagcaactccagaagtgacaaagcaaatcagggctccaagtaaagccaggccacctgacaacagagcagtaagcacctgcggagggaggagaaacactgagctaagacggggtcgcagctggggagcctgcggagggaggagaaacgctgagctaagacggggtcgcagctggggagtctgtggggcggtctgcacaggtctgacttctctggtctcagtgttcttccgtcctgtcatgggggagaattctgtccatggcaccccctttgaagcataacccatggtggggaggccgtgaggggtttctaggagagaaaggaccaagaagcagaatcgcaggccccggatctccctgaccgtgagttcgcctgagctgctcagcagcttggcatcacaaaccttttgcacattacagccattcagcctctgagctaaagaagaagctaccacaggcccaccactgactcttctaaggaaaagctgcattttcaaaagttccaggttcccaactctgattcttctctatttcaaatcaaggataaaaaaaaggaagggagggaaggaaggaaagaaagaagcaggaaagaagggaaggagagaagtgggagggagggaaagaagggagagaaacagcgagagagaagctgcagccaagctctgaaatgactccacttctgtcgctgtgtttctccagctgagagctttcttggccatcagtctgtgctcccactgccctcccagaaaataactgggtttccttccttgacaggtttctagcctgcttctacattggcttctttctcgttccttccttccttcccttccttccttctttctctctctctctttctttttgagacagagtctcactctgtcgcccaggctggagtgcagtggcacgatctcagctcactgcaacctctgcctctgagttcaagcgattctcctgcctcagcctcccaagtagctgggactacaagcatgcgccaccacacccagctaatttttgtatttttagtagaaatggggtttcactgtgttggtcatgccggtctcaatctcctgaccttgtgatccacctgcttcagcctcccaaagtgctgggattacaggcatgagccaccgtgcccggcccatattggattctttcttagggttctagatttttttctccctcccccaaaaatgcctattttaaaaatgtgaataacacctacatagcgtttttctgcagagtcatggagtcattctcccactgaggtcaagctggtttggagttggggagggatcagacaaaggtgcatagtaagttttgactctgagttaaaggagtcaagatgaatcagtaagcctagggcagtggttcccaaaatggggtccctgcccagccgcatcacatcacctgagaacctgttagaaatgcaaaacttccccgccatcctgaatcagaaactctggggagggagcccagcaatccgtgttccggcaaaagccctccaggtgattctcatgcacattcaagtgtcagaactacgtgccacggggaaaaccagaatgagaacagacagtgaatgaaatgtgcaagtgtttatttatttatctatgtacttatttatttatttattttgaaacggagtctcgctctgtcgcccaggctggagtgcagtggcgccatctcggctcactgcaagctccgcctcccgggttcaagagattttcctgcctcagcctcctgagttgctgggattacaggcgcccaccaccacgcccagctaatttttgtatttttggtagagacggggtttcaccatgttggccaggctggtctcaaactcctgacctcaggtgatccgcccatcttggcctcccaaagtgctgggattacaggcgtgagccaccgcgcctggcctatatttgattttttaacatgtaactgagtcagtgggcttcccaacatgtgggctgcagatatcagagcaggctgtggagttaccataaggccacagattcatgtctgagaacgagtgtgtgtgtgtgtgtgtgtgtgtgtttgttacacacacatatactgagatctttcaagtttatacagttgctgctgtaattaataaggtagaaatttattctgggcctcagtttatctgtaaaatggaggggttagattagaatctagtgattagatgatctctggaaaactttcctgttctaagaaaatattagttaaaataactaggaaaatttccatcaatgacacatgattacagtgtcataactcatgtccatattgtccaacaccctaagagagtaacagtttctcacactggtacagacgtctgggtcctcacactggtacagacgtctgggcttcactaagcactactcccttgacttgatcagctcccattttacagatgaaagcctgaaactggaaagatgaagcaacttgcccaagaacttagcgttactgagggtcacagtgaggacctgacttcaggccccaagaccaaaattgcctctttaccgccctgcctctagagtaatagaggtggagacattctgggtgttagaagagtggaatctggtgcttacgcttcgacagagcccactcttactgaagcagccgtatctccagcccatcaaggagatgaggatagctgcagtgagtacctgcaggagagagaagaatgttgagatggggaaatcgactttgccggctgtttctaggtgctgcccacagctgttagagtggctggcagctcacatgaacgcagtcctgttgactctgactctggggacccacatttgtatgacgagcctgatctaacgctgtggatgttaactttcacacccgacctgcctggtcccaagctaggcttcctgtctcttagagcttctacagacccaagatcagcttgttagaataaacttttctgcaaggaatcaaaacactcttcccatgccaccttcctgctccccgccggggtctctttgagagttcacgttcagggaaccccggacacttaccatgaggcctcctccccagagcccagttcccagcatggcatgcctgccaaggaggcccctcaacaggtaggtgacatcccagttaggaaggaggagtgccacgttggccccagcagcaaacagggctgcagtcccaaggctcagtcccaggatacgggagcaagtccgtgagcttgcctgcgtgcagggagaggacaccatcctggaacagatagaaagggagtcgcagcagctctgctgtggggggatggggaagggaactccagcagcatatcatgggtgagggaaacagactacagaaaccgccaccttccagggtcagaccaatgagagccaagcaacctgcttaaaaactctgctccttaggaatcttccccagtgactaggatttaattgtttccttttctgctaacccctgttcacacatacatagtttgcattccatcatattttgtttatgcctctattacagccagtgattatttctgacaaaaagaaatgtttaaaggtgtcttcatgatgtccattgtctccacttctattcaacgttgtactggtcctggccagtgcaatacgaaaataaaaggaagcaaaagccacacagataggaaagaaagaagtaatattgtcggccaggcatggtggctcaggcctgtaatcccagcactttgggaggctgaggcaggcggatcacgaggtcaggagttcaagaccagcctggccaacatggtgaaaccccgtctctactaaaaatacaaaaattagctgggcacggtggtgggtgcctgtaatcccagctactggggagactgaggcaggagaattgcttgaacccgggaggcagaggttgcagtgagctgagatcatgccactgcactccagcctgggtgacacagcaagactccatcttaaaaaaaaaaaaaagtaacattgttattattcacagataatgtgatcacattatgtagaaaatcctaaagtttattagaattaacaggtgagtttagcaacgtcatagaataaaagattaatatacaaaaattatattgtatttctatatacaagcaatgacaaattgaggattgaaattaaaatatatcatttacaatagcataaaaatataatacatatggatgaatttaacaaaatatttgcaagacctatatagtaagaattgcaaagcattgctgagaaaattaatggagacctaaataaatggagacatataccatgttcctgaaccagaagactcaaaatagttaacatgttctccctaaattgatgcaaagatttaaagcaatatcagtcaaaatcctaggagagttttgttatagaaattgacaaactgaatctaaatttatatggaaatgcaaagcaattgtgaagattagccaaagcaattctgaaaaacaaacaaagctggagaacttacgccatgtgatttcaagacttacaaagctacagtaattgaagacactgaagccacgcgtaaggaaacacatatggactactggaacaggctggagctcagaaacagacccggtccaggaaaaatgattttttttttttcttgagacggagtctcgctctgttgctcaggctggagtgcagtggcgcgatctcagctcactgcaacctctgcctcccaggttcaagcgattctcctgcctcagcctcccaagtagctgggattacaggtgcccgccaccatgcccggtaattttttgtatttttagtagagacggggtttcaccgtgttagccaggacggtcttgatctcctgacctcgtgatccgcctgtctcgggctcccaaagtgctgggattacaggcatgagccaccgcgcccggccaataaatgattttttaagaagatgacaattcagcgggaaaaagtctcttccacaaatggtgccggaacaatgcacatgcaaaacaaaactgccttcactattacttcacaacatattcaaaaattcacttgaaatggagcatgggtctaaaagctttataaaatttctagaataaaacaaaggagaaaaacactgggaccttgggttagataaaggtttcttactaaaatgcaaaaagtacaatccacaaaacatgattaatcagactgcttaaaaatttaaatgtcagctgggtgcttgcctataatcccagctactcggaggttgaggcaggaaaatcgcttgaacccaggaggcagaggctgcagtgagctgagatcgcgccactgcacttcagcctgggcgacaagagcaagcgactccatctaaaaaaaaaaaatcatgctaaaagaaataagccagacactaaaggacaaatattgtatgattccacttatatgaaatattcaaaataacaactttatagagaaagaaagtagactggaggttatcagggactgtggggagggaggagagaatggggagttattgtttaatggttacagaggttttcaggttttgttttgtgttgttttgttttttttttttgagacagagtcttgctctgtcagccaggctggagtgcagtggcgcaatctcagctcactgcaacctctgcctcctgggctcaagcaattctcctgcctcagcctcccaagtagctgggactacaggcatgtgccaccacgcctggctaatttttgtatttttagtagagacagggtttcactatgttggccaggctggtcttgaactcctgacctcaggtgatctgcccgcctcggcctcccaccgcgcgcggtggttttggggtttttttagagatgcagtctcactatgttaccccagctggtcttcaactcctggactcaaatgatcctccagcccgtgcctccagagtagctatgaccagatctgggccactgcccacggtttaagggttacagactttctgtttggggtgaagaaaagttttggaaatagataatggtaatggttgcacatcattgcaaatgtaattaatgtcactgaattatacactttaaaatggttaaaatgacaaatctgatgttactttaccacaataaaaaatcaattaaaaaatttgtgattactcaaatccttatcagtaatcaataggtgaatcaagacaaattgtgttatccatacaaatgagttctattaggtaataaaatgcgtaaatttctgctacatataacatggatgaatctcaaaagcattgtgttaagtggaagaagccagaaacaaaagactactcacatgtttctatatatacgaaattctagaaaaggcaaaacttttaacggagagcagatgagcggttgccatgggctgagaatgggaaagaggattagtatggggcatgggaagctttctgaaggggtggaagcattctgtgtctagattctggtggtgaatacataactgtacatattgacaaaactcattaaactttgcacttaaaataggtgaattttattgaattttaactatatatcaataaagctaattacaattaaaatgtcatatctagataaattataaaatgcctcttccactccttatgttcctctcttttatattttcattgatatgtgaacttcttgttttttagaaaaatatgaattaaggccgggcacggtgacttacacctgtaatcccagcactttgggaggccaaggcaggtggatcgcctgatgtcaggagtttgagataagcctggtcaacatggtgaaaccgtgtctctattaaaaaatacaaaaaaattgctggacgtggtggcaggcacctgtaatcccagctactcgggtggctgaggcagcagaatcgcttgagcccaggaggcagaagttgcagtgagcagagatcgtgccattgcactccagcccaggaaacaagagtgaagctctatctaaaaaaaaaatatatatatatacatatatatatgaattaaaataggactagtaatatttgggcagactcatgtcaatgtggatctgaaaaaagtcagcgtcatgacatccccaggaagtggcctgttcccactgtgcagttcagttacacgtctgtctccccttaaggctcgctatttatttatttatttaatttatttatttattttttattgaaaaaaatttatttttagccgggtgcagtggctcacgcctgtaatcccagcactttgggaggccaaagccggcagatcacctgaggtcaggagttcaagaccagcctggccatcatgacgaaaccccatctctactaaaaatacaaaactagccgggcgtggtggcgcatgcctgtaatcccagctactcggaaggctgaggcaggagaatcacttgaacccgggaggtggaggttgcagtgagccgagattacgccactgcactccagcctggacaacaagagtgaaactccgtctcagaagaaaaaaaaatgtaatagaggtgaggtctccttatgtggcccaggctggtctcaaactccttggctcaagggccctcccacttcagacacctaaagtgctaggatgacaggcgtgagccactgcacttggccacttgaggctcttgacacgcctataacacactgctttgcacctaatcagaaaatatgtgtatagaggccaggcacggtggctcacgcctgtaaccccagcactttgggaggctgaggtgggtggatcacgaggtcaggagtttccgaccaacctggccaacatggtgaaaccccgtctctactaaaaatacaaaaaaattagctgggcatggtggcgggtgcctgtggtcccagctactcgggaggctgaggcagtagaatggcgtgaacctggggggctgagatcacgccagtgcactccagcctgggcaagagagtgagattcggtctcaaaaaaaaaaaattaactgcgtggtggtgtgcgcctgtaatccaagctactcaggagcttgaggcaggagaatcgcttgagcccgagaggcagaggtggcagtgagcccagatcacgccactgcactccagcctgggtgacagagcaaaagagagagagagagaggagggagagagggagggagggagggaggaaggaagaaaggaaaggaaggaaggaaagaggaaggggaaggggaagggaagaaaaaaaatatatatatatataaaagatatggatcagaggctctatatatatgcacacacacatatatatcatatacatataatgtataatgtgcgtatatatgtgtgtacgtacacacacacacacacacaatagtcccccatatctgcaggggatatgttccaagagctccagcggatacctgaaaccacagatcataccaaactctgtatattcagatgcttctccacttatgatggggtcgaactcctataaacccgttgtaagtcaaaatatcctaagttcaaaaggcatttaatgctggcaacacagtagactgtccctgactcacaatggttcaacttacaattttttttttttttttttttttgagacagggtcttgctctgtcacccaggctggagtgcagtagcacaatcattgttcactgcagccctgatctgggctcaagtgatcctcccacctcagtctctcggatagctgagaccgcaggcatgcgccaccatacctggctaatgttttagttctatagagacagggtctcactatgttgcccaagctgatctcaaactcctggcctcaagtgatcctctcacctccacctcccaaaatgttgggattacaggcgtaagccaccacgcccagtcccaatttacttttgactttgtgatggtgcaaaagcaatgagtattcagtagaaaccgtaatcccatcataaagggtaaggagttcactgatgatggagttaggtccctagaaacctgtcgtaaagttggaaacttagaagtcaaaccactataagtagaggactgtctgtactatgctttttcctatacatacatatctgtaataaagtttaatttataaatcaggcatagtaagaagttcgcaacaataataataaaatagaacagttataacaacatactgtaatgaaagttatgtgaatgtggtctttctcattgaaaatattttatgtaagttttttgaactgcagttgaccacagatagctaaaactttggaaagcaaagcttcagttaaggggggattactttacatcacacataaataatgaaatatttcacagcatgaagaattaaacattgggggagggccagggctgaaaaactatctgtaggtaccgcgctcactacctgagtgacgggaatcactcataccctaacctcaacatcacacaatagacacggaacaagcctgtatatgtatccccggatctaaaataaaagttgaaattatatttttaaaatttgcattaaaggccaggtgcagtagttcacgcctataatcccagcactgtgggaggccgaggcgggtggatcacttgaggtcaggagttcaagacagcctggccaacctggcgaaacctcatctctactaaaaatacaaaacttagctgggaatggtggtgtgcgcctgtaatcccagctactcaggaggctgaggcagaagaatcacttgaacctgggaggcagaggttgcagtgagccaagatcgcaccactgcactccagcctggaccacagatcgagactccgtctcaaaaaaaaaaaattgcattaaaaaagaattaaacataatgtgtaaaatatatttgtaacttgtgtgagataattaacacccatgtaaacacaaccaatatcaaacatacgtcattacccatcacatcactgacactcaggtgtgccctctccaatcctgccttctttctggattccttcctaggaactactatcctatatttcatcttcaacatatccttttaaaaacagttttacgacttaggaactcagaattgttttagaaacttgtttagtcgggtgttttccatttttcaagactgtagcttttcttttctttttctttttttttttgagatggagtcttgctctgtctcccaggctggagctcagaaacagacccggtccaggataaataatttttttttttcttgagacagagtctcactctgtcgctcaggctggagtgcagtggcgcgatctcagctcactgcaacctccgcctccccggttcaagcgattgttctgcctcagactccccagtagctgggactacagctgcacaccaccatgcccggctaatttttgtatttttagtaaagacagggtttcaccatgttggccaggctggtcttgaactcctggtctcaagtgatcctcctgcctcggtttcccaaagtgctggaattacaggtgtgagccaccaaacccggccagactgtagcttatggtaaagaagacaaggggaggggtgccctgggagggtgggggtaggagagaggaagggtgccctgagaaggtgggggttaggagaagggaggggtgcactgggagggtgggtgtaggagagggaagggtgccctgagaaggtgggggttaggagaagggaggggtgcactgggagggtgggtgtaggagagggaagggtgccctgagaaggtgggggttaggagaagggaggggtgcactgggagggtgggtgtaggagagggaagggatgccctgagaaggtgggggttaggagaagggaggggtgcactgggagggtgggggtaggagagggaagggatgccctgagaaggtgggggttggagaggggaggggtgctctgggagggtgggggtaggagaggggagaggtgccctgggagggtggccagaggacaggggaggagtgcacagggagagtgggggtaggagaggggagggatgcacggggagggtggaggtagcagaggggaggggtgcatggggagggtgggggcaggagagggcaggggtgcttggggaggggttgtaggaaagaggaggggtgcactgggagggtgggggtaggagaggggaggggtgcactgggagggtgtgggtaggagaggggaggggtgccctgggagggtgtgggtaggagaggggaggggtgccctgggagggtgggggtaggagaggggaggggtgccctgggagggtgggggtaggagagaggtggggtgccctgagagggtgggcgtaggatatgaagcaacagtgactcctaccccaggggcccaagggtcctggggcagggtggggtcaggaatcgggagggatggggtgtctcttcccccatcaaccctctggctgacaggccaccggactcctcagtcacagcaaggaacctgtcctgctcctgggagcagggcgcctgtggagaacggccccctcacagcctgcccacactgctgcgatgtccccgcatgtctgcacatcctccctccgagacggtcccatcgtgcagtgcggggcttgcagtgtgtaattctgtgttgaggcaaattaaccacccagggtgttaacaactcacaactttaatccactgcccacccagatgtctgaccggggcccaaggaaagatgggtgtgtggttggcctttcaagcgggtgctctagatcatggggccaggagacgccgttgtgcaggaatgcatttagtgccttcaaatcacggcacctctgagaaagcaccgtctacacacttcagcaacatcaacccccctgacgatctcttctacagaaaacgttcccatcagaaaagtctgttttttttgtttttgtttttgttttgttttttgttttttttttgagacagagtttcactcttgttgcccaggctggagtgcaatggcgcggcctcagctcactgctacctccgcctcctgggttcaagtgattctcctgcctcagactcctgagtagctgggattacaggtgcacaccactacgcccggctaattttgtatttttagtagagatggggtttctccaggttagccacgctggtcttgaactcctgacctcaggtgattcacctaccttggcctcctaaagtgctgggattacaggtgtgagccacagcgcccagcccagaaaactcttaaaggggaaactaaaaatgatggacagcgagggaaaactaccagctggagcatggcttttggatgagtggaattcagagccctggctgtccgccaatcaaacactaaaagcacttgccgcactgcggcttcgtgtgaatttcacccctcctcctgactttattcccctagaaattataacatttggagaaacccttccaaaaatgtgaaccaggaggttagcaaagaggtggcctaatttgatatctgaagagacaagcaagatcagaaggtaaaaccttaaaaccaggctgctggggagttccttgttctgtcctgaggtcctagctaggtgagcacgtcatcggctagatgtccaggcaacaacagaagtgatcggctcaattccatggaggaagagaccgcacattctctacatctgtgtctctccctcgccacccagcaaggcttttctttcattcttccttcagtcggatatttattaagtgatcactacctgacagacacttggggggctagggatataacgatgaaaaagatgtaatccctttccttgaggagcttaaagtctagtggggacactgctgacgcaaaaagcaattctttttttttttttttttttttttttttgagacacagtctcgctcttgttgcccaggctggagtgcagcggcatgctcttggctcactgcaacctccgcctctcgggttcaagttattctcctgcctcagcctcccaagtagctggaattacaggcatgcaccacgcccggctaattttgtatttttagtagtgatgggttttcgccatgtgggtcaggctggccaaaaagtaattctaatcaagtgtggtaagaaatagagcagacatgagcagggcgggagagggcctctaccccagtaatgtcaggtgactatcaggtgatggccaggcggttgttacactgtctttctaaaataatattggtcacagccagcgttgggaaagacagtctcccaatagatagaaaatacctgaacttggtgatcagcagcttcctggtaagagctcaggaattgggcgagtgggctcaagcatctacactaagaagcaaaatggtggagtttagctggtgtgtgtgaccttcctctagtgctgctccgcgggtaagggaaaaacgcctcaagtgagcatgcgcacgacttcagtaaacacactgcgcatgcggcccctcccaagtgcctgtgcggcaggcaggcgccaagtcaagggtctaacagcacatttgggtgtctcaagtcacgcacttggcccttttccaagtgtactttacttcctttcattgctgctcaaaaactttttaataaaccttcactcctgctctcaaacttgcttcagcctctccctctgccttaaacccacttctgcccctcagccgaatctctcccccgagaaggcaaggattgagtttgctgcagactcgctggattcacagctggtaacagtaagtaccaggcaggggcatccaacttaaggtgtcatggaagcacatggaggaacctaatcctatctggcagaagcaaaacgaagcttcccggaggaagggctgcccatgcccaaacttgatggacgatgagatactaggcaggaagagtattctaggtgcaaaggccagaagttgacagactgaggcaacaggagaaggtaagtgaatggcgcaaagtcacacagacgccaagctgcagagccaggctcactggagtggaagcgtgcactctcatctgtgaggctaggctgttccctggccgtcacctcaccctttcatctctgcttacctgcatctggtgtcaagaatcagaatgggagagacagaacctggagaaaggctgcgtcttcagagtggggctccactcctccagctccagggctggacctgaaggttgtctttccaggactctttccaggagggccagggaggctctgtatatacgt

SEQ ID NO: 1536 - DNA, 62510 bp, Homo sapiens
gtgttacagtctctgattttaatgagtcaatctcaaggcaaagctataaccttttccatgtgaaccttaaaacggaaatcctacgtgtttggctcagctaccatagacatgtcttgccccagagttccagtgtatttttcacctttagtttcttggctcctctccgcctctacaccagcctcatatccacacgggatgctctctgctgagtattgtcttgagttagttctccctctcatgttctggctgatgctactcatggtcatagtatcacctgacggggaaggagtatgctatgaaggtgaaaaatgctaccatagcattttgtttgtttataaaatgtcaggccctggttccatttttcccccctcttatatctaaattttgaaaccactggcctctaacagtctgtagtaggcttaagttcaaggtgccatttgcttctctggtgcctgtttgtgagccaaatagaggaagagtatgctagagagagcgctgaccaggaagatcacatcaaaccaacggtgatagaagttgaactgcagttctccaaggacttcagtgattatggtgcggtattctaaaggcatactcattcggatcagcagcacagaggagacaaagtacatgccctgtaagtcaaatgaattaatccagaagtgactctgaatgtagtgaggaacaggacaaaggaaattattaaaattcttaaaagtatcaagcacatttctgatattttacagctgtaaacataaaggtaactaattaaacttaccattatctgtgctaatagcaggacaatgacattggaggacttactgctagagatggcataaaagaactgtcaagaaagagggagatgaatttatgcagtagtgttagattcctgtgtcacgaacagtaagaaatatggttaacatttgattaaaagtgtctcttccatgccacaatcctgtatagaacaattcatatgattaagactataaagaagagacttaaaatagactgctgaaaaagttatactttccccctgggggtaatttaattacataacatatgaaaggattcctattgctatcaaacttcagaaactatgtgatacatatgacttaacatcactataaaacattaagtcagatcactccagcccactccaagcggttgtaattgttagtaggctcccacgctctttctaaaactgtgctagatgcctgcagatcccttcctgtcccagccacttctctttcattcaaaagctcctggatttttaaatccctacctttcctaccagagaggactcactttccacctccgtgaagtcttcctacgttgattagaaaatagatgaattcaggctttggtatcaggatgatgctggcctcataaaatgagttagggtatcatcctgataccaaaacctggcagagacacaacaaaaaaagagaattttagaccctgatgaacatcgatgcaaaaatcctcaataaaatactggcaaactgaatccagcggcacatcaaaaagcttatctgccatgatcaaatgggcttcatccctgggatgcaaggctggttcaacatatgcaaatcaataaacataatccagcatataaacagaaccaaagacaaaaaccacatggttatctcaatagatgcagaaaaggcctttgacaaaattcaacagccctccatgctaaaaactcaataaattaggtattgatgggacgtatctcgaaatcgtaagagctatttatgacaaacccacagccaatatcatactgaatgggcaaaaactggaagcattccctttgaaaactggcacaagacagggatgccctctcccaccactcttattcagcatagtgttggaagttctggccagggcaatcaggcaggagaaagaaataaagggtattcaatcagaaaaagaggaagtcaaattgtccctgtttgcagaagacatgactgtatatatagaaaaccccatcgtctcagcccaaaatctccttaagctgataagcaacttcagcaaagtctcaggatacaaaatcaatgtgcaaaaatcacaagcattcttatagaccaataacagacaaacagagagccaaatcatgagtgaacgcccattcacaatttcttcaaagagaataaaatacctaggaatccaatttacaagggatgtgaaggacctcttcaaggagaactacaaaccactgctcaacaaaataaaagaggaaacaaacacatggaagaacattccatgctcatggataggaagaatcagtatcatgaaaatggccatactgcccaaggtaatttatagattcaatgccatccacatcaagctaccaatgactttcttcacagaattggaaaaaactactctaaagttcatatggaaccaaaaagagcccgcattgccaagtcaatcctaagccaaaagaacaaagctggaggcatcacactacctgacttcaagctatactacaaggctacagtaaccaaaacagcatggtactggtaccaaaacagagatatagaccaatggaacagaacagagccctcagaaataataccacacatctacaaccatctgctctttgacaaacctgacaaaaacaagaaatggggaagggattccctatttaacaaatggtgctgggaaaactggctagccatatgtagaaagctgaaactggatcccttccttacaccttatacaaaaattaattcaagatggattaaagacttaaatgttagacctaaaaccataaaaaccctagaagaaaacctaggcaataacattcaggacataggcatgggcaaggacttcatgtctaaaacaccgaaagcaatggcaacaaaagccaaaattgacaaatgggatttaattaaactaaagagcttctgcacagcaaaagaaactaccatcagagtgaacaggcaacctacagaatgggagaaaatttttgcaatctacttatctgacaaagggctaatatccagaatttacaaagaactcaaacaaatttacaagaaaaaaaacaaccccatcaaaaagtgggcaaaggatatgaacagacacttctcatgtgcagccaacagacacatgaaaaaatgctgatcatcactggccatcagagaaatgcaaatcaaaaccacaatgagataccatctcacaccagttaggatggtgatcattaaaaagtcaggaaacaacaggtgctggagaggatgtggagaaacaggaacacttttacactgttggtgggactgtaaactagttcaaccattgtggaaggcagtgtggcaattcctcaaggatctacaactagaaataacatttgacccagtcatcccattactgggtatatacccaaaggattataaatcatgctgctataaagacacatgcacacgtatgtttattgcatgtgcaatattcatactattcactattcacatactctattcacaatagcaaagacttggaaccaacccaaatgtccatcaatgatagactggattaagaaaatgtggcacatatacaccatggaatactatccagccacaaaaaaggatgagttcatgtcctttgtagggacatggatgaagctggaaaccatcattctcagcaaactatcgcaaggacaaaaagccaaacactgcatattctcactcataggtgggaactgaacaatgagaacacttggacacaggaaggggaacatcacacaccgaggcttgtcgtggggtggggggaggggggagggacagcattaggagatatacctaatgtaaatgacaagttaataggtgcagcacaccaacatggcacatgtatccaaatgtaacaaacctgcacgttgtgcacatgtaccctagaacttaaagtataatttaaaaaaaaaaaatagttgaattcagtaggtccttacttaatgccatttataggatcttggaaactgagattttaagtgaaatgatgtataacaaaactacatttttctcacagcattataatgaaatgttgaacgaaacatttttttgaggacttggtatatagttttgcttaaagctgctgtttccaagaacttattgatgacattaaggacttgctatattctgctcccttacttccatatcttctctgtaagtgactctcacaactattcttccagtctcaaatatctgctgaatatctgcctaccatgtgctaggttctgttctagatactgataacatatcagtgaacaaaacagacccatatcttactctatcacctttagtgaatgtacttatctataattggtatatgatgtaaatatatcatcatcaatttatgtagtagtttaacttttaaaaaattctgttgtatgtcttttaaatccttgacactgttgtttaaagtctcaggaggcagaattcttaatgaggtaaaattatctcatggtaccacctatttttttttttttgagatggagtgttgctctttcaccaggctggagtgcagtgtgtgaccttggttcactgcaatctctgctgcctgggttcaagtgattctcctaactcagcctcccaagtagttgggactacaggcatgtgccaccacacccagctaatttgttgtatttttagtagagatggggtttcaccatgttggctaggatggactcgatctcctgacctcgtgatccacccacctcagccttccaaagtgttgggattacaggcgtgagccaccacacccggctggtaccacatttaattaaacaaatgataagcagtactttttaacactgtgataaaacataccttggtaagagtgatcagcaatcctctgatggatgtgacgatgattattccaacaagaatgaaggaaatgtgttgggaccaaaacttcacctgccaccataacaagaaaaaatatctgctaaatctctgttcagagagacgtaagggctaagctatatcccgatcatttacatgactgtgagagggagctttattagaccctacctgattttttttcttaagggagagaggaaagcaagtaggtggcaaataaaacaactacagaaagactgcagtaaataccttaattagcagacttaattaaaccttaaaattaaaaaaatattttttttgtagagccagggtcttgctatgtagttcaggctcgtctcaaactcctgggctcaagcaatactcccacatcagcctcccaaagtgttggtattacaggcatgagtcaccatgcccggcagcaagtaccaagaagtgataaaaataacgctaataaatcagaaaaaaacagaactaatgatacagttttactgtgataaacgaaaagcaggaattaaaaggaaactaaataataccttgattattttctatctatgaataatagttccctaatcaccaaaacttcaaggaatctttctttttatagtaaaagaatatatagacattctcagctaaattctaggaaatagttgaacttcactggaaccacatgatacctttttctcctcctgtattgcttcatagtgagaaggagttttgggaccctgtgtttgattcagttctgaaaagtatctgaaagggagctgctattactaacatctaaacgatttgttattcagaattacaaaatatagcataaacagatgaattacagatgaaatatatacatggccatgtaagtatcctcagaaagtacagaaaagcaaaagcattgctaaaaattcagcccagtaaaacacttaaggaaacacaaatgcaacaacagcaaagcatactttttgttgttttttgagacaggggtctcactctgtcgcccagagtggagtgcagtggcactatctcagctcaccgcaacttctttctccccggctcaagtgatcctcctgctttagcctcctgcatagctgggactacaggtgcatgccaccatgtccagctaatttttatattttttctagagacaggttttcaccatgttgcccaggctggtcttgaactcctggactcaagtgatctgtctcgacctctcaaagtgctgggactacagatgtgggccacagtagtgcgtggcctgtaaagcatatttaatataatttatataccacttgaagaaaagatatcatgttccttcacactcaaagaggatacactattgatctagcatcaagaaacatgtacattgagctgtttctcaaggattggggctcaatttgctctcgttcattttcatttcatccaagtccttttgagattaggggcacgtctggctgggatggatggctgggggtagcacgcagtctgcgtctaggttgacagcacagctaaatggcctacactgggactaagaatatgacattggtcttactattaaagtgctattcagccagagtcattggctctggtttatgaataaagacactgaacttcaattaggacaagggtgtatttatgacagtggtattatgaaacagtaaaaagacaatttaaaaaaaaattttgtgcataggtgacagttaccatctttagcccaaggtccacattaatagataaagatcatttcttacagcagaaatcatttcagctctaacacagaacactaattagtagctaattttccactggagcatcaaagctgagttgtgtgtttgaagagcttaataagaatcacagagagaagtatttgaatactttggtggggagaaaatggtaaactggtagctgcctatagagaagcagaggagcagctgtagaaataatcagcatccatgacaatattaagtatcaatcattacttctggctttatgttaagagagagaatcttggccttttacaaattttccatgtgaatacatcaaaatataaaaattttccatgtgaatacgtcaaaatatacagagtgggaagaacaaaagcagaagcaagtacctaaagtatacaaattagaatcttaacaatggtaagttatagtagataaaacagaaacatgacaaaccaggatcttgatataacacttacatcaaattggattcccagataattcacagtgatctcaatgcctcttgtgacaggatccgttttcccaactcgatcaaaaacaatattgatggtagcctgcaaagatgcagatttttaccttggagcatcttaacaatcacttactatttcaaaaagtgactgaaactaatgaattaatcactgtaacatatcttacaggtcaatgttcctaaaaatgcaattctactcttaatccaaatcatatataggaaatctattttggatactcatatataggcaaacaaaagtccctatttcctccatctttcttttctgtaaagagtcaatgggaataaagctacggcattatgccttaatttatcaggagccagaaaggtaacattctggtagatgaagtcagattaagagaatcaagaaatcccagggtaattccttgtggttattttctgaatgctttaacagcaaatactaaaataacagaaaaaggagttatagctaataagtcaacaaacgatatcaaatggaataatgaaaaattcccaattaatccccaagatggaagtttaaaaaaaggaaaaagggagaaaagaacagatgggaccaatgaaaagaaatagcaacacagtagtttaaaatccaaccacgttaaaaaaaaagaaacaaccacatcaataatcacatgaaatgtaaatggtctgcataataggtgagcaaactctgccactggagtgtgacagcagccacagacaatacacaaatgaatggacttggctgcgttccaataaaactttatttccaaaggcaggcagtggttaggtttggcctgtgggctatagattgctgatccttggtctaaacatgtcaatgaaatggcagaggttgttagattggataaaaatgcaagacccaactatatattccttatgaaaaaaccactttaataaatataaagatacaaataggttaaaagtaaaaggacagaaaaatatattatgctaacactaatcaaaagaaagctagaatgtctatattaatgtcggacaaagtagatttcatagcaaaaatactgctaggtattaaaagggtcatttcagaatgataaaaggatcatttcaacaaggggtacacaatgattctaaatgtttatacacctaatgacagagcttcaaaatacgtaaagcaaaactgatagaaataaaaaagaaatggacaaatccacaatagctggatcccctctctcaataactgataaaattagtcagaaactctaataatactatcaatcaatttgacgtaattgacatttatggaacactcctgccaacaagagcacaatacatattctactcacatacaggtaagacatttatcaccatattctgtctgggacagaaaacaagtcaataatttaaaagattcatatcatacaaaatatgttcttagaccacatgaaattaaattagaaattaattagagaataatatttggaagatcctcaaatattttataacacacttctaaatcacccatgaatcaaagaagaaatcaaagggaaactcgaaagcattttgaattgaatgagaaatacaattcattaaatttgtgagatctagtatagcagtacatagcaagaaatgtatagcattaaaacccctatatcagcaaagatctccaatcaatgatcttagtttccatcttaagaaattagaaaaagagactcaaaataagcagaagaaaggaaataacaaagaccagagcagaaatcaatgaaatagcaaaaaatgagagaaaactaattaacccaaaagttggttctttgaaaagttcaacaaaaccaataaacttctactagactgataaagacaaaagagggaagtcacaagttaccaatattaagaacaagagagacatcactgtcacacccatgaggatggctataataaaaaagtttttattttattttattattattataccttaagttttagggtacatgtgcacactgtgcaggttagttacatatgtatacatgtgccatgctggtgtgctgcacccattaactcatcatttagcattaggtatatctcctaaaactatccctcccccctccccccaccccacaacagtccccagagtgtgatgttccccttcctgtgtccatgtgttctcattgttcaattcccacctatgagtgagaacatgtggtgtttggttttttgtccttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtcaatagtgccacaataaacatacgtgtgcatgtgtctttatagcagcatgatttatagtcctttgggtatatacccagtaatgggatggctgggtcaaatggtatttctagttctagatccctgaagaatcgccacactgacttccacaagggttgaactagtttacagtcccaccaacagtgtaaaagtgttcctgtttctccacatcctctccagcacctgttgtttcctgactttttaatgattgccattctaactggtgtgagatggtatgtcattgtggttttgatttgcatttctctgatggccagtgatggtgagcattttttcttgtgttttttggcggcataaaagtcttcttttgagaagtgtctgttcatgtccttcgccaactttttgatggggttgtttgtttttttcttgtaaacttgtttgagttcattgtagattctggatattagccctttgtcagatgagtaggttgcaaaaattttctcccattctgtaggttgcctgttcactctgatggtagtttcttttgctgtgcagaagctctttagtttaattagatcccatttgtcaattttggcttttgttgccattgcttttggtatgcttttagacatgaagtccttgcccatgcctatgttctgaatggtaacgcctaggttttcttctagggtttttatggttttaggtctaacgtttaagtctttaatccatcttgaattaatttttgtataaggtgtaaggaagggatccagtttcagctttctacatatggctagccagttttcccagcaccatttattaaataaggaatcctttccccattgcttgtttttctcaggtttgtcaaagatcagatagttgtagatatgcggcgtgatttctgagggctctgttcggtgccaatgtacaaaaatcacaagcattcttatacaccaataacagacaaacagagagacaaatcatgagtgaactcccattcacaattgcttcaaagagaataaaatacctaggaatccaacttacaagggatgtgaaggacctcttcaaggagaactacaaaacactgctcaatgaaataaaagaggatacaaacaaatggaagaacattccatgctcatggtaggaagaatcaatatcatgaaaatggccatactgcccaaggtaatttatagattcaatgccatccctataaagctaccaatgactttcttcacagaattggaaaaaactactttaaagttcataaggaaccaaaaaaagcccacattgccaagtcaatcctaagccaaaagagcaaagctggaggcatcacgctacctgacttcaaactatactacaaggctacagtaaccaaaacagcatggtactggtaccaaaacagagatatagatcaatggaacagtataaaaaagttaataacaattgttggtggggatgtggagaaattggagcacgcatcccctgctgacaggaatgtaaactgttgctgctgttttggaaaagtctggtagttctttaaaaggttaaacataggctggtcgcagtggctcatgcctgtaatcctagcactttgggaggctgaggcgggtggatcacaaggttaggagttagagaccagcctggccaatatggtgaaaccctgtctctactaaaaatacaaaaaagttagccgggagtggttgcatgcgcctgtaacctcagctacttgggacgctgaggcaggagaattgcttgaacctgggaggtggaggttgcagtgagctgagactgcaccactgcactccagcctgggcgacagagctagactccacctcaataaataaataaataaataaataaaaaggttaaacatatacttagcatatgacacggcaattctacccctagatatacacataagagaaattaaaacatatactcacataaaaacttatacacgaggctgggcatggtggctcacggatataatcccagcactttgggaggccgaggctagtggatcacctgaggtcaggagttgagaccagcctggccaacatggtcaaacctcgtctctactaaaaatagaaaaatcagccaggcgtggtggtacgcacctgtaatcccagctactcaggcggctgaggcaggagaatcgcttgaacccaggaggcagagatcgaagtgagctgagatcaccccactgtgctccagcctgggcaacagagtgagactgtgtctcaaaacaaaaacaaaaaaattatacacaaatgttcacatcagcattattgataatggcccaaaagtagaaacaatcctaatgtacatcaactaataaatggataaaaaatgtggtgtacctataaaatgaaatagatattattcagccatagaaaatatgaattttttttttaagacagtcttgctctgctgcctgctggagtgtggtggcacaatcacggctcactgcagcttcaacttcccaggctcaagcgatcctcccccgcctcagcctcccgagtagctggggccacaagcatgtacttccatgccctatttattttgtgtgtgtgtgtgtgtgtcggggagggaggggtaaagaatggggtttccctttgtttctcaggatagtctcaaactcctgggctcaagtgatcctcctgcctcagcctcccaaagtgttgggattacaggcatctgccactgtgcctggccaggaatgaaatattgatagatactatgacatggatgtaccttaaaaacattatgctagggctgggtacagtggctcagcctgggcaatatagtgagactcgtctctatgaaaaaaaatatatactttttaaaattacatttaaaaagctcccccccaaccccattatgctaaatgagagaagccaatcataaaacaatataaattatgtgattccatttatatgaaacatccagaatagggaaatctacagagacagaaaatagattagtggttgctaagggctgagggagtgggaattggagggaaatggggaatgactactaatgagtatggaatttctttttggcttgataaaaatgttcaaaaattgattgtggtaatggttataaaactatgaatatattaagaactactgcatcatacactaaatgagtatattgtattgtatgtgaattatatctcaataaacctgttacatgaaaaaaataacagtctctacaggttctatagatattaaaaggatagtaagaatattatgagcaatatcatgccaataaatttgacaacttcaataaaaatagacaaattccttgagacccaaattgcaagagctcactcaagaagaaatagataacctgcataaaccctgtatctttaaaaaaatgaattggtagtttaaaaaaatcttcctgcaaagaaaactccaggcccagacggctttattgataaactctacaacacatttaggggagaaataacaacatctccacacatacttttccactaatttaaagaggtggcagtacttctcaactcattctctaaggtcagcaagcattactctgacaccaaaaccaaataaagacattatgagaaaagaaaactatagtccaatatcctcatacatatggaatcaattttttttttttttgagacagagtctccctctgtcattcaagctggagtgcagcggcgtgataatagctcactgaggccttggacttctgggctcaagcgatcctcccaccatagcctcctgagtagctgggaacacaggcatgccaccacactcagttaatttttattgttttgctgagatggggtcttgctatgctgcccaggctggtctcgaattcctggcctcaagcagtcctcctgcttcagcctcccaaagtactgggaatacaggtgtgagccaacatgctcagacaatgcaaacattcttaacgtaattttagcaaattgaatctaacaaaatagaaaaatgataattcaccatgaccaagtgaggtttattctaggaatgcaagattggtttaatattcaaaaattaatgaatgtaatcaactatagcagactaaaaaagaaaaacattgatcatctcaatagatgcagtaaaagaatttaacaaaatccaacaccttttcatgattaacaatactcaataaactatgattacaatggaacttcctcaacctgataaagggcatctagggaaaacctaacatcataaaggtgagactggatgctatctccctaagagcaggaataacagtaggatgactaatcctaccacttctattcaactttgtactgaaggttttagtcagtgcaataaggctggagaaggagcaggagaaaaaggataacaagaaggaaggaaggatggggaaaggaacaacttaattaaaacactggcaaggtcgggggaggggccaaggtgaccaactagaagtagctgctgttggctgctcctatcaagaatgaaaacagcgagtgaatgttgcactttcaggctgaggtaaccaggttctctcattgggactgactaggcagttggcacaacccacggagagcgaggaaaagcagggtagtgcaacagccccacctgggagccgcacagggcaaggggagttcccacccccaatcaaggaaggcgatgagtgattgtggcaccctgcccaggaaaccatgcttcttccacagatctgtgcaacccgtggatcaggagattccccttgtgagcccaggccaacagggccttggatcccaagcacagagctgcccagatgctcagtggccactgaggttgcagccagcagcagcaggctggagattgcctaagacgaccaagttcccgggacagccaccatcactgcaggtccagtctgcccttttcccctgccagtgccggggagaataggtggtttggaccaggaggaattccccacagcacagcacagtggtagtggcagactgtggccagaccgcttctttaggtgggactcggatccattcctcctcactaggcgaggcctccctgcagaaatgtcagcaactccaggtaggggtttatgagcagaactgatctccctgggaaggagcccctgggggcaggggtgactatcgtcttcgtggttcagcagacttagtctttcctgcctgctggctctgaagggtctgggcagtccagaggagggggattcccttcagtgcagcacagctgctctgccaaggggcagtcagagtgcttccttaagcaggtccctgatcccgtgcctcctgactgagaccccccaccaggggttgccagacatcttatacaggaacgttcctgccggcatcaggtcagtgcttcctcccagaggacggagcaagcagccatctttgctgttctgcagcctccactggtaatacctccaggtgcgagagggacccaggcgagtagggtatggattcgaccgccaacaaatggcagcagccctacagaagaggggcctgactgttaaaaacaaacaaacagaaagcaacaacaacatcaacaaaaaaagaccccacaaaaaccccatccaaaggtcagcagcctcaaaaatcgaaggtagataaactgaggatgatgagaaagaatcaacacaaaaacggtgacaactcaaaaagccagagtgcctcttctccaaatgatcacaacacctctccagcaagggcacagaactgggctgaggctgaggctgagatggatgcactgacagaagtaggctttagaagctgggcagtaacaaacattgctgagcaaaagaagtaatgttctaacccaatgcaaagaagccaagaaccatgataaaacattataggagctgttaaccagaataacccgtttaaaaaggaacataaacaatgtgatggagctgaaaaacacaatgtgaaattcacaatgcaaccacaaatatcaatagctgaagagactaagcagaggaaagaatctcagagcttgaagactatcttgctgaaataagacaggcagacaaggtgagagaaaaaagaatgaaaaggaatgaacaaaacctctgagaactatgggattacataaaaataccgaacctacggctgattcaggtacctggaagagacggggagaacggaaccgtttcaagttggaaaacatacttcaggatatcatccaggagaacttccccaacctagcaatacaggccagaacttctccaacctagcaagacaggccaacattcaaattcaggaaatccagagaactccagtaaaatactccatgagaagatcaaccccaagacacataatcatcagattctccaaggtcgaaatgaaggaaaaaatgttaagggcagccagaaaggacaggtcacctacaaagagaagtccatcagactaacagtgcacctctcagtggaaaccctataagccagaagcaattgggagtcaatattcaacattctgttttttttttttttttttttttgagatggattcttgctctgtcacccaggctggagtgcagtggcatagtctcggctcactgcaacctccacctcctgggttcatgccattctcctgcctcagcctcccgagtagctaggactacaggcgcctgccaccatgcctggctaattttttgtatttttagtagagatggggtttcaccgtgttagccaggatggtctcgatcttctgacctcgtgatctgcccgcctcggcctcccaaagtgctgggattaccggcatgagccaccacgcccagctcaacattcttaaagaaaagaatttccaacccagaatttcctatctggccaaactaagcttcataagtgaaggagaaataaaatccttttcagacaagcaaatgctgagggaacttgtgaccaccttgcaagaactcctgaaggaagcactaagtatggaaaggaaaaactattaccagccactacaaaaacacactgaagtacacaaagcaatgacactatgaagcaactacaataacaagtctgcaaaataaccagctagcatcatgatgacaggatcaaatcacacataacaattttaaccttaaatgtaaatgggctaaatgccccaattaaaagacacagaatggcaagctggataaagaatcaagacccatcagtgtgctgtattcaggaggcccctctcatgtgcaaagacacacataggctcaaaataaagggatggaggaaaatttaccaagcaaatggaaagcaaaaaaaagcaggggttgcaatcctagtttctgacaaaacagactttaacaaagatcaaaaaagacaaacaagggctttacataatgctaaagggttcaattcaacaagagctaactatcctaaatatatatacacccaatacaggagcacccagatctataaaacaagttcttagagacctacaaagagacttatactctcacataataatagtgggagacattaacaccccacagtcaatgttacacagatcattgagacagaaaattaacaagtatatttaggacttgaactcagctctggatcaagtggacctgatagacatctacagaactctctacccaaaaacaacagaatatacattcttcttggtgccacatggcacatactctaaaattgatcacataactggaagtagaacactcctcagcaaatgcaaaagaactgaaattataacagtctctcagaccacaggacaatcaaattagaactcaagactaagaaactaactcaaaactacacaactacatgaaaattgaacaacctgctcctgaatgactcctcagtaaataatgaaattaaggcagaaatcaagaagttatttgatactatgagaacaaagagacaacataccagaatctctgggacacagctaaagcagtgttaagagggaaatggatagcactaaatgctcatatcaaaaagctagaaagatctcaaatcgacaccctaacatcacaactaaaagaactagagaaccaagagcaaacaaaccccaaagctagcagaatataagaaataaccaaggtcacagcagaactgcaggagatagagcacgaaaaacccttcaaaaaaatcaacgaatccaggagccagttttttgaaaagattaataaaatagaccactactagactaataaagaagaagaatcaaacagacacaaaaaaaatgataaaggggacatcaccactgatcccacagaaatacaaataaccatcagagaatactataaacatctctatgcaaatcaactagaaaatctagaagaaatggataaattcttggacacatacaccctcccaagactgaaccaggaagaagttgaatccctgaatagacccataaggagttctgatttggggcagtaataagcctaccatccaaggaaagcccaggaccagatggatttacagctgaattcagaggtaaaaagaggagctgataccatttcttctgcaactattccaaacaacagaaaaagagggactcctccctaactcattttatgaggccagctcattctgataccaaaatctggcagagatacaacaacaaaaaaagaaaacttcaggccaatatccctgaagaacattgatgtgaaaatcctcaataaaatactggcaaaccaaatccagcagcacatcaaaaagctcatctaccacgatcaagtcagcttcatgcccagtatgcaacactggttcaacatacacgaatcagtaaacgtaatccatcacataaacagaaccaatgacaaaaaccacatgattatctcaatagacacagaaaaggcctttgataaaattcaacatcccttcatgctaaaaactctcaataaactaggtattgatggaacatacctcaaaataataagggtgatttataacaaacccacagccaatatcacactgaatggacaaaagctggaagcatttcctttgaaaactggcacaagataggactccctctctcaccactcctattcaacatagtattggaagttctggccagggcaatcaggcaagagaaagaaataaagggtattcaaataggaagagagaaagtcaaattgtctttgtttgcatatgacataatcttctatctagaaaaccccatcgtctcagcccaaaagctacctaaactgataagcaacttcagcaaagtctcaggataaaaagtcaatgtgcaaaaatcacaagcattcctgtacaccaacaacagacaagcagagagccaaatcatgaatgaactcccatttacaactgctacaaagagaatacaatacctaggaatacagctaacaaggggagtgaaggacctcttcaaggagaactacaaaccactgctcaaggaaatcagagaggacacatacaaatggaaaaacactccatgctcccagataggaagaatcaatatcatgaaaatggccatactgcccaaagtaatttataaattcagtgctactcccattaaactaccattgacattcttcccagaattagaaaaaaactattttaaaattcaatatggaagcaaaaaagagcccgtacaagtcaagacaactgtaagcaaaaagaacaaagctggaggcatcacgctacctgacttcaaactatactacaaggttacagtgaccaaaacagcatggtactggtacaaaaacagacacatagaccaatggaacagaatagagaactcagaaataagaccgcacatctacagccatctgatctttgacaaagctgacaaaaacaagcaatggggaaaggattccctatttaataaatggtgctgggaaaactggctagccatatgcagaaaactgaaactggaacccttctttacaccttatacaaaaattaactcaagatggattaaagacttaaatgtaaaaccccaaactataaaaaacctagaagaaaatctaggcaataccattcaggacatggtacaggcaaaggtttcatgacaaaaatgtcaaaagcaattgccacaaaagcaaaaattgacaaatgggatctaattaaactaaagagcttctgcacagctaaagaaactatcatcagggtgaacagacaaccaacagaatgggagaaaatttttgcaatctatccatctgacaaaggcctaatatccagaatctacaaggaacttaaagaaatttacaagaaaaaaatcaaacaaccccattaaaaagtaagcaaaggacatgaacagacaattctcaaaagaagacatttatgtggccaacaaacgtatgaaaaaaagctcaagctcagtatcactgatcattagagaaatgcaaatcaaaaccacaatgagctaccatctcacaccagtcagaatggcaattattaaaaagtcaagaaacaacagatgctggcgaggctacagagaaataggaacgcttttacactgttggtgggaatgtacattaactcaatcattgtggaagacagtgtggtgattcctcaaagacctagcaccagaaataccatttgacccagcaatcccattactgggtatatacccaaaggaatataaatcattccattataaagatacatacacatgtacgtccactgcagcactattcacaatagcaaagacatagaatcaacccaaatgcccatcaatgatagaccggataaagaaaatgtggtacatatacaccatggaatactatactgccataaaaaggaatgagatcatgtcctttgcagggacatggatggagctggaagccatcatcctcatcaaactaacacaggaacagaaaaccaaatatcacatgttctcacttataagtgggaactgaacaatgtgaacacacagacacagggagggaacaacacaaactgggacctgtcgaaggcggggagggggagggagagcatcagggaaaatagctaatggatgctgggcttaatacctaggtgatgggttgatagatgcagcaaatcaccatggcacatacttacatatgtaacaaacttgcacatcctgcacatgtacctcagaacttaaaattaaaaaaaaaattggcaaaagatttgaacagataattcatccaaaaaaaatatgggtgggaaaaaaagcacatgaaaagatgctcaatatcattagacattaagaaaatataaattaaaaccacaatgcaatatcacctcgtatctattagaatgtctaatattagcaagactggccatatagagtgttggtgaggatgtgaacaactgaaactcatacacagtgcaggtggaaatgtaaatgatacaatttttttggaaaagagttggctgtttcttcaaaagttaaacattacatctgccatatgatccagacattccactcctaagtgcctactcaagagaaagacagcacacgtctatacacaaaattgtacacaagtgttcacagcaactttatctgtaatatcccccaactggaaacaaccaaatattcatcatcagatgaatggacaaacaaaattgtggcacgtccaaaccacggaaacactactcagcaatacaaaagaataaactactgatacaaatcataacatggataaaatgtaaaataatcatgccgagtaaaataagccagacagaaaaaggatacatactgtaggattctacttacataacattctagaaaatacaaactaatatataatgagagaaggcagattggcagtcgtctggggactagaggtgtgggagagaggcattacaaagggacaccaggaatctcaggaatctcatggcagtgatggatggatgtgttctctgtcttgaccgtggtgatggttgttgcataggtatatatgtatgtcaaaacgtacccagttgtacataaatatatgttcggtttacatatcagttataccccaataaacctgttaaaaaatgacatgctggctgggtgcagtggctcacgcctgtaatcccagcactttgggaggctgaggcaggcggatcacgaggtcaggagatcgagaccatcctggccaagatggtgaaaccctgtctctactaaaaatacaaaaaattagccgggcattgtggcacacacctgtagtcccagctacttgggagcctaaggcaggggaatcacttgaatctggaaggcggaggggttgcagtgagccgagatcatgccactgcactccagcctgggagacagagagagactccgtcttcacaaaaaaaaaaaaaaaaaaaaagacatgcttccctaggccgggtgtgatgatggctcacgcctgtagtcccagcactttgggaggctgagacgggcagattgcctgagctcaggagttcaaaaccaccttgggcaacatggtgaaagcccatgtctactgaaatacaaaaaagttagctgggcgtggtggtgcgtgcttgcaatcccagccactcgggaggctgaggcaggagaattgcttgggcccaggaggcagaggttgcagtgagccgagatcgcaccactgtactacagcttgggtgacagaatgagactccatctaaaaaaaaaaaaagacatgcttccctaaaggctgcatcttaggaaaataccttttagtagctttgctaactgaacatactatcttcattcattatctcccactgaatgaatccagattttaaaatgtcatctgagtattattgacatcaatttattgtaacactagatcctttatataatgaaaatcctcattcatctacattgatcaaaattaactaacaagctgacaaagctcctctttgcacaaacacaaacccagtaggaaagtcatcaaactaggaagtcaaatcagccttttctgtaatcacattgaaatccattaatacctgagtcagaggtaaagacaaatactgtacataaaaaatattatgagaaaaccacaaaagaattagagctatatgtacagcaaatgaatttatctatggaaatacattttagaatttattgtgaacttaattttttaggtatacacataattaaaaaggacaagtaacttctgagctgaaggtagaagttgaagttatatatacagttatgtactcatgggtaacacagaaagcagaatgcaaaataagaaatgttcacattctatatatatatatatatatatatatatagagagagagagagagagagagagagagagagagagggagggagagagagagagagatggagtctcgccctctccccaggctggagtgcagtggcgtgatcttagctcactgcaacgtccgcctctcgggttcaagcgattctcctgcctcagcctcctgagtagctgggattacaggcggcccaccaccacacccagctaatttttgtatttttagtagagatggggtttcaccatgttggccaggctgttctcgaactcctgacctcaggtgatatgcctgccttggcctccgaaagtgctgggattataggcatgagccaccatgcccggcctcaatttagatatttcataaactaaggccttattaacaatttctgacagaagaaaaatgcaacctttcttatctatgtaatctaaaaaggagagaggataacgaatgaagcccagagatgtggaagatcatgctctctgttgatgcaatcacatttggaatttagttcaatatatcagtcaaatccactcttatctccctgccactaccaggaaaaaacatctaaactctgataattaaaaataacatacttaccatgaaaattttccaaacacagtaaatagagaaaaagtaaccaagaaaattaaaatatttccccttgaaggttttggagtattctattctctcctgggggaaaacaaacacaaaacatagttttcagcaaaatataaatttatattcaacacaagtattcttccctctatgaatcactgttcaggctaagtcaaaaaaccatacattgtaataatattaaactaataacagtagttgtggccagcatttactgaatgcttgcttttagctagagactgggataaacatcttacatgcattatccacttaatcttcataacaattcttatgagatacgttctattatcttaattttacagatgagaaaattgaggctttgagaggttcgataacttgctcaaagtcacacagctggtgagtaggctcaggtttatctgtttccaaagcctatgttaacctctgtcctataaggttactcctgtaaagttatcctcaaaaagaattaaaagtttgtaatcttcactaacagattttgcacatttaaattatattttattttaggtgtacataggaaagttacttcttacagtttcgacacttattgacctggatcctttaaaatagggctaggccatccatggcagataggtgtctactgctcttataatattactaacttataaaggaataaaagtagctaccatctttatcccaggttagtaggaggtggtacgtgccaccttcctaaatgttgaaaagcctcttctgactatcccaccaattgctacttttgagagtgttccattaaggattttgctagtgacaggagcaatttcatgaagagtgaagatcccttatccctaatgcttcatggctgatatagaagctgtgaggtatctcttgcttggccacagagaaatctaaaaagccatttagtcttgttctctctttaataatattggtaaaaaccacacttcagtttccttgctctgtaccttggtagcatatagatcagctgtttccagaaaaagctgcctgcttaattcttccaaagcatccacttcctgttgaataagagtaagatctggcacagaatgggcatcaaggttttaatcacataggaattcaagaaatggcaatgagaaagcatatacttttggtttttcctacagtggattcccggagttgcctatattctcaatttcctgtttcatagccagcagcgctacttcagagcagctttcccaacctctgacgcaggtgtgtaaaagcttctccatcaagagcatcgccaccaaacaattaccactcagtttctcttaagcagctcaaacagatggtttcatttgttttttgatttaactagttagattaagtcaaatgtaatgttcaagattgtaaatagttacagaataataactataataaagcatagctttctcctacattatctgaatataatgttagaaaagggaactaatactttactgtgttctaatataggctaggatttacagacattaccttctttcttttcaaacattatcttcttttatatcttatcttcatgggattgtcttatgccatggtgttatccattttgcacataaggaaagtgaagctcagagagttaaataacttgctcaaagtcacacaattaattgatagagatgcaaagtcaaatcctcttttcctccaaagcctgctctttccattacactatgttattttccaagaactcaatcaggtagagttattattctcccatttagagaacaggggctcagggaggttaaataatcctgatatgtttgttaactcattactaacacagctcaaacccgtattattggcttttatgaacttttaagtaataaacatagtaaatacagccccttctaaaatagaagcacatacttcaatctaaatcctccctcctctctgatttttcccactattacccaaatcagtaagtgcccttcagttccttccttaatagtggctactactggcatggttcaagccaccaaacaatatggtttaactagttacatgtctgtctctcccatgattagagggtaagctccttgaggagaaaggctatactctactcatcattttatttcttagcactcagcctggaaataggagatacgaaataaatgtttcttggttaaataaatctaaattaatcctttttctttctcttccacaatcatcttgcctttctttgatcttattcttatcttcatttgacaccaggacataaatcataatttgtagcaagaatagacatccttctctaattgaggcaaaagggaatttgtatttccctgggacagagaaggaaacaggagtatgctatctcatgcttagttccccaaagttttgacctaatagcaccagagccacacagaaatttggttacataatttgggaagtagttcaacatcataaccaatcaggaaagaacagtttattaatctattaatcaaatctcctttatcctttcttttttattttgagacagggtctagctctgttgcctaggcaggagtgcagtggcgtgatctgggctcactcctacctcagcctcccaagttcaaacaatcctcccacctcagcctcctgagtagttgggattacaggcacatgccactgggcctggctaatttttgtattttttgtagagatgaggttttgtcatgttgccgaggcttgtcttgaactcctgggttcaagtgatctgcccacctcggccttgcaaagtgctgggattacagggatgagccactgcacccagcctccccttgattctttaaaccaaaatgtcactggagaagcagagctacttaaaatttgtttaggaatactaattactttagaaatgggccatttattttaggtagccattatgctttatggtggtttttcagagttgagaaatgtaatagtgtagtggaaagaactatgaagaggagaccacagttatgtttctagctttgccacaaaccaccgtgtgacttaacctctctgggtctattttctcatctgtaaaatggaaaggctgactttttaggaccacttcagctcaaagacaatgattttatgatattgtgcaggtgctggaaagatgactgtacacatggtatttcctaagcctagctcttaggagtttggactctgatgtagtcaggtaccttagaagggactatcccaacactactttttttcttttgctcttggtccagagttgagaaaaagaatcaagcagagggacaaaggatactttcacttcctgatgctgaagtggtaacactttttatcattccccagaaacctgatggtttgttatgcacttcccccttctggaacattgttctccgtgccattgccatcctgaaatgaaagaaaatataaagcctcagcaagcaagcatggaccctcacagtctagtcccatccattttccagtctcacaactgcctctcatgtactgagctgtttatgtaaggatactgattctggagtcctacttttctactacttacaactgaagggaaactatgtggaagcaatgtggcctgggtgaagaagcacagaatttgggctaggcaataaatttgaggactggctctgctatttggaagctgggaggtcttagagttttcatctcctcatctctggatggttgtgaagataaatgaaataatacatatgaattcatgttcatatgaggcgctatacatagtttaattactacagttaccatttaaagacaaaataaaacagctaacatacctggctgggtgtggtggctcactcctgtaatcccagcactttgggaggccgaggcaggtggatcacctgaggttgggagttcaagaccagcatgggcaacatggtgaaaccccatctctactaaaaatacaaaaattagctgggcgtggtgacccatgtctgtaatcccagctacttgggaggctgaggcaggagaatcgcttgaacctaggaggcagaggttgcagtgagctgagatcacaccactgcacgccagcccaggtgacagagtgagactccatctcaaaaacaaaacaaaaacaaacaaacaaaaaaaaccagctaacatacctaactaaaggaccaaatacagagtttggaacgcaatacatgttttcttccttctttttcaaaggcagacaaaaggaaaaaaaaatagcaaaattgcataaacctgtccccttctaaaatatcagtctctaagtccaataccctcaccttctgcaatctgtcctacaggtgaataaatcaacaggaaacctaccactcctggtcctctcagtctgtggaggaccgactagtacagtggtagctgctggcatgtcccagctcaccacaaaggtatcaacagggtcctagtgaggatcaaaataaaatatcatttgtacataattgatttaaagggtttaatgggccaaggcctacaggcataaaatgaactaggatgagtctaataaaaatagagtagcaggaccaaagaaaaatgtaactcaaggtggatatttttgggaggcaaaagataaaaatggtgaagagcaagcagcagcattggtatttatgcctgggactaatacaaatagtaccaatggtaccaaagatcaaatgatatttctatgggtgaaattttttgagccattagctaaaatgatattaacaagaaagaatgtcagccatgttgacttaactgtttccttttgaaaatgacctttgcctggatactgagtgaatgaaacacagctcttttagctctttctgcctttcttctaactacacatctactatcactcaccattttgggaagatgtaataaacaaccaagaagaggctcagacctagggagattctgacttgtaagattaaggcttagtaattctaggtttttatattttcatagttgaaaaagctagaacacatatacaaagaaggcaagggttctattccactcatttaatagttcatttcagcttaacatgcaggattaaaagaggcagttgtgagagaggaagcacagagctcatttctattgtccttattttcagtgtctacaacaaacactaatgactggctgtggagtggaatcgattgaatatgtaaaggtgattgacactgtgctgtggtctcataataggcaaagaagtgtaatcactagaagtgaaagttagaggcacatagacaagcatggccttgttttaaacaattcacttttactttcaattgtatcaagaatctattaattctaaaccaattttgctcttatcaaataagttgtagatgaaaaagaaatgatcatatatttaagaaggtaacaatattaaaccttccgaagcgtgaataggaatgaaaaaaccacccaaccatatgaggtactatagaattagatcaccttcatcttcaacttttctttactatcatcatcactattgcctctttataacaagggtagcttacaaggaattatctatttgttattagcccaatgtcatttaaaagttcctaatatggaaaaacatatgcacttggctgaggtttggtagtagtgcacaacagaagaagctaaaaaatgtctactgaggtttaaatgtcagtcaactattttctggtctctgttgtttctagtaggaagtcagccattacttttttttagttaaactttttgaaataattgtagattcataatgtagttttgagaaaaaatgcagagattccatgtaccctttacccagatttcctcaactgaaatatcttgcaaaactctagtacaaccaggatactgacattgatagagtcacaatacgggacatttccatcactacaaggatctttcagggtgcacctgtacagcttacctccctcccacctccaattccttaattctggcaaccacgaatctgttctccatttctgtaattttatcatttcaaaaatgtatatataactagaatcatacggtatatattctttggggattctttttcactcagcgtaattttcataaacattcaagtacagtttttttgtgtgaatataaatcttcatttctctggataaatgcccaggagtgcaattgttggggtgtggtaacggcatgtttagcttttaaagaaagagctaaactgtgttccagagggactgtaccattctacatggatgccagcaacgtatgagtgatccagttgctctgcattcttattagtatttggtgttgtcactaatttttattttagctattctgataggtgtgtagtgattatctcgatgtagttttaatggcatgtccataatggctaacaatgttgaacaccttttcatgtggttatgtgccatttgcatatcctctacaataaaatgttcatcatttttgcttattttctaactgcattttttttaaatgtaagctttgaatgttttttattctagatactagtgctttctcaaataagtggcttgcaaatattttctcccagtgggtagcttatcttttcatcctcttaacagtattttttttttttttttttttaagaaggagtcttgctctgtcacccaggctagagtacagtggctccatcttggctcactgcaacctctgcctcccaggttcaagccattttcctgcctcagcctcccgagtagttgggattacaggtgcccgccaccacgcctggctaattattgtatttttagtagagacggggtttcaccatcttggccaggctggtcatgaactcctgaccttgtgatccacccaccctggcctcccaaagtgctgggattacaggcgtgagccaccgcaccgggccttaacagtcttttacagagcgaaagtgttaaattttgatggagcccaatttatccattttttcctttcatggattttatttttggtatcaagtaaagaactttttgtgtagcccttgattccaaagattctttttttttttttctgaaagttttatagttttacattttagtctattatctgttttaattttttttttttgagacggagtctcgctctgttgcccaggctggagggcaatggcggatctcggctcactgcaacctccacctcctgggttcagcaattctcctgcctcagcctctccagtagctgggattacaggtgcccgccaccacaccgggctaattttttgtatttttagtagagacggggtttcaccatgttcgccggtctagtcttgaactcctgaccttaagtgatccgtccgccttggcttcccaaagtgctgggattacaggcatgagccaccacgcccggcgtgttttaattttatataaggtgtaagacttagatttagattcattttttaaacctatggacgcctaattgctctagcaccatttggtgaaaggttatctttcctccactgaactgcttttgcatctttgtcaaaaattagctgggtgtatttgtgtcagtatttcttttcttttctttttttttttttttgagacagagttttgctctgtcacccaggctggagggcaggggagcaatctcagctcactgcaacctctgcctcctggattcaaacaattcttctgtctcaacctcccaagtagctgggactacaggcgcatgccaccatgtccagctaatttttgtatttttagtagagacggggtttcgccatattggtcaggatggtctcaaactcctgacctcaggtgatctacctgcctcagcctcccaaagtgctgggattacagacgtgagccactgtgcctggccatgtgtcggtatttctgggttctcttttctgttccagtgatctatgtctaccagtaccacagtcttgattactgtagctatataatatgtttaaagatcaggtagaggaattcctctcatactgttctttttaaaaattgtattaactattctagttattttgcctttctgtacaaattttagaataattttgtgtatatctacaaataaatcttgctgggattttgaaatgaataacattaaatttgtataccaatttggggagaattaacatcattactattcaagtcttccaatctattaacatggtttatttatatcttatttgatttttttcattagttttataattttcagcaaacaagtcctatatacatgttttgttagacttctatgtaagtatttcattttgtgagtgattgtaagtagtgtatttaaacatttgatgttcatatgtccgttgctagcttatagaaagacaattgatttaaaaaaattggattttcaagatggggtcttgttactttgctctcaggctgcactcaaactcctgggctcaaacaatcctctcgctttagcctcttgagtagctggtcaagcgcattcaccactgctcctggctacaactgatttttgtatgttcatttggtattctacaatgttgttgaataaccattacttttttttttcccattgttgccctgtatgtatcattttccccttgttgctttcaagattttctctttacttttgccttttagcagtttcactatatatacacataggtgtagttttcttatgttttgggctggtatttctttcaatgctttttctgcccctttccttttctttagaactccaatcacaagaatgttggactgcttgatattgtctcctactgagacttttgttgagttttcttcaatatttttttaaaaaaatatttactatttttttcttctttttgagacagagtctcgctctgtcacctggggtggggtgcagaggcgtgactgcagctcactgcaacttccgcctcccaggttcaagccattctcctgcctccatctcctgagtagctgggactacaggttcccaccaccacgcccagctaattttttttgtatttttggtagagacggggtttcgccatgttggccaggcctcaagtgatccgcctgccttggcctcccaaagtgctgggattacctggccatttttcttcaatcttttatctattcttcagattaaataatttctattactctatctcaatttttatttttattttatgttttgagacagtctcgctctgtcacccaagctggagtgcagtggcatgatctcagctcactacaaccttgcctcctgggttcaagtgattctcctacctcagcttcccaagtagctggcactacaggcacgtgaaagcatggccagctaagttttgtatttttggtagagacagggtttcactatgttggccaggctggtctctaactcctgatctcaggtgtccaaccacctcggcctcccaaagtgctgggattacaggcgtgagccaccatgcccagcctgaatttttatggatctgattcttctgtcatctcaattctcctgttaagcccacctagtaaaatttttatttctgttactgtagttttcagtctttggatttctattttgttgttttttaaaagtttccatttctttgttgggattctctcttttcacttgtatcatgctttccttcacttttttgaatatatttgtaatggttactttcaagtctttgttaaatgtgtaatctggatccacttggagttagtatctattggctgctttttatcttgaacattggtcacatcgtcttgtttctttacatgtctagcaagttttggttgaaggtaatatgttgtagtgactttggaatctgttttgtttttctgagaattgttaatttttttggtactagtaagcagttaatttacttaaactgtgaaatctgtcatacctgcagcagctaatgtttctgctcagtttcttggtttctagcttctcctttttagcctaactccctgatattctctgctgagcttgagcttgtgtagggtagtggtagtctggacaaattctatagtcatattttagggcttatcctctctgtggatcttttgcttctagggatctctcctaaattttcaactgctttgccagtcctgagatctaccctctgacacctcaagccagaaaagctttcactttctgtcatccaaactgtgtgttcaacctgcacatagctcagaaaatgcactcaatcaaaggcacagcaaccttgcaaatcgcaccaagaagcagttcagtatatcaagcatagactctcttccagtttctgcctatttttctcaggctctttggtgtttaccgtggaaatacattatttaatgatgacacagagatttgggaagggtttatactgagattttggatattagtccttctgcatttccctcatttccaaaatttcccctttaaatgttcagttactcagctgatttaaactcttaccaatctgtacacttgagtgggtgctggcagggggggtggtggctaaggggcacttccaggcaagaaagctatcaacttgcaatagttacctgatgctcttctcaaatttctacctgcctctgctcattttccagtaacttcaaatacttgcttttaatattttttccagtttttatgattttctgtagaaagaattgcttaaattctttccactgtcatttctggaagtttcctctattgagaatggctgtgggtattgctgaaatttcactagtgaatatatttcttcctcctatctctacaaaatttcaaagaggtcctagaaaactaattcaaggtagaggttaacattttttccttcactgttccaaacaggaagacgtatgcctctttcctcctcccattttaaaccattaacttttttgtacataacaaatgttacttttcttgtatgtcatctcactatggccctctactgttaaggtgaaagatggttttctggtcactactcctccccaactatgaatgtttgcaaaaacagtttttcttttttattaaaaaaaattttattttgtaaaaccacttgtaaacaacaaaaacagtttttctatattgtggtaaatggcaagggcattatatgaatcccaagggccccagtgttgtcatgtttgctgtctatctgctctgttagttccactgggtaaaggactgtggtaacggggtcacgttgggaggctgattcttctgtgagccactcaaattaataaaacttactgtcggaccacaaaccattcctgatcctgaccagacaatgcattataggggaaatgggctatagtatgtatagatcagagtcaattccttagcactattagtatgaaatggcttaaaagtatgtatacacacttgacaagggtcatgacttcactttttttttttttgagacagagtctcgttctgcccccaggctggagtgcagtggtgtaatctcggctcactgcaacctctgcctcccgggttcaagcgattttcctgcctcagcctcccaagtagctgggattacaggcatgcaccactatgcccagataatttttgtatttttactagagatggggttttgccatgttggccaggctggtcttgaactcatgacctcagcctctcaaagcgttagggttacaggcatgagtacccggtcatgacttcacttttatatattcatttctttatatgaataaaagaaatacagtgagaaagagaatagccttgggaatcaaaatagtattgtttacataaatctttcacttttgaataatcttgctctactttttaaaatctgcatttatatacactcatgtaaaataaacaataaatgtaaataaaataaattatacacgtgtctaccttcaatagcctagtaaagacatgcagaaatagagacaaataattagtcagtgaacctgagccttcatcattctttttttttttcttttttgagacggagtctcactccatcacccaggctggagtgcagtggcgcgatctgggcttaccgcaagctccgcctcctgggttcacaccattctcctgcctcagcctcccgagtagctgggactacaggtgcccaccaccacgcccggctacttttttgtatctttagtagagatggggtttcaccgtattagccaggatggtcttgatctcctgaccttgtgatctgcccgactcggcctcccaaagtgctgggattacaggcgtgagccactgctcctggcctttatgtctaatgttatctcttacattaaggcttctttaacttgactatgggtcttactacagaaaagtgttgaaggaggaaatatgaaatgtgaaaatactcatgcaattcaaaacctgttaccatttacttatgggtaataataactttaataaagagagtagactaataagcttcatgaaggtaagaaatgattatcttgttcatcattctatccctagcatctagtacagtgcctggcgtaaactaggttttctaaaattattaagtgaatgaatctatgaatgaataaatgaaggcaaagcatgaaaagcaaatgattgtactgtagagactattaataatttcagtagttgtccttagctatatgtgggtcattgttctaagggctctaacttgtttttctaagtcttaactcattattattacctctattttacaaatgaggcacaaagacataaagtaactagttcaaggtcacaccattaagttttagatcaaggattcaaattcatacacagtctgatttcagagcctatgcttttatacactgtgatatagatttctatgaaatcccaccttgaaaatacacattttaaaagtactttttaaataacaaagatgatatagaggacttaaatgattttaagtagttggaacgaaggaagttgagatctaagtcagatatgtaaaagattgtaaaaaattaaggaaaatagacttaaaaaaattcaggacaataaggctgggcatggtggctcacgcctgtaatcccagcactttgggaggccaaggtgggcagatcacttgaggtcaggagtttgagaccagcctggtccaacatggtgaaaccccgtctctaccaaaaatacaaaaataagctgggtgtggtggtgcgcacctataatcccagatactcgggaggctgaggcaggagaattgcttaaacctgggaggtggaggctgcagtgagctgaaatcacgtcactgcactccagcctgggcaacagagtgagactccgtcttaaaaaaaaaaaaaaaaaacacaatagacaatattccattctttgaatacaaaaattatacaccagtccatgagcatgggatatctttccatttatttgtgtagacttcaatttcttctattaatgttgtatagttttcagtgtccaggtctttcttcccccttggtcaaatttatccctaagtattttttcttgtagctattttaagtgggatggttctcttgatttcatttttggaatgttcattgaacattagtattgttaaaacatccatactacctaaagcaatctatagatttaatgtaattcctatcaaaattccaacgtcatttttcatagaaatagaaaaaataatcctaaaatacacatggaaccacaaaaaactgaattgccaaggcaatcatgaataaaagaacaaagctggaggcatcatactatcttatttcatattatactacaaagcaatagtaattaaaacagcatgatacaagcataagcacaaactcattgaccaagggaacagaataaagaacccagaaataaacccacacatgtatggtcaattgatttttgacaagggtgccacatgtacacactgcgaaaaggacggtcttttcactaaacggtgatgggaaaactgaatatccatctgcagaagaatgaatttggacccttctctcacttaatatataaagattaactcaaaatggactaaagacttaagcctggaaactataaaactagaagaaaacagggaaaaactacacaaatcatgctctgagcaataactttttagatttaacccccaaagtgcaggcaattaaagcaaaaatagacaaatgggattacatcaaaataaaaagcttctgcacaacaaagaaaacaattaacagagtgaagagacaacctatggactgggagaaaatatctgcaagccatatgtctgataaggggttagtatacaaaatacataaggacctcaaacaattctacagaaagaaaacaaataacctgatttttaaatgggcaaggaacctgaatagacatttctcaaaagaaggcatacacatgaccaacagatatatcaaacaatgtttaacatactagccattaaggaattgcaaactaagacacaatgagatatcacctcatacctgtcagaatgactactatcaaaggggcaaaagataaagaacattggtgtggatgctgagaaaaggaaaccctattacattgttggtggaaatataaattagcacaaccctatggaaaatagtgtggaggttcctaaaaaaactgaaaatggaattgccatatgatccagcaatcccacttcttagtatttacccaaaagatctgaaatcagtaaaatgtcaaagagatatctgtacacctatgttcactgcagtattatttacaatagccaagttatggtatcaatctatatgtgcagcaacagaaaaatggataaaaaagatatggcatacatgtacaacagaatactattcagccttaaggaaggaaattctttcatttgtgacaacttgaatgtaactggagagcactatgctagcaaaatgagttggacacagaaagacaaatactgcatgttctcacttatatgtggaatctaaaacagtgaactcaacagaagcagagggtagaatgatggttaccagaggctggatgggtgggaggaatggagagatgatggtcaaagggtacaaagcttcagttagacaaggaggaataaggttttttttctttgcaacatactgtacagcatgatgaatataataaataataatgtattgcacatttcaaaatcactgagagtaaatttcaaatgttttcaccacaaaaaaataaacatgtgaggtgatagatatgttaattagcttgatttaattattccactttgtatgccacaaatacatacaaccataatttgtcaatttacaatttaaaaaattaaacaaaaaaattctaataatttatctaaggagaatgatctaaattcaagaaatgagattgaattttctttcacacaaaacactaaatctttttaaaaaaattttttatatttttaattttattgttattttaaaggggtggggtctcactatgttacccaggctagtctcgaacttctgggctcaaatgatccccccgtcgtggcctcccaaagtgctgggatcacaggtgtgagccactgtgtccagccaacactaaatctggtactttaccttatagtaaaaatgaataagataaaattccctgccagcaccaattcacagtcaaattttcttgttgagaaattgtaagagtccaaatgtattacagtgttgatatcttaccttttctttttgcttatgatcatatccatggtttgcagcagtcgccgttccagggctagaatatccgtgtcagtcacattcctacaaaaagcacaaactgctagcaaaatgttttggggtcccactcttgggcatgatacagggtatctggagacaaacatagacttcaactgttacctactacttttttctagaaaatagtaaaatgaccataataaactaaaatgcctttgctctcatttcttatagctaatcctctgggatctcagggaaatggaattcacccagctctcttacagtttttcttagctttgatccagttacatttatatatatatataaaatatatatttaaatatttttattttattttttattatactttaagttctcggatacatgtgtagaacatgcaggtttgttacataggtatacacgtgccatgatggtttgctgcacccatcaacccgtcatttatttatgaaagagtctagctctgtcgccgaggctggagtgcagtggcatgatctcagctcagtgacatttaggatgtatgtttaagcacacttttaacttggcattgtcttctactgttctgttaatatctaggaggggagctgaactgctgaagttggagttggtttatactgctggtcactagaaatgtgcctttaaaaaagtgggaggggagtgtcagattgaaatttgccatttaaaaaataaatgaatgtaggacaaataataaaggcaagccgtacaagtgataatacttatttagaaagatttccaggtcaatgcccacagggacagaggaagagaagaataaaaagacagtgtcatagatctaatatataatcttaaagatggtggcataatatgacatatgtattcaagaagtaatggggcaaaaaagaaaggatgcaaagcgctctgttacctgaggaagtaagacatgtaagtgtatgggcagttgacagcaccaaatccagaaagaagagccatgagagtcactccaatcacaccaacccggctgatgagctgttctatggataagatccctaaaaacatcaaggcacattaatgccaggtaatatagacaaaatggctctcatctgtactgcaaaaggaaacattatttaaaacattaaccattacacataactaactcatacaagccaacttttaattattaatgtgtagatgatttataataaatatactaaaagtttactgattttcctcctgtcccatatgcttcagagtgatctcttttattgggtgatagcagtaaaataataacaacaataattataaataacaatcattgactgtttactcttggtagcatgaatgctaacaaagcaaagtacttttagtaaaagcatcggccaaaaaaaaaaaaaactaagaaagtaaatctgctggaaaagtataaatagcaggaactactttgtgctaattatctttgatatatatgtatttcccctaaggtgatactcttttgcttttgtcttattcttttttgcatccaataaacacagaattcatctaataaaaggactaaacttatagatgaatgagtaattcaaaggcaaacacatcagtttcggattataaattgtatcctaattatcaattgtttcatatcacgtgagaatgctgaaaatcaacttagcagttaaaataaatactgctggttgatgtatttgggataaatgagagaaagcaatgctgaagaataactcagtaagtttggcattgcagaaaaagaatggttttaactggttttcactttctatttctaggatagaattcactacagccatccactcctatggtcaaatgccagagctataattcaggaattctgtcagcttcaaaactgaaaattccaatattccttttctgactactggcctccattcctagtctttctatttccactacactcgttttagaggtcagtgcaacctctggtcttctgcttctccattcttcacctagcttggactccaggcttgctggcttcaaattctctcaccaggagcctcaatctcctactatcttccttctgaagcgctaatcctacaaattcccaactctggatcagtctaacactctgccttccctgtgcccatgttttgctgcctcaaattgctagaatgcgtactgattttggagccattacaaatgtatggtctccagtcctaagagagctctcacactattgactaatccttatcttgcccttggtcagccatctctctccattgtcttcggcagttactctttatttttcctacctttgtccttctcctttgccaatgtccttattataaaagacatagctattagccataaactaccttcactctacactatggtcatgaattttctcctggttgcaaaattcaacattttccaatctttgttttatgggctgttttataacattgaatatacatctgcaatcatcctcccaacttgtctcccttagaacaaagtagcatccaaagctgacttctccacttgtgcttctgatcttctctgggccctgggaactgtctcatccttatatgtgagttctgggatattgctagtgataatcttggtgctatttgtttttggttttctgccaggggggtaagcaaagccagcttgcccctacgccaccatcttggaactagcagtcaccatacttttgattgtattcaatcccttccacctctttcagagtcttgttccatcatctgtctcctctctcttgtatattcaatatttccttctttgctagttctttctctttagtttcaattctcttttctaagagaaattctgttcttggcttcgagtttacgtctagttaccaacccccatctatttcctccttaatagccaggcttcttaaaagaagtttatagttattgtcaccttttcttcacctccagttcattccttaactgactgcaatccagctttcttcccattcttctttattgaatgaaattactttcactagtaattgtaatggcaataggtaatattcaccaagcacctgctatgactaggcactgttctaagcatttcacatgttctaattcatttaaccctcataacaatcctatgaggtagatattattgaaaacctaattttacagatgaagaaatggaggcacagagaggttaagtaacttagttaaggccacacagataaaaggggcagagtcaggattcaagtgcagtctagctccagagtctgggctttaaccactacgacactatggtaataagttttcccctggttgcaaaattcaacattttccaatccttgtttcattggctcttttatgacattgaatcatttttgtttaaaattattttatcttcttggcttccacaacaccatttccctaggttttcccttttacttctctaattgctttttcttggtcacttcttgctctgtctggaccagagttctcactttcatttcagtatacacattttttgcttaggtgatctcaccaatttccccagcttcacctaatggcatttagttgatgatttctagttgtttagattcctggagtcatctctatgaggactgatacatgtacaccttttccctaagctcctgatttgtacatccaattgcttatttaacatcacctggatatgcataagtaactcaaattcagcatataccaaactaaaattatctttcccctcaacttgttccttcctctgcattacctgtcttagaaaatgacataatcaccctaacaataaaatctatacactatacgattactttccattctatctcttgcctttccttgaatacaccaaggtctttctgcctcagggctttacatgatgtctcctgtgccttcttgctgggtcttcctttggtcttgtcctttaaatctcagcttaaatatccctgtctcagaaagggtggatctaactgtttgcactacattatcggcatttttctctatcacagcaacctgttcactccttgatgacaatgatcacaattggcaattatttatttatatatttacctctttattgtctagttccacccacaagactatcaatttcaggggggcagaaaccaagtttgtttcgtttgtggtttatttccagtgcttaatttatataaagtggatgctcaataaatatttgtgtaatgctgaatgaacgaataaatcctcacctaaattctgttattctacttgccgtatacctcttgaatttgcaacccctttacaagaagacatcatttcttattgatctttgttttccttactgcttggcacatatgaggtgttcaacaaatgtttgttgactataatatcactcagtaacataaaaaatccaagagattaatatgggctattaaatttgaaaaactgaaaaaattccccctctacctttattccttttaacatggtgtctttgtccttttattacatatctttttctggtttaaagtactttgtagatactatttacttaatctcagcatttctatgaagtaggagtcagtcatcattatccccatttagcagttaatacatggaaagtcagatgaataaggagactagcagaagatcatctcacctttgccacctgctcacacagattccttacagtcttttgtaatctctcttactctttcccactaaggacattccaaggttggttcagacaccgcacaagaagtacttttacagattatctttttttcattttacataaggattggtcttatctttttttttttttttttgagagtctcgctctgtcgcccaggctggaggggagtggcacgatctcggctcactgcaacctcagcctcctgggtttaagcaattcttgtgtctccggcctccggggagtagctgggattacaggcatgcaccaccatgcctggctaatttttctatttttagtacagatggggttttgccatgttggccaggctggtctctaactcctggcctcaagtgatatccctgccttggcctcccaaagtgctgggattataggggtgagccaacctgcccagcccatttttttgtggtcaccacagcaataaacaaccatactggttgttgggacagtcctgggaaagctctaagaaggcagtgtaaggctggttgcttctcagctactacctaaacttttcttcctccttacttatcttaaagggttaaataaattaagatacctgaacattcaggcataaaactgtaatgcctattggagtacaatggaaagaataaaactgaaactatctccctagctttctccctcagtgtccttttcagggtaatcccatagaatttagaaaaaggggtggatgaaaggacaatagatacaatggccttcatcttccctctggtgcggcctggctgcactggtcatgtgagctgaatgcacacaggagaaagctggagaaaggtgtcagagtcgggtctttgtagtgcatgtgagactgtatttgccctgtcagcagccctgggggccttttctaactcttctctctgacttctaccgtcacagataaatgtgtctgtctgtgggtttctttgaaataggtttatatgagaactatactaccaggactctttagtgcaagtcgttccctttgttgaccattgacataggcatgctgatcacattagcatttcctaaattcctatccagagtgttaaagtagtaaactcatctaccactttggagagactcaattttcttccatccactgattcaaagaacacgtattaaacacttgttatgtgtcagtttccacactaggcactggggatacaaagacaaataacatggagttttctgacctcagggagcccataggttgatgaggaagttagaaaaggaaacatgaaattttaagttttatagatgatatagataccttgagatggtagcaattaatatctcctaatgatggccaggaaaatcttcctaaaggaattgacaagagttgaatctagaaaggataaataggcattttctaggtagacagggttggtgaaggattgtccaggctgatagaacagctctagaaacttgaggctgggtgtggtggctcatacttgtaatcccagcactttgggaagctgaggtgggttgatcccctgagctcaggagttcgagaccatcctgagcaacgtggagaaaccccatctctatgaaaaaataccaaaattagccgggtatggtggcatgcgcccatagtccccgttactcaggaggctgaggtaggaggatcacttgagcctgggagtcggaggttgcagtgagccaagatcatgccactgcactccagcctgggtgagagtgagacctgtctcaaaaagaaaaaaaaaaaaagaaacttgaaataatttcacaggactggagaatgcaacatgtatagagagcagcagccaggtcatgaaaggtctcatacgccacctaagagtttgaatgcttttggcaggctggtgttatgttaagttttccggcctttaacgttatttgaaattttgaaagttattcttattttaaaaatacacaactatttatggtattgcatatgcttttcaaaactgcatatctcctctgatcttactgcaggagagtctcataacctctctcccgaaattcctgctataggcaatcagtatacatggaagggtgtgtgggaggtatggcagattctataatagacactggctcattcaacattaattccaatatccttttccagcatttgttttggtactacagagtttagaaagccaaaagccccttctcagacttccttgaggccaaggttttaaatattacctaggtttcaccaaaaaacccggcccatgtgaggcctcagatgcagaaatgaacaatgtaggggtggtgatagcacttaggagctcaaacagctgggactgaggtccctgatgtcatagaccctgagtggcaggtgataacttcagtgaggttttctagtttagtattgtggcatagttgggtatttctcttcactatatagcagttaagctttgcatccctactttcctagaaagtctataaattgcctgatactgtataattaatcactttctgctttaaattagttacaggagattctgttttctgcaataagaagcctagtaataggtacggcaggatggtgaataaagaggtatatatatatagatttttttaaaaaggttccagcatgaaacctgtagtatatttattacagatgggctctctaatctttttagatagattctctaatctttttagatagattcatacatacttctgaaatagttctggaaggacttgttagctgaggtacttttgttcattgtttttagcttaaaaattagggctctgccaaatttcttgttttaaaataaactttttttgttagaggggagacaccgattcttggaaagcttttctttatctactaattgtgggtgttttatgtcacctttcctcaaatacatatgcttccctaatgtatctttatcatcacttaagcagtggccgtttaccttttgggtcacagacccaaatctgctacccaaatctgataaaagtttattgataccttacctccaaatacacatacaaatatattcctgtagttccatatacaatatgagttagacaccgttctctttccttataccctttaagtatattcagtaaatgaaggtcaaaaattcctactctagaatgacagaagtgaggtccaaaaccagcattagttatctcttagaatgaaggagaaaatgtggttcaaaatcagacatttttcagagaaatagcttgctatcctcctcaatcagaaaaatttttttccaaatcccaagaacctgtgaattaataaattatttccccaaatacattttttccccaagaaatttaattaattgtttttgaaatcagaaaattaaacaaatcgtctccccccacttcctctgccctcctatatatactcaccatgttttgggctgagaatgggaaagggatctcctagtttccagaagaaatacataaaggtcagccataagagacaggaaaaaagcagtcgttgtttatgcactgagacagaggagacaaaactgttaggaaaaacagatataggttaaagagcttgctctatttaaaaatataagataatgctaactaatatttggctgctaattcacttggcaaatgactgatgaacagcataatttttagtgaaagcatccttaccatcgtaagagaaatttagctgaatttaaggtgtgggatgaactaaaggagacattattaataggtagaaaaataaagctgtggcagaacaaataacctaatcattcattcaatatttattttgtgccaattcattcaatatttattttatatttatttttaagatgttgtgtgtgaggtatcctcaaatagcggtagatactgaaagttaatgtagaaatgaagctatccacaatttaagtcccctcaaatactcatctcaatctatatgctgactgagagggtaaaatacttacgtagtcggatattgctcacaataaaatagccaatgtaaaaaggcaccatgaaaaccaggatcagcagaattacacacaggttcattttccagtgaaaataacgggagctgaaataaatgtcaaagactgtcactgggaggaagagagggcagcaactttctttctctttagtcttccaaagggtccttttgctctttggactcaatattgaatatatcctatctaatcagcctactaggctcttaaaatctactcatttgtagagattaaaaaatacaaatttttgaaaggtatatatgaccatcttaacatcttaagaatttcatatattaaaataagaatgtttatgtttttgatatattcataggcaacatataccattaacatgtatcaacatatgccattgctggtagaatgactattgttttacccacccctaggaatctcattccaatgtaagaattaaaggaaaataaatgttaacagtaatatatgttatactcaaaaatatttcttttgtactcttgatataaacacctgatttgcatgaattacttttattagtttataagatgtacttcatttattaaaactttttgttagcactttttataacagttttaatgagatataatttacccatttaaagtgtacaattcaatggtttttgtatactcaagagttgtgcaaccatcacctaaatcaattttagaacattttcattacgccataaagaaaccctgtacccattagcagtcactccctgtttctccccaatctcctcagctctaggaaaccaccaatatactttctgtttctaggaaaccaccaatatgtaatcttttgtgactggcttcttttacttaccataatgtttgcaaggttcatccatgttgtagtatctatcaataattccttttatggttgaacaatattcatcccattatatggatatattatattttgtttctgcattcattaattgaggacatttgggttgtttttagctattataaatagagacgctaggaatgtgtgtgtatacattctggtgtggacgtatgttttcatttctctttaggtagaaatggagtggaattgttgggtcatatgataaatctatatttaatcttttaggcactcccactgtttcccaatgtggctgcatcattttacattttcctcaggagtgtatgagagttccagtttctcctcagcctcgccaacacttgttattttctgtttttttttttggttatagccattttagttggtgtgaagtggtatctcattgtggttttgatttgcatttccttgatggctaatggtattgggcatctattcatatgtgcttactggccatttgtatatcatctctggagaaatgcctattcagatcctttattcattttttaattgtattatatgattaaactataagaattctttatatattctagatacgagtcccagtccattatcagataggtaatttataaaaattttctcttgtttttggaatgttggttcactttcttgatggtgtcctttgtatttactgattttaaacttacttaagccttgtttcaaaaaaggcctaagtggttaaatggcttacaaagataaataaaatacaggatgatgaaatgaactataaggaaatatgaacaacaatggtaacaggtaaaatattgggccaagcctgatggctattataaaacagaattctagaaagttgctatgggtaggtcataaatttagctttaagttttctaatggtcaatgtgaaataaaaaatttgatcagttagataaaatcatcatgtctgtaagaaaataaaaattaattcctcaaaggaagcataattatcatttattgttactgaattattaacaagattacaatgaaatttcttcaaagatttcataaagaaaatgcaaaggcaattaacagtgtcatcaacaacatcctttcaagagaaatatgtttcagagggctgtttcttattgttccttccttagtacagatggcaggcatcacgaaacaaagagccattcagtaaaagctaccctacagggagtgaataccatttagactagatacattgacagctttttgctcctctaggttaacaactactttagaacatttagagaaagaaacaagctggacatcctccaggcaatactacatagtatttcagctaagcttctgaaagattttgggaagcagtgggtttgaaataacaagtgcaactttaattggcagtatggactgcctattaaaagtgaaccacatgttttaactagtcttttgagctgagagtaaagtgatattctcttgaaaaaactaagcatcccaacaagattacatatttgaataggaagtcatatgatctctgctcaaaggtgagtcaaaggaatattctggccaagattctcttttcaaaacgattctgagtccagtcaatggacagttatacatcatcaaggttcatatttgtgttccataattgggtgaaacattagcatgaaaaaacaggtataactgaagatatgtctcagacccaatcctctatatagcacacaaagaaaaaccagattttagcaatgctacttcttatcctctttaactaattaagaaatttaggaaacatacaccatagtatgacagatgtttcttactatacgggttattaactataagttaaaagttgggggacatcatctaccaaaaacagtaaatatagctttagaatatctgaatcctctgtatcaatatttagatgagtagctggcaaactatggcctcacagccacctgcttttacaaattaagtttattggagcatggccatgctcgtttgtttatatattgcctatgactgttttctctctacaacagcagagctgagtacttgtgatagaaaccttctggtccacagaaacctaaaatatttattatctggccctttacagaagaaagtctgccaacccctgcttaaatagcagtgaaagatgcaggttgtgataataaaatttaataaccattatgtaaaataatacctgtctattctctatagtcacaggatctatatctagctcatccaagaaaaggtttggattattttttatttatttatttttttgagatggagtcttgctctgtcgcccaggctggagtgcagtggcacaatctcggctcactgcaagctctgcctcctgggttcaggccattctcctgcctcagccccccaagtagctgggactacaggcgcccaccaccacgcccagctaattttttgtatttttagtagagacggggtttcaccatgttagccaggatggtcttgatctcctgacctcgtgatccgcctgccttggcctcccaaagtgctgggattacaggcgtgagccaccgtgcccggccaaggtttggattattaaagtttaaaagcaggagaatcagaaaacacttctattttaccataatacatgttattcattgttctatcaagagaccattattatcaactctgattctctctctctcactcttttttttaagagatggggtctcattgtcttgtccagtgatcacagctcactgcatatcctcaaactcctgggctcaagggatcctcctgcttcagcctccagggtagctggcactacagacgtgtactaccacactctgctaattttttttatttttttgtagagacagggtctcactttgttgcccaggctcgtcttgaacccctgcacttaagtgatcctcctgcctcagcctcccaaagtgctaggattataggcgtgagccactatgtctggcccctctctctcttttttttttttttttaacctttcaatgttttgtgattaaccatctgtatagtaagtttttctttttaatttaaatttcgttttcaactctgattatcaaaggatttgagagtatagtctctctacaagtctcaagtgccaggggtctataatgaacttaccttggcactgaatcctaactttagagtgaaagactgctttactcctaaaaggtttttccaggtggtgataaaaaagcacaacaaagtctgcatagcatagttgatgaaccctacatataaatgctggcctaaaaacatactcaagcttgcagattaacaagcaagaaatattttgaatagactgtctaataaactaacaagtctattatttggaggggagtaaagagttatttttaaaaagtgttttaagaaacactttaaattcaaccaaacttgaccatgactgtaaaatcaataaaaataactaagttaagtaagaactggagtttcagtcttcagagagatcattaaagtagctctgaggaattctaatcttttcaggtagagattttcaatcagcagaacaatgtgaagggctgttactgggattcagtcagcgagcagtcctggaaaaataaagcttctaggagtgaagcctagactgcagcttcacagcctcactccaatgagttcttcagagttaacggtcagatcttttgtttcctggtatctcataatctttatcaaaccagctattaggtggctgtgacccatatctgttgtgatcattgcagttactgaaactgaactattaacacagtgtttttttttttcagttatgagatccaatagcttttccactgtaaagaatgtagcacagaactcttcaagaggagttttcagtactcttactcacctgctattcaatactcctaagatttcaaagatgatgagctcaaacatggtgcaagaaaatgcaaacgtcacggagaagatcacctgtacaacatactgacgtatctgttaaaagccaaacagagactagaagttatttccttgtttaaaaactgaactgataacctccttctggttacaagtcagaaaacttattttgaggaaattctcaagtcattggaagtagggccacaacagcaacttgcctggagctaaagaaaaagatcaatataggtggcacttctgaatcttgagtcactattaccagcatcctcctgtggatgaagaattttgaggacaagaagatgaagtgacagggtcataggtagcacttagaattcctgatgcatactgacaaaaaactgacagattcgtacataatggttaatgtttaaaggggttcttcaacactctgcagatcctggatcagttctggaaccttcctcgggaggtcttaaagtattgggcagaagaaaatctccagaatcccaggctctttcagacaataaactccctgggaaagtttaatggagaatatcctagaaatgacccaaatgtagactataaccactgatcttattactaattaggagaactaactaggaaatgtcgagtctagggtggtgatcttctgaatccaaagcttaagataaaaacaacaccagccttgtgttgcgggaagtcagggaccccgaatggagggactggctgaagccgcagcagaagaacataaattgtttcatggacatttattagttcccaaaattaatacttttataatttcttacacctgtctttactgcaatctctgaacataaattgtgaagatttcatggacatttattagttccccaaattaatactttttaaatttcttatgactgtcttactttaatctcttaatcccgtcatctttgtaaactgaggatgtatgtcacctcagtaccctgtgatgattgcgttaactgtacaaattgtttgaaaaacatgtgtgtttgaacaatatgaaattagtgcaccctgaaaaagaacagaataacagcaattttcagggaacacggaaagataaccataaggtctgactgcttgcggggttgggcagaatagagtcatactcttcttcttgcagaaagcgagtaggagaaatactgctgaattctttttccagcaaggaataaccctggggaaggaatgcattctgggagagaggtctatgaatggccgctctgggagtgtctgtcttatgcggttgagataggactaaaatacaccctggtctcctacagtgccctcagacttactaggattgggaaattccagcctggtaaattctagtcagactggttgtctgctcttgaaccctatttcctgttaaaatgtttataaagacaatgtgtgcacagtgggacacagaccctcatcagtaattctaatttttgcctctgctttgtgattttactgccctttgcagcatgtgatctctgtgacccactccctattcgtacactccctccccttttgaaatccctaataaaaacttgctggttttgtggctcggagtcaccatcacggtcctaccaatatgtgatggcactcctggaggcccagctgtaaaatttctctctttgtactctttctctttatttctcagaccggccgacacttaaggaaaacagaaagaacctatgttgaaatattggggactggttcccctgatagccttgggattttggtattaacttataatataaggtttgcaattcagggccagatagacaaatgaaagggaacatttgtgagacattatgaattaaattctctcctacagaataactatttgctattggtacatatcctgatatgactaagacataatccttgctcctaacttctgggctatatttgatttgccttttttccccccttttaaatcaattaagtctacttatattctgcaatctaatagttatatagtacttatttggtaaaagcttcctatcttggaaatgaacataatgtttctttaatggagacatttttcttgtcaatctaaatcatatagtgtaagtatgacaaaatgatttcttctcacctcatagtctttaaacaattggcgcatgaagaaaagccacccaaatccaaaaaatagtatctggaggagaaagaaaatagaatgtcaatacatattttcttttgagaaatgttttatagaaactcttttatgataaaaggtctgctaactagacggttaacttatttcagggattaaagataagatccactcttataagacctattattaaagctcatgacattggaaataaatttttaaatgcccttggagttttgaagttatccatgttacagagtatgctttaagacaaaaatggaagtacatattttgccataatcttatgataatcattatatgagccagagaagtttgcaaatagaaaaggagtcagtggccaggcacggtgcctcacacttgtaatcccagcactttgggaggacaaggtgggcagatcacctgaagccaggagttcaagaccagtctggccaacatggcaaagctccgtctctactgaaaatacaaaaattagctgggtgtgggcacctgtattcccagctactccaaaggctgaggcatgagaatcgcttgaatctgggaggcagaggttgcagagagccaatatcgtgccactgcattccagcctgggtgatagagtgagactaggtctcgaaaaaaaaagaaaaggtgtcagagtgagacttgcttcttatggatgatccctgattgcaagtatttaaaaataataccagcctggccaacatggtgaaaacccgtctctacaaaaaacacacacacataaaaattagctgggggtggtggggtgtgcctgtagtcccagccacctgggaggctgaggtgggaagatcacctgagcctaggaagttgaggctgcagtgagccatgattgcaccactgcgctccagcctgggcaacagagtgagaccctgtctcaaaaaataaataaaaataaattaatttaaaaaataaaaacttcaggggagaggagttgagaccaaaattagaggagtagtagaaagcctaatattttttatatctgtttccttcagagagttttcttagcttctccaccatcctgcctaatctacataaaagtggttttcatctcaatgtaaagccgagagattgcaggatccctctttcgtcagttttgtttcaaactggcagagaccgtagccacatgacagctgataaagctggtctgtagtaaacagaactttctatacatacacactgacacaactactcttttcttcttaaactggctaggacctttatgaataaaatgattttatgtctttctagggactactttactgagcaagtgtaaactcagtagtttagcacagactactttagcttcttatcatgcccctgctgcctagcaaactcatgtgttcagccccctggaacttctttggttctttagatccatattctttcacatcgagacctgtgtagatgtcctctgaaaggaacttctctctagccctctcccagttatgctatttactccccctggaaggccctctctgccctcccaaatgcagataaattgctttttatataatcctgttttacattgtacttccctcatcaaagtgcttaccatacagttttgtaatgtgtgatttaaatattttttgacattagattataagctctatgaggacaaaaaccatgtttgtcttgtaatctttgtatccttggcatccagcacaaagcctggtacgtagcaggctctccataagtgcttgctgaatggctaagtggtctacataaaagatggtttattcttcagcattcaatcttaaattttctgtaataactcctacgtgctatgctaagtgctgaggatacaaagatgaataggatggttactaccctctaggagctcacaatatagtgaagacagtacataaataattataacataatatggatgtgcaatgatagaaatacatacatgatattgtaaaacaatatgaaagagggagaccaaaccaatctgtaaggggttaggacagattttctggagaagataatgcccgagccgaaggaagttttaatttggggttaaaacctgatattgtatgcacattttggggttatgtgcatttttctagagtggtttcaaggtattcatcacacagtcaaaggtttccaccacccctaacataaaaaccatcctctcaaaggatgaataagaatcaagtagggaggctggacatggtggctcacgtctgtaatcccagcactttgggtagatcgcttgagcccaggagttcgagaccagcttgggcaacgtggtgaaaccccatctctacaaaaaatacaaaaattagctaggtatggtggtgcgtgcctgtagttccagcttatggggaggctgaagtggaagggccacttgagcctggcaggtagacgttatagtgagctgtgagcatgtcactgcattccagcctgggtgacagagcgaaaccctgtctcaaaacaaaacaaacaaacaaaaaacgaatcaggtagggtaaaaacaggtggtaggggtaggaggacagggctttccagatagcaaagggcatgagtaaaggcgcagagtgaatagcatggtatatgccgggaactacacatggtttggtgctgctagaagatgaaattcaaagaaggaagaggttaaaaatgaggctagacaggaggagtggatgtccaatcactgagagctttgaaggccaccctaaggagcttagattatagtctgtaggtgatgagggttatttaagcagggaaatggcatggtctgatttgttttatattatatagagcggtatggtggctgtatggaagacacacttgaaggaaacaacagtgtagaaagagaaacattatagaaatgtgttatgggaattcagatgaaagatgataaagccctgaattaagacatttggtgacagaagaggagaaaacagatttgagaactatttagaaggtaaaatcaacagggagaagtcaaggatgactagtttggaatacaggatgaagagtgaagctacccaatttatataaagaatactggagaaagaagaggtttaggaaagggggcagaggatggggaaaatgatgagctcatttttgaacacactaagggcctgagggacagccagcaagatggatcaagatatccagcaagtatctggaataaaagacagattgtgaaggcaggtctaagatatacctatgagttgaaaccaccaaagtacatgagatcacctgggaatagtatctagagtaaggagagcaatgtgccaagaagaaaacactagaggataaggaaaacaattttgaatagtgaggtagaggcaggaaccagagtgtagcaggtcagaatgaatgggagctaaagcagtggggacagtaaatgcaaattactctagggagagccaggaatgagaaaaaaagaaaacattagataataggctagagaagaatgtggaataaagggaaagtttattggccaaggggaaagaaagcagtcaagtaaggagaaaaagatgagaaggatggtggaatactagaggataaactgataatactattattaatatgattaggtaacttttattgagcatttactatactacaggctctctaagtagtacttagcattataatcttataaaaataattaaaaactcagtacagtggtttgattatcctattttcacggagaaagatgaggtttagagaagttaatcaatttatagtaagtgtcagaatcaagattgaactcaagcttgtttgactccaaaatctgtgcttttttttaaatattattttttcagctcttattgagtctgtctgtttagaaaatctgtgcttttaaccacttcaaaatacgctactctaagatcaaaggtaggtagaatggctttaaaccggagtaggggaaccccgttttctgaaatgggaggaaaggaggtaagaatggttgtgaacacagataaccttttagattaaaatgcagaaagtattcatagtaggagatcataccttttggcttcacttttgttgagtaagtacgaggcaaggttatctgctaagagtaagagaggtgagttagaaaaaggagctttgaggagagtgacaaagattcggagaaactttgaggggaatgaaacaagtagctgattaaggtcaagaaaaggaataattcagtgagctgagggttaaactcctggcgttggcaaactacacagctatgtgattttctatagtagccttcaggcctctgtattagtagtaaacaaactatagcagtgatccaagtgtggacttatatatacatgaaggtaaacgaacaagagggtgtaagaaagtaagttggatccaagcatctagatcaagcagaaaaggaaagggtcaaacagattaggagaaaatgtccaggatatcctttggctattataaatatttaccggtggagacagatgtaaattcagagtttagagaccatatttatatgacttatgaagccacgactgaagacagagaagttgggcagttaggactgagggtggtatgtatagtggaaatggatgattaaaaaaaaaaatcaccaagattgctatgaaatggaagagaaaacaagcaaaaattttaagtttatatggtggggaggggaatggaagaaaagagaaacagatatatacctttaatatttcattgtggcctcctttcacattgaaaaagaaaagcttaaaaagactttcagaacaaaattatgtcctttgcagcaacatagatgcagctagaggccatcatcctaagcaaattaatgcaagaacagaaaaccaaataccacatgttctcacttctaagtgggagctaaatattgggtactcaccaacataaagatggcaaaaacagaaactggagactacttgggggcaggggaggggagaagggggaagggttgaaaaactaattattgagtactatgctcagtacctgggtgaccggatcatttgtaccccaaacctgagctcccacaatatacccggcacaagtaccaaatctaaaataaaataaaagttgaaaaaaaaaaaaaagacttaaactacacacacacacacacacacaagtagctggagaattcatttacatccaagtaaacacaaattctggcaagattatagaggatccaaaaagaaagcagaagcaaaatgcaatttcaaatagctttgcaaataaaatggaaggcgtatagcttcttattaaaaatgagacttgatactttcagaattgtacagagtcttgaccttaggacttaagagtgtactctggaactgataagtcttatgacggtatagagggctcaaaacatgagttagttaacagttgcttttaaaaaagtgacttctgggttgaaaattagctactgttaaaaaaaaaagatggccatcagcaggacagttattaaagaattaactataaaagacacctttcttggatcatttattcacccttttaatcatttaacaaatatttattagtgcctaatatgtgccaggtccaagggatagaatggcaaatgagagcatgaatgctactctcaaggagtttataatctatggaggagataaacaagtaattaccaaacaatgtggtagtgttgttacaggggaagtaggtgaagggtactatggcagtaggtatagggacatctagtccagtctaggggaagcttcttggatgttcaacttgagatctgaaggcttaaagaaggggagggatatgaggaaaaggcccagaaagagaaaacacactgtgtggaaatctggaggcaccatagcatcgccaggttagggaactaaaagaagttcaggaagtctaaagaataaattggagccacagctgaagagagaagagccagggtcccatcaataagggacctgaaaagccatgtaaaggagtttgaacttcatcctgtgccgtggtgagcaagattgaatacgtgacctctgatttcagatttcatttcaaataaacctttcagttaatacaaaacagaaaaaatgagcagggaggggcgcagggggcaatggtggtgtttccaaggtaaccacacctctctagagaggtgctttttattaaacaaatattcactacaactctactatgtgcccgcaactgatctagatgctggtgaatacaggagagaacaagacagacagtatcttggacctcatggacagataacaaacacatgaatatacaaatgaaccatagtaataaatgccaagaagaaaataaaacatggaaatgaggaagaaggcagccgaaatggaaagctactttggttgtgggcagggtgtcaggtaagaccttcctaaagcgacatttttattaataccgaaaggatgataaagtagccacataaatatctgaacagagaacattccatgcaaaggaatctttgggtctttcttccacatttgtaaaaaccaggtttaacaattaattactgcatgtggatgcatgtgtgaagtgaaagtctatgattataaggcatacaaaattagaaagccacttcctcggttcaacgtatcaattatatccatgctaaaaatcgtagaggctgcaatgcaaagccaattttctactgacattcttatctttattctaaatgaaaagaaaagctaattaaatattgttatttttcttaaattggtactaaggctaaaaataaccctgagttgtcaccaagggcactgggtagtcttagaaaggttttaagcagaagagttacatgtctaggtttttttacattaatacatttgaatattatgcagccaataaaaacaatacttatgaaaactatagaaaaggtggtaaattttaaaaatgaaaaaactattgcattagagtggtaggattatggatggcttttccttctttcttattttcttaaatattgtaaacaagtttttgaagagaaaaggacaatgctccgctctacggagacgagtattaggatgaagcaatacaaaaacggaatcaaagaacacaaatttagttcactttaagcccccaaaggtaactgcttctgttatttgccgtttgagagaaagaacaagtaaaaacaaccacacacacacaaaatctttattggaaagatggggggaagaaggtcaacaggcagtctgagcttcacaaatattggccaacaattatttattgaatgcctgcacttggaagtggggatacagctatgaacaaggcaggatctcaaaaaacaaaatcagaaacacagacataaatgatgccagtgctatgatgaatgctaggaagaaacaataattaacaatagattacatggtaaaagcaagaggctaactagacgaaacttctattgagcagagacagtgtcttacatgtttttacgctcagagctttatataatggtcgataaatgtttgttgactgtacaaacaaatgaaggtggccaatggagaagaaatgagggtcagaaaaacatccggaaaaggtgggtaactaagcagaggataaaggacgaggtgtcagtgcaaaaacgaaaccttatactttcaagcacaggtattaccttatactgatactttgaagcagcaaatttctccacacccggattcaggatttgacatctaacagcaaagcctgcactgacgtgtcctcagtatccagtattggcgcgtcgcacaccgcgcgcccagaaccacacaggcttccccagtccaggatcagttggcgcagcccggaagcttcgaggagctcctagaaccgccgccttagctggcggcgccggctcttagcctggaggtcggcggaccgcttccaaaagtggaccgaaattccggggatggatgccgggtggggacgcggacggccgcaggccagtctcctgacagccggggctgagggaaccggccgcagcaaatcgcacaccctctctgggtgccagagtgactggcgcaggacgcgtaagagaggagcgagaccccggaccagcccgcaccgcggaggaccggagagggcgattcggtaaagggaggcggacgggtgtcggggcgggaggcggtgactcacctgggaggtaatcatgatgctggagtcgatgaggaaactcatggcgaagtgtaaggaaggctcctgcctccacttcccactccccgaggccacagcacgctggggccacaggccccctcacacggtctgccttctcccaggtgctgcagccgggactgcggctctccagcccgacgccatcaagctgcgccccagtcagccaatcagcgtctacat

SEQ ID NO: 1537 - DNA, 62510 bp, Homo sapiens; identical to SEQ ID NO: 1536

SEQ ID NO: 1538 - DNA, 62510 bp, Homo sapiens; identical to SEQ ID NO: 1536

SEQ ID NO: 1539 - DNA, 30061 bp, Homo sapiens
cgcggcagtatagagagtacctcacgaaggggacgtgggaaagtgttagcggggaacgctgggaaactcccggcctccgccaccatcttgctttcctttaatccggcagtgaccgtgtgtcagaacaatcttgaatcatgaagctactaaccagagccggctctttctcggtgagctcaggtggcgggtttgggaaagggctggggagcagtgtgtcgacaaggtgatacgaggcggaggtgtctggtctggggtctgggccttgggattcggtctgcccttcagctgaaccctgcgggccaagtgggctgcagactgggtcaggctttggaggcccagctcatgctgtgagcacaagagacctaacaccgggaaacctgaagagaggggcaggacgtgagagcggagttgaagcgagtccttggagagacttctgaaggtcactccggtactcaagtgctggagaaagagaccgtgaaacccagggggagcgggaggacggcgcacttagccccccaccttcactttatccgctgcagcctctgctccttggtttatcacggagcgtcagtttccccagcgaataaaagtataagaaaggagctaatgcagatagaacacttattacagtacctggaacttcattgttaaatactatggtgtcttagtagtctaacgttgcttttcttgatcgtatgttagacggttcctccaagacgtctctgtttgtcctcaaaagctccttaattaagtttccccttcaagcctaaattaaacatagctgtcacttggggaaaactcacacatcagggttatatcactgtgggacagtggttattaagaggggtaagggggaacacttaaaaaatcatagcgagggacagaatgcccccagggaaccggtggcgatgtttggagacatatttagttgcaacaacttgtaaggagggtgctattggcatggagaggccagggatgctgctaaacttcgccttacagcaaagaattatctagccccaagtgccagtagtagtacctgtgttgagaaacccccctagatggagatgcagaagaccagacctgggcatggaatgttcttatgctttatgtttacataaatgtgctgtgggctatatcgatttaggctgtaattgcattaaccttccaggtatacctagacacaccagtgattacccttggagggaagcacggttagattggcaaaagaccccaacatttccttctccattctattttgcaacagaaaaagctcagagaaaacagttggagaggcccaaagtaaacaaattgcagtaaacttgaaagcaattatttatgtgtctaattttagcactttatataggagaataaacttagatatatcttgttattagaacaaaataatttagaagattgcatgacagttactaggataatttgctgatttgaatgggacgattaagaagcacattaccggcggagcgcgatggctcacacctgtaatcctagcactttgggagtcagaggcaggcggatcacttgagatgaggagttcgaaaccagtctggccatcatggtgaaaccccgtctctactaaaaatacaaaaaaaaaaaaaatagccgggcgtggtggtggtgggcgcctctaatcccagctactcaggaggctgaggcaggagaatctcttgaacccaggaggcggaggttgcagtgagccgagatcgcaccgctgcactccagcctagacgacagagcgagactccgtctcaaaaaaaaaaaaaaaaaaaaattaccaacaaagagttactatttgggcacatttggttggaaaacacctaaaatctcacttggtaacggaattatagattattcatatttgaattgctatgcccatatatcttaaaagtttactttttggaaaattataggccaaaattacaaagaaggttaactataccatacccagcaaactaaattgatgacgataaagtaaagctaattgtaattcataactgaaaagcagtactaaaagcaagtgataaccagcagccaacctagtacagcactaatgatgtacaacaaacagccttctggacagcacagagtggaggcattgcagactgtgcagggatgtccgggaaactccagtgaggaggtgttcattgggtcttgggagcaccaaattttattcactcatcatctcctctaataacctcatgaactttagtcataatcagaatgatttgtatggcattgtataacatttgccaaaacaaactgaataaaatgaatgcattttgggtccattatctaatatttaatgggaccctttcaccctaccagtaactgcattttatatattgagaatctgatgtggatgaagccattattaatctcaggatgacatacatgtcataaatgttttatttagtcaaaaaaactaagacctttggttgtgtggtcttaatacagcacacaagagtgaagatacaatggaaaatattgagggcttggaggaagttggtatatactttgtctttttcttttttttttcttgagacggagttttgctcttgttgcccaggctagactgcaatggcacaatctcggctcactgcaacctccgcctcccggattcaagtgattctcctgcctcagcctccccagtagctgggattacaggcatgcatcaccacgccccgcttattttgtgtttttattagagatggggtttctccatgtttgtcaggctagtctcgagctcctgacctcaggtgatccgcccaccttggcctcccaaagtgctgggattacaggcgtgagccaccgcacccggctagtttgtcttttttaaaggttactaagatgattaaggagatgaaaccatttcaattggaaattagactgaacggatgacattcattgggcagataaaagaagcaagaagctgaaacctataaaaggttgtggacacaggccaggtgtggtggctcccacctgtaattctagcactttgtgaggccgaggcgggtggattgcctgagctcaggagtttgagaccagcctgagctatggggtgaaacgccatctctactaaaatacaaaaaattagccaggcgtggcagcatgtacctgtaatcccagctacttgggaggctgagacaggagaatcgcttgaatccaggaggcagacattgcaatgacccgagatcgcactgttgcactccagcgtgggacacagagcacgactccaactcaacaaaaaaggttgtggatggggtgatctgacactttttcaaaaaatgccaaagctttagaactacacagaaccatgaaacttttataaggtaactgaaagataagaaaatacagtgattctttacatcatttaaaaaataagcatcaagaactctataaatcactaataaatagaggtttaagaatggcttgggtaaactggtgggttagtaagtccataataagttatgcagctaggcggggtgcagtggctcacgcctgtaattccaacactttgggagaccaaggtgggcagatcacttaagatcaggagttcaagaccagcttggccaacacagtgaaaccccatctctactaaaaaatacaaaacaaaaactagctggacatggtggcacgcacctgtaattccagctatttgggaggctaaggcaggagaatggcttgaacccaggaggtagaggttgcagtgagctgagattgcgccactgcactccagcctgagcgacagagagacactctgtctcaaaaaaaaaaaaaaaatgttatgcaggtaaatcctcccatggaggtggttattgctccttccacccccgaacaccctctgtcgcttgggtaccctaagataccatgcttttatataaagcactgttcttgtgagaaatacgtgtaacctgtgttttttatgtttagagattttattccctcaaagttgcccccaaagttaaagccacagctgcgcctgcaggagcaccgccacaacctcaggaccttgaggttagtcccactaacttgctcgctggaagctatacatgccttactctccttggtaatacgaagacattcattatatctctactttattttaaatacagtttaccaagttaccaaatggcttggtgattgcttctttggaaaactattctcctgtatcaagaattggtttgttcattaaagcaggcagtagatatgaggacttcagcaatttaggaaccacccatttgctgcgtcttacatccagtctggtgagtatcttcacttcctcaagtgtttggaaatgctgtggtatcttggtcctgtgaaaaagaaaaactaagatcaatgtctttatattttgattccttgacctgccataacaaattaccacggactgggtagcttaaaccaaataagtttatcctgttacagttctagaggctagaagtccaagtcaaggtgtctaagccaagccaagatatcagcagggctgtgatccctctaaaggttctaggaaggcacaaatcctcccctgcctgttcctagcttccagcagttgcccacaacccttcatgttccttgacctgcaactgcatcactgcagtctctgcctttgttgtcacatggccttccttctgtctgtgtccacatttcctcctgataaggataccagttacattagatttagtgcccactataattcaatatgatgtcatcttaagtacttaaatctgcagagaccttattaccaaataaagtaacatgcaaatattctggctggacataaatttgggggggaacactgttaaacccagtactgtcccctaatgtaaaatgagaaaccacaagatatttgccacagagaagcactaaattagtatccatatgaatgttgatgttagagcataagaaatcagtaaacaaatttttaacaggaagtgccgcaaattgaaagaaaattaactctttttttcccatatacaagtctctttcagaatagactaatgaatccagtaagcttgtatttgacagtggaaattttacatgaatgtacttaatgtaaaaatgtatacttaagctttttgttgagccttgttttataattcttaactaaaaaggatgcaggaatttagtaaaattctttttaaatctgctcacaacagattttgatatagtgtgatgtttggcaaacttggcattgaaaagctacaaagataatcattctttctttttcaagacgacaaaaggagcttcatctttcaagataacccgtggaattgaagcagttggtggcaaattaaggtttgttaaataagtaatagaaaatagtgaaaatgccagaaaatattcaattttaagggaacttttctctgttatcaaggaggttgaggatttcttaagcaacataagaaggaaaagactgatgaatttgagtatatcaaactgtaaaacatctttatgtcttaaagtaaaaatttaagtaactgtctgggagtagatatctgcaatatataggcatacctcagagatgttgcaggttctgttccagaccaccacaatgaagggaatattgcagcaaagcaagtcataggaattttgtggtttcccagtgcatataaaagttatgtttacactatactgtggtctactaagtgtacaatgacattttgtcttggaaaaaaagtacataaccttaattttaaaatattttattgctttaaaaatgttaacagttatctgaatcttcagcaagtcataatctttgctggtggagggtcttgcctccacgttaatggctgatgactgatcaaggtggtggttgctgaaggtggtggtgactgataatttcttaaaatcagacaacagtgaagtttgctgcattgattgactcttccttttgtgaaagacttctctgtagcatgagatgttgtttttagccgtttacccacagaacttctttcaaaattagtcagtcatctcaaaccttaccacttttttatcaaccaagattatgtaatattcttttttatcatttcgacagtgttcacagcatcttcaaccaggagcagattctatctcaagaaaccactttgtttgctcatccataagaagcatctcctcatctgttcaagctttatcataagattgcagccattcagtcacatcttcaggccccacttctagttctcttgctactcccaccatagttgcagtttcttccccctctgaagtcttgcctctcagagtcatccataagggttggaattggcttcttccaaactcacgttaatgttgatactttgacatcctcccatgagtcacaaatgttcttaatggtgtctagaatggtgaattctttccagaaagttttttaatttactttgcccagatccatcagcgtcttcactatctgtggtagctgtagccttacaaaatgtatttcttaaataataagacttgaaaataaaaattactccttgatccatggggtgcagaagggatgttctattagcaggcatgaaaacagtgtcaatctccttgtacatctgcatcagagctcttggcattgttgcagtaataatttgaaaggaatcttttttctgagcaatgggcttaaaatattcagtcaaccatgctataaacagatgtactatcatccaggcttttttgttcatttacagagcataggcagagtagatttagcataattcctaagggctctaggattttgagaatggtaaatgacctcatcctaaagtcaccagctgcattagtccccaacaagagtcagcttgtcgtttgaagctttgacgccaggcattgacttctctagctacgaatgtcctggacggcatcttccaatgtaaggctgttttgtcagcattgaaaatctgtggtttagtgtagccaccttcatcgatgatcttatgtagatcttctggataacgtgctgcagcttctatattagcatttgctgcttcactgtgtactattatattaagaagatggcttctttccttaaagctcatgaactaaccacggctagcttcagacttttcttctgcatctcacctctctcagccttcatataattgaagagagttagggcattgctctggattaagctttgacttaagggaatacagtttgatctaatccagaccagtaaaactctgtattatcagcaataagtctgtcttgctttcatatcatttatgtgttcagtggagtagcactattagttttcttcaagaactgcactggtgcaagaggcctagcttttgacctgtatccgtttttaacatgccttcctgacttccttagaagcttaatcctttctagcttctgatttaaagtgagagacatgagactcttcctttcacttgtatacttaggggccattgtcgggttattcattagcttaatttcaatattgttgtgtctcaggagtaggaatatccaaagagagggagaaagacttggggagcagctggtcagtggaacactcaggacagaaacagcatttctttttttttaattaatttatattaaagacagggtcttgctctgtttcccaggctggagtggagtggtgcagacataccttattgcagccttgaactcctgggcccaagcgattcttctccctccgcttcccaagtagctaggactataggcacatgactccatgcctggctaattttttattttttgtacaaatggaggtctcactatgttgcccagactggtcttgaactcctggcctcaggtgatcctctcacctcagcccagcatgctgggattgcagatgtgagccactgcacccagcccagattttttatatattgtgttgtcagtggtaaagatgatagagaatgtctcattctgctgataggagtataaattgatacaaccacttaggaaagaatcaaggaatatctggtaatattgaaaaaccccacagtttttaatcacattcacaaaggtattctttataaagactggaaacgatctaagtgtccatctttagggaaatgggtaaagtatgacagagtcatgatgagaccactatacagccattacggaatgaactagatccatacgtcaacatagcacaactgaagggcaaaatagagtgtgaacaagcaagtttcaagatttctttaaggtattttaattttttaagcagaaaaatactatgtagtgcttatgattgtggtttccagagtgggagagagtgagggaattggtcttggaagggtacgaaaagatcttcaactttatttgccattttaaaaaattgtggtcaaatgtatataacataaaatttatatatatatatatatatatatatatatatatatatatatattttagacagtctcgctgtgtcgcccaggctggagtgcagtggcatgatcttggctcactgtaacctccgcctcttgggttcaagcgattctcctgcctcagcctccgtggtagctgggattacaggcgtgcgccaccatgcttggctaatttttgtattttcagtagagaccatggtttcaccctgttggccaggctggtctcaaactcctgacctcaagtgatccgcccacctcggcctcccaaagtgctgggattacaggtgtgagccactgcgcccggcccaaatttatcattttcttaagtgtgcagttaagtggcattcagcaaccatcaccaacattcagctccggaacttttctatcttctcccacctgaaattctgtacctgttaaacaatggctgctcattctcccctcccctcagcctttggcaactgccattctcttttcagtctctacaaatttgactactccaggtacctcataagtagaatcatacaatatttgtccctttgtgactggcttattatccttagcataatgtcctcagggttcatctgtgttgtaacatgtgaccagatttcactccttttaaggttgaattatttgctggtttttaaaaaaattttgaattttagttggttaatatgtggagttttgttatattattgttcgcaccttttatacttcagaaattttctttccaaaggaattggttgatagaagattataagggaaagcttactatcctgattcagatgatttactctagtttattttccgattcagtgtgaccgcaacaagggaaaacatggcttatactgtggaatgcctgcggggtgatgtgtaagtacctgtgtgtgtttaggacttctgctttgaaagaaatactaagctgctcacttctggtctttgtaatgcgtcattatgacctctgacttccattttggattattgttcataaactgctcaaaaacactgcttaccacaagacctaaagtttcacattgagagcattacagctatgtagaatctcaaatgttggctttacatttttgactcataattcttatctcgatgtcttctgtagtgatattctaatggagttcctgctcaatgtcaccacagcaccagaatttcgtcgttgggaagtagctgaccttcagcctcagctaaagattgacaaagctgtggcctttcagaatccgcagactcgtaagtacatttccagatcacatttgattctaagatactgggttttttagaagatcaatttatagaagaaaaaaaattgctgtcaaaatttttatttttatttttatttatttattgttttgagacagagtctcactctgtcacccaggctggagtgcagtggcacgatcttggctcactgcaacctccagctcccgggttcaagcaattctcctgcctcagcctcctgagcagctggaattataggtgtgcaccaccacacctggctaattttttgtatttttagtagaaacagggttttgccatgttggtcagactggagttcagtcttgaattcctggcctcaagtgatccacccacctcagcctcccaaagtgctggtgttacaggtgtgagccaccatgcctggccaaatgttttactccttgaatttgaaaatatctttttcaaaaatttgttatttagatttattattcttttgtttctaaacatttataatcatttttcatgtttgatggtaagtaaattgtttgtaagatcctagaagtttttcctgtttccttcccaatgttttgtttttgtttgtttgtttgtttgtttttgagacagggtgttgcttgttgcccaggctggagtgcagtggcacaatctcactgcagcctgaaccttctggactcaggtgatcctcctacctcagcctcctgagtagctgggactacaggcacacaccaccgcaccctgctaatttttatttttatttttttatagagatgaggtctcactctattgcccaggctggtctcgaactcctgggctgaagtgatcctcccacctcagcttcccaaagtgctgggattacaggcgtgagccactgtgcctgacccctagtgatttttaagagttgttttgcttaccccaaatcctacaccagtttattgctgctgctattattgcttactattgtattgctattattgtttagccatctcctctttattgagtctttccaaagtaagtaacttaatttttttaataggaatcttttttgcattcatattttatgtttatataatgtctaattatataatcttgacaagtacaactggtaatacaagtctgtaagcaagcgccgctgactcttgggagtcatacaacttctggtgggagcagaaatgtgcaggaagagcagaaatagctcaactcagtggttcagcatgggacaggctcccctccacatgcaggcctggggactgatgttatttcatgatgatgcttggtgtcacagaggagcattatctttgttgctcaggatttctactgaagaaatagatagaatagtacaattttagaaaagatgacctatgtgtccagagtggcttcttccccactggcggcagtgaggcaccagcctgcatctattctgcctgaacagttactgtgtagtctcctggctggtgtcagcctccaggtttacgtcttgagtccatctcccacacggccattacagtgatccttctgacgtgaaagtaagccttcttattatctatgggataaagtccaaacagcatatacgtatatggccttgcgtgatcttaccccagcccacttctcttactttatgctctaccctcttctccttccagctgcaattcccatttgaatcaaattattgttatactttatgcctttgttttgtctgcttcctgtgcctaaaatgctgttcccaaatgatttcccctgggaaacaccagctcattctgtaagatggatcccacatattacttgtattaattgttttccaattcccactgcccttgccttgtacctctactgcacttttgacacactgccgacattgcacccataatactttatttcacagtttttcctcttaaaatttgagggcaggcattgtatgttccacatctctgtatttctagcacctagcacagtgcctcgcataggcaagttgccaggtaatgagcaactgaaggaaatactgcaggcaaaaaggcattgaagcaagaaagcagggaaagcaccaagcaccacagaggagtaagtcccagtggaagctcccattggtcccctgaaagctacctgacaatctccttattacctagagaggaaacctaggagtaagtaaaattcagattaaatgacttgtccaaggtcacatggcaagatggcggcagaaccataactagatggggacttcccaaaacccaggccagtataccttccaagtgataccagctaggttaaagttagaaaagtggtttaggtggactccagtatatagaagctgctgccatgtaatcttttttatttttttctcagcacattctactggcagaaactggcagttactagaggttaaataataataaattttaagtcctcttaacatatgaatgccagaagatgaccaaatttgtataggcttgttgctttctaggttttaaaaatgttgtctttactgaaagtgcatttccctaaatgcttcttcacttatctcacagatgtcattgaaaatttgcatgcagcagcttaccggaatgccttggctaatcccttgtattgtcctgactataggattggaaaagtgacatcagaggaggtaccaataaaacatattttgaaatgtgcttgtttttcacattaaattgaacatctcccatttcaggtttgtttgttaatttttccttttatcttctaactttaagaaattcagcgtgctagctttttcatccacctgctttttaactaaaattttatctgaacaatttttgtgtctcctttaagaaatgttttcatgactaaagggacatgatcattacagaaaaattaaaaagtaaaatcaaacaaaatgaagggaaagaaaacatctcacatacctaaaggcactcagtgttaatacctggtatattttcttctaaaccgttttctgtgtgtatgtatcttttttgtttgtttgttttaaatacggggtcttgctgtgttgcctaggctggtcttgaactcttaagctcaagcagtccttctgcctatgcctctcaaagtgctgggattacaggcatgagccattgcacccagcctgtgtatcttttttaaacagtatttaaatgtttaagtatcataataggggctgggcccagtggctcatgcgtgtaatctcagcactttgggaggccaagacagagggatcacttgaggccaggagttcaagaccagcctgggcaacatagcaagaccctgtctctacaaaaaaaaaatatatatatatgtgtgtgtgtatacatatatataaaataggtcctttgactaaaactctttggtctctctgaatttgtaaataagacttgagcccacttccttagctcctgttccatcctcgctcactcattcacgttcttcagcacaccagcctccgtttgctggctataggggtttgtcacatgccacagccatatgtgcatcttagaactttgtttccaaaacatgaaacattgaatgctaaatctacaagtgtagatatgtgcgtataatcttaatttcctattcctaccacccagacccaaaaacaaattttatcaaaagacattaagagaaaaatttgtaattatcaacaccttcaaagtatatctgactcaaaaattcaaggtttttattctcgttttattcttagttagctgttacagaaaactaaactgtatcccttgctctttttgacttatcaattaacagtttgatgcctttcattcatatggcacttttatttagaaattttaacttacatcatccaacttgaacaggcagccgttttcataagactggactctaatgagttttgaaatttttcagaaatcaaattcaccctcatgaagatgtgtcattaagttagctaaaacttagcaaaagtttatctacaaggatggctattgtaatactagtttataattgtgaaaaattagaaacaagttaatatccagcattagggaactagttaaataacttatagaatggaacagtattcaaccattcaaaaatattagttgatacataaaactccacagcatgttgtcacataaagcaatttatggattaggacataccaaaaggtcccttttttttaataaaaggtatgtatgtatgcattatagacaaatatcaagatgttaactgtgataacttggttatctcaaagttaatagtattttttaaatgtgtccctaggctaaaggaaactctaaagaaattggcgctagaatacttggagcaatggcagcatcaatagaaaaacatcaatagaaaaagagtatgactttccaaggttactccataggtacagacaccattcattttagggcacggattatgataaattgattaaaagttcagtttcattactttagcccagtgattctcaaaacgttatcactttccttcctgaggagcctttctagccatttttttctaaacctcttacttttaataccacagatagagtttatgtgctgtatatttgtactttttacatagaagtcgtaagttttttttttttcttagttaccccaaaccaattttcacccatctggaaaggatagcatttctgttgaaagtacatgttttagccctacttttgtatattaagcctaaggtggtaatataaaccagtgataaccaagtctcaccaatcttcagatcgcctgagtggttgattggatggatgggtagttggtcggttttaaataaggattctaggattccacatttaatattttatatcagtctgtagggtaagtcccaagaatgggggacagtgaccgtttttgtttttcaagctgagtaattgtgatcttacagtttcgacaccctggtatagacaatgacttcatggtcagaaaagctttatagagattggcttcaaagatggacgagaagggtgttgtggtaaaactctgttagccctgttatagaatgttaatagtgcttcattactacttatataaacacaaaagaaacctgacatactacgtaagctacattataataaaaatcatagtccacgttttcaagtttaggccagtgtatgctctaatttctttttattcctttttttttttttttttttgagacagagtcttgctgtgtcgcccaggccagagtgcaatgacacgatctcagctcactgcaacctctgcctcctggattcaaacaattctcgtgcctcagccacccatgtagctgggattacaggcgtgcaccaccatgcctggctaatttttgcatttttagtagagtcaggatttcgctgtgttgcccaggctggtctcaaactcgtggcctcaaatgatccgccagccttggcctcccagagtgctgggattacagacatgagctactgcacccagcctctttttattccttttataaataacagctttgttgagatgtaattcaccatactatacaacctatttaaagtgtacacaattcagtggttttcattatattcacagagttgtgcaaccatgaccacaattaggttctagttcttttaagcaatagtttttataataaaatcccagggtaattcacctcagttagtaccttgtagttcattacagcaacttataaggccttataagtatttattttcttccaaactgtacttttatgtttttacagctttttatatttatgctaatataacctaataagtgtttttaacttcctcagttacattacttcgttcagaaccatttcacaagtgcaagaatggctttgattggacttggtaagtttagagtattgcctgcctgtcagtttgcttccttaagagcagttccttaaactgtaattacgtgaacataggattgaacaaaatttgaaaacttcggccttctatttatgtcagacaggcaatatatcataggattttaattgctagtcatttgttttggaaagcagaatccaacatttaaatttgtaaaccactggctttaaattctttacagtatttgtaaaacctgtgacaaaggtgaatttctcaaagcaaagagcttttacaaacttttttaaaaggaagtacagcttactagaaaaacaggcaaagggcatgaacagacagttcatgggagaaatatgtttgtatatgtgtagccaactatctttgttttaaatgatcagcctcactaataattaagaaaattttaatctgtgatgttggcaaaattaaaagatggactctgcccagaattaaccagggtatggagaaataggcactctcacaaattgttagtaggaatataaactagtacaacattttgggagatctttttgaacatatctgttaaaattctaggctgggcatggtggctcatgcctgtaatcctagcactttgggaggctgaggcgggcggatcacctgaggtcaggagttcaagaccagcctagccaacatggcgaaaccccgtctctactaaaaatacaaaaattagtcgggcatggtgacacatgcctgtaatcccagctatcggggggctgaggaggagaatcgcttgaacccaggaggcagtgattgcagtgagctgagatcgtgccactgcactccagcaagggcgacagagtgagactctgtctcaaaaaaatacaattccaaatgtttacactcatagacccagtgacttttaagaatttgtcttacagaaacattaggtcaagtttacaaagtagttgcatgagaatatcatttgtaatattttttgttttgttttgcaaattacagcttaagatataatttacatgctataaaattcacccttttgaagtgaatagttctgtggtttttaacagattcaactattaccactacctaatttcagggtgtgttcatcatccccccaaaagccccatacccattagcagtcactccccattctcatcttccccctgcctgtggcatccactaatctactttgtttttgtttttttttttaaagagatggaggtctcattctgttgcccaagctggagcacagtggcacaatcatagctcactgccttgaactcctaggctcaggtgatcctcccacctcagcctcctaagtagcaataatctactttgtctctatagatttgactattctggacatttcctataaatggagtcatacgatatgtggccttttgtaactggcttttcttacttagcataatgttttcaaggtccgtccatattgtagcatgtgtcaattcaatgtcttattcccttttatggctcaagaatactccattaccacattttgtttattcattgattggcatttgggttgtttctaccttttggctgtcgtaaatataaacattcacgtgtacatttttcttaggaaacctgtttttagttcttttggttatgtctaagaacagaattgccaggacatatggtaactctgtttaaccatttggggaactgccagactgttttccaaagtagctgcaccattttacattcccaccagcaatgcacaaaggttttgatttctccacatcctcaccaacacttatcgtctgtctttctgattatgaacaacctactgggtgggaagtggtcattgtagttttgatttgtatttccctaatgacaaatgacattgaacatattttcatgtgctttttgtccatttgtataactttttttgtttgtttgtttttttgagacagaggcttgctctgttgcccaggctggagtgcagtggcgcaatctcagctcactgcaacctccacttcccaggttcaagcaattctccggcctcagcctcccgagtagctgggattacaggtgcatgccaccattcctggctaatttttgtaattttaatagagatggggtttcaccatgttggctggactggtctcgaactcctgagctcaggtgatccacttgcctcggcctcccaaactgttgggattacagatgtgagccaccgtgcccagtcaactttggagaaatgtctattcaagtctttgcccatttttaagtttttttttttaattgttgagttgtaaaggttctttatatattttggttactcaagctgttagcagatatattatctgcaaatattttcctgcatttcatgggtcctctttttactttcttgatacagtgttctttgatggacaatgcaatgttgttttaagagctaactattagaaacatgctagcgtccattaggaggggattgatcaaataaatggtggtagagccatagaaagggattctttataaccattaaatatttgatgtagactactcacttagaaatttgtaaattatgaaagataagttagaaacaatatcaatagaatgataccattttagaaataaattgaagataatattaactacacagaaaattctagatgaatagtaatactaagtatatagtaaatagtttagtaatagtaaactgtaattgggtatctctgggagagtggcattatggcaggaagactcttatttattttgtagtgttaggattttacaatcgtatttttaaaacaaggaaaaaatattttacgattgtgttttagtaattgtggttctagctttgtttttgcttctgttgaaacaggtgtgagtcatcctgttctaaagcaagttgctgaacagtttctcaacatgaggggtgggcttggtttatctggtgcaaaggccaactaccgtggaggtaagcatttcattctattagggttaatttatcagaagggcgtttccccactagaatagcatattgaggtggaataggcctgaatatttactactgaacagtctcggcatagaattggatggcttgggtgttgtattttgagcatatgttttgtgtgtgtttggggacaggatggcatggggaaagcaccgagctgcagaaaagactcgtgggttaatactgtgttgtaggaaatactggagaatgaaaccaatggtgaacaagccattttcttcttccctctatccttaatctggccccaggtgaaatccgagaacagaatggagacagtcttgtccatgctgcttttgtagcagaaagtgctgtcgcgggaagtgcagaggcaaatgcatttagtgttcttcagcatgtcctcggtgctgggccacatgtcaagaggggcagcaacaccaccagccatctgcaccaggctgttgccaaggcaactcagcagccatttgatgtgagtctgaacagttggtatctctctttttgctttcaaaggctcagtatttaagatataattctgataatctactcttaaaatgtaagacaaacacacagaaaatctttgtacaattgaagagatagccaggcttgattttagtatctttgaaggcctatcaaaaactcactggcttttccactttgtctattacttgtcattagtaatataaaaagaggaattgaatgcttagaaataaagggaatccacacatccgttccctttagaataaagttgtagatattaaactttcccctagattctaactagtctttttttctagattttcttctgtccgcttctgttcttttggttacttcctgaatctcactatttgttttccaaccaagtggacaagatgaacaccaagaaattgtttacagactcactcattcagcttgagattaaatttgaaaagaaaaatgagaggctgggcacagtggctcacaactaaaatcccagcactctgagaggccgaggtgggcggatcactggaggtcaggagttcgagaccagcctggccaacgtggtgaaacccccatctctcctaatccaatgaagtaatttaatagaaattcctagttcagaactcagccagaaatttagagtataaataggatggcctcagaattataattaaagaaattgaagtccaggccaggcacagtggctcacgcctgtaatcccagcactttgggaggccaagttgggcggatcacaaggtcaggagatcaagaccatcctggctaacacagtgaaaccctgtctctactaaaaatacaaaaattgtctgggcgtggtggcgcacgcctgtagtcccagctacttgggaggctgaggcagaagaatcacttgaacccaggaggcggaggattcagtaagctgagatcgtgccactgcactccagcctgggtgacagagcaagactctgtctcaaaaatatatataaataaataaataaaagaaattgaagtgccttcttatgctttacgtggactgagccaatggttctccaagtttattgtacataagaattacctggaacacttgttaaaaatctgggcttccaggctgcatccacagggacctgagtcagtaggtccattttgggaatctgaaagtttgtatttttaataagaacttagataatttttatgtaaatggtccacataaacactgcaaatcgggttcaccctagagagctaaaagctctgctcaaactagataacaatatccctgttattcagaggttaaactcttgatagcttggacatctggataatgaccactaagcagaaatttttctctaactttctgacatgagtgtataagagaaatgaaagtaaattggtgaaaaagtccctaccaacagcagagagaagaaacctggtctgcctaatgccaaagcctatctatattataataataatgtttgcagattagtgtttgcataaacctttaatcatctaaagcaggttagaaaatacccagcataaaggaaagggagcagtcattttagaaatatttaaatgaaaaaacaaagccgtgatagttctgaaagaggtaacctatttacagaatacttcagttcgtgacagaactggctaagtaaaatattaatctattttgtttataccgtgaaggtccaagttttttctaggcaaacttaaagaaatcgtgccctgttttacttggtagaatatcatacagtaaagtctcattatctttcaggtttctgcatttaatgccagttactcagattctggactctttgggatttatactatctcccaggccacagctgctggagatgtaagttgcaaactcaccaaacttctttcatgaacaagttatttctcccccccgccataaacatgttttcggttaaaatatggaatgtttgaatgcagtgcaatgacttatcagagctctgtatagtatgatgtcattgaagcattatctgctatagggaaatttacacatgtatactaatgcttccaggaaagaggagagaattgcctccttcatgttttggttctggttggacaagttgcattgagttggctctgagacatctaaattgagaacccaggagaggggaagaccaggaggtttatttgcaagtcttcagtgtagagattgtgttgaaatcagggatatgtgtgaatgattgtaggaaaagaaaactaaagctcaatttctgggaaacaacaccatttaaggagcaagtggctaagaaaaatggcccaggtaaacagaaagaaaaagagaagctgatatatttgaaggataggaaagagagtatgtttaacaccattttgacccacagtgaaataacattcattaccactgagaagtctggtagtttcagcaagctaggacatcatgggtgatcttaacagttttgactagagtagtggaaattgggtaaaatgtgtagtgattaaggaatgaatgacaagtaagaaatgagaggttggtgtgggctagtggagcttagacattcaaggagcaagttgttttaggagagtttacactgagagattaggttgaaagagacatactgagcaaaaagatcggagcagatatcggagatagaaaattataaatggctcaagtctgagaaaggaatacttgggatccagcacacaagtggaccttttagccttacagacaggctaatattggaagatattgggaagatggggaagtacctcctcagtgagacaggaggctaagtcatgttttgacagacgtgagaggaaagtttaaagaaagtagtgaagtttgggacagacaaatagtgaggtacacaaaaagtgggtattcgctgtagtgtagatgtatccttgaaatcagcgaccacaaattcatagtacagtcagtcagcactgtcatgtaatttttcttcagttgcattcagaagcctaatagagaaatggaggaggtaggtattagggttaatcccaggttggaatcctgcaaagtgggcaggtgagaagtatgaggagatagcaagggagttgggagcattggcaagagtgattaaaaggatgattcagggatctaggctcaatagagaagtgaagccagagggggcctgataaattgaaagactggacaagtcaaggaactagagatcttgataaagtggaagaataaggatagtgagattaaagactgaggtcggggtcttagaattgagggcttcagaggtatgcaaatttaggctatgatcaggtctggggtgtggctctgaaaatgggcagctaaaatgaaggggaaacagaggtcctagaatttaggtgatcagagggaaaaataagtagcagacccagccagcactgggatggagaaaatcatggtcagatttatttatttattcaacaaatatttaccaagtacccacatccccggaactttattctttctttctttttttaaataccatacaaggattcagattccttcttgaccctggcttacaaagtatggacaagccttacaaattggctgtgtatggattactactctcttcttagtgaatagtaagagatagcagtattaatggcatgacactgcaagagtctggggaagttttaaaggtgcttattctttatgggtgattagaaatccatgtgtttggccgggtgtggtggctcacacctataatcccaacactttgggaggttaaggtgggaggatcacttgagcccacacatctctacaaaaaaagctaaaaaattagccaggcctggtagcatgcacctgtagtcccagcttcttgggaggctggggcaggaggattgtgtataaacagctgctttatgaacataggaagaataaggaacccatagtgatgacagcattccgcatggacactgtgctgtttgtctggaactaaccttccatctgtgtttttgcctcagtaaagaagtgtgtcagtgctgcaggagactctggtactgaccacagatgaccaacttttcttatctgtcctaggttatcaaggctgcctataatcaagtaaaaacaatagctcaaggaaacctttccaacacagatgtccaagctgccaagtaagtctcagtattaactgtgttttatgtttttgttatttgaaagttgtattcttttcagattataacaatattacaatctatgctcataaggactgagaagtacagaaaagcgtaaaaagggaaacatacccatatcctaccacctaaagatataattgttaacattttggccaggcacagtggctcactaatcccagcactttgggaggccaaggcaggtggttcatttgagaccaggagtttgagaccagcttgggcaacatagcaagacctcgtctccaccaaaattagagaataattgttaacatttttcttagtttattgatcatgcatttttaaacataattgttaatattgtatatatagatgctgcttgacttacactggggttacgtcctgagaaatgcgcatatcgaaaatgcatttaataccctaataacccagtcatccagccaaacaaacataagtcaaaccatcataagttaagttagggaccatctgtatacttttttatcttatttaaatagcatccttattatagaagtttgaaaattacaaataaaagacaaaaatgatctctgatttccctagcaatgattctgtttccattgattcaaattactaaaaatttaaacaatattcattggtgtgtcaaaatacacttgtgcattttctgcagttataaagatatctttgggcttaaaatatttttgtgtttcgtattactttcttggtgtagattcccaactaagttaagagttataaacataacgaaagactccatgttagagtgtgtgtatgtgtgtatgtttaaataatacatttgactaggcgcagttgctcatacctgtaatcccaggactttgggaggctggggcaggaggatcacttgaggccaggagttcaaccagcctgggtaatgtggcaagacactgtctttacaaaaagatatttaaaactagccaggtgtggtagtgtgtgcctgtagcctcagctactcaggaggctgaagaggggggattgcttgagcccacgagtttgaggctgcagtgaactaagatcacgccattgcacactagcctgggcaacagagcaagaccctgtctcttaaaaaaaaaaaatgtatttctaagtcacaaatctaaagagattgtaccagtttataatcataccaccagtatataagagtacctattctacaatagtttctttcttcataactaatttatacccaaaaaagatctgattttgttttgttttataagaaagactaaaatacttgtctgctatttggcaatttataaatccccactgtccagattgaaagtgctatcaacactcctaattcattagtagttcgagggtttctctaaaagagacagacttgggacaaagttggaaatcaacctgcattttcatacagccgcttaagacatttaagtttgactccatctacttagaacaattcaaaatgtgaatcttgcaactccagtggtcgttatgatcatttagtattgcccacaggggaagcagaattacaacccaggatggaacaaccttttggtcatttctgttcccattagtattgttagttttgttatgctgagcacactacaaagttgcatctcttgtataagtacaacacaatttattaaatattgtatacatagaaccaagaatcgataggatgcagggctgcttgattgtaccagaaacaaaacatgatgagaatacattgaaacactggatttacttaagaaaaacctaagtttttcaaatctaatttatttaagaaaacgtattttcttaataagtgtaacacagttcttacaaggtatggtaataagcagaaagtagaattttgaatattaatgtcaaagtatgttttctgccattttgatggagttgatactttttcttgtaagttcttcctgtagtgaaagagagaaagtgaggtgtcattgccgaaaggacacactaataacctcttggtagtttattgcaggtaaaatcattttttaattaagctgacaacgtggtaaaactgcagcattaaattgtaattatgtttaaatggaagtctttctgtagagtgttaaaggatgataaacgtttgaggttcaaataactcgactgtcttatcaaacaccatgtctataagtaataagtttctgggagaattgtgaattggattttgttttatttcaagtggatgcttttgtgcccatatttaagctgccgttgcttacaagacctgtactgcccttccccacctgccttttccatcataccctatgctcacagacaaatctcagcaagaggcaggagttgcttcactaatcaaaaccttacattaaaatagttttacctagatctaagttctagtcccaaatcaaaaagcaatctgtggagttttcagtataatttcgtactgacagctttccaaatagtaacgtaaacggttcacgtacttggtgaactgaagaaatagaatggaggccattagcactgtaagttgttagtttgcctgtttaccaaaaatatgttgagtttcggggcacataccttaaaattgccctgtttcactgtgtaagaggaactggcttgactacttcacccttggtgaaaacaaacaggccctaaaagaggcagcaacagctgaagtggatatcacagaaataaacagacagcagaagctcttcagacacccccgaaacctgccaaaactcacaggtaatacaagtgaaacgatagcataagaagaaaataaacatgagaatcttcaaactacaagcattgaacggtatcctccatccaagaagagaacccacttcatacaaggaaaaggcaaaaggaaaaggtcaagactgtgacctttataacactgtgaccccagctgtgggccaggtggagttgtctgtggtgacaccaagtacaggcctgacaccctggtttgacagaaggctcttcaagatccctggtcttcacactgtagcagccaaaaggtaggtttacaatatacactgtccccaacttgccatggatcaattataatttttcaacttgactatggaggaaaaccatcgcaatttcagcttccagtcatgggtcacataacgatggggatacattctgagaaatgtggtgttaggtggtttcatcactgtgtgaacctcagtgttcagacaaatctagatggtatagcctactacacacatgggctctatggtatagtctattgctcttaggctacaaacctgtatagcatgtactatagtactgaatactgtaggcagttataacacaaaggtaagtatttgtgcatctaaacataggaaaggtacagtaaaaatacagcacaaaagataaaaaaatggtatgccatttttatggcatagctcctgctttcgagtgagtcagtgagtgagtggtgagtaaatgggaagggctgggacattactgtgcactgctgtagatactaaacactgtaaacataggctacgctaaatttatttttttaaaattgcactacaacattatgttgtcagtaagtaataggaatctttcagctccctaataatcttaacgggaccaccatcatatatgtggtccatcattgaccaaaaacatcattatgtagtacatgactataccttgaatttcgatcttttcctaggctagtgatatgcagtacatgagataatcaatgcttccttacaaaatgggcttatgttagaagacttttgcccagctgcaggctattgtaagtgttctgagcacatatgagataacctgggccaagctatgatgttcgatacgttaggtgtattaaatgcacttttgactgccatctcagtggatgacagccttctcactgacagcagagagatcttcctcactgtgccagtgggcaggagaaagagcatgctgcgactggccagtgacatgcagaggatccagattgcacaaccggatccagaggccttgggaagcattagggagctctccagctgtctcactcaaatctgtagcagcatatggacccacaaatggaggccaaagtgggccctcaattggacactttggcaaccctgaagagacttcttcccttcagacttactgttttagtatgttccagagaagggagtggcattcttcttggggaattcaggaagagggagacacgctgttactctatccattaaataaagctttgatgttcacagccccccgccaccactcagaaaaaaaaaataattgccttgctctctaaaactgacttctgccttttattggacaggaacaagctgaaagctggatacctaatgtcagtggagtcttctgagtgtttcctggaagaagtcgggtcccaggctctagttgctggttcttacatgccaccatccacagtccttcagcagattgattcagtggctaatgctgatatcataaatgtaagtaaatgaaaacttaacgatttaacaacagagaacttaaccttaatgatccaatttcagaaggatgcataagcgtccttgggcagtgtattattcttatgtttggtgctcatctacttaatgtggaggcaggagggctcattcccataagatccgcaacaagcttccctgtcagctcgagtatatgtatcttcctccttcaaataaactaccattaggttaaactgtgatgtcagtaagagggctgccatccactgagatggcagtcaaaagtgcatttaatacacctaacgtatcaaacgttaggttaaactaatggtagtttataaaatgggcttatgttagatgactagaagtaaagaagagtcaaatattagcagtttcatatgatccaacctaaatagtgaagtttgctatttttcctcttcagtcctagcaatatttcaccatctagcatcttaagattttctttactcttctcagcctaggacattctcttgttcttgctaatttttttttcacatatattattgttccctacaatattgagctgttttgagggcaaggactatgtcatgtacttctttgtgttccctgctgtgcctaacaagcacatgacctacagaattaatccaaagtaagtgggttttccccattttctacattaaacttgccaacttgctttctactgtagatgtctcggccatcttctcaccaacaggtctaccttgtatagggacagtggggataagaaaaaataaaaaactaagctgggtgcagtggctcattcctgtaatcccagcactttggaaggctgaggtgggcagattgcttgagcccaggagttcaataccagactgggcaatgtagcaaaaccccatctctacaaaaaagtacaaaaattagctaggcttggtggcatgcgcctgtagtcccagctactcaggagctcatggggctgaggtgggaaggtggcttgagcctgggaggcagaggttgcagcgagccgagatcatgccactgtactccaggctgggcaacagagtgagaccctgtctcaaataaaaaagagacaaggctattttaagatagtaaccctgacttgatttcacttcgccccaatcgtcatttcatactcttcttttttttttttttgagacggagtcttgctctgttgcccaggctggagtgcagtggcgcgatctcggctcagtacaacctccgcctcccgggttcacgccattttcctgcctcagccttcctagtaactgggactacaggtgcccaccaccacggccggctaattttttgtatttttagtagagacggggttttaccatgttagccaggatggtctcgatctcctgacctcgtgatccacccgcctcagccttccaaagtgctgggattacaggtgtgaatcaacgcgcccagcccatttggtactcttttaaatggctgtcttcatcttatatcctatcattatgtgcgtcccaacccgactgcttccaccaccacctctccttcatagtaataagataagctggcctgacagaatatgggggctgctgctccacctacacctgactcatgatactacacttaaccagcctttgaacttggaagtagtggcataaagaatcctctagggtatcaagttttacttttaagttaacaatcaatgtatttttattgacccagactatttgccattgtaataccgaaacaggaaagtatatccctgcctgaagccacactactctatttgacagtgtcagtgttgttttccttatctctctttgaacagctaccctcttaccagtgttgctcttgcttggttcattacacatacaatgggactttcagagaaacagctaagcttttcctcccacactgtcccaaattaaagcaccagccatctcctagttaattttcacaacagctattatagtaattgctggcttagaatgtcctatcgaaggccaggttggtggctcacgcctgtaatcccagcactttgggaggttaaggtgagtggatcacttgaggctaggagtttgagaccagcctggccaacatggcgaaatcccgtctctactaaaaatacaaaaattagctgggcatagtgatacatgcctgtaatcccagctccttgggagggtgaggcagagaattgcttgaacctgggaggcggaggctgcagtgagccaagatcgcagcactgcactccacactgggtgacagagcgagactccacctcaaaaaaaaaaaaaaaaaaaagaatgtcctatccataaattcttgaaatgacaaaataagttcgcctgcttgatgatatatatttttatttttgttaattttgtcttttgtttgtttctttaaaggcggcaaagaagtttgtttctggccagaagtcaatggcagcaagtggaaatttgggacatacaccttttgttgatgagttgtaatactgatgcacacattacaggagagagctgaacgttctctcagcccagagcagcaaacacatgaaagtcagaagtctctaatatatcatttgtcttttttccagtgaggtaaaataaggcataaatgcaggtaattattcccagctgacctaaagtcaataaaacattctgtttaa

SEQ ID NO: 1540 - DNA, 82476 bp, Homo sapiens
ccgcttctgctcaacctagaccagccccagcttcagcctcagctcccctccttcctggatcgagcgcccgcactcccggccctgcagccacccgagtcccgctcgctgtcgcctgcacgcgagtcccccctggcacgcgctcccacatcccgggatcgtcccaacggcccctgcgcccttcctgggatcactccgactgccccgcgcgccctgggatcggtccatctaccccgcgtggccccagctgcttgcccggagcgccagctagcgctccccgctctccgctccccggcactctcggggggcccgcccgccctgcaccctggagctccgggccgcgagcctctgccaactcctctggaccctcgcggccgtgggcagcggctgccgcgcctgtctgcccgagggaggtaggtgtggaccgcggccggcaaggctgtggggggctgggagcccgcgctgcaggcctgtgcgcccgggtgcagctggcgtctggagcgtgctgggtctgggcttgggaatggggccggagaaggcatggaaggagagtgtgggggcgcttctcctctggttgttaaactctctggggctaagtgcttgctttggagaaatggggaagttgtgcggattaaaggcgatgtggatatggaaagcaattggcaagcaatgggcggtgatctggctgcaagtgacagagagtttgggggcctcccccctcggggcccctagagtgtgggcgcatcgctgccttcctgtcccctgcagggctcagagccgcatcccccacctttcccctgaactagaggcctgcgtcagcccgaattcccggaacctccaggactgtatagacgcgcccttgctgcattgttggctgcgggagtttgttggcaggcgctgctgacatgtgtgccaaggggctgggcattaataagccggtggccgcgcgggggtgggggcctcccgggtaagccccggcctagatccttttgcgcgcgcctgggggatttcggggaaccagcccagctgcgccctgagtgtgacagatgggccgcatggggaagtgagatctgcccagggggacggtcccagggagcccgacctctgggacctcggtggtgggtgcttcttcagccaggaaagcaggaaacactagggctggagtcctgggttggaattctagctcatttatgctctctggccctcggttttctcatcggtaaaatgggtacagtattagtatctaccacttagtatccttggaaagagtagatgagtatgtatatgtcaggtgcttggaacagtgcctggcacacagtgtcatagtctatggccccgggagacatctgatggccaagagccctgtggttgagggccctggacaggctgtgaagtcacagcgaattgagtcacgtagtctatcctaatgtttttagcgaggaggaaaccgagggtcagagtgatccccaggcccacagaagctccctaagaggaagccagtcacataaacagattctaaaaagcgagatggagtaaatgggaatacagagcaagcaggtgggagctgagaatgcccactgtgtgtgtaaaggggagagggttatgggggaaggcttcctgtagcaagtgctgtttaagctgagctggggaagaggcaggtggaaggaggtagagttcagagatggcgtatgcaggtgtcttccttctgtgtggcctccacagcacccgatgttcattcctttgttcagctattaattcaacaactacagtaaaacctctcaaggacatgaatttcagtgtaacatggctgggattggcgtccgccctcctctcagcccccattctcaaagaagggggtggggtccgaagttcttatcctctgcagggaatggggaggccagaagacagaactgaagtggtcacagtttacacataatcatcggtgtacattccaagagctaccggtgttttgggccaggggcgtggtggctcaggcctttaatctcagtactttgggagactgaggaaggtggatcacttgaggtcaggagtttgagaccagcctggccaacatagggagcccccatctctactaaaaatacaaaaattagctgggcatgttggcatgagcctgtaatcccagctactcgggaggctgaggcaggagaatcgagaatcgtttgaacccaggaggtatagtttgcagggagctgagattgcaccactgcactctagactgggcaacaaagcgagactctgtctcaaaaaataaaaaagatccaccaatttgtttttcttgtgctttttgtaactgtacagtactttttggctgattacggatatatcactggctgggtgtggtagctcacacctgtaatcccagccactttgggggtgctgaggcgggaggattgcttgaccccaggagttcaagaccagcctggctgacggggtgaaacccggtctctatttaaaaaaaaaaaaatctctgatttgcttttaaaacattttactgtattatgtggcagagaaagctatgggtcaccagtacccatgttctcgtcctcctggggtgctccctggatgaattttcctaggcttccttaccattcggtagggccacacggctgagttttggctgatgaaatgtgagtgtgtccatttcaagcctcgaccctaaaaacctctcactctttccttatttgttggacaagtcaaggcgactttgaaggcctagaggagggcagagccacaagccagagggagtgtttgttgtttttgagatggagtcttgctctgttgcccaggctggagtgcagtagtgtgatctcagctcactgcaacctctgcctcccagattcaagtgattttcctgcctcagcctcttgagtatgagctgggactacaggcacatgccaccgtgcccagctaatttttgtatttttagtagagatgggatttcactgtgttggccaggctggtctcaaactcctgacctcaagtgatccacccgcctcccaaagtgctgggattacaggcatgagccaccatgcccacccgggaaggatgtctttagggttgttatcttgctgtggggagagtccccaaagcagtcttgtccagtttttggcagggttgtcgtctggttgccgggactctgggagctgtgtgaagaaagccaagggtgaacagcagaagcttggacttgttcaagctcgttctccgggattcactatttctggtccagttcttacacctgaagcagaacaactgaatgatcagggctatagacaaagtaatagcggcaggttgaactaatttaaaagaatcagtgttttttgttgagggagattggttctgctgacctgaaagctgcaggttattaccctgatgaactgagaaggctcctagaaggtggttagagcgatgaccttgtctccacctgggatgaaagcggcttgggccttaaagtgttgctggatcaaattcttgcagccaaggctgatgagcacaagcaaggaggcttcttttttgttgttgttttgagacagggtcttgctctgtcacccaggctgcggtgcagtggcacagtcacagctcactgcagcctggaactcctcggctcaagtgatcctcctgcctcagcctcccaagtagctgggactacagacatgagctaccaccatggctggctaacttttaattttagtgtagagatggggtctcactctgttgcccaggctgggcttgaactctgggctcaagcgattcttctgtctgggcctcccaaagtgttaggatcacaggcatgagccgtgcccaaccatataagaaggcttcagacaaaggaaggagtgagtcactaacacgctgatgataaagcagaaaataacagtgctccccacaacccccaaagtcccagggctgtgggactcctagagaagcgtctcaaatggctccagagtcagaaggtggatggcgttctgttctccagctgtgaagctttcgagctctagcaaggactagcaagccagaggaagcacccggaagtaggtggctaaactgcggaaaattgccctaggccagcgtttctctaacttcagtgcacatcagcatccccagcaggacttgcttacactttgattgctggacccatccccagagtttaatttagtaggtctgtagtgaggcttgagaatttgcattaccagcaagttgccaggtgaggctgctgcagtggctgctgcggcagctggtcccatacttttagaagcgctggttaaggaagtgatgactgcattgaaagctctggattcagcccgcaccagcttcaaacccaactctagtcatgtgatttgggataagtcacataacctctctgttccttagttttctcatctgtagaatgaagctaagagcgactaactcctggggttcaggggaggcttcatgaaggaggtgatatctaagctgagacctgagggatgagcagtcaagttggccaggggatgagtagggaggacaggctggggtgtgtaccagacagagggcatagcatgttcagagcccgaggaggaaggagtgcctgccttctagggagctgggaggagttatgtagcaagtgctttgtaagtgatactgaaatgctaccaatctgttctgggcaggatcacagtggagaggaagccaaccagggtatggaaaatgggctgctggacgggctcagaaatggtacaagttatttgtgctctttcattggccagaatgcagtcacatgaccttacctagctgcaagggatgctgggaaatgtccgtggccaggcaggggagaaaggattcctggaggaaagccagctctctgtgccacctgtggttttcaggccccctctctcacttcttctccaccttgctcactttgctccactctgttgagtagatgaattttacagatgaagaagctgaggttcagaaggttaagtaatttcccccagcattcctcagctgactgtggcagggccaggacttgaattcatcccaaaggccttgtttggctagatctggttttggtgcttatcaggtcctccatgagccagtctttcccactacgacctcagccatgtcattggactaagtaactcctatgtagttacaacacagtaggttgttttgtttgtttttgtttgtttgttttttcggaggtctgggggcggggggatagagtcttgccctgctgcccaggctggagtgcagtggcacaatcttggcttactgcaacctctgtctccttggttcaagtgattctcatgcttcagcctctcaagtagctgggactatacaggtcgtgtgccaccacacctggctaatttttgtatttttggtagagatggggtttctccatgttgcccaggctggtctcgaactcctggcctcaagtgatctgcctgcctcggtctcccaaagtgctgggattacaggggtcaaccaccgtgcccagccacaacccaaaagtccttctgtttctccattatatcagcaggaaactgccagcttttcttcacttactcgttcattcatgcagcatgcacttgtgcatttatggtgtgtgccaggcattgtgctttgggctgggagctgcagaggaacaagacacacggccccttttgttcaagacactcacatggtctggccaccgagagggctgggcacacagttcatgtgagaagtgagacgtgctgtatccctgagctgacccaccaggagtagagtgtaccgtggacatgcagagagtgcccagcaagtgattaaacattacagttcaagctcccttgtgcattttgctaatcaaagctataattatattttgtgtttcatattccaaaatgcatttttcagattcctgaaacaataaaatagcccttgcatgatgacagttttatatgcagaaaacacagtgtactgcaatgatatttttacgagcctttagcagagcaaatgatgacgtatctctggcttctgcagcaggttgctgtttacatcggtaagttgatttctctgtctctttctttttttttttttgagacagagtcttgctgtgtcacccaggctggagtgcagtggcacgatcttggctcactgcaacctccgcctcccaggttcaagcaattcttctgccttggcctcctaaagtagctgggattacaggtacacaccaccacacccagctggtttttgtatttttagtagagatggggttttcaccatgttggtcaggtctcaaactcctgacctcgtgatccgcctgcctcggcctcccaaagtgctgggattacagtcgtgagccaccgcacctggccttctctgtctctttatggtatgtggggagatttgtttttaaaaggaaaaggggaagagagggttggggagggctccttaaaattacaccagaggctggacacagtggctcacacctgtaattccaacactttgggaggctgtggctggaggatcacttgagtccaggagtggcaagacaccatctctacaaaaaattttttaaaataagccaggcatagtggcacaggcctgtagtcccagctactcaggaggctgaggcgggaggatcccttaagcccaggagttcaaggatgcagtgagctgtgattatgccactgcactccagcctggatgagagatcaagacacccacccagtctcttaaaaaagaaagaaagaggccaggcacagtggctcacgcctgtaatcccagcactttgggaggcggagatgggtggatcacctgaggtcaggagttcaagatcagcctgggtgacatggtgaaaccctgtctctactaaaaatacaaaaatgagccaggcatggtggcacacacctgtaatcccagctactcaggaggctgaggcacaagaatcacttgaacctgggagatggagtttgcagtgagccaagatgtagttgctgcactccagcctgggcgacagagtgagactccatctcaaaaaacaaaagaaagaaattccaccagattcattctagagctgggtttctcagcctcggcactgacattgggccggaccttcttcactgcaggggactgttctgtttattttaggatgtttggcagcatccctggcctctatccactagatgctagttgcacccctagagtttcaacaactgaaaatgtctctagacattgccaaatgtcccttgagggagcaaaattgcccaaggttgagagctgctcttcaggacttcgttagtttccaattgctgctgtaacaaattgctgcaattacttagtggctttaaaacaacacatttattatcttatagttcctggggatcagaagttctaaaatctaggtgtcagcatggctgtgttccttctggaggccccaggagaaaatcggtttctttgccttctccagattctaggggctgtcctcattccttgggctcctggcccctcccttccatctttgaagccagcagtgtggcaacttcacacctttctgtctttggtcacatctcttcctctaactctgacccttctacctcctttttataaggatccttgtgattacactgggctcacaggataatccatgactgtctcccatcttaagatccttaatcacatctgcaaagtcccttttgccatataaggtaacatattcacaggttccagggattaggatgtagccatcttaggggagccatgtttctgcctgccgcagacagtctggcctcaggttataatgaaatttgcttgtggagggtttgtagggagcgaagtgatttagggagtcggggactggaggattattgggacataacagcagctagtacttttgagagtcaagtctatcccagacaccatgtgcctaatctcattgtatcctcagaacaacccctgcaggggtactgttagctgacccctgtttacagaggagggaactatccaaggaaggctttctggaggccaggtgcagtagctcatgcatgtaatcaactttgggaggtcgaggcaagaggatcgcttgaggccaggagttcagaggcaagaggatcacttgagcttgggagactgaggctgccgtgagccatgattgcaccattgcactccagcctgggtgacagagtgagaccctgtctcaaaaaaaaaagaaaagagaccagcctgggcaatgtagggagacgcccatctctataaaaataaaataacataattagccagatgtgggtggtatgcacctgtagtcccaggtacaatggaggctgaggtgggaggatcacttgagcccaggagttggaggctgcagtgagctatgattgcaccactgcactccagcctggccaacagagccagactctctcagcaacaacaacaacaacaaacccaaaagaaacaaacaaggaaggctttctggaggaggtcaacatttgagctgcgtcttgaagagattaaagggttttgctagtgagtgggaaagggattccaggcagaggtgttactggtggagggtgtccaggttcttggcattttgagcaaagaattggacaaaacacacgaacaaaacaaggaaagaaagcaacgaaagcaaatatttacagaaaacaaaagtacactccacagggtgggagtgggcttgagcagattgcttacagaattgcctggggtttaaaaaccctctagaggtttcccattggttacttgatgtacaccctatgtaaatgaagtaatggcctgggatcagtctgataggttgtggaatgcgaccaatcagaggctgaagtgaagttacaaatgaagactcctatacaaacgaggacttggccagcaccagcctgattggttgtgggaagggaccaatcagaggtaacttcagtttttcatctgccacgcaggtaagttgggggttgcaaagggagtagcctctggtccttttgttacttgggcttggaaagtaggggttttccttttgatttagttctaggaagtcagcctgaatcagccttaggttccctgcctccagaccctattcgcctgcctcagaggcacctgcagatagatacaagggcaaggaggtgaggagagtttggtggtgcatggagattgattcttggacttggaaacttgggaagctgagatggcagggaggaagggacggatgggctggactctgtaaattggtcctttcattctgatgtactatttctctcaatagtttaaataaatgtttatgagcacccattatatgctaggggtgcagacattaagacactgatgtgaactcttagcttgatgcttgacttaatcactcctaatgctgcatcccagtaaataaacactgagcagccagacacggtgactcacacctataatcccatctctttgggaggctgaggcgggtggatcacttgaggtcaggagttcaagactagcctgaccaacatggtgaaaccccgtctctactaaaaatacaaaaattatccaggtgtggtggcgggtgcctgtaatcccagctactcgggaggccgaggcagaagaatcacttgaatccgggaggcggaggttgcagtaagccgagatcacgccactgcactccagcctgggtaacagagggagactccatctcaaaacaaaagaaacactaaacataagggtatttgagttcatgttgagcacctgtgcactgaaggcaatacaaggtatggggggagggatggagacagcagtgcagaccttaggatgtcacagcccacctgacaagtctattgtctaggagagggtcccagctcctaatggtggggcccaggattcaaaccctggccatgcggctgtagaggacaagctgttagccactgtattgggctttggtttttgtttcttgtttgaaggaaactcgggactccagctagggtttaaaatatcttcagaacaagccaggtgcagccctcaacagcctagcgctgtgtagttccgctcccttaaggttgccttttcagaggtagactgtcacttctggacctagcagctcctgtcattgtcagaggagagtccagtgtagcacctggtgtgcagtcagtctttcacgtgcattatttgtctttcttatttccatagaaattacgcctttttgaggttgataagcttttgaggttgataagcagataagtagctcttctgcttacttatcactcattcacagcacaaaagccacactctcccttctctgaattcgtgttaaactgtgagaaactcagcttcttctagttggtggaataagacagtgtccttggcatggtatgtaaaggaaccagatggctgggcactgtgactcatgcctgtaatctcaacattttgggaggttgacgcgggaggatcacttgagaccaggggcttgagactagcctaggcaacacagcaagatgccgtctgtaataaataaataaaggaaccagaagaagacctaccagtgtagggatagggtggggaagggaagtagtaaggggaagtagagctaaagtctcatttatcatacctggaaatcagaagataggatgaaaatagataaattaagaaataatcagggccgggtgcagtggctcatgcctgtaatcccagccctttgggaggctgagatgggtggatcccttgagtccaggagtttgagaccagctgggcacatggtgaaatcccatctcaacaaaaatatacaaaaattagctgggtatggtgacgcgtgcctgtggtcccagctactccggcggcttatatgggaggatcacttgagcctaggaaacagaggttgcagtgagccaagattgcgccactggactccagcctgggtgacagagcaagaccctgtctcaaaaaaaaaaaaaaaaaaaaaaagaatcaggaagcgtattatttagtgatatatatagatagatagatagagagagagagagagagagatgcgaaggataacactgagaatagttggaagtagttgcctctagggttgggaagtagggctgcccgtgcaaagttgcaaaggttgttcactagagttgagcagtaccccacctatatgatcatatacagtggccctagtaagaaaaaggtgtttaaagcatttttaaaattatatataaataatatacaatggcccaaaccctggctgggtttggacagagtctcactctgtcgcccaggctggagtacagtggcacgatcttggctcactgcaaactctgcttcccaggttcaaacaattctcccacctcagcttcccgagtagctgggattactgggattaccggctcgtgccaccatgccccgctaatttttgtatttttagtagagacggggtttcaccatgttggccaggctggtctcgaactcccgacctcaggtgatccacctgccttggccttccaaagtgttgagattacaggcgtgagccaccgtgcctggctggtttggggattttcatattgcatgtgacagaaaacctatctgtaactagctaaatagccctttcccctactgccccccaaaaggcggggtttattgtatcatctgattcagaaatctacgctgggcttggtagtttggtttcgggaacatctggattccaggtctcaaatgacatcatcgctattcatttttctctttctctggttctgccctccaccacgtatcagctttgttctgtgttggcctcagccccattctcaagttcacattcagcatgaaaaggctgatcacctcttccagtcactcaagcaaaaagccccaggtttgctgcaatgggctagaatagtttgactgtaatcacatgaccacctctaagccaatctctgtggccaggcaccccagtggttggtttaggcctggatcttgtgacacactcctgaacacatgactcgagggtggggcagaggcagatcctcacacagaagctggtgcgtgattccaggtggctgatcaatcacctgtgtccactgtggttgtagtcaagggcgtgtgggttgtgctgtgctgggcgtacactagtgtgtgcattggccagctcggggtgccacgttattggctttgggatgctggttcccaggagtggcggtgggaagattccacctgctttctatggtaggaaggcaggtcctggggtgagggtgagccccgagggggaccagtggccactgtggcttgacccgcaggccttgacctgagcattgcaggcatagtttcctgcccctgtaactgccagatcgagacccagtgagacagtggtttccgtcgccagagactgaaatagtgtattccctgaggacccctgaagaagcttggctttgctacgagccagacgtccaggtcacaagtctggctgggacccaaggctcagtccctttataatagctgttgagttcacggagtgagtacaattatgcatccccactgaggctcaagaggtgaagtcacatagccagttagtggtagagatggggcttgaacctgggtcttcctgactcactcagctacctttccatagaaatagggactggaggccgggcgcagtggctcatgcctttaatccccagcacgttggaaggccgaagagggtggatcacttgagggcaggagttcaaacaaaaaaattaaaaaaaaaaaaaaaaagagaaaaaagaaaagaaatagggactgggaggagaagatgtggatgcctgagtgaggtagagaaagctttcaagaaaaatcctgatgtctttcagctggagtcctattcttatcacaggagtagatcctttctttgggccaagggaaccccaggatagatagagacccctaggaggctgggcatcttgcctggtgttagaacaggcctcctggaactgacttaaaggctaaggaaggttccttgcttgtttggggaaatccaacatcctccaggtacccagtcttcatgtgcaaatgtaagagtatctgccaagttaggactatggattgaggccacagttttcccaggttgaccctgcccaggcacccatttgtcataaaggttgtgacctttaggccaggtgcagtggctcacgcctgtcatcccaacacttcaggaggccaaggtgggaggattgcttaaggccaggagttcgagactagcctgggcaacatagtgaaactgtgtctctacaaaaataaaaaattaggtgggcatagtgacacacacctgtagtcccagctactcaggaggctgaggtaggagaatcacttgagcccagagatcaaggctgcaatgagctctgattgcacaattttactccagcctgggcagcagaacaagaccctttctcaaaaaataaaactttacaaaaaagaggatgtgactttttatgatatgggagagaaggagctactgttaccaaataaaattagcaagtagaaaggaaaaaagaaaattacagtagattatacaagtttagctatcagagtatgaagtttctgaatccaggattgttatgctgtcccatggtataagagacccaggttctgtttgtctcatagctcttccagcctcagcacagggccatccgcctcatggtctagggtagctgcttgagctccggcaatcacatgtgcatttcagccagcaggttggaaggagagccaaggggcacactccctttaagaacccttccctatggttgcacacagtccttcttatatcccattgactaaaacttgttcacatgtttatatctatctgcaaaggagtctgggaaatgtatcctgagtggccacgtgacatgcttagccaaaacccggtggttctcttatcaaggaagaaagagtgaacagctattgggggatagtttgccacagctgccttaagagcaaatttatgacaactcaaaagccataaaacagatgacactcacttagctctggaatgcatatcaagtgcctgctgtgtacaaggcgctgtgccaggcagggtcacagctgcttgtcttcatttcccagggccgaggagaacgtcaggtctgtggtgggacatggccgagggccgagctccccacactgtaagatgagggagtcggctccgtgaattaattgggtaaggagccagatttgctcgctagcagcccagatcctgaatctgagcgtgcttttttttttgttttttgcttatttgagatgaggtcttgctctgttgcccaggcagtggcacaatctcaattcactgcagcctctgcctccccagattcaagtgatcctcccacttcagcctcctgagtagctgggactacaggcacacaccaccacgcccggctaatttttgtattttttcgtagagacaggatttcgccatgttccccaggctggcctcgaactcctgagctcaagcgatctgcccaccttggcctcccaaagtgctgggattacgggcatgagccatcacgcctggccctggatctgagcttttaaccaccgaactacactgtctggaggtctgcagcttggggctgtggttctggccctcctcctggcactgtcctggcccccagtggccgctgactaggctgggcctgctggcagctcctggcaccacgccgtgttggtcagcagggattctggccaagggctgaccagggcagagtaggcgctggggctgggagcagctgacagtgaggagaggccagtccagggctcagggaagattctggtgacaagcaggatcaggtggctctggcattggatccaggcctgtgactgtgtcttgcccagaggataagaaacaaactcagtagttcacgttggttttcaaacggtgagtatagaaatcaatgtgtgggtggtgtgttaaggaaaaagattaaacagaaagaaaaaacagaggacttaagtagaatagaaaatagcaagagtgggccaaacacagtggctcacatcagtaatcctagtgctttgggaggccaaggtgggaggatcacttgaggctggaagttcaagaccagcctggccaacatagtgagactctgtctgtacaaaaataaaaaactttagccgggcatggtggcatggactgctctggaggctgaggcgggaggatcacctgaacccagctgttggaggctacagtgagctgtgatcacaccactgcactccagccagggcaacctgtctctaaaaataacatttaaaaaaaaaaaatagcaagagcgcattatacaaagtaaggctaagcacaatttcttgaaattttactgtccattttataagcatgtagtgggttaggatataaatatatttcctgcttcggtagccagagtaccaaagccttggctctagaagactgtgcacctgatggacagcactgtcaaaaaaattggaattattggtttgatgtaaaaaaatttttaaactaatttacttactattttgtgtctaaagcaatccagctttgtaaaaaagttaaagcagtatagaaacatacaaagttttaaaaagctggccaggctcagtggctcatatctgtaattctagcactttgggaggccaagacgggcagatcacttgaggtcaggagttcaaggccactgtggccaacatggtgaaaccccgcctctactaaaaatacaaaaattagctgggtgtggtggtgggctcctgtaatcccagctactcgggaggctgaggcaggagaatcgcttgaacctgggaggcagagcttgcagtgagccaagattgtgccaccccactccagcctgggcaacagagcaagactctatctcaaaaaaaattaaaaaattaaaaataaaaagtttcctccagctctacagctgcttatttcgagtgctgtacagttcctgtggatttttcagggaagttttcatgcatgtacacaggtcctttttcttttcttttctttttttggagacagggtcttgctgtattgcccaggctggagtgttgtggtgcaatttcagctcactgcagcctctgggctcacttgaacctcctgggctcaagtgatcttcccacctcaaccacctgagtagctgggactacaggcacgcaccatcacacccagctaattttttgtattttttttgtaaagtcagggtcccattatgttgcccaggctggtcttaaacttctgggctcaagcgatcctcccacctcggcctcccaaagtgctgggattacagacatgaaccaccacatccgactttcttttctttaaaactttggctttcttgagataaaattcacataccttacaatctgctcatttaaaatgtacgattctggctgggagcagtggctcatgcctgtaatcccagcactttgggaggctgaggtgggcagatcacaagttcaggagttcgagaacagcctggccaacatggtgaaaccccgtccctaaaaaaaaaaaaaaaaaaaaaaaatacaaaaattagctgggcacagtggtgcgtgtctgtagtcccagctatttgggaggctgaggcaggagaatcacttgaacctgggggtggaggttacagtgagccgagattgtgccactgcactccagcctgggtgacagggtgagactccatctcagatagatagatagtacaattcaatggtatattcatagtcatatagccacagtcaattttagaaccttttcatcaactcaaaagaaaccccatacccattagcaatcattccccatttcccccaaccattcccaccaccacaccctacctccatcctcaggcaaccattaatctattttctattgctgttgctttgccttctctggaagtttcatatacagagaattagtcaatgtatatagtcttttgtcactgcctttcacctcccctagtggttgtaagtttcatccatattgtagtgtatgtcagcacctaggagtggaattgctggatcatacggtaactcagtgtttaactttttgagatgttgtttttttctgttttttttttttttttttggttttgttttgtttttagacaaggtctcactctgtcacccaggctggagtgcaatggcacagtctcagctcactgcaacctctgcctcccaggctcaggcaattctctcacctcagcctcccaagtagttgggattataggcatgcaccaccacgcctggctaccttttatatttttagtagagacagggtttcgccatgttggccaggctggtgccagagtgttttctaatttcttaatttttgggtatggcgtaaggaaggggatcaacttcatttttttgcatgtggatattcatttatcccaacaccatttgttgaaaagattcttccttccctgttgaatcatcttggcttgttgaaaatcaagtgactgtaaaactgagagtgaattatcttggcacccttgttgaaaatcaggtggctgtaaatgtgacagttctatcctacaatcttcctgaactctttcttgattatttttgtgtgtttgtgggtatgggaccgtcccctttctaacagtcacggagtatttcatggtgtagagagaaatactgtaatctgtataatgagcttctattggacatttggggttgttgggttttgttttgttgctgttactgattgtgctacagaaagtgcttttaggccaggcgtggtggctcacatctgtaatcccagcactttgggaggccgaggcaggcggatcacctgaggtcaggagtccaagactagcctggccaacatggtgaaaccccgtctctactaaaaatacaaaaattagccgcgcgtggtagtggatgcctgtaatcccagctactcaggagactgaggcaggagaattgcttgaactcgggaggcggaagttgcagtgagccgagatcatgccactgcactccacagagccagactctgtctcaaagaaaaacaaacaaacaaaaaatgcttttagggccactccttcattctgggaaagtgcattgagtgccttctctgtgccaaacacttttggaggtattgggcatacagacaataacaaagtaaacggggtgatttcagtttgagaaaagcacaatgaagaaatgaagcatgcctgtaatcccagcattttgggaggccaaggcaggaggatcacttgagcccaggagattgagaccagtctgggcaacatagggagaccctgtttttacaaaaaacaaagaaaattggccaggcttggtggcatacacctgtgatcctagctacttgggaggtttgagtgggaggattgcttgggcctgtgaggtcaagcagtgacctaggtgagctaggattgcaccactgtactccagcctggatgacagagcaagattctgtctcaaaaaaaaaaagaaaagaaaagaaaaagaaaaaagtccggatgtggtggctcacgcctgtaatcccagcactttgggaggcccaggcaggaggatcacctggggtcagaagttcaagaccagcttagccaacatggtgaaatgccatctctactaaaaatgcaaaaattagctagttgtggtggtaggcacctggaatcccagctacgcgcgaggctgaggcagcagaatcgcttgaacctgggaggtggaggttgcagtgagccaagatcgcaccattgcactccagcctgggtgacaagagtgaaactctgtctcagaagaaaaaaaaaaaagaacaaagaaagaaatggaacggggtgatatgcaagggagtgattggatatgcatgttgggttaagggttctttgatttggggattcacagaagatttcactgaagaggcatctgtgagctgtgagctcaatgatgagaaagaacccactgttagaaaggttgttccaggcacaaggaacagcaggtacaaaggctcggaggtcggaatgaacttaatgtgttcacagaacagaaagaaacccagtgtacctggagagcagccagggccggaggagaagtgggcagcacgctagatgaacgcagctcttgcagccttaccaaggcatttggattttattatgaatgtgaaaggaagctgccaggggtgggcgttaagcagaggagtgcctcgatctaattgatgtgctaaaaagagcactctgcttaagaagccattcctttcccaacctggttccaacatttgcaaacactgagttcttaaaagtggaatgacgactgggtcagcgggtttcgaatttaaaatgtgcctgggtgctgccaactgcctccccaaaagatagctctaggttttaccccaagggtgccagctcctgcgatagcctgcagcatttggggtgagggtcgggcgaattcgcagccctgggccccagcacccactctctggcccttgctttccttgtaggaccttcgcctctgcatttgtccagtaactctggctgtgccggatactgcttgggtaaaacgggcaccccaggaacatggcagacgaagatctcatcttccgcctggaaggcgttgatggcggccagtccccccgagctggccatgatggtgattctgatggggacagcgacgatgaggaaggttacttcatctgccccatcacggatgacccaagctcgaaccagaatgtcaattccaaggttaataagtactacagcaacctaacaaaaagtgagcggtatagctccagcgggtccccggcaaactccttccacttcaaggtgagtgagccacctattccaccttccccacctggcttagctgctgtaagggatggagggttggagtcgctggttggggacttcttcgtatttccaaaccctggacagtgctctaaactctgagctgaggatatacttgttaagcagggagggtattattgatttaaaataaatttcattaccttggaactgggtgtttttcaaatagtagcccaggacacactacggagttgtgaaaaccttttgctgagttttgtccaatgttttgttttgtttgtttatttattttagctttctttagagacagagttctcctctgtcacccaggctggagtgcagaggtgctgttctttttttttttttttttttttttttaaagaaatggaacagaacagaataaaacagcaactattggggaacattgcaaactgtaaagatcttatttctttgtaaaaacgtttatttatttatggcaatagaaaatccccaaactaaggaccttatttctctttctctctttttctttcttttccttcttcttctttttttttttttttataaacgtggtctcgctttgttgcccaggctgcagtgcaatggcacaatcatggcttactgcagccttgaattcctaggctcaagcaagcctcccacctcagcctcctgagtagctaagattataggcttgtaccactatacccggctcattaaaaaaattttttttgtagaaatggggtttcccaggctggtcttgaactaccacgcccagccacttgttgttaattttttgaaagaatttatttaacaacataattttaggtcaggcgtggtgtctcacacctgtgatgccagcactttgagaggacaaaagggaggatcacttgagcctaggagaccagcctgggcaacatagtgagaccctgtctctcaaaaaataaaataggctgggtgcagtggcttacgcctgtaatcccagcagttggggaggccaaggcaagtggatcacctgaggtaggagttctagagcagcctggccaacatggtgaaactccatctctactaaaatacaaaaaattagccgggtgtggtggcgcacacctgtaatcccagctacttgagaggctgaggcaggagaatcacttgaacctgggaggtggaagttgcggtgaactgagattgcaccactgcactccagcctggacagcaagagtgaaactccttctcaaaaaattaaaataaaataaatacatttattattcattttatttttttgtattccactctgctgcccaggctggaatacagtggtgggatctcggctcactgaaacgtccgcctcctgggttcaagtgattcttgtgcctcagcctcctgagtagctgatataacaggcatgtgccaccacacccagcaaaagttttgtattttcagtagaaacagttgcactgtgttggccaggctggtctcaaactcctggcctcaagtgatccacctgcctcaggttcccaaagtgctgggattacaggcatgagccactgcacccagcctaaaataaatttaaaaacataattttattgaaaaccgtttggtaggtgccagcgtgggtacttgattacatgaaatttgcatttatttattacatattatatatctgtcaccaggctatgcactgagtacagacaggcaaacagcaattgtttacagacttaacaatctccccatttatcagcagagacattcaagcggagaaacaaatataataactattagttactttgatagaaacttgttttagggacactgaaaaaaatgatctcatttaacatttatagctatcttggctgggcacagtggctcaagcctgtaatcccagcgctttgggaggccaagatggtaggatcgctttaggccaagagtttgagaccagcctggtcaacataggaacaccccatctttattaaagaaaaaaaaaaagaaaaaatgcttacagccatcctatgtagttacagctatgaaggataaaccaaattctttttttttttttttttttttttttgagatggagtctcactctgtcgcccaggctggagtgcagtggcacaatctcagctcactgcaacctccacctcccaggttcaagcaagactaaattcttatgaatcattacttttgaaacaatacctagtattgtgtgtcacacattataggtgcttaataagtgttatttccctctctgttgccacattccaggagtgtggtcctaataatttgtcactgattatgagaattaatatattttttaaaacctttccacaaattaattaccttttcccaaatttgtttactgattaaaagctcatactgtgggctgggcgcgacggctcacacccgtaatcccagcactttgggaggctgaggcggacagatcacaaggtcaggatttcgagaccagcctggccaacatagtgaaacccatctctactaaaaatacaaaaattagccgggcatggtgttacaataaaactccagccaaggaaaagacaaagagacctttggaaaccaaagagaactttatttaattcaggtacccgggccgacagcaggcccacgcctaaaatggctgccgactgggacacagaaagcaggcttgcttatatgtcgtttgaggagggaaaacaaggcaggatacaggtttcagacaaagacagtaaattatttaacacgtgacaattctgagaaaacatataatttagttatcttgaccagtcaactttgaagctggacagctcgagcttcggggtaagggaaaacaggaattacagaaatacgcgggggtctggaggcaggcaataagcttggaagattgagataagctcatagctgcaacttgttagcaatgctgggaggggctgcttaaatttcttagcctatgtataacttctaaataacctatacttaatgttaactattacttatgtttattatttttaactttattattacttattttattttccttccacaatggtggtgcatgcctgtagtcccagcttctcaggaggctgaggcagaagaatcccttgaacccaggaggcagaggttgtggtgagccgagatcgcaccactgcactccagcctgggcaacagaggagactccatctcaaaaacaaaaaacaaaaaacaaaaacctcatactgtggaaggtttccgtctcaagtgtcttctacatttgtccaattttgtgttgaatattttgaaagcacccctgcatatgcgtgtatgtgggtacagagacatatgtgcaatgtgatccttcatgttggttatcgtaaaaaaacaaacaaaaaaacactttttagagttggacatccttctctggactgaggaaaagtgtacttattttggtagggatttgtgttcataccatagcaaagctggtataaagaagacggggagaagccgggcgcggtggctcacgcctgtaatcccagcacgggcaggcagatcacctgaggtcaggagtttgagaccagcctggccaacatggcgaaaccccgtctctacgaaaacacaaaaattagccgggcgtgttggtgccacctgtggtcccagctactcgggaggctgaagcatgagaatcacttgaacccaggaggcggaggttgcagtgagccaagattgtgccactgcactccagcctgggtgacagagcgagactccatctcaaaaaaagaagagggggaaaggcgaacattattggactttttataataactggtgggggtaaaaaatcaaaagtgcaataccattaccctttcttaatcaaatcctcacaaacagttaagtatcagtactgtaaacaaaatgcctattaccacttggggatttgaaattaaaaataatcttccataacttctgaattaatctgtttttagaaaattaataattttagttcttggagatagttgggtaatgttttccctttaggcctagagttctagctggagttactctggggcaggcagctccagaaatagccccgtgggtctcctctggggtccgggggcccctgaaggggcaggtttccactgatcctgtttcctgtcctaaggcagctttgaaatgaacacccaccccgaggaggacagctcaagtgtccgcaagaggggctgatttaaattacaggcattggttctcacagaatgctgtgtttacgttagaacaaagtgatgtttctttccttctttttttttttcgagacagggtctcactctgtcgcccaggctggagggcagtggtgtgatcctggctcactgcaacctccacttcctaggttcaagtgattcttgtgcctcagcctcccaagtagctggaaccacaggtgcacgccactatgccctgctaatttttgtatttttcgtagagatagggtctcgccatgttgcccaggctggtctttaactcttggcctcaagtgatccgcccgcctcagcttcccaaagtactgggattacaggcatgagccgacatgcccagccttttcttcttcttttcttttttcttagagacacggtcttactctgtcacccaggctggagtgcagtgacatgatcatagctcattgctgccttgaactcctgagctcaagcaatcctcacacctcagccttctgagtagctaggaccacaggtacatgccaccatgcctagctgatttttaaaaaaattttttgtagatatgaggtcttactatgttacccaggctagtccaaagatgaagatgattctatgtgatttgaccttttttgttgttgttattgttttacatttttttgtagagagagggtctcatactatgttgcttaggctggtcttgaactcctgggctcaaacaatcatcccacttcagcttcccaaagggggattacaggagtgagccaccacgcctggccatgatttcactctaaaacagtgcctactattacatatagtatgtgtgtgtgcaaatccataaagagcctttggcacaagcctggtccataataaagtcaaaaaatgttagcatttttatatatgtagttaagttaaaaagcaagttgaaatatagtatgatgcttttttttttcttttctgagacagagtcttgctccatcacccaggctggagtgcagtggtgcaatctcggctcactgcaacctctgcttcccaggttgaagcaattctcctgcctcagccttccgaatagctgggattacagccgcccgccaccacgccttgctaattttttatttgtttatttatttatttattttttgtatatttagtagagacgggggtttcaccacgttggccaggctggtcttgaactcctgacctcgtgatccacccacctcgacctcccaaagtgctgggattacaggcatgagccaccacgcccgacctgatcctatttttattaaaaatgtatatacatatatattggtatctgcatagcaaaaaccatttgaaggggaagtttgcacccagcagttagtggcagttctctctatgggagaggtaccattaaaggggggctttgtatattttttaaacattttaaacttttaaagttacacatatgtatcacttatgtggagaaaaagatgttgttaagaaaaataaagtaaaataaccaggtaacttcctcttcctcaaatacattgataaataccccctcctcaaaactcatcacttctggccgggcacggtggctcacacctgtaatcccagcactttgggaggctggggcaggtggatcacgaggtcaggagtttgagaccagcctgacctacatggtgataccctgtcactactaaaaatacaaaaattagccaggcatggtggcacatgcctgtaatcccagctactcaggaggctgagccaggagaatcacttgaacctgggaggctgaggttgcagtgagccaagatcgcgccattgcactccagcctgggcaacgagagcgaaactctgtcttaaacaaacaaaaaaaaaaaaaaaaaaaaaagcttcatcaccaggatgggagtgtcttctaggtccctccgctccaggacctttctaggctctgttcatcccctccactcacacacatctggaagctcctggaatgggcttccctttttcacacctctgccttataaaatttctttcaactgatgtcctggtctatcaaaattacagttctgcctccttcagaacccagctttaatttttatttttttaattttaaagacaaggtcttgctgtgttgcccaggctggagtacagtggcatgatcataactcactgcagcctctaactcctgggcttgagcgatcctcccacctcagcctcctgagtagctgagaccacaggcgtgcaccaccacacttggccaacttcttaatttttttttggaacgatggggtctcattacgttgcccaggctggtcttgaactcctggcctcaagcagtcctcctgcctcagcttcccaaagtgttgggattacaagcataagcgattgagcctggcccagagcccagattgaagacaacctttccaggctttctgctctgccttccgtggggctcttagcagacctttatgtgtgtgagtcattctccagtgtcgttctttgtttgagtcagcacctgactgcaagagtagggttgtgtctgatgcgacctccattcccttggtcctgcgtagtaggacttgataaaatgtttgactgtgtgtggacgggagttggcacttcattgcttactttctaggttatcgaaagcaggctctgttgggttagtgttgccaggggtggcttcagagggagacaacagctcagctttccaacctttgttccctcagcatcccataaacctaagtggttttttttttaacgcactgtgacctggaaacttggattgtttaaccaaaatggcccgctggcctccctccaaggaacacacccagcaggtattgggtgtggattgtgaaaggtcagattctatcgctgtcaagcccagccttctgcccaagctcccgtggagacgtggcagaaccattcagggggccgccctctccatagaatatcaggcagtcatccaaagatgtttatagagtttatgataacgtgggaaagtgcctctgctccagagttaaatctaaaaagaatacagcatgattatagctctgtgaaactcgcacgtacacatacagccaaggcctgaggggaagcacatcaccagggcagcaggaattgtctttggattggattaggagggactgtgttccttttctccttctctgtcatttctacattttctagaataagcatagggagcaaatacatgtttttaatttgttattaaggtgggaaattttatttttaaatattattttcagccaggtgcactggctcatgtctgtaatcctaggacttttggcggccgaggcaggtagatcacttgaggtcaggagttcgagaccaccctggccaacatggtgaaaccccgtctctactaaaaatacaaaaaaaaaaaaaatagccgggcatggaggtgggcacctataatcccagctactccacaggctgaggcaggagaatcacttgaacctgggaggcagaggctgcagtgagagattgcaccactgccctttagcctaggcaacagagcgagaccctctcccctgccccctggcaaaaaaatattttcctgatctgagaatatctcagagctcattccacatcaatacacatagatcaccttatttaaaaaaatttcttttgagatagggttgcccaggcagaagtgcagtggtgtgatcatagctcactgcattgaaatcctgggctcaagtgatcctcccacctcagcctcccgagtagctgggaccacaggcatgcaccaccatgcccagcctgttgttggttatttaatggctgaatatcatttcattgttggaagcaccataataaatgtagccagcccctccttgtagggtatgtaggttatttccagtcttgtcctgccacaaacagcacttccttgtgcatgtgtctttgcacccatgaatgggcgtgcccaccagaggaccccccccagaggtgaactggctaggcaaaacgtttgtgtgtttaaactgggataggtgttgtcggttgctcctcaaagaggttacaccatcgtgtgtgccccccatgatgggtgggtacacctgcttcccatgcccttatttggccaactttggtgattacactcatacttgtaacccactgagggcagctctaacagcatgatcaaagaataatgattgccttgggaggccgaggctggtggatcacctgaggtcaggagttggagaccagcctgaccaatatggtgaaacttcatctctactaaaaatacaaaaattatctgggcgtggtggtgtgagactgtagtcccagctactcaggaggctgaggcaggggaatcacttgaacccgggaggcggaggttgcagtgagccaagatcgcaccactgcactccagcctgggcaacaggaaaaaaaaaaaaaaattttagcagtttttggaaatataattcacatgccatacaatttacccatttaaaatgtactattcaaagcctttgagtatattcataaaattatgcatccatcaccacaaccacttttagaacattttacccaaaaactaaattctataccccttagccatcacgctctaatatacacatcccacccagccccaggcaaacaccagtccactttctgcctctctggacttgccttttctggacgttttacataaatagaatcatacaacatgtggccttttatgtctggcttcttttgctaagcataatgttttttgttgcttttttttttttttttttttttaggggcggtttcactctgttgcccctgctggagtgcagtggtgccatctctgctcactgcaacctctgcctcccaggttcaagtgattctcttgcctcagcctcctgagtagctgggattacaggcaacatggtgaaaccccatctctactaaaaatacaaaaaattagccgggcatgggggcgcacacctgtagtcccagttactggggaggctgaggcgcaagaattgtttaaacctgggaggcagagattgcagtgagctgagattgtacaactgcactccagcctgggagacagagcaagactgtgtctcaaaaaaaaaaaagtgcagatattttgctattaagatcttagtgtatagttcagactttactgtatttcactttaaatatacacaaatatggacattttgttgctactgtagaatcatgctatatatgtcttcagtaaccagtttttttcggcaagcaagaaatcatcatgtcttttcagatcagtaaatatggatgtagtgtcttgatggctctgtcagcccattgtatggctacaccacagtttctttaagcattgcctcttgtgggatacttaggcagtttccacgtttgtttgtttttgagatggagtttcgctcttgttgcccaggctggagtgcaatggcacgatctcagctcactggaacctctgcctctcgggttcaagtgattctccagcttcagcctcccaagtagctgggattacaggcatgcaccaccacgcctgactaattttgcattttttagtggagatggggtttctccatgttggtcaggctggtctcgaactcctgacgtcaggtgatctgcctgcctcagcctcccaaagtgttgagactacaggcgtgagccaccgcgtctggccagtttgtttgttttttaagagatagggtctcatgctgttgcccaggctggagtgcagtggcacaatcatgggtcactgtagcctcgacctcctgagctcaagtgatcctcccaccccagctccccaggtagttgggactaaaggcatgcgccatcacgcctggctaatttttgtatttttttttttgtagaaatggggtcttgctatgctgcccaggctgctctggaactccaagtgtcaagtgatcctcctgccttggcctcccaaattgctgggatcacaggcatgaccactgtgcctggtttccagttttttgctgctgtattccatgctgggttccactgataattgtaccaaacctctaagtgcatgtggcatagattgtggcctctacacaccactgttggtctctttccattccagagcctcactgtgttcccccacttcttcccgcttcttttatttgagcccttgagtttggttaagcccattactgctctgcaggaggggagagtagttgggctgtctctgagttgtatttctttttttttttttttgcctcgacttcccaggttcaggtgatccttccacctcagcctcctgagtagctattactacaggcgcatggcaccatgcctggctaattttttgtatttgtagtagaggcagggtttcgcaatgttgcctagacttctgagctgtatttcataaagtctgcagaagtgatgatggggaaaaaaatgattttataacatgaagtgactgtaacaggtgataaaggcttgggtgagtcactggatgtgtcctcaagtaaccaggggccttgattactgtgataatggcaataataacagtaatataaaattggcaacaacagtgataacatcccacgtgccaaaacatttgcaaacacattgccggcactccaccctcactcctggcatactcgatgaagtaaattattattactatagtaatcattattattatttccatctccctttcctggtatataattattatgatttcactattatttatttttattttgtactctcagactttgaagaaccacagcctttctattctgtagccagaattatgttttcctttttttatgaaatatccacagacctcttttttttttttttttttttttttttttgagacagagtcttgctctgtcacccaggctgtagtgcagtggtgcaatctcagctcattgcaacctccacctcctgggttcaagcgattctcatgcctcagcctcctgagtagctgggagcacaggcacacgtcaccacgcccagctaatttttatattttttgtagagagggggtttcaccatgttcaccagactggtctcaaactcctggcctcaagtgctccacctatgtcggcctcccaaagtgctaggattacaggcatgagccaccacacccggcccatagccctctgttctatgtaagattaattaacctactcaacaactgagttccggaatccttagaaatagaggatattagagctggcacggccttaagaatcatctaacctggccaggcgcagtggcttatgtctgtaatcccagcactttgggaggccaagacaggtggatcacttgagtccgggagtttgagaccagcctgggcaacatggtgaaactctgtctctacaaaaatacaaaaaattagccaggcgtggtggcgtgtgcccataggcccagctacccgggaggttgaggtggaggttgaggtttcagtgagccatgattccattactgcactgcaggctgcgcaacagagtgaaaccctgtctcaaaaaaaaaaagaaaagaagaaaactcgtctaacccagtaatttttgtttcttaactttgatttacacaggcattacctaaatacattctcattgtaaaaagaatgcaaacaacatagataaactgaggtctctttgagcaacttcttatccctttctattcccagagataagaattatattagtttcatataaattacttttcagacctctttttgtgcatttgcatataagtatacatttgtgtgtatgtctacagacacacacatccttagaaaatccatggtattgatttgtgggtttccgccaccagtaagtggtatcatagtgtttgtattgttctgtaacttgcttttttcccccctaaacaataggtcttagaaattgcccatgctgggtgcggtggctcacgcctgtaatctcagcactttgggaggccaaggtgagtggatcacctgaggccaggagttcaagaccagcctgaccaatatggtgaaacctgatctctactaaaaatacaaaaattagccgggtgtggtggcactcacctgtaatcccagatactcaggcagctgagacaaaattgcttgaacccaggagacggaggttgcagtgagcagagatggcgccactgcactccagcctggacgacagagtgagaccacgtcccccactccctgcccggggggaatacaaagatcacccgtgctagcatcttattttgagtataccaagtgtatgtgatcatccccctacagatgggcagtttgtactgcctgatcattatggcattataagtgctgaccttgaggctagagttcaagaccaccctggacaacatagagagactgtcatctctacacacacacaattttttaaattagctgggcatgatggtgagcacccatagtcccagctacctgggaggctgagttgagaagattcgttgagcccaggagttggaggcttcagtgagctatgatcccaccactgcacttcagcctaggcaacaaagtaataaatacctggtctcaaaaaaaaagaaaaaaggaaaaaaaaaaaaaaaaaaagcactgatcatccttggaccagcttacctggacacacctgggtaggtgataggaatggctgggtcagaagtcggtgcagaagaaggttcatagccactgccaggtggctctcaaagatggcagtacctgcttccattccccacctgatggtaacattactggtgatttgtagctccagcaggagtcacccataataagcactgccaccccagtgagccactgtttttggtgggagtgtgtctaccctgggtgcaggggccacaaaaaagtggaccaccagcagccaaaaccttcttcatccttgtttgtaaacaaggaaatggaggttcccacagccagtcagtaagctggaaccagagtcagggacatgaatgttagtacagtactttttatactgtgcttattaaaaaaaaaaaagtcagttgcattaatcccacctgttgccaataaggtctggcatgactctgttctgggtttggaaaaaaggtaatttttattctatgaaataccacaccctctaattctgcagtactttcctccctgttttgtggttggtgccacggcatccagccaggaggtaatttctgttgctaatcttcactgaatggggacggtccctgttagtggcttacggagtggcggagtcgtttgagagaggcactgtcagagaattgtgtgtcgtagacagagaacagggcacctgtacagacatgcttggaagggtggcctgctgaattctcaaccctgcaggctctcctgacaggtggaggtcgaaggctgtccctgccatttgtagcagccggaatatgagctgagactggtgctttaagttacggggattgggctgggcgtggtggctcatgcctgtaatcccagtgctttggaaggacaaggcaggaggatcacttgagcccagaagtttgagaacagcctgggcaacataccgagatcctgtctgtacagaaatttaaaaaattagccaggcatgatggcaagcgcctgtcatcccagctattcgggaagctgaagcaggaggatcacttgaacccaggagtttgaggctgcggtgagctgtgatcatgccactgcattccagcctgagtgacagagcaagaccctgtctctttaagagaaaaagtacaggggccaggctcatgcctgtaatcccagcactttgggaggccgaggcaggcggatcacaaggtcaagagatcgagaccatcctggccaacatggtgaaaccctgtctctactaaaaatacaataattagctgggcgtggtggcgcaagcctgtagtcccagctgctcaggaggctgaggcaggagaatcgcttgaacccaggaggcagaggttgcagtgagccgagatcatgccacttcactccagcctggtgacagagccagactccatctcaaaaaaaaaaaaaaaaaaaaggtacagggaccgaaattcagaaaaatgttttagacatacacatgtctgctgtggggttatttacaacagggagcaatcagtgacaagcttgaagtctaacagtggagagcaacaggtgaataatcaagtcaataacaaaaaagttatacagtagattattatgcaactattaaagcaggatgcaaataacttataaattttatagttatctgatgtactgtctgtgccaaaagaattttagtgatttgtttactgcttcttggagtataacttgggataaattttttggcagagaactcagtcatttctagattttaaatgtgatccagcagttacatttcccaaaaaatatgtactactgagatcttgcacaagcgcccaagatttggataggaagatgttcacttcagcactgtttgtactaggaaatgttggagggaacccaaacattattcaattggaggttaggcaaataccttaaggtacatttatataattatatatctggtagttctggaaatgaaaggaggttaccccagccagtctgcacatatgacatggaaagatgtccaagatcttacattaagaaaagtcagatgcacaacagaacatgtggtgtggtccaattgctctttctttttattttgttttatttttatttttttgagatggagtctcactgtgtcgcccaggctggagtgtagttgtgctctcttgcctcactgcaacctccgcctcctgggttcaagcgattctcctgcctcagcctcccaagtagctgggattacaggctcgtgccaccatgcccggctaatttttgtatttttagtagtgacagggttttaccatgttggccaggctggtatcaaactcctgaccttgtgatctgcctgcctcagcctcccaaagtgctgggattacaggtgtgagccaccgcgcccggcctaaactgctcttaaatatgtgtttatgttcacagaggcataggaaaaaattttgcagaatgtctacatcaactgtcagctgtggttttcagaggaagtggattagggaggacttccgctttctaattcagagttctatagtgcttgcagtttttatgtgatgtggatcatactttggaatcagaaaaaaaaattgagatcactaaataaagcacaaaatcccattgacccactcttctgtaaggaggtgaattatattttatggtatgataccaatcttattaaaaaatgcatgtaggccgggcaaggtggccacgcctgtaatcccagcactttgggaggccaaggcgggtggatcacctgaggtcaggagttcgagactagcctggccaacatggtgaaaccccgtctctactaaaaatacaaaaattagccaggcatgttggctcacgcctgtaatcccagctactcaggaggctgaggcaggaaaattgcttgaacccaggaggttgcagtgagctgagatcaccccactgcactttagcctgggtgacagagggagactgtctcaaaaaaaaaaaaaaaaaaaaaaaaaacatatagaagatctggaaaagaattagtctacggcattgctccagtggatggtatatggtggatttgacttttgtcttctgtattctccaacttttaaattaagtctaaattagctaccaaaatagaagaaaagaattacaggctttattttttgaactctgcagaggtaaaaaagccccagcaggctaggtgcagcagctcatctctgtaatcctagttccttgggaggttgaggcaggaggatcacttgaggccaggagttcgagaccagcctgggcaacaaacgtagtgcaacccggtctctgcaaaataaaaataaaaataaaaaaattagctgggcatggtgacacacaagtgtagtcccagctactcaggaggctgaggcaggaagatcgcttgagcccaggagttttgaggttgcagagagctatgatcacactaccaccacgtagcctggacaacagagagagaccttattcctatttaaaaaacaaaacaaaaacccaaaaacaaaagaaagccctagagagagtgagaggcctgggctctgtgtgtgtgtattggaaggcccagctccactgcctgagctgcttctattttgagcaggacccagtgctggggatgaggtgaagccctgtttgggctgagtccttgggaagctggactcttttttttgggtacagagtcttgctctgtcacccaggctggagtgcagtggcctgatctccattcactgcaacctccacctcctggttcaagcgattttcctgcctcagcctcccgagtatctgggattacacgtatgcacccagctttttttttttttaaagtagagacggggtttcaccacgttggccaggctggtctcgagctcctgaccttggatgatccatctgcctcggcctcccaaagtgctgggattacaggcgtgagccaccatgcctggctactctcaataggttttgatagatttgggagttcttttgggccatcataatgatggggtggtgggcactgctggcatagagttagggaaggccgggaatgccagcaaccctgaaacagggctgttctgcacgatgaattttcctgcatcccacaagatcttggaacagctcatgggaatcgtttcataattatctgaggccagagttaaatgctatgttatgtgtaaaggcggcgtatcctttgggaggctgaggtgggaggatcgcttgaagttcaagaccagcctgggcaatatggtgagaccctgtccctacagaaaattaaaaaattaaccaggtatggtggctcagcctggggtcctagctactcaggaggctgaggcgagaggatcacctgagccgtgatcatgccactgcactccggcctggggacagggtgagaccccgtctcttgaaaaaaaaataaaaaataaaaaaggcaacatatctttggcatggttctagctctgagcttagaaatttatgttatctatgaatttcacatagggcagtaaaatggggtgttatataatatttattataaaaagaggtcattgggtctggtaaggtcaagaatctccaccagagatgcagcctattttttttttttttttttttctgagacagggtctccctctgtcactcaggctggagtgcaatggcacaatctcggctcactacaacctctgcctcctgggttcaagcgattctcctctctcagcctcccaagtagctgggattacaagcgtgtgccaccatgcccagctaatttttgtatttttagtagagacagggtttcaccgtgttggccacactggtctcaaactcttgacctcaggtaaaccacctgcctcggcctcccaaaatgctgggattacaggcacgagccactgcacccagcccagcctagaaaagttttatacccccgatggtgtgtgagggtacccgttccctgatatccgggccagcactcgctaaaatgtttcatctcattaaaataattgccagcctgctgtaatcccagcactttgggaggccgaggctggtggatcacttgaggtcaggagtttgacaccagcctggccaacatgacgaaaccccgtctctaccaaaaagtacaaaaattagccaggtatagtggtgtgcacctgtaggtccagctactcccaaggctgaggtgggaggatcgcttgaatccaggaggcagaggttgcagtgagccgagattgcaccactgcactccagcctcggcgacaaagtaagaccctgtctcaaaaaaaaaaaaaaaaaaaaagaggccgggcacagtggctcacgcctgtaatgtcagcactttgggaggccaaggcgggtggatcacttgaggtcaggagttcgagaccagccaggccaatgtggtgaaaccttgtttctaccaaaaaatgcaaaaagtagcagtgcgtggtggcgggcgcctataatctcagctacttgggaggctgaggcatgagaattgcttgaacccgggaggtggaggttgcagcgagccaagatcacatcactgcactccagcctgggtgacagagtgagactctgtttctatatatatatatacgttatattctgtttctatatatgtattgtgtgtgtgtgtgtgtgtgtgtgtgtgtgtgtgtgtgtgtatatcctatataatatatatataatgaaatgttagccaacctgaatgggggaatggtatcctattttcattctcaactctttgatccaagcgttgtgtagttaagatgtgccatttctgcccacagggaggctgtgcctgtgagtgcagataggttcttttggggactgtgttcctgaaaggctactagacaggagtctctctctgtcctgatactgtctgcctctccagaggaaataacagggcaggaggagtccacgctgtccccaaagcccctgacctgggcctgatgttcctaccttctcctttgccttccacaggaagcctggaagcacgcaatccagaaggccaagcacatgcccgacccctgggctgagttccacctggaagatattgccaccgaacgtgctactcgacacaggtcagcagcttgtgtggggtctcgaggagtcctgggggctatacgtccagcttctgttcccaatcagtgaggcctaagtactcttgggggtcaggggaagggagtaatcataacagcagctaatattggcatgctaatgcgtgcttaaggcccggtgcattacctcactgaatccttctcgtggttctcacaaggtacctattagacaggctagactgagctagtttttttaaattgttgcagatctctggccgggtgaggtggctctcacctgtaatcccagcactttgggaggctgaggtgggcagatcacttgaggtcaggagttcaagaccagcctggccgacatggtgaaaccccatctctactaaaaatacaaaaattagccatagccaagcgtggtggctggcacctgtaatcccagctactcaggaggctgaggcaggagaatcgcttgaactcaggaagtggaggttgcagtgagctgatatagcactgctgcactccaacctgggcgtcagagtaacactccatgtcaaaaataaaataaaataaaattgttgcaaatctctgaaacattttccaatatattgattgaagaaagtccatttataagtagacccacgcacttcaaacccatgtcattcaagcatcaactatacttgccctgggccggtgcaaactgtgcagctctggagagctttcctccctctgagcctaggggaggttaacctgccaggcctctgcttgtttttcccggtggaggcatcaggctctgggaaacctgttctcaccgagggtggggtgttctggagtctgccccggctgagaggtgcgctaagggaaacctccaactagagttaagaacacctcagcccggagggaggtttcaaactttagggatccattgagctgaggagatttccaccaggcaaacttgtgtgaggcctggccaggcccaggggctgatttactctgggaaaggagagatggaaatgttccctgaaccctctccaagctctctctgccttaggtatgcacctatctgtgacaaaaacaaacttaatttaacctactgtacccttacaacacagaatgcttctgtgagctcaaaatgtgtggcggtttctccccacccacaagcaagtaatcagctctgcagtggacaccagcagatgtgcgtctaattctgttcctctaattgaaggaattagaggagttttgagttgggtatcctatgattcaattcaattctgacaccatctacctggagatagcatcagatcccacaggttggaggctcagtcctacaagaccgtccccgactttcactgctgatcgcaagcccgaagtggtttcacctgtgcttctgaccagctataaatcagggttcccatgaacccctccttgggtttgattaacttgctggagcagctcacggaactcagggaaacacttactcatatttactggtttattataaaggatgttacaaagggtacagaagaagactgggcatggtggctcatgcctgtaatcccagcactttgggaggccgaggtgagtggatcacttgaggtcaggagttcgagaccagcctgaccaacatggtgaaaccccatctcttctaaaaatttagccgggtgtggtggtaggcgcctgtaatcccagctactcaggaggctgaggcaggagacttgcttgaaccctgggagacagaggttgcagtgagctgagatcgtgccactacactccagcctgggtgacagagtgagactcagtcttaaaaaaaaaaaaaaaaaaaaaaaaagacgtcactttggagattccaaggactttcagagttgcatgccaggaaatggaatctaaaacaaaatatatatttaccatcacacaacctggtactggggctcagaaaatgataccccaaagtgaaggcttcagaaatagcccctctctgatcatctcctgccctcctgtctctcaccccttgttgtctccttaagcaagccattgaaactagaattggccgggtgcgatggctcacgcctgtaatcccaacactttgggaggctgaggcaggcggatcatgagatcaggagtttgagaccagcctggccaatgtgatgaaaccccatctctactaaaaatacaaaaattagttgggcacggtggcatgcgcctgtaatcccagctactcaggaggctaaggcaggagaatcgcttgaacccaggagacagaggttgcagtgagctgagttcgccccactgcactccagcctgggtgacagagcgagactccatctcaaaaaaaaaaaaaaaaaaaaaaaaaaaaaagaaactagaattgcccttgcccactaccagtcatagaaactagaacccctttttcccaaagccagccataaagcttaaaaatattactctaggccaggcgcagtggctaacgcctgtaatcccagcactttgggaggctgaagcaggtggatcacttgaggccaggagttcaagatcagcctggccaacatggtgaaactccatctctacaaaaatacaaaaaaaaaaattagctgggtatggtggcaggcacacctgtaatcccagctactcggaaggctggagcaggagaactgcttgaacccaagaagcggaggttgtagtgagccaagattgctccactgcactccagcctgggtgatggggagattctgtgtcaaaaaaaaaaaaaaattctctaaccttacatgaattttctgtgcaatagctggccataaataaattatggaatgagaccctcattccaaaggggtcctactccatacacaagagaaggaaatgctataacagagtggccaagaagaatcgcaacaggccttgctggccaactcagtctgttaccattagctcatctcctttttgcccaatcacattgcttcacgccatccctgcttcactgaacctcagcataaaatcggattggttcttctgtatctttgagtcttcattctgaaggcttccgtgtcacataaaactggttgtccatgacccttatgatggggaggaaagagatcactcctttctacccgtacaccggcagcccttctcctgtctagactcagagacgggacccttaccctccactgtgtgcggctgttacttctcgggagatgtgcccagctgcctggcaagatcgagggcaccaccaccacctcccctccctgggccatgccgtttgttacggagaccagttatgatcagcatattatttattcagtcattcatccaccttgtatatttattttatgtatgtatttatttttatttttatttttatttttattttttatcttttgagacagagtctcgctctgtcacccaggctggagtgcaatggtgcaatctcggctcactgtgacctccgcctcccgggttcaagcgattctcctgcctcagcctcctgagtagctgggattacaggcatgcaccaccatgctcggctaatttttgtatttttagtgcaggcagagtttcaccttgttggtcaggctgatctcgaactcctgacctcatgatccgcctgccccagcctcccaaagtgctgggattacgggcgtgaaccaccaagtccggccatgtatatttattaagcatccacacacactgggtcctggtgactaagacagacatgggtctgcttttgtggggttacagtccagtgggagccccagatgcagaacaagccagtaaacagcacagcagtgagtgctggggatatggaaatgggggacatggtagagagggaacagtgggtttgaggaaaggattgagaccagtgtgttgggacgtgggagggagggacagtgtctccaacccaacccaggaggttggctgggctatgggccaaggtggagagtgggttggttctgaggtcagtggggagcccagaagggtctttgacctttagccagtgagaaacaggaccacgtgatggacgctgtgccccatggtggatgggtctctgcaggtacaacgccgtcaccggggaatggctggatgatgaagttctgatcaagatggcatctcaggtgagcagagcgttgagccccgtggggacagggctgagcaaagactttctgcagctaactttggtctgtgcacccttctctcccactcccactttatttaatttttgtaacttcgggggattctttgttattgtttatttattggttgtagccagcatttttttttttttttttttgagacagggtctcactctattgcccaggagcacagtggcacagtcacagctcactgcagccttgacctcctggtctcaagccatcctctcaccttagcctcccaagtagccaggaccacaagtacacaccaccactcctggctaatttttttattttttatagagacatgggttccactatgttgcccaggctggtctcaaactcctgggctcaaatgatcctcctgccttggccgcccagagtgctgggattataggcgtaagccaccacacccgtctctactaaaaatacaaaaaaggcttttgaagaaaaaaaaaaaaagataaaagactagaaaatagagtattccctgcatattgaagttaggattgctttatgaaactttgttttagtgtaatatacaatatacacagaaaagtgtacagcttgctgagttgtcacaaaatgagcacactgccttaacatcggcccgtatcaacaaacagaaggcaaccagcctggccaagcccctctcagtcactcctcccatacccacagggtaagcacccctctgaattctatcaccctagattacttttgcctatttttttgcttcatataagtgggggcatacaacaggtattcttttttagagacagggtcttgctctgctgcccaggctggggtgtaggggtacatgatcttgccttactgcagccctgaactcctgggctcaagcaattatcccacctcagcctcccgagtagctcagactacaggggtgcaccgtcacacccagtcaatttttaaaaatttttttttttttggagatagagttttgctcttgttgcccaggctggagtgcaatggtgcgatcttggctcatcgcaacctctgcctcctgggttcaagcaattctcctgcctcagcctcccaagtagctaggattacaggcatgcaccatcacgcccagccaatttttctatttttagtagagacagggtttctccatatttgtcaggctggtctcgaactcccgacctcaggtgatccacccacctcagcctcctaaagtgctgggattacaggcatgaaccactgtgcccagccttaaaatatttgtagagggaggtcttgctatgttgcccaggctggtcttgaactcctggcctcaagtgatcctcttgcctcagcctcccaaaattctgggattacagacataagccgctgctcctggtgctgcaggtgttcttttggtcaacattttgcattggttttcatcgctgcatggtatttcattgaaggaatacacctggttgatttttccagtatattgttgctggacacgtaggttatctccactttttttctcttacagtcagggctgggaaaacgtcctctgagatgcactgtccctcccccatcatcctgcccccgtggattcttcccctcagctggggtggaggaatgggggttccttgtcatcctggcagcctctgggttggaaggcctctatggctttggtgctgagacatagaagggagatccccagggatttcaggattgagatgaggcccagggcacccatttgataggtggcatgtaaggggagcacctcctgtcttagggtcccttttgggtggggcatggggactgataacactctgtgtggtgtctttcagcccttcggccgaggagcaatgagggagtgcttccggacgtaagtgactcagcctggctcttggggccctgcccagagtccccccaggctcctaagagctgaggcattgggacattttcagccaaggaatggagccaggggcctctgccttcttgtagcccaggttcctgtccatctagtctccctcgggccacacattgggcctggctgtgacgatgggctcaggaagaacagggaacaccccacttacctctgccctggtgttgggaggtcaagggaaatgggataggagacctttaacagtgacctttaatccccctgtcccagctctttgaaggatgcagaggggtggggacgtccttcttacctcctgcattttgttcctgctgccagccacccagccacatcagacagggtcttgctgtcctgaggaccagggctgtgtccctggtgaaccccagagtacccaggtaggccccctgttgcctcttcccacaggaagaagctctccaacttcttgcatgcccagcagtggaagggcgcctccaactacgtggcgaagcgctacatcgagcccgtagaccgggatgtgtactttgaggacgtgcgtctacagatggaggccaagctctggggggaggagtataatcggcacaagccccccaagcaggtgcgtggccccactacctgccccctttccatgccagggcagctgggcacagtgtctgggaaagagggccatggtgaatccctatttcaccttctttttttttttttttgagatgaagtcttgctctgtcacccaccaccaaggctggagtgcagtggcatgatcttggctcactgcaacctccatctcccaggttcaagcgattctcctgcctcagccaccccagtagctgggattacatacaggtgcctgccaccacatctggctaatttttgtatttttagtagagatgtggtttcaccatgttggccaggctggtctcgaactcctgacctcaagtgatctgcctgccttggcctcccaaagtgctgggattacaggtgtgagccaccatacctggcctctttcaccttcttaatagtagctaataacaaccactgtttactgagcatgatgaaccaagtcatttattttatttttattttttttgagacaggatctttcttggttgcccaggccagagtgcagtggcataattacagctcactgcagcctcaacctcctgggcttgaacaatcctcccagcttggcctcctgagtagctgggactacaggggtatgccaccatgcctagctaatttttgtattttctgtagagaaagggttttgccatgttgcccaggctggtttcaaactcctggcctcaagcaatccatccacctcggcctcccaaagggctgggattacaggcgtgagccattgcacttgttccagagtcatttattcctaaaaacagagctctgaggtcggaatgtttttatcctcaattacagatgggatctattagtcaggatttttgtttgcaaatgacagaaacccactcaaactgcttaatccgaaaagggaattcattgccttatgtaactgaaaaataatgctgccacaggcacggctggatgcaggattaaactgaggttgtcagaatcttcctccatctctggcctgggtgttcttctgggttggcgtcattctcaggcagcctctgcactagtggtagcactctggcccccagcaggcccaagttcttgttggaatgacaaaacctatttccccagaagttccaataaaagtcccagagctgcgtttcattggctctgattaagtcagatccctattgccgagccaatcacagtggccaaggggcaggaatatgcagattgggcacaccctagccatgtgcctgcccttagagctaggaatgtaggtgttccacccagaccacagggactgagactggaaaaggtgagattcccaagaaaaagcggaagaaagagctgggaatgtatattagtccgttttcacacttctgataaagacatacccaagactgggtaatttataaaagaaaaagaggtttaatggacagatagttccatgtggctggggaggcctcacaatcatggcagaaggcaaaaggcacatcttacctggtggcagacaagagagattgaggaccaagcaaagggggtttccccttataaaaccatcagatctcgtgagacttattcactatcatgagaacagtatgggggaaaccacccccatgattcaattatctcctaccaggtccctcccacaacacgtgggaattatgggagctacaattcaagatgagctttgagtggggacacagccaaaccatatcatagtggatactatgtctgctctttgggaaaccctgggctcaaagaggctaaatgacttccccaaccaggcagagctgtagccaggtctcaaatgcaggcttttcaaccccctgctaggttggcaccttcatttgagcccctagggtgatgagtgactgaggccaagcagaattccctgttgcctttcggcatttgaggaaggatccatgcctctgccctgcatgagcccacagctgagatcttccacagcttgagcatctactacatacaacgcacagtctcctgggtgtgcagaatttattgagcacctgctgtttgcagagcccttgatgaagcatacttgaggcaggcgcaagaagccacagtccccaccctggggggctgtggcttcctctgcaatttgcggccttccagcctggcctcctttctcttcctccacaagcttgttcctgccccaaaaccttggccctggctgtgggcttggcgggcatcttgtgtcaccgtaattcttgcatggctagctacttcttatagttcaggtctcagatcctgtgtcacctcctcagccagcccatctcagacaaccctaagaagtggtccctctgccccagtcacctctgtcacatcattctaactttttttttttttcctgttctttggagcagttagtatgtcattcatttagttaatattttaggtgcttctctcccctaaaggcagagattttattttatcatgttcactgctgtctcctagtgcctaggtgtccagtaaataatactgtggtaggcctggcacagtggctcatgcctgtaatcccagcactttgggaggctgaagtgggcggatcacctgaggtcaggagttcgagaccagcctggccaacatggtgaaacccccgcctctactaaaaatacaaaattagctgggcatggtggtgcacgcctgtaatcccagctacttgggaggctgaggcaggagaatcacttgaacacgagaggcggaggctgcagtgagccgagattgggctactgcactccggcctgggtgacagagcaagactccatccccaaatagtagtagtagtagtagtagtaacaataataataataataataataatgtggttgacttaagggagggagagagacgtggttgtttgagaaggtgctggttgtccactgtggctgtaccactgcccctcgcccagggagccctctggcccagcaggtggccctgctgtaagtttccttgtagggatgggaccagcctttgggcagaaccctctgagaaccgccgctccctgccttcccctcaggccggttctcagaacccattgaagccttgtttggggcaagttctcacctctcagatcaggaccccttcggcctctgcatctgttgtctgcatgtctggtgacccactctccatggatggtcgtttccttgggaaacctggacctaatcctcccaggaggtggcattgaggaggacatgggaaccaaggatgagtccttgtgtaacagggcaagaggtgcaagctagagtccctaatctcccctactccactttacaaaccatatgcactatttatacattttcttctgtgtacaaaattaaacatagactttataaaaacaaaaaaaattcggcaaggaatgtcaaagttccctataatttcccattgcagggagaaaactgctgtttagaggttggtttatatttctctagaattgtagctcctgataaaaatgagttgccaggcacagtggctcatgcttgtaatctcagcactttggaaagcccggggtgggggggcggatcacttgaggtcaggagttcaagaccagcctggccaacatggtaaaacccatctctactaaaaatacaaaaattaggcaggcatggaggcgggtgcctgtagtcccagctactcaagaggctgaggcagaggaattgcttgaacctgggaggcagaggttgcagtgagccaagatcgtgccactgcagtccagcctgggcaacagcctgggcaataaaatataaaataaaatgaaagcaaacattgcctggctcctttttgcatcaataagtttaattcacagactgagcctgagaccctctttatgcaggtaaagaaactgaggcacagagaggtgaaattcagaaatgttcccaaattcacagttttactgtaaggcatagtctaagttgcttagcaaacagacccacaaaatatgtgtggacacgaaatggtttctttttcacttgtgtggaggtcttgcattggtgggtggcttggggtaggcttgtttgtgcctcatctccttgaagccatctagagaactcgttcctttggtcttttttctctgccatcccctcaggggtttgccatggaccacataatcaattctggctcccaagcagagtccaccttacagggcaggctggagttacatcattgcaatgctcacttcccattggctgggcacagtcatgtggccacacttagctgcaagggaagcttagcaatgtcatccctagtgggtggctgtgtacccttttaaaactcaaaggaaaacagagctgagcacagtggctgcagcttgtcatcctaatgctctgggaggatgctggaagacaagaggattgcttgaggccagttcttgaggccagttcaagaccagcctaggcaacatagtgagacctcgtctctataaaaaaatttagatatgagccatgtgtagtgacacacgcctgtagtcctagcttctcgggaggctgaggtgggaggatcacttgagcccagaagtatgaggctgtaatgagccatgattatgacactgcactccagcctgggcgacagagtgagaccctgtctctaaaataaatttttttttttttaagacggagtctcactctgtcatccaggctggagtgcagtgacatgatcttggctcactgcaacctctgcctcctgggttaaagtgatactcctgcctcgacaccctgagtagctgggatttttggtacgcacaagcacgcccagctaatttttgtatttttattttattaattttttttttgagacggagttttgctcttgttgctcagggctggagtgcagtggtgcaatcttggctcactgcaacctctgcctcccaggttcaagtgattctcctgcctcagcctccagagtagctgggattacaggcatgtgccaccatgcctggctaattttgtatttttggtagagacagggtttcaccatgttggccacggttggtctccaactcctggcctcaggtgatccacacaccttggcctcccaaagggctgggattacaggtgtgagccaccatgcccagccttaatttttgtatttttagtagaggcaggatttcaccatgttggccaggctggtctcgaactcctaacctcaactgattcacctgcctcagcctcccaaagtgctgggattacagatgtaagccaccgtgcccagcctaaaaatatattttttttaattttaaaaaaattaaaggaaaagaggagattagattctgggcatcatcaggagctcctacaatagagagctagtaagtcatggagccagggtctgagcccaggcaggcgagttcctctgagccctccccttgccgcttctcagaggaggtgcgcctgggccctcccgcctgagcccactccccatcccaccaggtggacatcatgcagatgtgcatcatcgagctgaaggacagaccgggcaagcccctcttccacctggagcactacatcgagggcaagtacatcaagtacaactccaactctggctttgtccgcgatgacaacatccgcctgacgccgcaggtgaggccgagctcacctccaccctctgcccaccacagcccttggggtgagatcctggccaggctcagcccctaaagaggaaggtccctgtgggcttggagtctcacccccagagaagcctcttggagcattcagaaggagacccgtcaccccatgacagcttctgtcacctaaggtggccacaggacctgcagcccaaggtccctgcccaactgaagaggcctttttcctttgtcttttcctctatataactccttgaagagaaagcccctcagcatgggcagaggcgtggccagtgcctgcacagacctcagcctgtctcttgacatctcgttttccttcctgtcccctgtaggccttcagccacttcacttttgagcgttccggccatcagctgatagtggtggacatccagggagttggggatctctacactgacccacagatccacacggagacgggcactgactttggagacggcaacctaggtacgtggggaaagccagcctgtttctgcagaaaccacgctccctgctaaaacctctgagttcttcgtacagccaaggaaacaggctgagacactgtacgcgctttttcaagatcatggagatgggagcctggatgtctgatgcctcccagcttggcacgttttatacctgccctggccatatgtatgaggcccaccactgcctgtcccccgtcacagagcaaagcaacactccagacacccccgctctgtccacaggtgtccgcgggatggcgctcttcttctactctcatgcctgcaaccggatttgcgagagcatgggccttgctccctttgacctctcgccccgggagagggatgcagtgaatcagaacaccaagctgctggtgggtgcccagtgtgaccctgcttggcctggcaggcccttctgctacttgcaaagcaagccctgctcccctgtgtggtgacagccaggtcaagcagtgcttaactgatgaataccagggctggaagcatctgtcccatccatgccccagcccgtcccctccagctcagtgcacaaagccctcctgagcgtccttccaatcgagcagctggtatctgcttaggttgggcccattttttaccagagtgaggggaacaggcacgtggagatagtgagaaggcatgtggtgtgtgtgtgtgtttgtgtgatgtattgacaaatgactgaactagtcttagacctggctctccaggcacctcaccaacatacctcccatcctcccattgctacttggaccagggacaagagaatgttgcaaagaccagcttgggatgctggacatagagtggaatgctttctccagctctgggctgtggaatgtggtcagtgctttaggggatactggcaggtcctctgagcctctgttccagatgccctttcttggaggccttaggtttaatccctgactgattttttattttttaagacaatatatcagctcctaaacaggcatgtttaggagctgtggatgaaggggtttcagggttagagggaacaacaggaagagccctttaattcccagagggtgtgtgcgtgacatgagtatccctattaatgtccctagcaatcagccaagaccatcttgagaggaacagaggaaaaatgtgggagcccccaagtaaggaccctctctgggagccggccacccctgctccgtcccctttcagagaactctggagacgagaacatgagcgacgtgaccttcgactctctcccttcttccccatcttcggccacaccacacagccagaagctagaccacctccgtgagtgacggttcggtccctagtcactgtgattggaggggacaggtggagcagagctaaaccagctttcatttatgttagaaaaatcagacatgctaatcgaaaaggttcatggccccagtggttttataggtgagtttcattgagtgaactttcaaaacagatcatccaaatgctataaaaacaacccctattgtaggaaacaaagtaacttttatcagtgtgttttatgaaaccagcaaaacctatataataaatttgacaaactaaaaaagaaaattatatcccaaccttatttaaaatttgtatttgtgtatagagaacaaaaaaaaaatctaaatagatattaacaaataaaaatagtactatgttaaaaggttcacctgtcacagttaaatagggatttcacaggaatctgagggttgttcaatgttagaaaagctatgaatgtgatattaatgggtcaaaggagaaaaacagaatcattatttctgacactgaaagagtggagtttgctgatgattcagatgagagtctgtaggaaaggatagaggcaagactgaccccagggtattggcctaaagagctggaggtcatgtattcagggaaagtgtgagcgggagcaggctcagagcaggagagcaagattttattgtttagttttttaatttttctcattttgatacctttgaaagagagaaagattttagtgtcaaacattaaagaagccctttagatgtttccactggaaggtctttggaatagtctggaacaggagtcaacagacttttttaaaaggtcagagagtaaatattttaagctttgcaggtcattcagtctctgcatttggagcatgaaagctaccatagaaaatattaagtgagtggatgtggctgtgttccaataaaactctatggatggtgaaatttaatttttgtcatccatttaaaaatgtaaacactgttcttacaaactataaaaacagacagatagatttggctgtagagggcaggagacagagatagggaaccaccaggagatggttggtgttttttttttgtttgttttgttttgagacggaatctctctctctgtcaccccggctggaatgcggtggcgtgatcttggctcattgcaatctctacctcctgggttcaagcgattctcctgcctcagcctcccaagtagctgggattacaggtgcatgccaccatacccagctaatttttgtatttttaatagagatggggtttcactatgttggccagattggtcttgaactcctgacctcaggtgatccacctgcctcggcctcccatagttctgggattacaggcataagacaccgtgcccagctgaagatggttttgaagctatctgaggcccacttcttgagccccaaatgtataaacgtctgttcttccttcacaactgcattttattgaggaccaagtggtggccaggcacatatgctaataaacacattacaaggataattgcattgtgacaaccctgaggacacacataggtgacaccacttggccagaatcatgtagctggcaaacagcagacttagaataagttctcaaggaagaactttagcctccaggtgctgataacattcttctccttttttgtgcctttctttaaagcttaaaaaaaaaaaaaggcttggtggcaggtatggaccgccctaggccgtgggttggtcttatgcatgttccagtagtggaaccaggacatgatgtctgtttctccctgcccagattggccagtgttcagtgacctcgataacatggcatccagagaccatgatcatctagacaaccaccgggtgagtgtgaagggagggaggctgcaggcttcagaccccagcaggggtaggagtggattcactcccagagtgaatcttcagcttcggaggtgggcagcctagcccaggcactgccaggagggcacagaatgggggaattagggaggatgcagatgaatgtcagcctccagtccaaggctgagctttcctctgagaaaaggtgggtcccttgcagttcccagagatggttagggaagagggactcccagtcagcaacaatgcgatcttgtagtaaatgccagtctcagctccaggtttggtttgaccccacatgtgttggttgtcctatagagccctaatactgggtcttagatgtgtaacacatagcacagtaagccatgtgttctagctcttcacacctagctctccagttagataaacagaacatttcctgaagctttgggttgacttggtggtaagaaactgaaggcatcttatctgcattctcacaaatgtatattatggcaaattataatactctctatgcttgtgtgtgtgtttgaaatatttcttagtaaaattggccaggcatggtagctcatgcctataatcccagcactttgggagaccaaggtgggcagatcacttgagcccaagaatttgaaactagcctgggcaatatgacaagacccccatctctacaaaaaaatacaaaagttagccaggcatggtggcacatacctgtagtcccagctactcaggaggctgaggtaggaggatctcttgagcctgggaggcagaggctgcagtaagccatcatcacaccactgcactccagcctgggtgacagcgagatcttgtctcaaaaaaaaagaaaaaacaaataccttttagtagaggctgggcgcagtggctcacgcctgtaatcccagcactttggcaggccaaggggggcagatcacttgaggtcaggaatttgaagaccagcctgaccaacatgccaaaaccccatgtctactaaaaatacaaaaattagccgagtatggtggcagtttcctgtaatcccagctactcaggaggctgaggcacgagaatttcttgaacccaggaggcggaggttgcagtgagcagaggtcgcaccactgcactccaacctgggcgacagagcgagactcagtctcaaaaaaaaaaaaaaagaaatacttcttagtagaggcggggtgtggtggctcacacctgtaatcccagcactatgggaggctgaggcaggcagaccacttgaggccaggagtttaagaccagtctggccaacatgatgaaacctcatccctacaaaaaatataaaaattagccaggcatggtggcatgtgcctgtaattccagctacttaggaggctgaggcaagagaattgcttgaacctgggaggtggaggttgcagtgagctgagatcacgccactgcactacagcctgggtgacaacgtgagaccctgccacacacacacacacacacacacacacacacacacagaaaagatacttcttagaagaataaagaaggaaataaaactattccgttactaattgtgcaggtgacatgcagagagagctataattcaatgttggtaggtacatggctgaagttttagagattctaaattataccagattcgctttcagaacagaactcagacctgggagaataaaaaatatgcccaactaggccaggcacggtggctcacgcctgtaatcccaacactttgggagtccaaggcaggcggatcacaagttcaggagtttgagaccagcctggccaatatggtgaaacctcgtctctactaaaaatacaaaaattagccaggcgtggtggcaggcgcctgtagtcccagctacttgggaggttaagacaggacaatcacttcagctcaagaggtagaggttgcagtgagctgagatcgtgccactgcactccagccagtgtgacagagcgagactccatctcaaaaaaaaaataaaaatgtgtggttttggttgagggcttatttgtattaaatattgttcccaatgctatatttttgtccgtgggtcatagcccttaaccagcctttgtttttctgcctgtgaagtgggtgagtcactctcagtaaagcacttcctgtgatccacactctcagaatgtaacagtgcatttcacccacacagcccttcgatgtaggggctataatgaatcccataactaaggacactgatgctcagagaagttaagcaactgcccaaggtctcagctggcaagaaataaagccaggatttgagcccaggtcatttggctgtagagcccaaggtccttactgttaccttatactgctccctcgttggccaggcaggtcttgaacttgtgtcctcaagtgatctgcctgcctcggcctcccaaagtgctgggattacaggcatgagccaccacacccggcaagggacagcaggagcagggtgttaggtaatgggacagaggggagaaagctaacagttggggtgttgagatgtcataaccatttccaggtgctcaggggaccaccaggaccctaaggccgtcttctctccacaggagtctgagaatagtggggacagcggataccccagtgagaagcggggtgagctggatgaccctgagccccgagaacatgtaaggaacccccaggaaatgagaccggtgtcacctgttgccttgtttatcctccaggaaaatgaaaactccccttcctggagggggaatatgagtgggtcctgagaagataacaagtaaattaataaagagtatttcaggccggtcatggtggctcacgcctgtaatcccagcactttgggaggccaaggcgggtggatcacctgacatcaggagttcgagaccagcctggccaacatggtgaaaccccgtctctactaacaatacaaaaattagcctggcatggtggtgcatgcctgtaatcccagctactggggaagctgaggcaggagaatcactttaacccagaagacagaggttgcagtgagccaagattgtgccactgcactccagcctgggtgacacagtgaactttgtctcaaaataaaataaaataaagagtatttcagataaagataaatgcaaagaagataaaacaggatcatgtggaccagtaacggggcaagtgtggaggcttagatataaggctgataatggctgacaaatcttatggtgaagtgggagtcctgggctgctgagcagagaggatcctgggtaatagctggacccactcataggcaggatcctgtgaggccccagggaggagggccttggaggtcagtttccttgggtagcctcccagcagcatcctggtgagggcaacctcagacagtatctgccatttagaggtcttaccctgtgctgaaatggagcctgcacatcaaggccagtcttgccaggacacctctgatctcagctttatgattgtgaataaagaacatgctggccgggcgtggtggcttatgcctgtaatcccagcactttgggaggccggggcaggcagatcacttgaggccagaagttcaagaccagcctggccaacgtggtgaccccatctcaactcaaaatacaaaaattagccgggtgcagtggtgcactcctctagtcccagctactcaggaagccgaggcatgagaatcacttgagcctgggaggtggaggttgcagtgagccaaggtcatgccgctgcactccagcctggaccacagagtgagactgtctcaaaaaaaaaaaaaaaaaaaaaaaaaaaagtaaaacagctgggcctggtggctcacctgcaattccagcactttaggagggcaatgtgagaggattgcttgaacctggggagttggaggcagcagtgagctttgatcacactgctgcactccagcctgggcaacagagcaagacccatgtctaaattaaaatataaactaaacatgcagtaggagctctgcccgttaccccagtggctttgtgttgggatcctgcaccatcaagtcagttccacctgctcacacacggagggggacagcaaggctgtgactgcaccagcgttgtcatccctgcctgtgacccagcatcccttctgcttggcagagaagggttccagtgtcacctgggaacatagggccaattttctgagataagggtcacctaggagggccaggctggttccagggaggagggctggaccagctctcaggagaggttcctgggaagaagcttgtcgctttggatcagtgtaatttcttcctccgttcagggccactcatacagtaatcggaagtacgagtctgacgaagacagcctgggcagctctggacgggtaatgcgccctgaggcacccttgtctctgcctcttccctgtctcctccaggctctgttgctgtttctcctgtctcatatctctgctgcctgcccatctgtcttgcacatgtgctaaaggaagattttgcaaagcagcaaatctgggcaaatgctctttgaacctctgcagggcaggatgctgggggatttgtggggaggattagagaagagcagctcagccccatcctggaggggaaatcaccacagggacagctcctgtcttaagtgcctgccatgaaggcacttcgcagtaatcagtttccttcttgcaaccacccagagagacaggctaatgtgactctcatccccattttatgtatgagaaaactgggctcttaagcaactttccccaggttaccctcgcttgtatgtctaacaagcatcagcaagtctgggaaagaccagctctgtgccccacccacccctctaagtgattccctcacacgctttgaactgcccatctttggagcctttactaaggcaagtctctttcctacctgcaaagtcctttctctccctctgtcatctctcttcaaatcctacctgctctccaagcctggatcccagggcccctcgtccaggagccttccctggcctccaccacaggcatgactctggcatctcccagaacactgattatttaccctgtggtattttgtagccagattaggatcttctcagttaggtatggaacagggttgctcaagcaaggcactactggcattctgggctgaatcgttccttgttgagggggctaccctgtgcattgcaagatgtttagcatgcaaacgtgcacacgcacagctgcctggctgtatcctgcaagagcctttggagggggcatctttggccaggagaaatgatgtgttttttaaacccatttcctacagcaacctgctgatgttgctcatgtcgttgtggtgccttgcagaggaaagcaaggggatttgctggaaggtctgaagtgggagtcttctggtgccttatatggggagctggcgaaggggttggtttagagtgagacccccacccccaaccaaatccagattggtaaatgatggggaagcgcttccttgagctgctgaaatctgttccactggctcttgaatgcatgagttgatggaatttgaatgattaaaattggagctgtattagccgggcatggtggtatgcacctgtcgtcccagctactcgggaagctgaggcagaagaatcgcttgaacctgggaggtggaggttgcagtgagccgagattgtgccattgcactccaacctgggcaatagagtgagactctgtctcaaaaaaaaaaaaaaattggagccatgttttgccaataaactttgacatcgtgagggttcactccccatctccctccagccaggctcctgtgtagtaggggctgctgacagctgtgatgctgcgtccacccccagcccctcgcttccctggccggttctttcccttcaggtatgtgtagagaagtggaatctcctcaactcctcccgcctccacctgccgagggcttcggccgtggccctggaagtgcaaaggcttaatgctctggacctcgaaaagaaaatcgggaagtccattttggggaaggtatcggcgatgcccattttggagccctgtctgcactaacctggagccccccagctccagcctctcctccgctaatcacttcctcccgcaggctggctgggcggtcttgggtgcggctttggcccgccagacagccaggccgacaccgtagtctgtgtggcaggtccatctggccatggtgcgctaccacgagggtgggcgcttctgcgagaagggcgaggagtgggaccaggagtcggctgtcttccacctggagcacgcagccaacctgggcgagctggaggccatcgtgggcctgggactcatgtactcgcagttgcctcatcacatcctagccgatgtctctctgaaggtgagcaggtggcggggacccagctgcaggtgggggtgggacttggtcaccctgtggttcacctgcctcccatcctggaagtcatgcattcacctgccttctatcctgaggtttatgcatgccacaaaaatgtcccaggcactggtttgggggcaggcccctccaagttagttgaaactggcagaatcgatctctgtctttggagagggaggggaaggtaagtcacgtttccaggtaataacgacatggtgtgatgggggaagcagaagacaccagtggaaacatgtgaggaagggctgtaactggggcctggaggggttggttcaggcttcctgctcatcagttctgtgtgtatccctagtggctggggcctggcactgagtagatgcttggtagagattcgtagaatgaacagatgaagggatacctacctcaggccagagtggtggcttaaacctgtaatctcagcactttgggaggttgaggcgggtggatcacatgaggccaggagatcgagaccagcctggccgacatggtgaaaccccgcctctaccagaaaaatacaaaagttagccggacgtggtggcacacacctgtaatcccacctactcgggaggctgaggtgggagaatctcttgaacctgggagacagaggttatagtgagctgagatcacactactgcactctagcctgggcgacagagtgagatcctgtctccaaaaaaaaaaaaaattgggggggatatctgctttcgacctgaaggcccaaagggagtgagccaggccaagtgggggaggtgagcagctcaggtagaaggaacagcatgtgcttaggcccagaggtgagagacaaggtgcacccgtgtagctagaggtgcaggagctgaggcagagctggagctgaagcagcagggtgtggacctgcagggaaattgcgtaggagcctgctgctgcttctgtccctggtccgtgagcagagggaggaaaggattgaatgggatctggcaaggcccaggcaaagtgatcttttcccaggagaagttgagaagcccttggcgggcacatcctcccatctgttcccatcctccccatcacgtgggccaacgttgcgcatggacaggtggcctaggctcattgtgggtgcaggacatcagctctccttgacgggttggtttggctgtggcccagtgggtgaatggatctcagactcgagggtgggaagatactccaaagtcctttatttatttagctttttgaattggtaattacattcatgtgattaaaaacttatttatttattgttttgtttttgttttttttgagacagagtctcgctttgttgcccaggctggagtgtagtggtgcgatctcggctcaatgcaacctccacttcccaggttcaagcaattctcctgcctcagactcccgagtagctgggattacaggtgcctgccaccgcacccagctaatttttagtagagacagagcttcaccatgttggccagactggtctggaactcctgacctcaggtgatctgcccacctcagcctcccaaagtgctgggattacaggtgtgagccaccatgccggactatttatttattttagagacaggttctcactctgtcacccaagttggagtgcagtggcatgactgtagctcactgtagccttgacctcctgggttcaagcgatcctcctgcctcagcctcctgagtagctcggactataggcctgagccaccatgcccgaccaaagaagtttttttttttaatttttaaatataaaaagcttaacgatgggtgcagtggctcacacctgtaatcccagcactttgggagatggaggcgggtggatcacctcaggttaggagttcacaactagcctgcccaacatagcaaaaccctatctctaccaaaaatataacaaattagccaggtgtggtggcatgcgcctgtaatcccagctacttgggaggctgaggcaggagaatcacttgaacctgggagacggaggttgcagtgagcagagatcacgccactgcactccagcctgggcaacagagcaagactccatctcaaaaaaaaaaagctttacagtgaaaaatctgccttccaccttccccacatcctctcattctttgaataataggtagccatcattattagttacttatatgtaattccagagtgtattcacttcctaggacttccttaagaaattccacaaaccagttggcttataacaacagaaatttgttctctcacagttttggaagctagaagtccagaaatcaaggtgtcagtagagccatgccttcctctgaaggcttgaggggagaatccttccttgtttcttcgggcttctgggggttgctggcaatcttcagcgttcttggcttggctcactgaaatctctgtctccatctttccctcgtgtccctatctccctgtttcttctgctcttgtaaagacagcagtcatataggatttagggcccacctaacatccagtgtgacctcatcttaatataactattttttttttttcagtcttgctctgtcatccaggctggagtgcactggcaggatctcagctcactgcaacctccacctcccaggttcaagcaattctcctgcctcagtctcctgagtagctgggaatacaggtgcctgccaccacacctggctaatttttgtatttttagtggagatggggtttcaccatgttggccaggctggtcttgaactcttggcctcaggtgattcacccacctcggcctctcaaaatgctgggattacaggcataagccacagtgcccagccagtataactaattatatcttcaaggaccctatttccaaatcagatcacattctgcatggacgtgaatattgggaggatattgttcggcccagtacacggtttccatatacaaatatgaaataggctcctattttcaccctgctttttcctccaaagttagcatcctacacacacactcctgaacctagtgtttttcacttgacagtgtcctgtggacattttacctcagtggtatagagatagcttcctgattctttttttttttttttaatttgagacagaatctcgctctgtcacccaggctggagtgcaatggtacaatctcagctcactgcaacctccaccacccggttcaagcaattctcctgcctaagcctcctgagtagctgggattacaggtgcctgccaccaaacccggctacttttttttttttgagatgaagtcttgctcttgtcctccaggctggagtgtgatggcatggtctcacctcactgcaacctctgcttccttggttcaagcaattctcctgccttggctccccgagtagctggttttacaggcacctgccaccacgcctggctaatttttgtatttttttttttagttgagacagggttttaccatgttggccaggctggtctcgaactcctgacctcatgtgatccacccacctcagcctcccaaaatgctaggattacaggtatgagccaccatgcccagcctaatttttgtatgtttagtgcagatggggtttcgtcatgttgttctcaaatttttgacctcaagtgatctgccttcctcagcctcccaaagtgctggattacaggtataagccaccatgcccagccagctccccgattctttttgacagctgcataatgttctgttatatgtgtggggcatacctgtgagctattgatggacacttgggttggctgtattcttttgatatcacaaaaattgctgtagtgactggcctcctgcataatgggtggaacctcatgaaactgctattttggaaggtcataaatggtagaatattggcagtttcttatggttcagtcagattacatcatttgacatgtgggcagggcgtcgcccaccagtttttgtttcatgatggtgagacaaaaacttagatggtgaggaggaggtttggttggaagagaggatttttcacttttttgtctctctctataatctctctctctatatatatgtgtgtatatatgtgtgtgtgtgtatatatatatacatattttgtttttcttttttttttttttttgagacaggctctcgctctgctgcccaggctggagtgcagtggcatgatcttggctcactgcaacctccgcctcccaggttcaaacgattctcctgcctcagccacccaagtagctgggattacagatgtgcaccaccacgcctggctaatttttgtatttttagtagagaagggatttcaccatgtgggccaggctggtctcgaactactgacctcaggtgatctgcccacctcggcctcccaaagtgctgggattacagaggtgagccaccacacccggcctttctctggaatctctatgctcattcagccagtggtgtgctggggaacatttgacaattgactcttggaggtgggaaggaaatgtgtgcccacatatatgtaaatatattaaattttgctaatttaaagaataagtaggctgggcatggtggctcacacctgtaaccccagcacttttggaggccaaggcaggaggattgcttgagtccaggagtttcagaccagcctgggcaacatagcaaaactccatctctacaaaccccccacccccaaaaaaacaaattagcctggtgtggtgcacctgcctgtagtcccagctacttgggagagtgaggcgggaggataaaaaccatacactacaggagtttgaggcttccgtgagctatgatggagccactgcactccagcctgggcaaaagatcaagaccctgtctcaaaaaaaaaaacaagaaaaaataatatgtggtatatggtttacaaataacaatgaaaagtaaatttcatatcatcaactctcacacaatacttgcactgatttttgcaaactcttacacccatagccaacctatggttgcaattgatggagaagtgtagttctgacataagtgagatgaaagtgaaattaacaaagacctatgttagaactggaacttcatttgcctctgatgtgagcgacctccttcctgaatcagatggtagttttaaatactggaaggatatttcttcaatttgctgtactcgtcacaatagaatagctacaggcatgacccgcttgttagtttcatctgcagtgttcatgttttccacgcctttcttacaatagaaaaaacagtacatcaaaccctgatttgcagcattgtctgctttctaccaggtaagttatatgtgacccagcagtttcactcatagccataaacccaaaagaataaaaacacactttcacacaaaaacttgtacacaaatcttcatagcagcattattcataatagccaaaaaatggaaaacaacccaaatgtctgtcagtggatgaatggataaacgaaatgtgatacagccatacaatggactattatttgatcataaaaaggaatgaaatattgatatgcgctacaacacagatggaccgtgaaagcactgtgctaagtgaaaagagtcgcaaaggaccacatattgtatgactatattattatgaaatgtccagatccagaataggcaatccatagagacagaaagtagactaatggaagcctagtgctgagcaggatgaggagagtaggggtagagggagattgacagttaagcggtatgagatttctttctggattggtgaaagtattctgaaattgactggtgatggccatactgttctgtgaatatactaaaaactacggatgtgtactttttttttttttttgagacggtgtctctgtcacccaggttgcagtgcagtggcttgatctcggttcactgcaacctccgcttcctagattcaagcaattcttgtgcctcagcctcctgagtagctgaaattacaggtatgcatcaccacgcctggttaatttttgtatttttagtagagacggggtttcaccatgttggccaggctggtctcgaactgctgacctcgaactgctgacctcagatgatccacccgccttgacctcccagagtgctgggattacaggcatgagccacccagcccagctgtgatgtgtacttatgatgtgtacttctgatgcagggcaggcaggccccacattggagcttagcccaggagggttttttgcttcacccagaaaagaattcaagggtgagccaaatgtagaagaaaacagctttattgaagtgtcagtgttatagcttaggcagtggtacagctccatgactgcttctacggaatagggctgccccacaggcagtgtgctgagattagcagcttagggcagttctgcagtcagatttatacctacttttaattgcatgcatattaagaggcggtttatgaagacatgtctagggaaagggtagtaacttctaggttgtggggccatagccatagaaacaggcagtaactctcaagtgttgccctgacaatggtaaactgacatgttgcacaggtgggcgtgtcttatgaaaagctgttttcccaccccatccctgttttagcttgtccttgatttgttccagtgtctgagccaagcctctggagtcaagtgccccctcctatctcacttctatagcctcccaacccggagctctcaaaaaacagggtgaagattgagtagtgagatcttggcagccctcgagtgtaagcctcattcactcttctttctccctctttggtttgtatcaacaggagacagaagagaacaaaaccaaaggatttgattacttactaaaggccgctgaagctggcgacaggcagtccatgatcctagtggcgcgagcttttgactctggccagaacctcagcccggacaggtactgcagctgtcacccaggaggagctggtaggaacctgggctgcaggtgggcgcttgtcctcggtatcagcacaggcctgggttccagtcttggctgccccatgaccagtccagcaaccatgggcaacttattttacctccctggcctcagtttcttcatattgtaaactgggagtaattatagcacctgtatcctggggttgtcccatgaagggtaaacgagatgctgactgtaacccttgcggtgcctggcacataaagcatgtggtatggctgggcgcggtggctcatgcctgtaatcccagtactttgggaggccaaggcgggcagatcacttcaggtcaggggttcaagaccaggcttgccaacatggtgaaactctgtctctactgaaaatacaaaaattagggccgggcatggtggctcacgcatgtaatcttagcactttgggaggccaaggagggcagatcatgaggtcaggagttcaagaccagcctgaccaacatggtgaaaccccatctctactaaaaatacaaaaaaagaaaagctggcctggtggcacacacctgtaatcccagctactcaggaggctgaggcaggagaatcgcttgaacccgggaggcggagattgccgtgagccaagatcgagtcactgcactccagcctggggtacagagcaagattccctctcaaaaaaaaaaaaaaaaaagataaaagtcatgtgatacgaggcagccattctaaccagtataggtaatgatttgcctgagaaaaaaatctgaaagactatgcagcatccaggtgagagtgggtatccctagataggattatgggtgattttaattgacttttcctacttattattatattttagaaacagggtctcactctgtcacccaggctggaggacagtggtgccatcatagctcactgcagcctctacctcctgggctcaagcagtcctcccgcctcagcctcctgagtaggtgggactacaggcatgtaccaccacacccagctaaatttttaaatttgttggagagatggggtctcactatgttgttcagactggtctcgaactcctgggctcaagcaaccttccctcctcagcctcccaatgggattacaggtgtgagccaccacgcctgactagggcaggtattttggctctattttttgggtgactaaactagttctgagatgtaaaggggcttgcccatggtcaaatatttagcaagtggcagagccaacttacatcttctcacccctcctctgatgtactgtctactggcatggaggagaggtaaacaaaaaagactgacatgattgtattaggtcaaatgtcagtgtatacatatggtgcccattgagtgcactggggaagcacatcatgcatggggcggggcctggagctgggcactgagtatttgcatctgtgctttctcttcctggcctttgtctaccttttatttccatttgaggtgataagtttttattgacttgtaaaagttctttatatattaaagctattaaccctttggtatacttttctctttattttttatttttattttttaattattattatttatttatttatttatttttgagatggactctcactctgtcaaacaggcttgaatgcactggtgcaacctcagctcactgcaacctccacctcctgggttcaagtgattctcctgcctcagcctcccaagtagctggtattacaggtgcctgccactgtacccggctaatttttatattttaaatacagacaagatttcaccatgttggccaggcttgtctcgaactcctaacctcaggcagtctacctgcctctgcctcccaaagtgctggaattacagacctgagccaccactctcagcctttttattttatttttgagacagagtctttctctgtatcccaggctggagtgcaatggcgcgatctcggctcactgcaatctccacctcccaggttcaagtgattctcctgcctcagcctccccagtagctggaactacagatgtgcatcatgatacccagctaaattttgtatttttaatagagacagggtttcaccatgttggccaggcttgacttgaactcctgacctcgggtaatcctgcctgcctcagcctcccaaagtgctgggattacagatgtgagccaccatgcctggcctattttttatctatttatttatttttgagacagggtctctctgtcacccaggctggagtgcagtggtgtgatcatagctaactgcagctttgacctgggctcaagtgatcctcctgcttaagcctcctgcgtagctgggaccataggcatgtgccaccctacctggctaatttttataattttttgtagagacaagggcttgctatgatgcccaggctggtctcaaactcctggcctcaagcaatcctcctacctcagcctcccaaagtgctggtattacaagtgtgagccgctgtacctggccacatttcattttaaaagacattttttttttcagatatgtctaccatagatagagggagggcacagatgccacataatgaccattgtttactgggtttggggacacactggtttttaatatttatttagttaaaatctatcaaaagtatttctttattgcttctgctctagtcatttccttattcttcttccttattcaaagcagttccaaccccacccatgcaaagaacattaattaagggccagctatgggtaaggcagggctctgtgcaggcccaaatttgcgtttaagggattcaggccccagaagttactatccaataggcgaaggagaaggtgctagaaacgccaaggaaggatggacgccctcgccaatgggatagcatcgggttggggtggacaggggtcagcgattaggcctttcccatatgttttcaggccaattttgctttgccctttaagaccagggaaggtcagagcagaaaggagataaacaatctagtctagtgtctcctagtcagtgttaaaaccgagcccagcatggtggctcatgcctgtaatcctaacactttgggaggctgaggcgggtggatcacgaggtcaggagattgagaccagactgaacaacactctgaaaccccatctctactaaaaatacaaaattagctgagtgtgatggcagatgcttgtaatcccagctacttcagctacttgggaggttgagggagaagaatcacttaaacccgggaggcagaggttacagtgagccaagatcacatcattccactccagcctgggcaacaagcatgaaatgccgtcttaaaacaaaaacaaaagtttgttgagcatgtcaccaataattttcaaatggtccattttttaaatttaacttttatttatttatttatttgagacacaatcttgctctgtcacccaggctagagtgcgatggtgtaatcatagctcactgtagtctcaacctctcaggctcaggctatcctcccgcctcagcctctcgagtagctgggaccatagccatgcaccaccatacccaactaacttgtattttttgtagagctggggttttgccatgttgcccaggctggcctcaaactcctgggctcaagagatcctccaacctaggcctcccaaagtgctgggatcacaggcatgagccatatctggccattttttaataagataaaataaagtcaagattatttcctgagcaccatcccagccagccacttgcttgctttttttcatttaccagacatttattgacactatgctgtttgccagaccctgggaatgcagtagacaaatacagcaaaatagacaagggtctcctgccttcatggggcttaccttctagtcaagggacaccatgataaacaagtgaataaggagaattaaagattttggtagttgtaagaaacagtgtttgggggcagaatctctaaagaggtgatatgtgagctgagattggagggatgatgagtgtcttagcctgttctgtgctggtaacagaatatctgaggctgaggaatttctcatgaacagaaatttgctggctcttagttctggaggctgggaagtctaatatcagtatgccagcgtcttgcatgggccttcttgctgtgtcatcacctggcagaagagaaggagagggagagcaggtcaagcacggtggcttatgcctgtaatcccagcactttgggaggctgaggcaggaaaatcacttgagtccaggagttcaagaccagcttgggcaacctggtaagagtgtgtctctataaaaaaattttaaaaattagccaggcgtggtgacatgcccctgtcatcccagctactcaggaggttaaaatgggaggattgctggatcccaggactttgaggctgcagtgagctatgattgtgccactgcactcctgcctgggcaacagagtgaaacgctatctcaagaaaagaaaaaagagagagcaaaagggggctgaactcgcccttttataacaaatccactttcctcatactggcagaaatccattcatgagggcagaaccatcaaagcccaatcacctctcaaagatcccaactcctaatacctcacaatggcaagcaaatctcaacatgggttttggaggggacacacgttccaaccagagcaaggagccaggtgcagaaagagttggaggaagaatcttccaaggtgagggaacagcgggtgcaagggccacagagcaggcaggagcaggcatcgttggggaatggatggcagccggtgagcctggtgcaaaggtagacaaacaggagaccgtcctggagggcagcgcctgtcagacagggccgcagagggcactgtggcagcaaggcagggacagcaagtcatcagacctattgcttctggaatgtttcacgagacccacaggccttcttacctgtgtcgctgtatttgctctttcctgatatactataaatagttactcacacggattacacccaaagaaaaagagccctccgccctgtttgctgtgtattctgtggtgcgtgggtttggctggaaactttgtgtgccctggctggtttggccatacatgggctgcagtaggaggagttgagggtcgacgggcagagctggaagtggagactcaactattctggggtgagttctgcattgtgctggaggcaattttacataacaaaattcacagctgtcccgcacagcagagcatacggtgattgccattagtgcagatggctctagaggcctctgcagaggaccccgcccccaatccacttctctacaagtcagagggcagcttagctaggacactcaggcattgctaatgctagctcatggctgcctctgtgtagactgtaaaaatgggccccttcctcaagggggtgtcctagctaagctgccctttactttcatctatgggaaaattgttgtaatatactgattttattaaggaaagcaacttgactcctctttttttttttttttttttaacacagggttatactctattgcccaggctggagtgcagtggcatgatcatagctcactgcagcctctaactcctgggctcaagctatcctcccacctcagcctccggagtagctgggactacaggtgtccatcaccacacccagctttttgtgtgtttattgtattttttaatttttgtgggtacatagtaagtgtgtatatgggttacatgagctattttgatatgggcatggaatgtgtaataatcacatcaggataaatgggatatccatcatctcaagcatttattcattgtggtataaacaatttctttatactcttttagttattttaaaatatacaattacattatttttgactatagtcactgtttttttgttgtgtttttgtttttttgtagagacacggtctctctacgttgcctgggctggtcaactgctctcttaataaatattggccgagcacagtggctcatgcctgtaatctcagcactttgggaggcctaggcatgtggatcactcgaggttaggggttcgagaccagcctggccaacgtggtgaaatgccgtctttactaaaaatacaaaaaattagctgggtgtggtggcgtgcacctgtaatcctagctactcaggaggctgagacaggagaattgcttgaacttgagaggcggaggctgcagtgggccgagattgcaccactgcactccagcctgggcaacagagcaagactctgtctcaaaaatgaatgaatgaatgagtgaatgaatatcacagtatgaaggtgcctcatagatgtattggccttggacaagataggtcgtgaaccataggtggtggccctgctgggatccctgacttgcccctcctgctggaaggccctcctcctgccaccctgttgccatggtaacctccacctttccctctgtatctcctggcaaggtgccaagactggctagaggccctgcactggtacaacactgccctggagatgacggactgtgatgagggcggtgagtacgacggaatgcaggacgagccccggtacatgatgctggccagggaggccgagatgctgttcacaggaggctacgggctggagaaggacccgcagagatcaggtagggcctggcagacctgcccctgggctgcaacagggctgggcagggaggaacctaatttccattccactgggagttatttatgacaagatgacaggctgaatcttcttccagggaggggaatttatggagctagtatgaagatgaacattgttattttaatggttatatattacggctttgtagggggtttttgcaattttaaaaactgaattgagattttcataacaaaattcaccatcttaaagtatatagtttagtaggggggttttcctttcctttctttctttttttttttttttttttgagacggagtctcgctctatagcccagactggagtgcaacggcataatcttggctcactgcagcctccacctcccgagttccagcgattctcctgcctcagcctcctgagtagctgggattacaggtgtgccaccatgcacagctgatttttgtatttttagtagagacagggttttgccatgttggccaggctggtctcgaactcctgacctcaagtgatcggcccacctcggcctcccaaagtgctggattacaggcgtgagccaccacacctggcccagagtttcactcttgtagcccaggctggagtgggccatctctgctccctgcaaccttcacctcccaggttcaggtgattcttgtgcctcagcctcctgcatagctgggactacaggcacacacccagctaatttttctgtttttagtagagatggggtttcaccatgttggccagactggtcttgaactcctgacctcaggtgatctgcccgcctcagcctcccaaagtgctgggattatacgtgtgagccaccatgcctggcctcctttccttttctttctttcttttttctttgaaatagaatctcactgtgtcactcaggctggagtgcagtggcacaatcatagctcactccagcctggaactcctatgctcaagcaattctcctgcctcagcctcccaagcagctgggactacaggcacttgcttccacacccagccaatttttaaaagttctttgtagtgacagagtcttgctatgttgcccaggctggtcttgaactcctagcctcaagcaatctgctgccttggcttcccaaagtctttggattacagatgtgagccactgcacctggtcctagtgggttttagtatagtcataatgttgtacaatcatcactgctatgtaattccagaacatttccatcaccccaaaaagaaatcccgtaccagttagcagtcctccccgaacctagcagccactatactttttgtccctatagatttgcctattctggagattttatataactgggagtatacaatttgtggctttttgtatctgcttctttcatttagcataactttttcaagattcatctgtgttgaagtgtgttatcagtacttcattccttcttattactacataatattccattgtgtggatatacagcctttatccattcatcagttgatagacaagttatatatatattttttctgttacataatgtattagtcttcttgggctgccaaaacaaaatactatagagtgggtggtttaaactaaaaaaattgctgggcacagtggctcatgcctgtaatcccagcactttgggaggccaagatgggaggatcacttgagtctaggagttcaagaccagcctgggcaacataggtaaacctcacctctacaaaagaaattgttttaattaactgagtgtggtggcacactcagtgagctatgatcataccaccgcacttcagcctgggcaacagagtgagaccctgtctcaaaaaacaacaaaaaaaattatttctcccagttctggaggctgggaattccaagatcaaggtgctggccagtttggtttctggcttgtagaaaacagctttctcactgtgtcctcacatgacctttctcctggatgcaagtggggagacagcaagagagctctgctgtctcttttgcttcctaaacgggaatgagctctgtgtgattagggccctacccttatgacctcatttaagctttatcacctcctcacaggctgctagaatatgaacgtcccctccaagtctcatgttgaactgtaatcaccactgtgaaggtgtcaagaggtgggactgttaagaggtgattaatgttgttatcatgcagattggtcagtcatcacaaaagtagctttgttataaaagcaaatttggccccctcttgctcgcttgctttctacgtctcttgctctttgccttctggcatgggatgatacagcaccaaggcctgtgccagatgctggtgctatgctcttggacttgccgggctctagaactgtgagccaaataaatttcttttcattataaattatctagtctgtggaattctgtcatagcaacataaaatggactaagacacagactgtgtgtctccaaatacagtgcagttacatcatgaatgaagagttcaacatatgaatttgtggatggggagcccagtggggacacagcattcagtccctaacatataataaacatactaagttcctaatttcacaggtataggatgaggctaagttttaaaagtttttaagttatattttaaaaattaacaaagaataatgcaaatctaggctgggcagtggctcgcgcctgtaatcccagcactttgggaggccaaggcaggcagatcacctgcggtcaggagatcgagaccaggctgggcaacatgatgaaaccccatccctactaaaaatacaaaaattagctgggcgtggtggcaggtgcctgtaatcccagctactcaggaggctgaggcaggagaatcgcttgaaccccagaggcagtggtgacagtgagctaagattccgccactggactccagcctgggtgacagagtgagactccatctcaaaaaaaaaaaaaaaaaaaaaagaagaagaatgatgcaaatctataatcttttatttgaaaattttaaatccaaaaagctccaaaaacctgaagtatatttgtatgttttacacaaattcacttggtaaaacctgacctagctgacatgaagctgtttgtaagtcgttatttcttccacttttgcacatccccacttagttctgcaaaagttctcaccctgattctcattggctcaaattagttctcagcctgattctcattggctcaaactcaatcatctacataccccaaaccaacagtagttgtttagatggcttactctgattggccatgactaaatctggaccaatcgctgtagcttggtgggggataggaggagtgctattattggctagattttatcacaggcccacctttagagccccgcccggaacacctggagggagagggcacacggagtagtttgagttcttaaggaaacgtcagggtgttcttctgggaggggtgatgggggacactgggctggcaaaaacaacaggtggttcacctctttttgcccccctttgctgtctttcaggggacttgtatacccaggcagcagaggcagcgatggaagccatgaagggccgactggccaaccagtactaccaaaaggctgaagaggcctgggcccagatggaggagtaaccaggaaaatcactgccggctagtcccaagcaaacgggctaggaggaaagattaaaaaaacaacaacaacaacttatttagtttggggaggggaagcatttttaagtgtgttgtaaaatcaaattttatatttcattttttgactcttgaaaaatgtctttgctccttggcagctaccagcagagactctatagctgtctcttagggcagtattttggggaagtggggcttgaagaagcagcctaatgaaccaacataccgttttgtgtgtggttttttttgtttgtttgtttgtttgttttgagacagagtcttgctctgtcacccaggctggagtgcagtgacatgatcttagctcactgcaacctccgcctcctgggttcaagtgattctcctgcctcagcctcccaagtagctgggattactggtgcacaccaccacactcagctaatttttgcatttttagtagagatggggtttcaccatgttggccaggctggtctcgaactcctaacctcaggtgatccacctgcctcagcctcccaaagtgctgggattacaggtgtgagccaccatgcctgcccattttgtggttctattttcatttttatttctttttttttttttgtcacgagatataagaaagtgctttttgccttgaatggacaattttagggctgtgctcactagtcttttcaggctggactgaaatgtcgggcccatggagccctgtgttttgtgcatcgggatgagaaatgaagcacttcacgctggctttcctaagtcacggggcgtgtattgccgtggcttagtgcaaagcattctttctcagagcatttagaggcatgcgtggcattttttcagtgggtgtgagattgcacaatacccaggctcccttctactgtggggaagggcctgcatgttggctgttttttaaacttctagttcaatttccttccataatgctactgattttctggcatacagccgaattccatcttttaagcatgctttctacggtgggcttttcaaaacaggtttgagttttgtatgcacacgtttactacctctaactcctacatcagctagtgtggaagagggtgcacctcaaagcttttacacgtaaggacagcggcttggaatgtgagagccttttctccaagcagacccacactctgcatctcagtggcagctcccacaacgtgactgcaatgtctcttatacagtattccttggtgttttcttagtgtctggatgttcttacgtgaaatctgctccccagccctggtccttggcattttctgcttgaagctgggctgattttcttgtaatttacagcaggacgctttcagcagcagtctcttgggattttatctaagatgtttgaggatgagagggcaagaactataaacactcattaattctagtagtctccccatggccagacaatggcgattgttatttaatgagcttttcctttcaatggaattcagctctcacattagtatgatttcatttgatgtttcaaatagcaaagatgctaggtgcggtggctcccgcctgtaatctcagcactttgaggagggccaaggtgggaggattgcttgagctcaggacttcaagaccagcctgggtaaacatggcgagaccctgtctctaccaaaacaacaaaaaaaagacagactgctttgatcaaccctaaatgcaaaagcagcctatttttctttgtttaaaagtcaaaacataaaaaagcagagtataacatacaaaccattcttaactattcattaaaatgggtccttcaacaccttagtggggtttgttgttgttgcttatgcagagagattattttctttttattattttataatttttgaaatagagatggggtctcactgtgttgcccaggctggtctcgaactcctggacttaagtgagcctcccgcctcagtctcccaaagcgctgggattacaggcaggagccactgagcccagccaagacttcagtgttgactgctttggaggcacaaacccatgcaagcgttagttccaaagttcagtgtgtacccttaaatgaacaatgaagcaggtaaaattacccttgaaaaaaatcccttggaccacccataaatgacagtgactttttcaatatggactcatcatagccagttttccttttgaagttggaactgatcacccttttgtcatctgtaccagatcagtagttggcttgtgttacattttgtgtgtgtgtgtgcgtgttttaaaccagtgcatataaattgtatgttaaatgtaagtaactttaagttgacttatctcttcacagtaatcaagcctcacgtaattcatgctttttaaattcagccagccccccctctctgaaattttattatgtaaataatttgtgttccctgatcactcgtttaagttcttagttgtatgtcatctcttctctagcaggaattggcaaacttttttgtaaaggggtagaaagtgaagattttaggctttgcaggccatatagcctctgctgcaaatgctcagccctgctgttgtaatgtaaaagctgccacagacactacatgaacacgaatgagtgtggctggtgttccaataaaactttatttacacaaacgggtggcccttttgggctgtagtttgtcaacccttgctctaacccttgactgagagctactttattaagccctgagggcaggagctatcccaattttgtgttccccagggcaccaaaacacagtgctttggcatagagtaggcactcaacaagtgtgtgaacagatggagagccagccctagtcagtgcactcaccctttgaggctctggttcctccaaacaatgattcgttgtctggattggctggaactgtcacccccgcaattctactccccacccacccatgtgaccttaatgtcagttgctggtctgttgctcttcggggagggagagatggcctggatacagagctaagcaaatgcttctttaagggcccttaaaagtgaaaagtaacttgcaagaggttgagatccttctgagctaggagaacttattccaccttcaaaacctagtttgggctgggtgcagtggctcacgccactttgggaggctgaggtgggcggatcacctgaagtcagctactcgggaggctgaggcaggagaatcgcttgaacccaggaggcagaggttgcagtgagccgagattgcgtcactgcactccagcctgggcgacagagtgagactccgtctcgaaaccaaaaacaagaaaaacccctagttttgtgccttctgaagatagttaggacatcttctttttccgcaaatgctggacatgccaaaaacctaacgcaaaacccaggacattccagcccaactgggacgatatcagagaccatcttcaagtgcaagaagcaggtgaaagcccaggaaattggcagagccaggattatcatccagtactttcatttcacaaatggagaaaccgaggttctgccagctagattttttttcacagtgtcactgctagcaagccactaagctggagctgggatttgagagctgctgctatttagaggatcttgggaataaaatttaaactggagtttaatggccctttcagttttgctataggcaagagaataaaatgaatgaatggataggtggctttatgggtgtaagaaagaagcgaaaaaaactcccaaaccccagtgttcctgaatatctgttctccccctgaccactctgggaatttatcaaatgcagctttgacctccaagccaagtaaactgctcttgttgctattttagtggtttttgtttttttaagacacaaggtctcactttgttactcaggctggagtgcagtggcatgatcataactcattgtaggctcaacctcctgggccccagtgatcctcctgcctcagcctctcaagtagctaaaactacagatgtgcaccatcacatctggctaatttttttttttttttttttgaggtggagtctcgctctgttgcccagattcaagtgcaatggcacgttttggctcactgcaacctctgcctcccaggttcaagcgattctccctgtctcggcctcccgagtagctgggactacaggcacctgccaccacgcgcagctaatgtttgtatttttagtagagacgggggtttcaccatgttggccaggctggtttcaaactcctgacattaggtgatccacctgcctcggcctcccaaagtgctgggattacaggcatgagccaccgtgccaagccacgcctggctaattttttaaaattattttttgcagagacagagtttcactatgttgcccaggctggtcttgaactccttggcctcaagtgatcctcccacctcagcctcccaaagcattggggttacaggcgtgagccactgcacctggccctgttttcatggcttttatttcctttcatcccacacatttgtctgcagtactagacatgttttacaaatcaacaagtttacacaagtatatgcagcttgttttggggggaaaggagacaaaatatgcatattttctgtgtggatttgtgcctcttaattgtgtttctagtctctaaggtgaccctttaacctactcaagatggggcccagagaagtggcctgcgttacagatttattttggcatatgtactaagttccattttctctttacaaataaagtgttttctttcttttctgtctcaga

SEQ ID NO: 1541 - DNA, 28683 bp, Homo sapiens
gttcattttcataggtagctttatttggtttttagaaaaatatatacaataatcggaacatcagttcttaaatagttttaagttaaaagaatgcaagtgagaggatgtttccacagtcagatcaatactgcttaataaagtagataggaatttctgcaacaagtcaaaacatttacaggaatggtaagaactctgcaagagcagcttgtggctggcaagtcagccagctcagaaaacaggtaggaagggaaggggtttgatctttcccctttagtttgaatttgagaaagtgataaaagatttacatattcacctatcctaaaggctagagctttgagtaaaaacattagaatacagggatggaggccctctagggcatatgctaacaagctaacttatatcaaacaaaaatttgccatctcaatttggtattcagttggatttggatatattaggattacctgtcagtcacagttcaactagttcagatataacaaaactcaaggacttggagtattggttaatgacatttcttttggattagacccctgctttctctcgaacattcttcgtaatgaattcacagtattcaaactgtttgcaaagatatttgagtttgacagccttctgactttcatcgttttgagaagttgcgcaaggaagcaataggaattgccttagctttgttctaactcgacccttttcccccatactgtagtaactccaggcctacttctccagaagtatagctcttccctccactggtccttttcaggaactgaagtctaatcagcgcgccagccagaggccagtttgtcatgggatttcctggggagcttaaatggaagtggatcagagaactgataccactagccacctcctttcctcgttgtatgcatttgctaaataagcaaagcaatgaggcaaacgtcatgagtaacattaggcttcagagtctacaaacacttgtctgaatgggagagagaggcgataggcaataggcaaattagtagtagagctagaggttcaattaagaatgagaggagagtgatcggtattttgttctctgttcatctatttcctgcttagttttcttgatgcaactaaagatctccttaaacaacgctttgtattctggaggtgttgtaggggaactcacgggctctgggttgacagaggccagttcccagccgctggcaacaggctcagactgggcgttcactccagtcaggtccttggctgcagccctggaggtctgcacagccttgtgtgacagggagtcctgttcctcttggcacttcttcagcaactcttcatacttcaccttcagggcgctgtactgcgtgtccacttcgtgcagaagggagatgcccctctgtttcacagccttggccctcctgatgcaggtctcctcgtggcccttcacgatgtcactccctgccaagctgctgaggatcgtctcactgctgctgcgcttgagaggctttctatgtgattccggcacagtcaggaacatctcttccagcaggctctggctgggctctttgaaaggaacatacagagagtctggcaccagcttctcaactccattcacaaatggatgctctgactgcaacatctgtcgcatctctgccacctcggcctctagttccagcgcccgtgctcggtaggcacctgtggcccccagctgctgctccagttcactgttctcctttaacacgagcccatattcctcctccatagtcacccgcttctgccgctccaggctcagctgggcctgcaacattgtcactgtttttttcaagtgctcattttcctcttcatcagggcttggctgaccttgcaaggaagtgatcttctcagcgaacacatgatcatacacgaagtgtctagggaaaaaaatattgaaagaatatattacacaggtccactgaaaatgacgagaggaagactggtgattttttttcaactaaataaatttgaggagctgtgacagtgactaatttttttttctttttttttgagacggagtctcactttgtcgccaggctggagtgcagtgaagcgatctcagctcattgcaacctcagcctcccaggttcaagcgattctcctgcctcagcctcccgagtaactgggattttagacatgcgccaccacgcccagctaattttgtatttttagtagagacggggtttctccatgttggtcaggctggtctcgaactcccaacctcaggtgatcctcctgccttagcctcccaaagtgctgggattacagacgtaagccaccacacccggccaacagtgattggtttttagccacacttggagcagtggctaaaatggaattgtgtgaggctggtaaataaacacatgaaagcaaactcaatttttgtgacaaatctttttttaatgttaaaagtactagagaacatctattctagcagtatgacaatgacctcacaagggaaaccttaaaaagtactggtgcctgggtcccaacccacagattccaacctagttggtctgctacctggcctgagggtttctaaaggctctccaaatgattcataatatgtaactacgattgaatcactacagcaaattactgttgctgtggtgatttttaaccaggaatgttcatcagaattgcctgggcagctttttacccgcacctagaaattctgatttaggcctgaggaaatgtgttggtatttgcattttgaaaaaccccacaggtgatctgatgtacagccaaggttgagacccaccaaatgaaccacctggtttctcctgctcagtctgaagcaccttgactatttatttgtgtttttatttgcttatctgccgttccgttagactgaaagctcacaggggtagaaactattttgctcgccaacccttgggtctagcatacagcttgccacacaagtgttccataaatacttcttaaagattcagacttataactctaaattataaaggtacttctttaagcaaaaaatctcctgttcgcttgaatttttgttttaccagtatttctgtttttcttcactctaatgtaaaacacaactcccaaatctagtctatcagaattcatcttaaactatgatttaatacattaaaaacactgaaataagtgttccaagactttcaaaatgagaactactaatatctaagaactctgtaatttatatgtttaagtgattttgttcaaaccaatggtagcttaatagctaagtgacttttcttaaaatggtactttcaatctactggaaatcagaatgtgccaatgacatgagacagtccctgctgtaactccacagaaaggcaggctcttactggcggaggtcatacagctccttcagacatgcaaagctgggtgccggtttctcctggtcacactttcccgggctccttctcccttggccagatgacttcagctcctccacttggctctggaggtgatcaatgttggtttgcaggcattcaatcgtttcagtcaggctgtgaggaacagacagaagccactgctgcttgtcatattgaatcaagggcaaaagcggtgaggagagattaggtgcaaaccactcacactgggctttcttaattggaaaggatgtctatttaatctccattctccaaaaagaattaaattaaaccttatcccatattgacccaaacccactgcagccatgttctattctagtttatactaaagaacttccccctagtccttccttgtcagattctagaaaatttacctcagaatcttttgctgtgaggccttgctgtcagcaactagcttttgatttgtttcttccagttcccttgctgtgacgtctaattgttcataaacctttgcatgttgttcgttcatctgccgtagaagttccacttgcttcgtcagatactgtaagagaagatcaggaccaggtgacacaaacagataagatacctgctgtttcttggctggctgcggtggctcacgcctgtaatcccagcactttgggaggccaagacgtgtggatcacctgaggttaggaattcgagaccagcctgaccaacatgctgaaaccccgtctccactaaaaatacaaaaattagccaggtgtggtggcacacgcctgtaatcccagctacttgggaggctgaggcaggaaaattgcttgaacctggaagacagaggttgcaatgagccgagatggcgccattgcactccagcctgggcaacaagaatgaaactccatctcaaaaaaaaaaaaaagatacctgctgttctgctgttccaacaccaattctccgattgtcagcaccaactcttgttggggtggggctgacatagagtctccatctctgggctcactggcctcccagcactgcccagaagctcctttagacccatttcagttttctccaggtcttctctcacatcagcatgattgattcaattattggccattggtgactgaactcaagctccaacccttccctctatccagaggttgtggggctgggactgatagatctaaccctctaatcatgtggttgccttctctggtgaccagacctcaacctatcaggaaattccaagggttttaggagttctatgccagaaaccagggacaaagaccaaatatataatttttattataccacaataccatatgtttattttaagaaaagaagaaattaaactccctgtcttcataagaaatgagcacaggctgtcctttatatgcttagctcctctaatgctcaccaataccccagtgcattgtgaggctaattttccaaagcatataccatgcataaaattaatattcaactaaaaaatctaaagtgagacataacaatcccttaagacaaaaaacatggaacatgtgatcaaagtttaagcaaaaacatcatgtttaacagaaataaagcctaacgtggaggatttttaaaaaaaattatactctaagttctagggtacatgtgcacaatgtgcaggtttgatacataggtatacatgtgacatgttggtttgctgcacccatcaactcatcatttacattaggtatttctcctaatgctatccccaccccgacaggccccagtgtgtgatgttccccaccctgtgcccaaatgatctcgttgttcaattcccacctatgagtgagaacatgcagtgtttggttttctgtccttgtgatagtttgctgagaatgatggtttccggcttcatccatgtccctgcaaaggacatgaactcatccttttttatggctgcatagtattccatggtgtacatgtgccacattttcttaatccagtctatcaactgatggacatttgggttggttccaagtctttgctattgtgaatagtgccgcaataaacatacgtgtgcatgcgtctttatagcagcatgatttatgatactttgggtacatacccagtaatgggactgctgggtcaaatggtaattctagttctagatccttgaggaattgacaccctgtcttccacaatggttgaactaatttacactcccaccaacagtgtaaaacgttcctatttctatgtggaggatcttaatttggaaaaaaaaatcaatctctttctctgaatgaggcattctggaccaaaaaaaatgaaaagtatgttgctttgacgagaaatatattttagcttaatatgcttcaaagactcctgttatttttaattttatgagagttttatcaccattatcctccttattcacgagaaatttatcagatgatttattctggtcctgctaagactgcttcctaaatggccaaggataaaggggaataatcccaaccttaatgccgcagtgtaagtcaccttgattccctccctgctcagctctacctgaagacactaaaacacagtatatattccaaaggaaaaagtcacagtatttccctggacagaaccagaaagaggggagaaatggtttgaagcttactgatgatcaaactgtaaaagactcagaacttgactttaaaaacactcttcttggccaggcatggtggctcacacctgtaatcccaacactttgggaggccaaaacaggcagattgcttaaggcaggccaggagttcaagaccagcctggccaacatgacaaaaacccacctctaataaaaatacaaaaattagtccggcgtggtggcacgcgcctgtaatcccacgtactcaggaggctgaggcatgagaatcttttgaacgtgggaggtgaacgttgcagtgaaccgagatcgtgccactgcactacagcctgggtgacagagactgtctcaaacacaacacaacacactcttcttgaggctttttctacaactctagaaggatttgcaaggctaacaaacaatgggctaaatgacactcaacgggcccttaaagtgttgaaaaaagcatatatggctttttttttttcaaatccatttacataactcagcagcaaagagttgaacaaacacttaacctaacttcaactttctcatctgaaactcttgaagtcaaaagtgttttggaaaattctttaaattttagaaagacaacatggcgctcatacctgacacacagctgacaccttataatacctgtgaggtctgggcagcaccctgtaatcaagcattaatatttctgcatcaaaaagtatgaactaagactataaacagcctcacatcagttcaggtaaagatctactaccaaatgaatctgttgcaaatttaaggggaaaaaaaaaatcttgctttatagagctttttgagttcggaattagtaagtggatctgttagtacctaccatgtagaactggcagaattaaatgagaaaggtgagcacatggcacggtctataaaagcctgtgtgtagtcttcactgcctcaactcccaccagcttcttctggtcctttggaaatcaaccactaattctcatgcgtgaagctttctcagaactaaaggagtaggcccttaatcctgccctcgggctagtaattccatagtaggttcttgtcattgatgggaacatgttcaatctcttaggaattgatgagattccacaggagcggaaaaaaggcttagaatcacaagaatatatatataatagctgcagaaatgtttcaagcttctttatatcaagtataaattatcaagtattctttaggactcagaactacctttaaaaaggctaatgcataagccagacattaatttattaatatacaacaggaactgttcctgcccagtgacaagaatattcacatcctctattaggacacagctgccccacaaagggcatgtgaaaggccgattcatgaatgagagtctctggtagacatgggatcagaggagtctgatgggaggcagtggtatagtagctaagagcacaggctttggagtcagaacctggtttgaggtcttgctttgctgtttagaactgggtaacctacagcaagcacatttttctaatgtgagttctcctcatcaactacttcataaggctgtaaagataaatatgtgtgtgggagagactggactatgtcaccccaaagcatgcgtctttggcataaaaaggttcctgcctcctccctctctaccagggagaacaaaggttaaccactaacaactttagacctttatgggccagaagacagcaccagaggaatccacactaacaagctttgctaacgggcctttatcaccacttacttgccttcccacaagttctgcccctagacaaagttcttcccctttgtcttgtcacttctctaaaaaattaccattctttgttgaagatactacataagctggaattcaaagccacctctgagaatgactcatcccctgggtatctcccacacatataaatgaaatagatatgttagtaagcttgtttttctcttgttaatctgtcttttgttgcaggggtcctttccaactaagcactcatgaaggttgaggaaaaaaatatttttcctccctgacatatacaaatatataatttacaaaaacgttaatatatgtagagagctcagcatgagatctggcagatggtaaattgctcaataaggagaagctactgtcatctttatttaaagctacagttttcaaactttacatgtgctaagattcacctggaagaagatttattaaagtgtaagaacctgggtcccttcccctcaaacggctgagactggagtagagccaggattctgcatttttagcaacaaacccaggtgatattagtacaggcagtccagagatcacacttagagaaatgttgatcttggacatggaaaatcctggacgtcccctgccctgaccaatgtccttttctcttgggtctaggagacacaggcattcactggatcaatgatgactcttcagcttaatgctcaccgtctccctgcatagggctcagcttagatgcagttatccactaagattaggttatattttaactgtaccacagcagcattcatcatcataacgcttcactttggtatgttcttaacaatcattaattccctgaaattacaaactagttaccttaaccttgcttgagtgatccttcctaacttctcagtccaaacaaatactgaatttctacagatggctaatcttatccactgcattttaaaactttctattgtggaccaggtgtggtggctcatgcctgtaatcccagcactttgggaggccaaggcgggtggatcacttgaggacaggagttcgagaccagcctggccaacatggtgaaactccatctctacttaaaaaaaaaaaaaaaaaattagttaggcatggtggcacacgcctgtagtcccagctacttgggaggctgaggcatgagaatcacttgaacccaggaggcaaaggttgcagtgagataagatcacaccattgcactccagcctgggcgacagagtgagactatgtctaaaaataaataaataaataaaactttctattgtggataatctcaaacatatatacatgcagagaaatggtttaatgaactcccacgtacccatcaaccagtttcaacaattatcaacatacagccaatcttatttcatctctactctcctactttcctcgtcctccaatcattttaaagctaatccaaggcatctcaagtatacatcttcatacatttctaggacgttttattttaaccacaattcctaagggaaaaaaactcaataattccttaacatctattacgtttcagcattaatattttcccaattgtctcaagtggtttttccagcttcatttgttagctattgatttttttaaaatttcacacttaggggagatatctttgccttttttggagttgccccactgcaaggcaagtgcctccctcctctaatgcctttacgatcccctatccggggggatgcagttctcctggctgctccacctaagccagcagttcttagcctggggtccatggatagactttagagggtctgtgaacatggatgaatttaaagggtctgaacagctacatcttcatttttgttaacttctaaatgaaatttgacatttctttcaagtactaatagatctgttaaaatttataggagaccactggtttggactgagtccctgccctaggcccaacaaaccaaaccaaaatggagtcacttgtgctaaagttccatgtcagcaagccaaagcaaagttgttcatctgacttctgagaaattagaagagataatagccaagcccccaaacatgccagttttagccagcataagggacttccctctgctttaacctttacaaataaattaactttgaaaccacccattttttgttttctgtttctgctttcctcagcccctgtctataaaaccaacttcctctgctcagctcattgaaaccctcattctctaagaatgaggtgttgcccaactttagaatctcaaataaaagctaattaagatctttatactatgtttgtcgtaattttttcttttgacagaggcaataaaccactagtagtattaggtttatctgtgacttcatcatcaacagaaatcacaggtattttcatattgcactatagttgcagaaatcttgatttactgcctacattcatcactatttgaaatcatggtagtttctagatcttgttattaaatatgttaatacgtatctatattacatcacaaatttacttttttcaatatttgacaggtatttcattctaacaggtttcctttgtaattcaatgaattttaagaggattatcctagatctcattagataatcaaagggatccatggcaccaaagaaagattataaattccagttatccttctggcctcatttcaaacataacctcttcagaagccttttaagaccactttggccaggtgctgtggctcatggctgtaatcccagcactctgggaggccgaggtgggcagatcacttgaggtcaggagttcgagaccagcctggccaacatggcaaaaccccgtctctactaaaaatacaaaaatttgctgggtgtggtggctcatgcctataatcccagcactttgggaggccgaggcaggtggatcacctgaggtcaggagtttgagaccagcctggccaacatggtgaaaccccatctctactaaaaatacaaaaattcgccgggcatgatggcaggtgcctgtaatcccagctactcaggaggctgaggcaggagaatcacttgaacccaggaggtggaggttgcagtgggccgagatcacgccactgcactccagcctgggggacaagagcaagactttgtctaaaaaataaaataaaataaataaaaatacaaaaattatccaggcaaggtagtgtatgcctgtaatcccagctactctactggggaggctgaagcaggagaattgtttgaacctgcgaggcagaagttgcagtgagccaagatcatgccactgcactccaacctcagcaacagaacaagactccatctcaaaaaaaaaaaagaaaaaaaaaaaaaaaaaagaagaccaccttaaagcaggtctaaagcggcagcattcccaaggtaccctaaattgatttctctcaaaacaatacaataatattcaattttttgttgttgttgagatggagtctcactctgttgcccaggctggaggcacgatctcagctcactgcaatcttggtctcccaggttcaagtgattctgctgcctcagcctcctgagtagctgggattacaggcttgcaccaccacaccaggctaatttttgtatttttattagagactgggtttcaccatgttggccgggctggtcttgaactcctgacctcaggagatccacctgactcggcctgccaaagtgaagggattacaggcatgagccaccgtgccaggccagtactgtagtcttctaagaatggaaggctcttgtgtatctagtccattcctgacacacagtaggggacaaaaaaatactggcgaactggcagtttctagacttttcttcacaacagcttattgtgcttggcatgactcagactgtgagatgtcaagggggatttaactgaaaggttttgagaagggctttggctttagccctcttgggaaaacagcctattaaccatgaattctctccccgcttttccatttatagattatttctctgtatttattcccatggcagcaattgccccggtaatctgagggggagacttttacagttcctaccagataccagatgggtctcaagttgttgttctcttacagataggatgttcaagttagagttgtggccaacatacaggaaacaagtcaatatgcaaataagtacaaacaggccatttaagaaactatagaaagttccttgtttgatatataaaaacctgtgatacctgtgataacaacataatgaaaccatttaagaacttgtgatattttggttttagatgacttggctttaacaacaatctaaagaatgtcaaggagcttgttttcacatggtaggagcttaatcttattatataaaaccaaaattaatcagaaaagcccttcacttctccaagattcagttataggggacctacagaagagtctgacaaaaccagtcagcaacttaaagaaaaatgatgagctctctaagtacgtactgatgtaaggccagacatctaggtctatggagtcagtgcttcattttttttctgaatctagaaggaaatgggttagcttatttcctacctctcatctcaaggtacagacatgctgctgacatgctggttttctctttgatacacagcctccaatgaatctgactgccatagtaaacaggaaagggagacatttaaagcaaaacagtgggggaagggggtcatggggtagcagaaatgtgggcaaaaatgtcaacttatagcaaaatgccttgggtttatctcactgtctaggaatttgcacagactgtcacctcaactatgagtacaaggttccagttatgcacaaaagctacaaacaggccacctttacaattaaggtaaatctttaaaaaacaaaggccagcagaattacataaatacctatttgcaattgtggaatcctaacctggaacgcagggaaagatagaaacaaacgaccccaagtaaaaatgcatagaaatggagtggaaatctggcttgtaagcagtgttgggattatcctgaaattaaggattacagcctaaatcctctgaatttactatcaaaatgaacttccacaataataaagaaatatttcctattacttttgaaaaatctctttcccctgatgaaatatatttcccctgtagaaatttggtggcgggaggcatgaacatgaaaatagaaaccacctataatcccattattaaaattgtgggattagattgtttttaaagtctatttccagtaattctggaagatttattttttcagaatttaagttctttcatgactatagttaacaatatcttattgtatacttcaaaatagctagaaaagatacgcaatattcccaacacaaagaaatgataaatgttggaggtcatggttatctcagtttagatttcatcattacacattgtatgcttgtatcaaaacgtcacaggcgccccagatatatgtaaagctgttatatatccatacaaatttttaaagacttttttcactactaaaattctttttttttttgagacggagtctcgcttttttgctcaggctggactgcagtggcgcaatcttggctcactgcaacctccacctcccgggttcaagcaattctctgcctcagcctcctgagtagctgggattacaggcgcccgccaccacgcccagctaatttttctatttttagcagagatggggtttcgccatcttggccaggcttatcttgaactcctgacctcgtgatctacctgcctcagcctcccaaagtgctgggattacaggagtgagccaccgccaccggctcactactaaaattcttaaaacattggtaaactatgcaacgatttataccgttcaaaatatatatgcttccataatctcatcccctcagaaaaatcctataccaaagtaacaatttatactgttcaaaatatatatgcctccataatctcatcccctcagaaaactcctacaccaaagcagtgtaagcattatcaccattccataacggagcaaagagaatctgaggggtaattcatatgtctaaattctctagctatttgcaattaaaattgagggtttaaacctgaatctcctaaaacagaggccagagccccttctgcctgccttaaaaatctccagaggtggaaacccaaagtttaggagttattagaagagctttgtaagctgtttctcctctgttaaaatactgatttcaacaaagtattgattacctagtatgtgtgaaagaccatgaataaacacaacagtgctcactgttgcaatgggaaataaggggaaaggaaaataaagcaaatcaattaagtatcatatgcagtagaatattgatacatgcagtaaaagcagcacaaaatatttttccatttccaaagagggcatgaactcttgaaagaagggatgccttgaaggccagactactttgagtgctaggcacaactcctgtaggggataatgcaggtgtctaagcagggaagtaaccaaaacacaaggctgtaggctgcttacacggttgtagcaaagtgtaaatgaatccaatggtgtctgatctcattactctcccaagtaagagttctctcctcccctccttccacccagaacagaaaaaacttgctctggattcttaaaaaattatctaagtttttcaaattagcactgaaaaaaagtaagacaggctacaggcttctctgaagccagtttaaccattattttgaatagtttaatcttttttcgttttcacataaaaggaaatttttgtttttttcgtttttacattaaaaatgatgcctaccaaaaatactgatcaatttttaggaggattgtttgaaaccctccaagagtctttgaaagaatatttgtggttctacttacaaaataccctttggcagtgtccaagttgtctatttccataataagtcagaatcttagggatcttgtcctagtattttcaccagttctctgcactatttttcattcgctcagatgagtttgttcccagaccattcttctggactgtctcattttaaatttcactggtggtgggataggagctgactttttgttcttcaactatatatttttctgaattaaaaaaatgatcttttttttttttttttttttttttttttgagacggagtttcactctttcgcccagactggagtgaagtggcaggatctcggctcactgtgacctccgccctgcaggttcaagggattctcctgcctcagcctcccgagtagctgggattacagggatgcaccaccatgcccagctactttttgtatttttagtagagacagggtttcgccatgttggccaggctggtctcgaactcctgacctcagtgatccatccgcctcagcctcccaaagtgctaggattacaggcgtgagccactgcgccaagctgtgtattactttgtaatctaattcccaataaacattctaaacagttactttaaaacttgtacaagtgattccattcacgtaaaggtcaaaaacaagctaaacttaggatgctagctcaccgggtggtgaccagatgagctgataatgctctcaactccttatctaggaataggttgcatgggcatgtttactttatgaaaattcatcaaactatacacttaggatttatgcccttttctgtaatgtagatttcaataaaaagtttaagggaaggagaaacacgttgaaaaggctcaaattaaggagagggcccttataaagtttagggggcctcctgaaggttgcaataagaggaacatatgcaagggtcattgtttagcaaggaagtaggctctttagctgcctggttacttttacaagagcacatggcattcttttaggctattagagagacctcagaaatctacatcgtgatctctacatctgcccaggcacagttgtgatggagcaggcagcaaggacagtctgtgggaatcccctggctggtaagtgggcttagccattactgccatctcatctcccctactgagactggaaacttactttcatgaagcaacttataaaaggaaagaaaaaagaaagtcaactgtaatggtggtgaagaaacctaagagagtaattattcttagccaaaaacagctttggataaagagtaaaatactgcattgtgcaatgctcagatctaggaaccagtggactacatattacaggaacaagagactcatgaatatgtttcccgaaatattccaagctaaatctcctgaatagttttatacatgaattttatacttttttttttttttttttttttgagatggagtctcgctctgtcacccaggctggagtgcagtggcacgatctcggctcactgcaagctccgcctcccgggttcacgccaatctcctgcctcagcctcccaagtagctgggactacaggcgcccgccaccacgcccggctaattttttgtgtttttactagagacggggtttcaccacgttagccaggatggtctcgatttcctgacctcgtgatccacccgccttggcctaccaaagtgctaggattacaggcgtgagccaccgcacccggctgaattttatacctatttaatcatgaaggtctgaactggattatttcatttccatgacgctttgcaatatcttatggataatattagataataaagtgttatttgtagatttagagaatctcagatatctttggatactttcagaataccaatgatctagcttaaatgtttaatcatcctcgataccacagaaaacaaagcagttgtttgtaatctcctatgctaatcaataggcatcattctcccaacttacaaatatttacacttctttcagctacacttgaaagatatgctaaaataagtaccagttatagtgttttataaatgctctaacaggaaacatcaatacaatttattaactattagcaataatcaggcctcggataaacctcatagactacgataatacaattaagactatgtctctacacaaatacaaacagtgatgatcgtttaggactattctgaaatctcccactgagttaaaaaacaaagtctacgaaacaaagtaggaaagagttccttgaccacgtaaaacatttggctagtttaatagttttgtttttagactagagacacggtctcactttgtggcccagtctggtctcaaaccctagcctcaagcaattcttccacttcggcctcccaaagtgctgggattataggcgttagccaccatgcctagcctagtttaatagtttttaaatgcctagtttctctgcattttaggtttctggcaaactctacagtaggtcttttttttttttttttgagatggagtcttgctctgttgcctaggctggagtgcaactgcacaatctcagctcactgcaaccttcacctcccgggttcaagtgattctcctgcctcagtgtcccaagtagctgggattatgggtgcttgccatattttttgtatttttagtacagacaaagtttcaccacattggccagactggtctcgaactcctgacctcaagtgatctgcctgcctctgcctcccaaagtgctgggattacaggcttgagccatcgcgcccggcctacagtaggtcattaaattcaatttagtgtaaaacatattgtacgctcttttgatgtagaatatgctaaaaatggtacctggtgacttcaatatcattgcaagccatactttcctagaattataaaagtgtatttcagaaatcctgctcaaggggagggtctactgtatacaccttttatgttactaggtaaaattaatggatactgagattgcacatttgcctttgttttgatgatagatttgtattcaaaagtttaaaactgtatgatgtgatcacttctaaggaaggactgtgtaattctccgcttgtttgaattcccagcacctggttcaggaaataatcaaagctttagtaagtactcattatgatgaactgcttcactgttctagagtcttttacatttttctgtgcacagacacaaaagtcctgggtctactgtaccaatttaagggggaggagcttataatttaagtacagaccctttttgggggaagcatgggttgggacatggagaaaggtgttctgatgggacactggttaatatccgtgattatctttacagtcaagtggcctacacataactgaactacttgaaggggactatttataagattagcagcatagagggccattttaatgccctagtctagcatctttcattttagtttgttaagctgggcaaaaggtattatattattattatttttttattgagacaaggtctcgctcccatcacctaacctggagtacagtggcacggtcttggctcactgtagccttgacttcccaggttcaggtgattcttccacctctgtctcccaagtaagctgggactacaggcacacgccaccacaccagcctaatttttgtatttttttttgtagagatggggttttaccacgttgcccaggctggtctcgaattcctgagcttgggcaatctgtctccctcggcatcctaaagtgctgagattataggcataagccaccacactcagccaaaaatgtagcattttaataaaatatccagcaaaaatgtaaacaaatcaagatcacagcagagagaaagcaacatgtattttatgattatttgaatggagcaaaacatctgaacacactgtgaaatcaggaactatgatttttttttttcaaatttaggatatggtttggtagtaggtgggagggatatgtcaccaaggaggaggtataagttccctctccggtgggaagttcaagagtgtgggcagtcttcttttttaagctaggtggtggatatatgggtattcactgtattgttctcttaccccattctgtatatcttaaatattgcatgttttaggccgggtgtggtggcccatgcctgtaatcccagcactttgggaggccaaggcaggtggatcatctgaggacaggagttcgagaccagcctggctaacacagtgaaaccccatctctaccaaaaatacaaaaattagccaggcgtggtggcaggcgcctgtaatcccagctactcgggaggcggttctcattctcaaaaaagtttgtgttaaaaaataaaatgctgcatctaattgcaagtgcttttttaccagtatgtgattggcataacagcaacacatcgaagtgtcaaaagtgtaactctcctgccaagtgaattacctcaatttcctgtaactgctcctgattggttgtatacatctgctgaacagagtcctccaactctgtgttccgatccagtaatgtcttcccaagctcagcagcaagttgaagatctagcacaacaaatgaatcttagaataatacaaatgatctcacatcaacaatttatataacccagtccttcaaaaaagaacatgtagtttaagtcacatcccaatggaaggtggagtggcacagaaggaaacccgagttctacttaaaattcagttaaactgacgcctccagcaggtaatgtattctcttatgtacccatacttgtaagaagtgaaaaatggtcatctactttatggagatgcagttatttgttcaggaatgatcattccgcagtgttacttctaaaatcctatttgctagtacaatgaatgtattcatatcctgacagtctacttttttgaatggacccttgagccaaggtataggtggagctttcaaaaatctttaaagttcccatgaatttgcctgctgtgaatacaactgttaaagtttattgtcatatatcctggactcctaaggggactaaaatttattaagtcaagaaaaggaaaaatacatcagcattaagaacactgccccaggtcactctacttctcttcgtgtccttctgtaagatgagcaactagaaaagcaaaacagaaatgtggtttttgaggtaattacatgtcagtagctcatacttccatttagcacagaaccatattttattttaaacctcatttttcaactctctctattcttaggtataatgcccataaaacaggatttgtttatattatactcaactcccagaaatgaaaatttagttaacaatataagaaaggacactagttgtaacatacgtcattgaaatacttctttgcatagtaaatcttatggagcagtcctttgatacagtgggaaatgcactgcactctgggcaggtaagtctcaggcccagttctatcatttaccagaacactttcaatatggtgactttaaggcccctatagttagtattcttgtttagagagatgactgtcttatcaatataagattgtgaaaatcaaatgaaataatacataaaggagtactttacaaactaagttgcaatacgcacgcaaagtactattaatagtcattgattcacaaatgaatgtttttgttgccaggcactatgctaagcattagctatagaacagtgaataaaatgaagtcctgctttgctgacattcccagattagtggaggaagccagacaaatgagtaactaaactcacatactgtgataaacagtattcatgcatgcatgcatatactcaataatatcagacactattctaggcactgggatggtgcccaggagccataaggaactcacattaaaaaaatatccctgccctcatggagcttatattctactgggagaaacagcacaataaaacttgatagcgataaatgctaaagagaaaaaaataaagcaaggaagaagtacaggaggagtgtggatgtgggaggctgaaatttaagaacatgtgaccagggccacattagaatcaatgtgtgaaggaacagaataagtgacccatgtgtatccatcagggaaacagcactccaggcagaggcaaggcaagtgcaaagcacctgggaggaagcatgactgagtcattaaggaggctgaggagggtggagcagaatgtattgggcagggaggggagggggaagactcaaatcagaggggctccaagatggccagtttgcggagggcctaactaaagaggtcaagagtttggcctttactccaaatgaaggaatccaatggaggtttaacaggatcactccggctgctgttatacagggtgaatgggacaaaggtgggagcagagtgacagaaagatactgcaatcgtctgggtgagagatgatggtggcttggaccagggtggcagagatgaagatgggagaggaggggcagaattctgacatgttttgaaagtaaagctaaaggatttgttgaccaattcaatataaagtctaaaagataaagcgggggagaaaaacctggatttggtgataatgaacaaagggctttctttttctgtctctttattaggcacggtctcgctctgttgccatgctggagtgcagtggtgcactcatggctgactgtagccttggattcctgggctcaagtgatcttcctgcctcagcctgccaaacagctgggactacaggcatgcactaccaaacccagcttacttacttactgatttattgtagagacagggtcttacaatgctgcccaggatgatctcaaacttctggcctcaacacatcctcccacatcagcctcccaaaatgttgggattacaggcatgagccactgtgcccagcctagggcccaatttagaaagggaggtcataaggaaggtctgacaagaccttttagctgaagcttgaaggatgaagaacttgccatgaatttggcatattctacaacctgacaagcagccagtatgatagaagcatgagggatcagatcatataggattttatagcccatggtaggtaaagtttaaattttattctaggtatgatggaaagtagcctcagttattgtcataaaagtattatgaaaaaaatttatcataaaaacaaggaaactcactacataatgatttttaaacttaatttttagaggttgacaaataaggcttaatggctatccaccactactcatagtaaaacttagcattgagtaaatggtaacaacagcattagttgttgtaatgtccactcaagtgcataattagtattctacttggttagttttcactctggaaaaagcagcaaaacctaccacacccaactccagatcatttaaaaacattttacacccatttaaaataaaacagtatactgttggtagataggtgctaaaatacattctcttgtgatttcaaaactaacaatgtctattagtcattacattcattaagactttagaggccaggtgcagtgggtcatgcctataatcccagcattttgggagggtgaaccagatggactgcttgagctcagaagttcgagaccagccagggcaacatggtgaaattacatctctaccaaaaatacagtgaggccctgtctcaaaaataaaaaaataaaaaataaagacttccattaaatctatgaaataacttgtatttacaaaacacagaacttttacaaatagctcaaagcatttaagagacattagtctttttcttgtcattatttatttattttttttgagatggagtctctcactcttgtcacccaggctggagggcagtggtgcgatctcggctcactgcaacctctgcctcctggattcaagtgattctcctgcctcagcctcctgagtagctgggattacaggcacccaccaccacacctggctaatttttgtattgttagtagagatggggtttcactatgctggccaggctggtctcgaaatcctgacctcaagtgatccgcccaccgcggcctccccaagtgctggggattataggcatgagccactgcccccagcctactttttgttttctagagacattagtctttatatctttaaaggtatttagtccagtttctcagatgagacagcctgaagcacaaaactgttaattgacctaatcaagctccaaggtgagtcacagatcaaacagaaactcttaggtcaacaggttctcactctcactctcatcacgattctttgttatcttcatctgcagagttttaaggcaattgaaagagaggtccgcaggcttctttaaggtagagaatacaaatgttccccttgttgaggtacttaatttcttctacttgttttcacagattgcaatgagaaattagagttcaactatttgggtttttattgcctgctctgctagtgaaagcacatacaaccccaggcaagttaataccctgttttcaccaaatgaaaaaggaactatgtatggctcaacatgttccagaaaaaatgattttgtactcacagagtgtgtaatgtgtatacatagacccatatggaagctaccacactgtattaaagacaaagtataaaaacattacctaggtattacttaagtctttccttcttaaatgtgtgaagtggtaattcctcactgggaaggctcagattcaccaaagatgctcttaaccagcaatcaaagcctgagccaaggaccgggtgtggtggctcacacctgtaatctcagcactttgggacgccaaggcaggaggactgtttgaggccaagagttcgagaccagcatgggcaacatagcaagaccttgtctcttagcaggaaaaaaaaaaaaaagaaaaaaaacaaaacccaactgggctgaaacctctcccagaatccagactgtcttgagactatcaccactttcattcagttatggaactacctgtgctacttaagagtagccaggaacctcttccctgctcctgcagaaagagataccaaggacagcactctttagtagatagcaaacaaaaaagaatttgagacttgtccttatctcaaaccttatttccagtaaaacaaagcaccagcctggctcagaaacctgaagtctcgatctcctaaatatttataggctgttaaggatagaattttaacaagtcccaactacaagaaagctcctgtgaagtcacactgtataacaggatattacttcatctgttagcttaaagacaccggactttgtctttaaaaaaagttcatttcctgttgagtagcagctggcttccataaccaaaagaggccaaaagctggcagtaagcccaagaaagttttctaaataattagtggagggaatagaatattgaatgtcccttatagttttaattaaggcacaaaagaaaaggaaataatatagtttcgaagccttatacacctgttcatctctacaggattacaaaatgaattttcattaagagggtcttctctaaatcctattgaactggcctggtttaggcaactactaaaaatactgtagatttattgcaggcttgagaatttcaacatatcaataccttcatatgttgaatattctttcactaatgagtctttgcaggtaataatatatttttaatggtgtaaactgttagctttaaacagatactcagctctatgctttaggcaaaaaattagtactggcagctgtagtctgtaggagtaattcactaacagtaaggctgaaagtttttcctattacaaagtcaaatgcgtcatttagtgatgcttctgtttaactcctgttgccaatgttactataattgggaaagcagaaaacctgaatataaatatcaagaaaaatgatgttgtcagttttaataaccctccaaacagtgattcagcaaaatagttgtacacaaggaggatgtactcatcctgcaattttaggattcctttaaactaagagttcatttactgatccacataacagaaacctgaatccttattctaagtttgcacagctcaccaaatgacaatagcagctggtttaaaagaaaatccagtctctgaagtctttccaccttgttctcaggggcatgtttcaaagcaagcaccatcattacctgcactgaaggctcctgctgtcccagaaaagatcttacccacagagattattgtcagtattcctactgagccaactcagctctctgacaaaagacagtctcttcatcaaagagttttgtaacagcaaagggttttctcctcctgcctacacaaaagctttacatgtttctaacaaggtatgaatagtagaccagagtttactgaggttagaaatttccagcaatttcaatttaaaaacggataccctaggaaactttgatacaaagattcaatctattcagagcatggcttactactgctaaaggaaaacattctatagttgtaagatactgagaacaggatcattaaaagttgttttccagccaggtgcggtggttcacgcctgtaatcccagcactttgggaggccgaggcgggtaaatcacgaggtcaggagattgagaccatcctggctaacatggggaaaccccgtctctactaaaaatacaaaaattagctgggtgtggtggcacgtgtctgtaatcccagctacttgggaggctgaggcaggaaaatggcttgaacgcgggaggcggagattgcagtgagccaagagcgtgccactgcactccagcctggggacagagcgagactccacctcaaaaaaaaaaaaaaagttttaagcagttctctccaaataagccttgctcagtaataataatgaggatgttaaaaaacggacagatgcctgcacataaaatcccactagacttgctgaataatctgtttaacaggacagacctgctcccaaacttaattcagcagcaagtgtctactgagggcctacaatgtacgaggcgctgtagtgggcacatcccatgaggcggcacctccaggcttctctagtgaacagattcctggaacattcactctatgggagtaggaatcctacctatccactcatgtggggaggtgctgtggccccagggcccaggcgaatacctggcaaagagcagataatacatttttgagaaatgaacaagttttaaaatctgttaaaagtttaggagttaacatataacttagcaaaactggggaaaggatacccttttattcacactgtagcctttattctttgacaggccatattcacaagttacaattgttggaatttcacatcttctactcgtactccatatagttggttatgacacagagggttaagtcaaagtccactgtgataacgtaacagccctttgaaaaacacagaaatgcaactggcagtaaagaggttcagatatgtgtgtgtgtgtgtgtgtgtgtgtgtgtgtgtgtgttttgagagggagtttcgttcttgtcatccaggctggagtgcaatagcacgatctcagctcactgcaactccgcctcccagtttcaagcaattctcctgcctcagcctcccgagtagctgggattacaggggcctgccaccacacccacctaattttgtatttttagtggagatggagtttcaccatgttggccaggctggtctcgaattcctggcctcaggttatatgcccgcctcggcctcccaaagtgctaggattacaggcatgagtcactgcgcccagcccagacctgtgtttttaaggttaaacttgaagagctgatgactttattttgatcagaggttaaagagaattcctcgtgtaaccctgacacgttgcacttgctgctcggtagattgaagtgttacagctgttgttcctaacaacctcccacagcgggagaatgcagcgtggactaaggcacctgatggaagagagccatgaaaacaattctgtgcgagtgcttcagtgcagttcaacaaatattaaaatcgagcttccagtatgtgccaagtattatgctagatgctggaaacacaagaaaaaagaacctgccccctctatgcccttaaagattaatgcttcttaaatacaggaaagagaaatatttagttgtgatgatacaaattaaattatagggaagtactgcagtggtacagtggttgcctcacaaatcctggagaaactatcaaactaggccatcaatccttacggggaaatctgaaaacaggtttgttaatatgtataataaatttgtctcttggacataaagaagatggtgccaaacactgcactgcaaccactaagtagcttggactctgtaagtgtaataaaggtgaattactttggttaaagtgattgcatgttaatttaagaaattatcttcctccaaaagaggtgctcattttattttccttttctgagttattcaggtctacattcttttcttctgccatgttcagtggttagcatgaacaagcaacatgatcatttaatattcaactaaatgagatgttaattttcattgcaagattagagctgagagcatttacacagaattgcagaaactgaagatgcctggaaaaattcctgaggattgttcagtactcagtatagcggttaagaacgtttgctctggagtcttaaggagaaccctagcactccccaacattactacctctattgtgttactgggagaattaaatgagcaactgtgttatgggcctatcagtgttaggcacataaaaagtgttccccaactgctagctcctgctattagtataagaaaaacaggggccccactggccccaaagagtgggctactctacgattgttctctggagacaccatcggcaggcctgtttctaagtgaaagctggcgtgcaaactgaagaaaagtggcagagatagatgcgctctttcttctgtcgtttcaattggcatctggtgaactatgcctaacagcttaacgcccaactgaaaaaaactgtaaactaggatggtaaggaagagatggggtttgagcagtgactacaactcttcttctgagtgtgtgggttcaaaaaacactccctcccacacttagctttaggcaagccactttaccgttttaatctccgctttcctcatatggaaaatgggataacaaaagtgtgtaattggattgtttgtacctcaatggataaatgctgggatggacgccccgttctccatcacgtgcttatttcacactgcgtgcctgtatccaaacatctcatgtaccccacaaatatatacacctaccatgtaccctcaaacattaatttttaaaaagttactgtctcctggagttacggtgcggagcgcacagctcccgctacgccgcaaaacaactaccacctgcagcagccggccctccacgctggccatgaaaggcgctgggctagacagcctgcgacggggcggcttctcgggctatgccacttactgcgggacacactggctcacccgggtctgcctcggaggaatgcagtgaggattaaactagctaatccacggaaagcgcttaaaacggtgcctggctcgtccctggcccccacgcgcctcggggctgatattcaactgcgcattagcaaggccgtgggccccgtgccgaggcttcctgcgggcgggatccgcgggcacggccggcccagccgccaggtgagcctgagcccttcccggcacctgcatcctccgccgccacaaaaagcaactttttaacagtttcgcagcgggggcctcccgggccaggccgccgcccgcccgcggggcgcccccgccctcaccttgctggaggtcctggtggtcgtaccacggctcgtcctccttcatctcaaactcctctaccaggttttccgccagcatctcggctgggtcttctaggggcagcggcccccgccgccgtcccgcctcagccgctgccccgggctcttccccggcccctccgccctcagccagagccgccctcgggcgggacgcgccgccgcccagactccgctgcgccgcctcagccccgttcccgccggcggccgccgaccggccggctgcctcgactcgcctcgcgcctaccgacggccccaacggccgggcattacggtgcgaacgcctggagccggagtctcacgcagccgccagtcttcacgccgccgccgggcccaacgtggcactttggc

SEQ ID NO: 1542 - DNA, 17247 bp, Homo sapiens
attatgtctcttagttattttaattatagtacttgaagtttaccaaaaaaaagagagaaactaaatatttaaagaaaaatgtagtgtttacataaagtgacattctctactatgttcagacattctgatattggatttctctacggcattttctaaaagaaagaaattcttctcaaaaaggagggtcttattctgaaaataagatttgtgaggcctgcaagaacccaaggaagtctttagataatcctgttgaagaacatctctaaaggctttataacgcagtcataagagaagagaattggtgagtctacagacagtccttgataagtacagcaaacttgtgcctggtgaggcacaaaacttgggtgtctgcaagataaatgctcatatgaccacagatttgctaaccaacctttgataccagttgggctttaccctcttcaacttgggcacaatcttccagccaaaatgcatctgaggtagaggaggtagaggaggaagagctttcattgtcttgcttcaccattatccagtatggagaaggggccctcacttctttcttgtcgtctctgtgaatcatcacgtcacaattaatgtcttttcctacactaatagtatggttcttcttcttatatccatgccagtctctggagatggatattggtctccttgcagggtgatgcacagttgaccacggatatctataatattgaagtcttttatctaaatctacattttcattatcatcactgcttgtgaaagattcatcttttgccagctcaattttctttggtgtgctgaaatgaaaagaatagtgaataaaatagattcttcatgtctaaacatttatggtcccctaacaagatgccttataacttgctttgactcataaaagatacaatttagctttagcattacctttctgtgtcattgaaatgtttctcttttttaaatcgtcttgaaatctttttccatttctaaatggaaatcaaattctgccttaaattacttcaccataccttaaaaagttttgcacagacttatactagactactgaccagaatattaggaggtgttaaagggtaggttaatttcactgcagctaaagtgacggattcaacctggccatctcctgagaactctattcttgtggctcacgtggcattaacacaacattactgatttccagaggagtcaggaagtcaggaaatagtgggccttaaggatcttcaacatcctagtcattagtaagtcttagagtcttttttttagagagggtcttgctctgtcacccttgctggagtgcagtggtacaatcatagctcactgcaaccttgaattcctgggctcaagtgaccctctggcctctgcttccaaagtagttgagactacaggtgtgtatgctgtatgccaccgcacctggctaatttttatttatttttatttatttatttatttttaaaacaggatctccctatgttgcccatgcctgtctcaaactcctggcctcaagcaatctttactttggcctccaaagtgctaggattacaggcatgagccactgtgcccagccaggtttttgttgttgttgttgttgttgtttttaactttctccaattattgactttcttgattgttgaaactaggtggtgcttgcctgctagcacctccaggtctctgaactttcctaatgcctacagtacctgtgcttgctttaactttccagaatgaatgctctgtcacctgctttccctcatcctggtgctattgcccagcagaaccaaaactagatctttgtgattacaaatctctggtacattctgccctgctaaaaggaaataggtttcttccctgccaacctgttaagacttctggtgttatcactaataaccttggcagtctgcctgttgtatttgcttccaataatttgaatggcttttccaaaagtttatctcttccagtaataaacagttgataatgagtaatttttactgagagccactagtcttaaatactgattttctttgtctgatttgccttcagacacacctaggtcttcctgaacagcacatgaattttttttttaaatccaagtattagtaacttttttttttcagactgcagggggaatccttggcaactctgatggttaggtaaccataaaggacaggtaaattgtcattaggtaataaagccacaaccctgcagaggtcaggattggctagaaacaaactttctataccacttggcctacccagagcgttacatggagaatttctccagtgtgtatacccagtgccattttctcctggaaaagtttatactagctttgtgaaagcatctttttccttcttctttccctgccgcgttatacataagttactaaaatgcctcagatatgggtactttgcctaattaagaaagggaatcagcaggtgcttggtattgtttgtgggttttcgcctcttacttaagttgtactgttctatcttttctttgcttttgaatggtcagtctaccatccttagaatttaatattctggatctcaaaactcctccatgtaatgaaaatgcttagaacatagttgttatgtaatcacatgagcccaggcttttagagtcgtgccctccagtgtaggagtcgctgagtaggatttgattgtgagttgtgatcgtgctactacactccagcctgagtgacagagtgagaccctgtctcaaaaataagacttttaaaattaaaaattaaaaacaagtgaaccactgaccacatgaaagtcctagggcaattttagcaaaacaagacagactcagtccctgccttgatggagttcacattctcccagggaaacacagtgaacaactgattacacagattatttcattaaaattgggataaatgtgaaggagcgagctgtgagagcatatgtcaggtggacctgtttctaggaagaccccttggagaagttacactggagccttcaagggtgactactgaagagcaaagttacaaacatgttgcacacagagaagagcaagtgcaaagaccctgaggcaaaacaaaaggcagagagctggaagctaaagggggctagagaaggatggggaaagcagtatgagttgaagttggaatggtttgcagaggccagctgaaccccatagagcatcattggccaatgtgaggattttgacatttatccaaagaacaaaaagtcttaagagattttttgcaggaacatgccaggatcagatttgcattacaaaaagatcattctggccaggcttggtggctcatgcctgtaatccaacactttgagaggccgaggcaggcagatcacctgaggtcaggagttcgaaaccagcctggccaacgtggtgaaacttcgtctctattaaaaatacaaaaattagctgggtgtgttggcatgcgcctgtaatcccagctaccctggaggctgaggcaggagaatcacttgaacccgagaggcagaggttgcagtgagccaaggtcacgccactacactccagcctgggtgacaagagcaaaacctcgtctccaagaaaaaaaaaatacagttttggtgataatacagtttgaaagtaattagcatgtggatagtcatagaaaccacaggcatcaatgaaactggctaggagaaaggacaccaagaggaaatggccagaggtaacaggaaaatcaggggagtgtggtgtcacagaagcctgggaagtgctatttcaagaagagagtgggtggaaattgttaagtgtctaatgctgctcagaagccaagcaagataaagacagaagaatctagtgggatcagaagtgtgaaggctatgggtggccctgggaaaaggactcagccaagggatgaaagcaaagcctagattgaagtgggtggaggagtgtctgggaagtggcgtctttcgaggaaacagaggtgtctaatacagcttttagcaagttgggagtggatgcaaaagactccagtggctaaagagggtagggagaggagagtggactgaagataggatttgccaagatgggagaagtttaaaaaggcttagatgttattgggaaggacccagagaacaaaaagttgaatacggaaaagaaaataggatttgcaagaagcactttttttttttttttttttttttgagacaaagtctcgctctatctccaggctggagtgcagtggtgcgatctcggctcactgcaacctccgactccctgattcgagcgattctcctgcctcagcctcccgaatagctggaattacaggcacgcgccaccacatccagctaatttttgtaatttactagtagagacggggtttcaccatgttggccaggatggtctcgatttcgtgacctcatgatccacccgcctcagcctcccaaagtgctgggattacaggcatgattcaccacacctggcccacaagaagcatttttaagggctgactcgggaaagaggggcaccatacaggtaggcatggggacaaaattcccaaccgatgacttgttttttaactccaggttgacttcatcgtgctttctcatattagatcctacagatctaataccagaaacccaggaaattactctgacagtgtcaccagtcctcctgtcatgatccttatcatttgataattgtcacattaaaccatctatgcctcacaggccctgggattctgtattataacaaagagttcctaaaatgaactatttaccttgttactgggaatttggcctcagggattaaatcatatatttcttgccattcttcaggaatgttaataaaatctcggtaaaccttgatttgtagcactgttccaatagtgatatgttgcaaaagctgtaaaaattctcgaagagtatatcctaacacattggcatggccaacactaatcagaacatcacctgaagagggaaaaaattatgtatcagtaaaactagaggtttaaagggactatattgatttctggctttattgtgaggtatttcattttatgggttcatattgttgattctttttgaaccaaaaccaggcttcagccttttttttttttttttttttgagatgaagtctaactgtcacccatgctggagtgcagtggcatgatctcagctcactgcaagctccgcctcccaggttcaagtggttctcctgcctcagcctcccaagtagctaggattatgggcatgtgccatcaagcctggctaattttgttttttttttttagtagagatggggtttcaccatgttggccaggctggtctcaaactcctgacctcaggtgatctgtccacctcggcctgccaaagtgctaggattacaggcatgagccaccgtacccggcccagcctttatttaataaagatgttcatgtccatgatatgaatgtcctttgcatactgaagaatgtatgcaagatgtttcttaatagcagtatattggtagacattatatgatgtttttgagacgtttctgaagttcttggtgtgacagaggctaaaaaacatttataatcggaaccagctgttaggattctaaaaatagattagtttcagataaaatgaatggctattactagaaaagaaaaaaccacttacactaagtggtgaataaatgacctactttctattatacctgcctggcaatttccagtgccctccacagttaatagaccatattaaacataaagcctttcattttaattctctacccttgtgcagtattagttgagcaaataattctgtataaaacattgggcaattaggcatgctttaactgtaagatgtgtatgcagtgagtatgttggtttaaagggatttgacagctaggtttccctaccttagggcaacgcaggataaggaaagaaacaagatgggcaaccatgcagcttccgagtccctggcaggtgggaagaggactacatcttgagcactaacccccgaaacccccaaattgaaggaagctaaaaagaccaatttttcacttgctccaacctcccccatgtccccacctccagcagctaggtcatggacctgtgagtgagatccagctacttgacactcccacctgggtcactgaacctggaggaggagatgcaaaagagtgacaggagcttctagttgctaggggtagttacacacagctcttggttctctcaccattttccaagcctgcttctccagccttttgggagattctgtcagactcagtatcccaaattcagtgcattaacagaagtgttttctgttttttgcaatgaggaaccctggctgctacaacggcattcagcaagacttcagaaaggaatacaaaggatttgctttttaaggaccagctcacattgggcaaaatcttaagtcttcagatcttactagtactgaccttctggagaccctcaatcagcctcattctaagacagctgaagcctaacctcaaagaagaaaagggtcaagaagtgccttctctgatgcatgcactgggcttcaatcaggaattacactgatcccaaaagaagcctctaaggatgccaaggacaaatgtccatagctctagatcctatcagaaacaaaagttcccagaattccagaaaacaaatacttacaagggtggagaaaaaccttctactttggtcttaagcagtagctgggggtaatacaatcaaccatgtatctgaagctcacttcagaatgaaacaaggctacctgcagcttgagcaatatgaaacagctgctcatcctactgaggttaattacaatggcaaaacaaaacaaaacaaaacaaaaacaaaaccctccccggatgagcttacttacctaatgttaaaagcagtgtttatagctgaaagctatggcttggcattctgcttaattatgttgtaaaagtgtgacttttatcaagagggcagaaaataaacagcttaatttcctgaccgttctggctgtaaaccaaacatgtcagcatgtgaatgtgattactctagcaatagatattaacattgcccttcatacagaaacaccaatttcgtacttatgaacaccaacctcattacacctttttttttctgttttaatgggctataggatgacattatataaactttgtctcgattacctacagtaaatcaactttgcagcagccaagccactactgaaaaatattttatctttttcatctctcccaactaggctggaagttccttaagttcctcaaggctaaggaccatgtctgtgccgttcaccactacacccccagtgcctagctgggtgtctgcacacaccaggcctttaggaactgcttaggcagtagccagtccatgacttgtatttactgttgaagctacattaatttctttttttttttttctcctgagacagggtctcactttgtcacccaggctggaatgcagggatacaaatacagctcactgcagcctcgacctccagggctcaagcaaccctcctgcctcagcccctggaggagctgggactgcaagcgcatatgcccaccatgttgggctagtttttgtattttttattgaaatggggttttgtcatgttgccccagctggtctcgaactcctgagctcaatttgcccgcctcagcttctcaaagtgctgagattccaggtgtgtgctatcgcacccggcctacattaatttctcaagacttagaatgtcagaatctgttaaggccatactgcccaaaaggaactaaaagtttagccagaataaactaacactaaactaaattaggaaatcaaggtgaaaccctatcctgaaacaccaaaggagagaaatttcagcacatagataaaagataatggggctgggaggaaacggggtcaaagaaatagcatgtttctacaattatcatctctcgagatcttatcatcattgtctaaaaccactgagttacagattttaaagcctagaatgatgccgaggagaactggcaggcttgtcacgaagagatttggggctctggacttcctctgtattcaaatctcatttctagttgttaggcaattgactagaaaggtatgggctttctaggcacacatcggttcaaatcccagctctgaacacagactcagttgtgtaactaagatgaacaagttatttcatctctctacgcctctgtatttcattatctacatttcaggagtgttgcaaactttaaattagataacacgtggggccaggtgaagtggctcatgcctgtaatcccagcactttgggagactgaggcaggaggattgcttgagcccaggggttcgaggctgcagtgagctatgattgcgccactgcactcctgcactccagcctgtgtgacagtgagaccatgtctcttattcaaataaaattaaaaattggagttaaaaaaagataatagatggggaaatatctcccacaatgcctaggacaaatatttattatttatttattaagcaaagacataacaaatgagccactactttaggtgtgacggttaatattgtcaacttgatcggttcaaaggatgcaaagtattgtttctgggtgtgtctgtgaaggtgttgccagaaaagattaacatttgagtcaatggacttggagaggcagacccaaccctcaatctgggtaggcaccatccaatcagctaccagcaaggctagaaaaagcaggtggaaaaaggtggaatgagcagacttgctgagtcttccagccttcatctttctcctgtgctggatgcttcctgccctcgaacatcagactcaagttctttggcttttggactcttggacttacaccagtgttttgccagggtttctcaggccttcagccacagactggaggctacactgtcggcttcccaacttttgaggttttgggactcggactgagccactattggcttccctgctcttcagcttgcagatggaggggcagaacaatatggtttggttctgtgtccccatccaaatgtcattgccgattgtaatccccacctgtggagggagggaggtgattggatcacgggggtggtttcccccatgctgtcatgatagtgagtgagttctcatgagatctgatggttttatgagtgtttgacagctcctccttcacacactcacactccctcctgccgccttgtgaagaaaatgcctgattcctcttccactatgattgtaagtttcctgaggccaccccagccgtacggaactgtgagtcaattaaacctccttcatttataaattatccagtctcaggcagtatctttacagcagtgtaagaatgcactaatacagtaggtgagtcctggatttaaaagatgaaattcaagactgcttctaacctcaaagagcccactaactatagccgtgccatgagattctctgttgcccacctaaaagcatactcctgtcccactctagcaccctggagtatgcacccggatcatcacccagcatctgtcacctgaccttgaagaagctgagaagcagcagcttccccatgggacctgtcctggagttcttttgttctggtaagtccagaactctccaccggccgccgtttattctccaccaccaagtagtgatgtgtggggaaaatgctttggattttaaggtatagcaaactgtttcataaaaccattatgtatctgctttcttctttaatccattgcttggaacccttagctgcaaattagaatcacctgaggagcttttaaaacataaactgccctgtcccagtccaagaacgattgaatcaaaaacctgtagggagatagggaccaggcatcttggttttaaaaacttcccagatgattctaacaggtaaccagagttgcaaaccagtggcttaatccactgggacccccatacagccatcattttttattaaaacacacacatgcaaaagtctagagaatctgtaagaacagcctaagagatgattgccaatatttctgtagcacttcagttttaaaagcactttcataaaaattatttcatcaggttgggctcaatggctcacacctgtaatcccagtacttttggaggccacatgggaggattgcttgaggccaggagtttgagaccagcctggacaacatagtgagacaccacccacccaccacctccattgcccatgtctacaaaaaaataaaaaataaaataaaaattagctgggcatggtggtgcacgcctgagtcccagctactgaggaggctgaagcaggaggatcacttgagccaaggagtttaaggctgcagtgagccatgatcaagccactgcactccagcatgggtgacagagtgataccccatctatcaaacaaacatgcattatttcatcaaatctgcgcaacctctgacaaacacaggaatatcccaattcaaagatgaggtgactaaggcctgaaaggttaagtggctttgcccagggtcacagaactaaaaagtgtcagaccctgagcctgaatcaggacagctaacacaatgttttttctttctcaccatggcgccagcccattctgcctccccaactcctgggcacagtactaggcccaggccaggcactgagaaaacacctcttgaactgcatggaaaattcattcacccaaagacacgaggagcagggcagtattggtaaagcccttaggctctgaagtctgacagagaaggttcaaatcccagctcctcagagtgaccatgggagagttactaaacatctgattccttgtctgcaaggtggtttcatgcagaatctagctcagggattgtgagagtgaaatgagatcgtgcagctaagtgttagcaatgcttaatactgcctacgaaagaaaatatctttacgcactgagagccatagctctggagtaacatggtccctgaatccccacttaggagaaacaggtgacctggacaaggaactcaatctcactgaccctcattaagtaaatttaattttttttttttttttagaggtagggtctcactctgttacccaggttggcatgcagtggcacaatcatagctcactacagcctcggcctcctgcactcaagtgatcctcccacctcagcctcctgagtagctaggattacgggcacgcaccatgccgggctgctttcgttttgttgtagaaatggtgatatggtttggatttgtgtccccgcccacatctcatgttcaactgtagtccccggtgttggaggaggggcctggggggaggtgactggatcacaagggcagatttcccccttcctgttctcgtgatagcgagtgagttcttatgagatctggttgtttaaacgtgtgtagcacctccccctactctctcttcctcccgctccaaccatgtaagacatacctccttcctcttcaccttctgccatgattgtaagtttcctgaggcctccccagccatgcttcctgtacagcctgcagaaccatgagccaattaaacctcttttcttataaatgacccagtttcaggtatttctttatagcagtgcaagaacggactaatatagacagcatctcactgtgttgctcaggctggccttgaattcctggcatcaacggatcctcccaccttggcttcccaaagtgctggaattacaggtgtaagccactgtacccagccagaattaaatgaattaatatgcccaacagtgatagttatataagtgatagccattggctggcccatagaaagttctcaactaatgtcatatcctttttttttgagacagagtctcactctgtcacccaggctggagtacagtgctgccatctcagctcactgcaacctccgcctcccgggttcaagagattctcctgcctgagcctcctgagtagctgggactacaggcgcccgccactaggcccagctaatttttgtatttgtatttattttatttatttatttatttaattattttttgagacggagtctctgtcactcaggctggagtgcagtggcgcgatctcagctcactgcaacctccacttcctgggtacaagcgattctcctgcctcagcctctcaagtagctggcattacaggcatgtgccaccacgcctggctaatttttgtatttttaatagagacagggtttcaccatgttggccaggctggtctcgaactccctacctcaggatccacccacctcagcctcccaaagtgctgggattacaggcatgagccactgctcccagccagtttttgtatttttagtagagacaaagttttaccatgttggccaggctggtctcaaactcctgaccttaagtgatccaccccgccttggcctcccaaagtgctgggattacaggcatgagccagcatgcccgtcatatccttatagttacactgaaacccggtgacccgagtcaccctgcaggcagatgggcaggatgggtggttgggaagcatggcgaaagggcaatcacctggctggagtttcccgtcgttggctgcagcccccttcctgatgaggtgggtgatctggaggtagggtccatgctggatgatgatgaggcctaatcccaggctacccacagtgagtttggtctgctgtgttttgctcaagttgtgtacagatgttttgaccttgttgctgactcctctttctaaccaaaagaggggaacttatttcagtccttcaccaagacagaagcatggccatacctactggggttctgaagccagatccctgggacagttatttaatccctgttcctcagattccttgtcagtaaaatgaggataaaaatgttcaccttggagagctcttctgaaaattaaatgggtgcattaaagggcttttgcagagtctggcatattgtgagtgcttaatcaatattagttagtattatctgttcacttaacaaatatttattgatacagtgtgctaggccctgggtttaccatggtgagcaaaacagatgtgttgggttttttggttttaacagacaatgtctcactctgttgcccaggctggagtgcagcagcattatcagggctcactgcagcctcgatctcctgggctcaagggctcctcccacctcagcctcctaagtagctgggactactggcatgtgctactatacacggctaatttttattgtttttgtagagacagggtctcactatattggccaggctagtcttgaactcctggactcaagcaatcctcccacctcagcctcccaaagtgctggcattacaggtgtgagccaccgtgcctggcccacatgtgtttcttgtcctcatgaattttacagcctagtggaggggacagatatcaatcagtcatgtaaatatatgttggataacaaactgtaactcatgctatgaaagaaaaggacggagggctctgagaatgagtaacagagggccaaagtctcatctggggatggcgggtcaagcttccagcagggctaaaatttgaattaaggccaaaaggaccaataggaaatatttaggcaaagaaaggtggatccggagcaaattgtgttaaggtctgagaaaggaaggaacagtccctgtcagaggagggggaggcaggaggagcgaggaccaaccagacagaggctgcttctcagacttccttagtgaaaaggctccgaagtgagtaaagctggacatggttagatgaaatgaaatgacatgaaaatgacagggtcctggcacatgtcatggcagtgacagcggaaatgagcagtggatggatccaaaaagcacatgggggaaaatccgaaggccttggagacaaggggtagtgggagaggttgaaatatgttttctacagaaccaaatctcacaagaaaaatttcagggactaaaaggacattcaaaacaacaagttaatttcccaagaggaagttgctaggaaactccttttcggtacacaggaagctcctggggagatctgttttcagcacacttttccagcatttcacacacaactcctttccataaggacaggtgacacacaagcttgccaagtccatgtgactgtggtgttttcagggccactgctgagggagaggctcccccagctccctacctctggctgtggggagctggaggggttcatggccctttcctctaaagcaaatgtccttgcccatctccaacctcaccttcccccaaaccacagatgctctctgtttgggaaaataaaatagcataatataaacaagataccatcttcagagacctttcagggttctgggagcaactgggggcaggatacgccctgcctgagcctctggttcctgagcaaacagagaagtcacatcttgggcaaggtccagtggttcctatctcagtttgtaaattcaatatgcttataaggtaagctaccaggagcccacttttaaaagtcagcagggttaagtaaaagaagccagactcaaaaggctccttacagaagaaggacatgtctcaggagtttgatccagacctctataagcaaatgcagaagttcgggaaggcaagaaacacaagtacatcttgaaaaaaaaacaaaaaaaactttgtgcaaggcacggtagctcacgcctgtaatcccagcactttaggaggccaaggcgggtagatcacgagatcaggagttcgagaccagcctggccaacatggcgaaacctgtctctaagttacaaaaaattagctgggcatggtggcgcgggcctgtaatcccagctacttgggaggctgaggcacgagaatcgcttgaacccaggaggcagaggttgcagtgagctgagatggcgccattgtactccagcctgggtgacagggcgagactctgtctcaaaaacaaaaaaaaattatctgggcatgttggtgcatgcctgtaatcccagctacaagcctgggtgacagagcaagactccatctcaaaaaaaaaaaaaaaaaaaaaaaaagagagagaaaaaaaccttgacaaagtgaagttggatgtagattttcttggagcaagtaaatacatgcaatctcctgtctcaaatgctagcaacataccagaccactctgcttcattttggagagaagacttctcacactatggcagccatccatgagagcttcacaggttatcagccatatgaagtcactactttaaagcacttacaaaaccctctgaaaaaactagttgagaaagaagaaaagaagctcacccagcaggaaagcacagatgtaacagtgcaggagctgagtcaattaatttcattagaggatgaaaaccacgacaaggaaaacactgaagatggaaaaggtattttatgtgttttaggcaaaggctcttcacacagtgcatgctcaggatgaactattagacatgaaacctgaggaaagtgctcgctagggcccagtggcagggaccctggaacccgaaggtactgacaaagatgatcctactgctgttgaaagtgagatcttcaatgcttcctccctggaaaagggtgagctcagaaaagagtgagctgctgtgtttggggacaaccaggtggaggaggcagcactatggtcctcggagagccagaccccaagcaccagactaaaatatgaaagacttacaggttttgctacaaggctagtcagacagcaatgtcaaccttcccaaggacaagcagtccaaatgacaacagccctgcagtgaaaaagcctaaggctgtctggcacctgcctgcctagttcagcctctttgccaacctcaagtcttatcaaatcctgatgctgtgcggaaaaaagccataaagaacaagaattgctcagtgcaggagtctgcatccttcagtaagcccacctgggggctagcagaagtataaagtgattagagcctgggcaacatagtgacacctcatctcttctatttaggctgggcatggtggctcacacctgtaatcccagcactttgggaggccgagggtgggcggatcacttggggtcaggagttcgagaccagcctggccagcatggtgaaacaccgttgctactgaaaacacaaaaatcagccaggcgtggtggttcacgcctgtaatccaagctactctggaggctgaggggcaagaatcgcttgaacccgcctggaaggcgggggttgcagtaagccaagatcatgccgctgcactctagcctgggtcacagagcaagactctgtctcaaaaaaaaaaaaaaaattagctgaatgtggtggtgcatgcctacagtcccagctatgggaggctgatgcaggaggattgcttgagcccaagaattggaggctgcagtgagccaggagcataccactgcactccagcctgagcgacagaacaagactctgtctctaaaaataaaatacagtgacccatatgctattttaagatttatgtgcccttttaataaaaatgaaagggccaaagtccctatttacattggtataattttttaaaggctccttactatgtgatttcatttttatgatgttctccatggaaaaggcaaaaaaaaaaaaacgctgtaaaaaacagatgggggtgtgaggagctgcagtggggtggggtttggctgcaactgggcattgcaaagtaattttagggagtggtggaactgttccctatcttgatggagggggtggttcaacgtgggtatagcttgtcaaaacggtagctgtacttttaaaaggggggatcttactgcatggaaattataccttgataaaaataacgatggccaaggcgggcggatcacttgaggtcaggagtttgagaccagcctggccaacatggtgaaatcccatctctactaaaaataaaaaattagctgggcatggtggcaggcacctgtaatcccagctactcgggaggctaaggcagaggaatcacttgagcctgggaggcagaggttgcagtgagctgagatcgcgccactgcactccagcctgggggacaaagcaagactccttctcaaatgatgatgatgatgatgatgatgatgatgatgatgatgatgatgatgataatgatgatgatgataacaacaacgatggagagaggttatctcccaggccaagagtgcaccgttgccattttacagaggaggaacattgacgaaggcttggtccccagggcttcttcacccgcttccttctccccagttaccttttttgtttttgtgggaggccttctgcatggtcccgggaggtcaggcagcccgggagggcctcccggagcagaggctggagtcagtcccaat

SEQ ID NO: 1543 - DNA, 17247 bp, Homo sapiens; identical to SEQ ID NO: 1542

SEQ ID NO: 1544 - DNA, 76518 bp, Homo sapiens
cgcggctgctggtcccgggcgcgcggagggcgcgagcggcgcgcgggggccgagggggcgcgaggcagcggcgcggggactccgggccccggcggcggcccatggggcgggaggcgtgaggccgctgcctgtccggggctcggggggtggggggagcggggcggggagatggataaactgaccatcatctcaggatgtctctttctggccgccgatatcttcgccatcgccagcatcgccaacccggactggatcaacaccggggagtctgcgggtgagccgctggcgcgccgggccgggcgggggattggctgagggcgacgcgagagaggggagacccggactgaggagaggacggggtggagggtcccggccggaggctagcctgaggagaccgggggcggaggggagacccgggccgcggaggaaagggatggaggagaggaagccgccgggcgccagcgggacccccgggctgaggggagaggcgccccaggccgggtgaaaagtggccgaggagacctgggctgggctggcaagtcccggaccggggaggaggggagcagccctccgatgtgagggatcgcagaggaatgagcttcgttctggattaaaaaaaaaaaaaaaaaagtcaaggtgggagacgggaggaaactgaggctcctgcaagggaattagaaaccaggcggagaggctagggctgagagtgaggcagcctgcggggcagtgcgggagccactagagagctggtgggcgaggggaggccgagagggatcaggtccgaccccagaccctccaccaccagaggaagctgcggccgggggcgagcccgggctgcgggcgctgaccccaccaggcagggtgaatggtgggtgctgggagagctggtggggttggtgggagtggggggcgccggattggagcccctctgcaccgccgcccccgcccatcccctgcccgcttggcaatgtttgagaagcttgtggcttcggattttccctttgaagtgtgtatgtggttataattctgctttattttaggcccgggagctataatactactaataataaacctcattttatggagcgtctttcattccagcgcatcacaaaaacgctggagagctcttaatagtagttacaaaattaaataacacattacagttgcaggcagcccggcagcgggagcagtgcttgctgtaccaccacggagctgtgggcgggagaggcaaggtggtgccctcgggaaagaggcgggcatctttctgaagggtaccccaggtgaatgcgcttccaagatttttctcagcttgggccacttctttccctgttacctcttctccctcccctcttcccccgcctctctttctccctctctcccagacctgtgagaccaaaccttaattaatgtaaacagctgtcaggagagctgctccgatttaaggaatggtcttgttttttaactgcttgttcagtgcaggtgaaggaacttttggagggttgggaatgtcaagctccctccatggataatttcttataaaaatgcggccgggcgcggtggctcacgcctgtaatcccagcactttgggaggccgaggcgggcggatcaggaggtcaggatttcgaaactagcctgaccaacatggcgaaaccccgtctctactaaaaatacaaaaaaaaaaaaaaaaaaaaaaaaaaaaaaaaagagaattagccgggcatggtggcgtgcacctgtaatcccagctactcaggaggtgaggcaggagaatcgcttgaacccgggaggcagaggttgcagtgagctgagattgcgctactgcactccagcctgggcgacagagcgagactctgtctcaaaaaaaagaaaaagaaaagcatcactgtgctgtcaaaacttaatttttaagtattacttatggttctgtatttatcctgcaatatttttagctcttagaaaaaaagtggtagctgggacatttgttgcttcctcctccctcccttctctcccccaatctagacctagtaacacaaaatcatgctgtcatattcactggttattaaaataacactctaaaaattctgctacttttcttgcccatagagttttagcagaactcttaattgtaaaagatatgaagaatcaggatggtttcgaatttggtggtactatgggctttgtttatgaaaatattgttgctgcccgacaacttaacacggttacatgtatgacatccagttcgtgacctgttgatgtttttatcctacttacatgtgtattgactccttttatgagactttcaggcttcacgtacttaggggaaaaggggtttcggtgctgtagcagaaggaatctttttacaaagaagttttagatagaatcccaatagataaaatagactaaatgaccatgcaaaagatatagttgaaagagaagaattgttacatataaaagagaagaaagataagtgatagcataacgttcctaagatggaaaagggcatagccgggcgtggtggctcatgcctgtaatcccagcactttgggaggccaaggcggacggatcacctgaggacaggagtttgagaccatcctggccaacatgatgaaaccctgtctctactaaaaatacaaagaagttagccgggcgcggtggtgcatgcctgtcatcccagctactcgggaggctgaggcaagagaattgcttgaacttgggaggcggaggttgcagtgagccaagatcacgctactgcactctggcctgggcgacagaatggtactccgtcttaaaaagaaaacagaaaaaaaaaaaaaaagggcaagctcctcttgtattcagaagaaagcaaggatagaatgagtataactctttaaaatttggaggcaaaattggctgtgagttgccatggagataggagcaatggatgtccaaggtctgaggaaatagaaactgttcgaaataattgcagagaaagcttgccaacggtgataagtaggtttgtctagcagcactgatgcgtcgtggaagttgatggtcatgaacatacagtgtgataacctatctgccctcttgaccttttctagtagtgctatgtcattttggtactaaggtaggtgaattttccaagtgttcttggaaataaggaaacatcaagaataatgtaaaagcctcatatacaataatgaataataaagaataatgtgaaggcttcattcaaggttggggtttgccagatacattgcaacaaaatgacagagcagccaaggtatttaggatagtggccaaagtattgtaatgatggcttatggagtgtcagctggataaagagtgaaaatgaataaaaactaatggattgttcagtcgaatagcagatggtacaatggtacatggccagtagaataggggacccaataaaattgaagaccagtcagagtgggagtgatcaatccagcaaagtggaatggcaggggatcgtaggcacaaggtccagagtgtaacagtgacaatgtgtggctgatgtgggatcgaggaagtgattgttttttttctaaaagttttccttgccatctcaggataccactccgttaaatattatggctagaaagaggaataagagatactaggaacataggaaatttttaaaattcttatctagcatgtatttcttaccttacatatgtcaggcagtaaaccccccaaaacataaaacgaatgggacagtatgttccttggtttaccgttgtgcttgagcttgtatgctgtacagtctcacctgagcaggcagatgtagtcctgagttaaaaaaaaaaaaaaaaaaagtgcagagttacaccttccaaatcaatgaaacatttacaagaagttcaagtaagatctcagtggtgacaggtctagcttatttcaagagctgcacaaaagccacttaacctggcaacaaaaagttaatgtgttggttccctttggtgtattatattcagtctattaaagttttgattgtgatgttttcattgcagtttttataccggataaaatgtattttagaagtagaacttttggagctgaaatagtctgcagaatgtagcttgaaaaccacggcagtgaactactaagggaaagtttcagaattcaagtctagacttcatcacttcgtagctctgtagctttagggcaggttctttagcctctctttgtctccgtttcctcctgtgtaaagtagggataataaaagtatccatctcactgggatattttgataattaactgagttaacccatgtcaaacatttagaacagtacctgacacacagtaaatgctcaataaaaattacatattgttatattgctgttctagtttataagaacaggtgtcagaatccagttttgaaatgaaagcccagaactgtgagaaatgatgtttttctctattagatgttctaggaaataaggaaacatcaagaataatacagccatgcttagaacaagttaaatatatgtccctcttggctttggactttctctgtcacttccgtgctgttcttcctcttccagtctctccatactctaatctctgttctcagcttctacttgaactaccatagaaggaatagaaaaaaaaaaaaaaaaaagagtaacttcctgaagtccctattgataaactgttactataagattatggaccatactttggacagcagagtttttcatgtttttattgtcttggtctagatacagagaaagtacatcccttttattttcacctgtgtgattaacatttcatctacttcttgtaatggcttgtggattatgcacaaacttttgaagatctgaaacatattgtatgtatgggggaaggcactctaatgaagactgtttgtgttagtgtaaccagaaatattaaatgtagatgaatacagtggcaaaattacataattctgctatgctaaggtcaaatttctgctggttactggaactcaacaccaataggaatatctttgattttatataatgcttcatagtttttgaagcactttgacatccattacttgatctgattccttaggatgtttatatttggccaatgtaaaatagtcattttcacattttcccccacatggtagtgctttgcatgtgagatttgagtttcagtgctgcaaagattccattgaagaaaattcttcactgaagtattacctatatgttatttatgcacaccttttacttatcttaaatgaaattaaaattcttcagtggctggaggttttcccagattacagaagagggaaagaaggagacttgggggtctttgctttgtacaagcttcttaatttcactgtcactctcttctcacccctgaagagactttttgtcagggggaaaaattagtgttagttaattttaacaagataaacagttaagtaaagctgcgtctctgataaatataaatggtctgcagatccctttagtgaggaaggcattatcccctcacagcaaggatttcagtgaccgtaatcctaatcatcctagatagatttgccttatgttctttatgaagatttccagatgttccccaaaagtctctttcaagtagctgaaagaacttctcccttatgtctcgtcaaaatttccctaaagtggttatcatattcatgttatagtttgtcataacgaagttaaggttagtgtattcatttctgaagatattttcattcttgttgtttttaaaattgtctagatgggatgttactgtttggggggggggaatctcaaaaactgacatgtttttccctgcttgtattctgaactagttgaggggcaaaaaagaaataaggtatttaggggctaaaatattattttattactaagaaagaggatattggagaatgtcacttacatttgggggcacgtgacgtcctactcctggaccttaaaattgagcagacttaacaatccagtcccagacagaactgggggaactgcccctataacacttccagcatgacagaggagagatgagtgcttccaaagacaaaatgttggatcacatatgcccattttctcctaaactaccagtcagatgaagtcagtccttgtgacctgacaaggattgagtgaggagacacaaatgagctaaaagtattatgccaacaggattctgtcctctcccccggtctccattgctcatggataataaaatcgggaataaggagaaagccttatgtgtttaaaacccactatatgtctagcattttgtgaggaagagttttcattttcttcaggtctaaagattggcaggtgttcagggaagtgaaagccttggtgaggggtatcatttcctattctgctacctcctacctacttcataggaaaatctggtaaacctcagataagggactgtggtgcttgacatctatctcataagggttcaagatctacaggtagatcccagcctatgcactggggatcctcagtttaaaacactaaaattacaagttgctcaagcagacctgtttattaagtaatagaaaatgattaaatcattagtcctttccctggaactgtaacaacttcaaagatcacaaaggtactttgacatgaaagaactctgtaacatcagttgttaaacaaacctatctcaaactttattttattaatcactttggacatgatttatagaggacaggatttggttacctaaaagggcaaacattttgagattgtgttgtccttgaatttaaaaagcattaataatatttcttcattggccttttgagcctatttccagtaaattttttttaaagagctttattgagatgtaattcacataatactaaaattcatccatttaaagtatacaaataaagtatttaaagtatacaaatcagtggcttttagtatcttcataaagttgtgtgctaccatcaccatagtccatttcagaacattttcattactccaagaccaggctaagaggtgcctcttagcctcctaggcaacccctaatatgctttctgtctgttgatttgcctattctggacatttccaatcatagaatctatgtgatcctttgtgacaggcttcttaaacttagcataatgttctcaaagttcatacatgttatgacttttttttttctttaagagacaggctcttgctgtgtttcccaggctcaaactcctgggatcaagcaatcctccagcctcagcctcccaagtagctgggactatagatgcacgctgccacacctagctatgtatttcttttttattgccaagtattccattatatggatagaccacatttatttagccattcatcagttggtggacatttggaccactcagttttttacttccaagcataaaagtctatgaagataaagtgattaaagatgttttttaaatgtgattttttaaaaagtgacattatcagtataatctatttcagcatatcaagtaataattatcaataaaaattcaaaaaccggtctttttacagtactcacaggacatgcttaaagcttgagatcatttatgatactgtgaattcccagagtggactagattttccaataggaaattagatctcctgaacaaagcattaatatttcctttacaaccttagttccaaacatcatctcttttatcattaccaacagagatggagccacttcagaattaagactataaataagcctaaatgtttttggagaaggggaatttaggatgaagaacatgaacagcaggcatgagtaaatggaaatcactaaaagaaggaaattcagaagaaaaaaaattagagtaaagactgctgatgcatttgttagattggccatacttattgagtccttccttatttggctgccagaacccctttcaaattttgcatagtaatagttacatatatcagttctccactgttctgcttagtgtgaccaaaaacatcattgtttaatccctttcctggtaaatactgagtttgtattggagttgcagtatagtaaaatggttctgtaggatttggagtcaggcatatctctatttgattcttggattccttttttattagctttatgatttggggcatgtaatttgatttttcagctataaaatggagacaatacatttacctcaaaggatagttgtgaggagataaaatgtggcatataagagattagcacattgtccgatacttagtaaatgctcaaatgttagtcatttattacataaaagctcaaaacatctggatttttagtgtttcccttttgtactgtctgtcttatttatttacttatacctgccttgttccagaaagagatttaaggcaacataatgtgtctgtatttgaatgttcgtgaacccagctgggtccaatctgggaagagagactgcatagtcagttgttgtggtaatacacacttatgggacacatgtaactaccaaaaccaaggagtacttgggtttttatgtttctggaacagattgaagaggttttctaagtgaaagacagcctagcatagtggaaatggcacacgggctttggggcaaaccaacatgtagccaagtccctgtcctactatttacgagccgtgtaattgatcttagacaagttgcagttgagggtttttattaatgaaaattatatcattcagacctgattaatacctctttcagcacttccaatagttatgcaggtttagactccaactttgttctcctgtgggttaaagaatattaaccacagtgtattgttaagatcatttagttcagaggttagttttaaaggaatttaagagctggtagtacagttggagtatcaagtcaatttttctcacctcaaagtgtgaaaataagtttgaaatatatgagatagttggttctttatagaaacctggcaagcgatatagctgaagatttagtttatggaataaatttttttctagttactagcttctgtaatgcaactgtgagttcattttttccataacccatttcaatgcatacttaggtggtgggccatattgcataatcttataggggaaatttagacatgtaatgaagtgttcctgtttatgaaattgtcaccattgaattataaataagaacttgttcgtgcaacctgaatgcataattatttacatagtgaccgtgtttgatatgcttctctaagagacccaggaaattaggttgtacggtgacagcagtgacaagtatataggtataaatttcatatttacagctttacctttgtgatggtttatataacatgacattcatgtctttttggttgtcagaatgttgtattttcaagttctgaagctacacctttttttccaagtactttctagaattccccgcccaactaagcagctagcagctttataattagaaaacctgatccgattgataacaacagattgaaagtagcagttatttcatcctttatcaactacaaactgatgaaaaagtaatgttgggaaagctgttgtagaaatcctaaagaggcttagataagagccatgaggaaacctgaagatctttgaatatcaggatacctaaaaataggtacctggattaaaaccatttttcaataatatacccttactgtgtatttcacctaaatttactgtgtttgtaaactttactgtgcattctcttgttaactgcaaattacacggaggagaattcttgccaaatatgcaatgagcaagtagaatgtgacgttcctttggggtttattgctttagagttgacaaaaaaaaagagcatttgggtttgggtgttgctatcaatggtacttacatgtatttgtgaatatgtaccaactaacatgtatagtttgcttaagggaagtttcagtgtgtgactccagttcacttttgaagcaaactgacaaatctttgaatcactgcttttttttttaattagcaaaaggctgcactttgtgtgtctcattatactagctttgctataaataaaatatcacatttggcattttgacacttgccgttgtatatattgagcaaaaaggcagctgttgacttttaatatagatctgttcaactagggaccatattctactatagttagagattaaacaggagtagaaaaaaatgcagttgggtgggtcaagtaagaaaaaggaagaacaaaatttcattattgcaatatattcacagtaagttgtttacctggaacatggttgggtccaatttcagccataataatagaagttcttttcaaaaataggccatgttcagatcagttctgctgaccaggccactgacctccaaagacaaaaatctttaaggccacttagactgtcaaagagatatgaccatttgatttataaggtaccatcattttgataaaagaaatctttaatttactatgaatattttaaaaatcttcccatagatattccctatgcgattggacttcattccagaccatcttgcaacaaatgctattgacgtatttgtggtctgtaaggaatctgtactgaaataatcagagagattatgtttaagcaaatgaaaaaagtccttgaggtaccctataccctgggaagataaaattgtatcttgcatgtcttacatcttgtgagtatgtaccaacatatgcataggatcaggcaatcagagaggaggtggaatttgagcttaacagatgatacatttaataatgagtaataaggaagacttgggtggttcttgttcttgaaaagggaatggcatgagtaaaggtagagaggaggcagtgaaatttctattccagtccatttctctgtattgcaacttactttatctttctaaagaacaaatagaataataaatacttgtatagcatttactttgtgacagattcttttctagacactttacatgtgttaattgatccccacaatgcccctgtgtaagtgctgttatttagacagcctcatgaaaatacagagaagtcacttgcctaatgtcacacagtggatcctggctcttaactattgcatgtgcttgtaccagaaaccttcagtgacttcatcttccacaggacaaaagacactcaaggattttcacaatctggctccaacttataatactttctggccttagatcctgcttttttccccgcatgaatgtacattctagcccctctgtattactttctgtttcctgtgtgtaatctgtattctcatctgtaattctttggtcctctcactctctccagtccctgttttatcagtatcctacccatcttccgagcatatcagttgctatcttcataaaaccttttttgatcccttacctaaagtgattttccaaccccttggtaacactttgcacattttttatggtagcatatctgtgtcatggttatttgtgtggtacttgccctattttctagtataatttttttgtagtatagatttttttaaagttctttgagagcagggaatatgatttgttgatctttgtatcttaggcagcattcagtctaagcttgcacagggcaggaaagaggaaatgttatggttaacactaagattttgaacctgggctagggaataaaattgggaatttagagagtgaggtgattgtaaaaagtgaggagttgatttagacatgttctgtttgaggtgatagtaggatatgcaagaagaaagggactagagctcagaagacaggaatatttggcactcccagtcttatctcattttcacaagtatgatacttaaattgctacatatcaaattagctgcatatccatagaattcaggcttcttttttttaaaaaatgtatcagttggggccaggtgcggtggctcacgcctgtaatctcagcactttgggaggccgaggcgggcagatcagctgaggtcgggagttcaagaccagcctgaccaacatagagaaaccccatctctactaaaaatacaaaattagccaggcgtggtggcacatgcctgtaatcccagctactcaggaggctgaggcaggagaatcgcttgaacccaggaggcggaggttgcagtgagccaagatcgtgtcattgcactccagcctgggcaacaagagcgaaaactccatctccaaaaaaaaaaaaagtatcagttggtttttatttagaaaatgaagtccagctactatataatcattcctgactttaattttttttttttttttttttgagatggagttttgctcttgttgcccaggctggagtgcaatggcttgatctcggatcactgcaacctccgcctcccgggttcaagtgattctcctgcctcagcctctcaagtagctgggattacaggcatgcgccaccacgcccagctaatttttgtatttttagtagagacagggtttcttcatgttggtcaggctggtcttgaactcccgacctcgggtgatccacccgcatcggcctcccaaagtgctgggattacaggcgtgagccaccgcgcccagccctgactttaatattataagatgaaacttaatttgtaggttgttttgttgattctctgggtcaatacggaagttagatttctaggctagcccacaagtccatgttgtagttgaaatacttacttctgcaacaacaaaatagtagaaagcaatacagttgctttactatttgcattttcaaaagataaaaaggaacaagaaagtgcagcttatttttcttattcttgatcggtttgacttcaaagcttacagcattcctcctatgtgatatagttgttcactgagattcttcttatatatgtcaacagtgttttgggttttctggccctatcagaggaattacggagattgtatgtgtaagaggtttcctgaagtggaataacctgtggtagagttaactcagtagagctgaggaagatacgtatgagtgaatgcaagtgcatatgatatgtgtagtttgctgtggtgggggtgggtaggggatggtgaggaacttgtaatgggtaaataatctctcccatgaggaagcaagatgaaatggaagaggttggatccaatgttcctcatctgagcccacgggaagggccattggtctggtctagaatggttactgctcgttgaggggacctctatggttggatagagtaaggagaaaaacagtattttgtatgccagtttaagtatgataaggtgcagattaagtcttttatgttgaaatctgggttctgattctggctttcccatggttgttttgtttgtgcttgaaaatttacctaaattttgttattctgtattttcccccaactgaaaaatagttcctgtcccccttcatcttcatgaatatcctcttacttgaaaataaaagtgagtgtatatgatatgttaaattcttaggaaagtattttattcagaaagttaaaagagtatgggggctgggctcacacctgtaatcccaacactctgggaggccgagatgggcagatcgcttgagctcaaggagttcgagaccagcctgggcaacatgatgaaaccctgtgtctacaaaaaatacaaaaattaacccggcgtgatggcgtgttcctgtagtcccagctactcaggaggcgtaggtgggaggatctcatgagcctgggaggtggaggtggcagtgagccgagactggaccactgcactccagcctgggtgacagagtgagaccctgtctcaaaaaaaaaatatatatatataggggagaagtcagaactcagttcaaattctggttctgttgtttaccagctgaggggctttgagcatgtttcttggcctcggagctatagctttttcatgtataaatggggataatacttcttaccttgaagggtggttgtaagaattaaagttaatatatctgaaacatctaccacagtacaggcacacatggtaactgctgttattgtggttaagcaactaaatggattaatctcttatcacatttgatacatggaacataaacattgcagttgattgtttgcccactatacagttactgaaggcaatctgatgtttttaaagtaggatatatcattgttttatccttggctgcccgtatcactttttttttttttccattaaaaaaagtagtctcgctatgttgcccaggctggtttcaaactcctcctgaactcaagcagttctcccgccctgacctcccaaagtgctgggattacaggcatgagccactgcccaggccctgccggtatcactttcacgatgtacattctaaccatgcccctgatacctggattgctatcttcttccagctcagtgcactaagagtatcagacagcctatccaaatgtttatatgcaggtgctgtgctgcatatcaaaggtaatgtgtatttggggatttttcaagtgtgatgacagattgtactaagccactagcatccttcaaccttcctacactagccaacatttgctaactgggttatggatgtaatctgtagtcctagggtagatttccctgactggctaggtatgtaaaccataaccctaacctcattagttgaggttagtcactatcatggactgaatgcacccctccttccaaattcacatgttgaaatcctgacccccgatatggtagtattaggcagaggggatttggggaggtgattaaaaagaggtctagcccactttgtgctatatgaagatacagtgagaatttaccagtttgcaacctagaagaccctcaccagaaccggaccttgctggcaccctgatctcagatttccagcctccaaaaatgtaagaaatgaattttaattgcttttaagccacctggtcctttgttacagcagcccaaatggactaagacagtaaccaagtgtcagtcaagggttgtaaatgtaaaggatgattgataatcacaggtagcctacaagataatttatggtataatcttattcatcttcttatgatgaaacgtaaaatgtgagactctgtttttttattctgtagacaaaatactttgggtttaaaaattttttaaattgagtcacttaagaaaccatagcaaagaatcttactaagacaaatgtagacagtcatatatcagcctactaaatcaccttttagactcccactctggataagatttagtggattaggattagaagacaaacccttttatgttgatatgttgctaatataggactaatcctagaaacctcatactctttctgaggttcttaccattcagtaggtagctattatcgtgtaaccatttagaattgcaccattagttaagtaagatgttggctttaagtggaccaccctgtattgaagatttaattatcctttattgtgactatcttgacagttatcagggatgttggatacattatgggttttccctactgtgctatttcttttattttttgcctctgtaagttgctgggcactgctttttttctctttttattagcctagaattaactaaaagattgtatctcttatccatcacctcctactgtgctctgcccttcctctctaggagcctcttgtggcaaatctccaacttggccattcaagcagttcatacccagatgaaaaagttcaaggtacagatatcagccattctcagtggtcagtttccattgtctttaccaatagctctctgctgtgctcagctcctgtttctctgagcttggggttttactgagttttttttagaaaatccgtcaacttatctaatgaagaagactcttgtcttttgactgtattgatacaggctacagaggtacttactccttttctgtgaacctgttttctcttgtatagattcaagaaattcttcagtgattctgctttgttgatggtattcttgtcattttctcatgctgctatagaattttgtacaaattatatatatatatatatattttcttaagaaacttagtttatccaacaaaaggactataacactattttacattcttaattctgatataaagcacattttcaaattagttgccaacctttgttttaaaattatattgaaatcctggatctagatcttctagacagtttctttggtatattatattggtcatttcagtggggtttggagaagacaggagaataaattgactcactttacctcccagcaatgtttaatgaatgttgattgaatgagtgaaattagtggttaggtagagcagttgatttggcctaaataatatttacaaatatgtataggagatttagtctacagcagttgattatctttgaaaacttttttttttttttgagacggagtcttgttctgtcaccaggctggagagcagtggtatgatctcggctcactgccacctccacctccagggttcaagtgattctcctgcctcagcctcctgagtagctgggactatataggcttatgccaccacacccagctaattttcgtatttttagcagagacggggtttcaccatgttggccaggatggtctcgatctcttgaccttgtgatctgcccacctcagcctcccgaagtgctggaattacaggcatgagccactgcgcctggccgaaaacatttttaatagtgggaaagttatgatacaataattttcttaaggtcacacatttaagtaaccagaaaaggtttaagttttatggctcctatttatggcagggacatatgtgtaatcagttagaatgcaggagacattatattaaagtggctaacaggacagactgtagagcctaggttcaaattctacctgttctgtctggacatgacggttcatgtgcctgtaatctgagcactttgggaggctgagatgggaggatcgcctgagcccaggagtttgagaccaacctgggcaacatagcaagacttcatctctacaaacatttttttttttaattgctagtcatgatgatgtgtgcctgtagtcctagctactcgggaggctgaggcagaaggatcgcttgagcctaggagttcaaggctgcagtgagatatgattgtgccactgtactccagcctgggcaatggaacaagactctgtctaaaaaaaaaaaaaaaattctatctgttcagcttactagcagcatgattttgggcaacatacctcagaggtctgtttcatgtatataaaacacttacagtgcttggcacatagcactatgtaagtgtcaactaaagttaatcagactaacttttgaagatccttagctatagtcttttcgggagccataggcagttatcttaaaaattgatcataaatactttattgtaataaatattaagttgtagatataaatgttaccataccgattctactgtttacatataaattctagtccatggacaactggccacagtgtttacctcatatgaatagtaccactactgtaaagaagagtagtcttactgttgaaaaaagtaaatttcaatattgaatacaaattgaaatcagtgagcctaactgtacatcaaattaatcatgtaaccatcaaggaaaaaaggaattatcaagtaacttttcaacataaaactctgactgtgctctcttaatgatgggatataacctaaggacaaaaagaactgcaaagaaatactgatcttagtaggtaacaaaccccctacaacagctctgcaggggaaatgtccccattttgctgttgaagaagcatattcaaagaagggaatgatttacctggcattaaatgatgctggagtcataccacactgctgtttttatagtgtgctgtttctgatgagtcctgttttaaccatcctggtttgtttagtacctctctcttattaacaccctctgtaattattagaaccacattttcaagaacttagtaaccatttgaacccccttttttcaataatttcattccatgtaatcaggcctagttttttgaaatctgctttcctaaggggtatttgacctacccattctttacaaattctgagatgacctagatgacctaacagcttttttcctaattcctcctgcttcaccaataactagttcctggaatattagctagtgtccaagtcacaattatttatggtctgtatgataactaagtctggaagttggatatgagagaattgcattcttttttttttttttttttttggagacaggatctcactctgtcgcccaggctggagtgctgtggtgcgattttggctcactgcaacctccaccttccgggttgcagtgatcctcctgactcagcctcctgagtagctgggatgacaggcacgtgctaccaagcccagctaatttttgtatttttagtagagacagggttttaccatgttggtcaagttgatctcaaactcctgacctcaggtgatccgcccacctcggcctcccaaagagctgggattacaggcatgagccaccgcgcccagcctgagaattgcattcttaaagacattaatctgtttgtaatttaggatgtcttatagtgatttggtggtgagacatacgggaaggggtggtaaagagtgcaattgttggacctgtgctttttacgtgaaatagcggaaatgagtattactttacaaactggttttggaaatgattcattcattaaagaaagcaaataaaaatagcaataaaactaggacataataactggttgttaaatgaactctatgtcctttgaaaaggagatgattaaggaagaaaatatgtaaataacttgggtacacaagctgctatttgaaattctgctgagtaaaaatgataggaggagttaaactgttcaggaatttagctcttgcttaaagtattcgtgtagcaagtctctgttttttttaaattacagtgtttgaagatcctcttcttgaattaacagaatcaaagtgaaattccattttttaaatcactcctaaactgtctttagtgtgtggctttaaaatataattctatgtaatatactagagaaattctcaagaaaatctaggactaggatttcaatataattttaaaaggaagtaaggtgggcaatcagattaatttgaaaaagtgctttatatcactagtaagaatgcaaaactgtgttatagtgctttcattaggttaactgcgtttctaaacacctggagaaaattattttagtattttctgtccaaaatagcggtttgtggaaaatgcgccacttgtctggggaaatcagtgtttatgagacatctttgttaatgtttctaaagttttaactctctggacaaacattcaagaaaaatttaaccgttatacaaaaatattcctacatagtaaactttgagcacacctgtggaattagacttggttcatgttctaaccaactccttctagctggtaccttgtcatttagcctgttactgagtttccttattgaattgttttgagaattaacttgagcacacataaagcacttaatactacacccagcactaagaaagcactcaaaatatagtggcagctattattatttatccttcttcctctccgttttctcctccagatttatgagtgatagggacagaaaatttcttatcagagtgccctttattttaatctcaaggttttgaagtagaatttaggacaaaaatagatttttctgaaccaaaacactgaagattctgtttgggaagtgagaaagcaagctgctaaacacctactctacttgtgcagtgacaagaaaattgaatttctcattcgtttcctgcccctagcccttgccttcagtttctctgcctcagtatgaaagtatctgtattcctttggggacagttgcctcactgaagccacaaagagcagtctccaggagttgtgtggcaagctaactataaccttttggaagaacatctggatacagttttcatttttaaaatgtatcgttttttaggtcattagatttatatagttcaaatttattggtgtcagttctcttcctaggttgtaccatccattttgaaaagatgtatgtcttttatccagaagatgtaaagtatatagggtcataatcaataaaaatctctatcttcagttaaactactggagttttcccttcttcaagttttcagaatataatcattataccaaacacacgtgtgcgtatgcatatatatccatccatacaaatataactttcctttattatgattactcagttgcaagcagtgtagaagttataatatttgttttattataatcatttcagcaatatggatagggctactggaccctggaatttgaaaagagaggatcttttttatgttttttttttttaattttgataaaatatgcataacgaaatttaccatcttaaccatttttaagtgtacagttcagtggcattaagtttattcacattgttttaccaccgtcaccccgatccatctgtaaagctcttttcatcttgcaaaaccaaaactctacacccattaaacaacttaaaaagagaggatcttaacatcagaatcacataattactactctataaacatctgatgggtgtttacttctaaaacaactgctttcttttttaattgacctttcactatacttagcctcttctaggaattattatatgtaatctactcagtcatattttctttaatttttctctttctacaactttacttttccaaaggtgatgtaaattacatgttttatgttctcccatgtttatactctacttaaccttccctcactcccataggcttgatgagtgtatattgtcagagcattatttcctgtacccactgctatgtttgtttgtttgtttatttattttgagatggagttttgctcttgttgcccaggctggagtacaatggtgcagtcttggttcactgcaacctccacctcccaggttcaagcgattctcctgcctcagcctcctgagtagctgggattataggcacctgccaccatgcccggctaatttttgtgtttttagtagagacgggggttcaccatgttggccaggctggtctcgaactcctgacctcgttatctgcctgcctctgcctcccaaagtgctgagattacaggtgtgagccaccacgcctggctatgtttatatttttaaaagtcctaaaagtcagatggtttaatgtacatacattcttgacattttaaatacctccaattttgaaagcattctttctctgggctgttagatacatgtatgattcataaaatgaaatagggttgcctgtagttatttcttgagttgccatttagagtcttctggccttgtcatctgtctagggaagaaatccagcataccttactgtcatgtatgtcattgtagatcttatagcttcagaaaattctctttccttttcttcagaattcaccagttttaaagctttttcctctccttcaattttgtcaccaaaatgtggctttgcagtcacttgacctgtaactttacacacttaagtctgctagacagaaaaatgctgttgcattcttaaaagcttttaagcagttatttggacttttagtagaattaattaactaatttatttatttatttatttagagacagggtttctccctgttgcccagcctggagtacagtggtgcaatcatagctcaccacagccttgacgccctaggctcaagtgatcctcccatctcagcctctcccatagctgggactacaggcatggacactaccatgcccagctaattattttgctttttgtagaggtggggtttcaccatgttgtccaggctgctctcaaactcctgggctcaaacagtcttcctgccttgacctcccgaagtgctgcgattacaggcgtgagccatggcatctggccagaatttctgagttaccagattgctaaacaacttcacagaaaaattaataatagtctcaaaatattgttttcttctgactcctctcaccataaattcatgcttctccactctactctccccagcagattctggaagtttcctagcaaaattgcatattgaagcacattcaaacttaaggttgaagaaatctacacaaaggacatcattgtgttattttagactctaggtggagtctgtactatttgttctaccttcacccttatttagaattgataagaatgcactgagccttagtactctctggggtctgactctgcaggcagatagatattcactgggatccagaacctatcatacatcactgtagaaaaagattcaaatacagtcaacgtatttgaaaatcaaaaccgtattttccaaacagtcaagttaaaagtgtatgtctgcacaaagcctatccagttaagacagtgtgtgtcactatttttccttttgcaaacttccttagtgtctgaacattaagtgcatatttcttaggcaaattatgcatcagtacttttctcttcacaattaaatatttccagcagtttgggactcatttttaactattcctctccctgttttttgagacagagtctcaccctgttgcccaggctggattgaagtggcgcaatctcggctcactgcgacctctgcctcccaggttcaggtgattctcaacctcccaagtagctggtattacaggcatgctcaccacacctggctaattcttctatttttagtagagacggagttttgccatgtgggccaggctggtcttgaactccaggcttcaagtgatatgcccaccttggcctcccaaagtgctgggattacaggcatgagccactgcacccagtctttttttattattattattttaagcattcttctgagctgacaaatgattatcaaagtgattctgatttatgattagtttatcccattttttgaaaagtatgttttaccttctctaggccaacctgcaataaataagacccagttttagtgggagatacaattaaacagttgaccggaagtcagtaagaagagtgctaaaatagtagttaagtgcatattgcagttgaagcatattagatgtgcctctaactcaggcatggaaggttagaaacgactacatagaggaatgacatctaagccaagatgtaaagaacagataggatttggctagagaaggaagggccgtaagaatgttccaggtagaaggaagcctcagaggtttaaaagaatatattacatgtaggggtcctggaagctcagtgtaacaggaggagtttgagggaaggagaggcatcagatgactctggatggggaaacagggactaggtaatgaagagctataatgaaatataattccacttttctttttaaaacagatttattgaggtataattcacatcatacagtttacccctttaaagtgtacatttcattgtttctttagcatattcacagttatacaatcatcaccacagttgattttaaaacatttttgtcacctcaaaaagaaaacctgtaccttttagctagcacccctccaactaccctagtcctaagtaactactaatctactttctgtttcatacagtttacctatttggatatttcatataaaggaaatgataacgtggtcttttgtgactggcttctgtcacttagcataatgtcaaggttcatacatattgcaacatgtatcagtacttcatttttattaccaaatgatatttcattgtatagatataccacattttatttttccattcatcagtaagtagacatttgggtcctttctactttttgtgactattacaaataacgcctctgtgaaccatgtacaggtttttgcatggacatacattttcatttcccttgcatatatacttagcaatgaaattgctgagtcatacagtcattgtatctttaactttttgaggaactatcagactgttttccaaagtggttgtaccattttccatttctgttaccagtataggagggttccagtttctccacatcctcaccagtacttgttatttgtgtttttgattctagccatcctgttgggtatgaagtagtttctcttttggttttgatgcgcatttccctgattactaatgatgtagcgcatctttccatatgcttattggccatttctgtatcttctttggataaaagtctattctgatcctctacccttttcttttttttttttttttttggtgagagattctcactctgtcaccctggctagagtgcagtggagcaatctcggctcactgcaatctctgcctcccagcttcaagtgattcttgtgctttaagcctccggagtaggtgggattacaggtgcatgccaccatgtccaagctaatttttgtgtttttagtagagatggctttttgccatgttggccaggctggtctcgaactcctggcctcaagtgatccactcgccttggcctcccaaagtgctggaattacaggcatgagccactgcacctggccctctacccatttttaaattggattacttgtctttaatattgaattgtaacagttctcttttcttttgtttttgagactaggtatcactctgttgcccaggctggagtgcagtgaccccaatcatagctcactgcagcctcgaattcctgggctcaaggtatcctgctacctcagcctcccaagtagctgggactacaggtgcacattactctgcccatctaactttttaatttttttatagagatggggtcttgccatcttgcccaggccagtcttgaactcatggcctcaagcagtcctcttacctcgacctcccaaagtctcggcattacaggtgtgagccaccttgcttggcctgagttaattttatatatggtgtgggtaggggtccaaactcattcttttgcatgtgaatatccaattgtcccactgctacttatcaaaaatactattctttcccaattgaatagtcatgtcacccttgttgaaaatcaactgatcataaatgtgagagtttatttctggaatctcaagtttttttccattgatctatgtccttataccagtgctacattatcttgattactatagctttgtagtattataggttttgaaattgagaagtttgaatcctccaacttttctctctttaaaaaattctatggctattctgagtcccttgcatttccatataaattttaggatcagcttatcaatttctgcaacaacaatgacaaaaacccagctgggcttttggtaaggattgcattgaatctgtagatcaacttggaagtatcgtctaagtcttctaatctatgagtatgaaatgtctttctatttattaaatctttagtttcagcaacattttatagtgttcagtgtacaagtcttgtactttttttgtttgtttttttgagagggagtctcactctgtcgcccaggctagagtgcagtggcacgctcttggctcactgcaacctcggcctcctgggttcaggcaattctcctgcctcagcctcctgagtagctgagattacaggcacccgccatgatgcccagctcacgcctgtaatcccagcactttgggaagccgaggcgggcagatcacgaggtcaggagatcgagaccatcctgactaaccttgaaaccccgtctctactaaaaaaaaaatacaaaaaatcacccgggcatggtggcaggtgcctgtagtcccagccacttgggaggctgaggcaggagaatggcatgaacccaggaggcggagcttgcagtgagccgagatgcaccactgcagtacagcctgggcggcagagcgagactccatctcaaaaaaataaaataaaataaaaaacatgctcacaatacttacattagcctatagttgggcaaaatcatctaacacaaggctattttataataaagtgttgaatatctcttgtaatttattgaatatggcaccaaatgtgaaaaacgaactggttttataggtactccagtacatactggttttgcacgatggtcaagttgaaaaactgtaagtcacggaccacggggacactctatgtacatttagaactaatctaagttcactttcaaatgacactataccacttaacaagtagtacaattactttataacagaatattcccaattcctttgtcctcttccttattgctgtcattcattttacttatccataagctgtaatcactgacacattgttgctattatttgttttgaacaaactgttgtctgtcagttaggaataagaaaaagattttattttgccttcatttattccttctgtaatgtgctttctttccttatgtaggtccaaatttctgactgaaatcattttctttctctctaaagattatctgttatcatttctagcaagacaaactttctggtgaagaattctctcaatttttgtttgagaaagtctttatttctgtttcatttttgaaagataattttactggatacagaagtctaggttcatgttatttttctttcaacacttaaaatatttcactcctctctccttgctcgtgtgattcctgatgagaagtctcatgtaattcttatctttgctcttctgtaggtaaggtagttttttctctggcttttttcagtatttcctctttatctttgattttctacaatttgaatatgatatacctgtgtgtagattttatctcccttgatgtctttggggtttagaaactgttttttttgtttgtttttttgggttttttttttttttttttttttttttttttaaagacagggtctcactctgttgcccagggcggagtacagtggttgcccagtctcaggtgattctcccacctcagcctcccaggtagctgagactacaggcatgcgccaccatacccagctaattttgtttgtattttttgtagagacggggttttgtcatgttgcccaggctggtctcaaactcctggcctcaggtgatccatcctccttgacctcccaaagtgctgggattacaggtgtgagccacggcgcctggcctagacttcttaaataaggcctgagatctgcagttctttgagttatattcccctttgatcatacaggagtcctgtcaatatgaatgacggtaaggtacatggggaggggaagagttctataatcctatgaggagatctcagtctttgagtgagcctgtgccctgggctgtgatcttcacaagtgcttcttggtgccttgccccacttaggtgagacaggaaagctagagagggctggagttgggtattcagttcagctccggtgaaatagtttcttttcaggcacgccttgttgaaaacagtgtgctctgggcttatttcaaaatgacttatttcccctttcccctgccagaagcaggaggggattttttttttttttttttaatcttcactgtgaggacctcatagggctcctagagataaaatgcaaaaatgtgccctcactctccttgctcaagcctgggcccctctggaatttttaactctcagatttaatcatactgagcctcaggaattcctcttacaggttagattttcctaccttcattcaggtttctgtggaggttttgaggtttccgcacctataacttgtgattttttgtatctacctgtttgtctttccaattttgcaggcagcggtttgccctgtgtcttcagttctctgatggatttaagaagagttgtttatactgattttgttcagcatttttcttattccatgaatgaggatgacaacttgtaacctccttacatgcctgactggaaatcggaagttacctgcttagttaaatttattcctagatttcttgttttggggttttgttgtagttgttacttttttgtagttgtttgcttgctgttatattataaatgcattgccttcttagtttttggatttctcactgctagtgtataggaatacaattaatttttatatattggtcttgtatcctgcaatctttctaagcttattagttctaataatgttttaaagaatttgtttttgcgcttaattgctctagatgttacctccagtacatgtcgaatagaatttggaaaagtagaaatccttgtcttttaaattttatttatttatttacttatttattttttgagacagagtctcgctctctctcccaggctacagtgcagtggcccaatcatggctcaccgcagccttgacatcctgggccaagtgatccgcttacctcagcctctcgagtagctgggaaccataggtgcacaccaccatgcctggctaatttttgtatttttgtggagacagggtctcctgatattgcccagactggtcacaaactcctgggctcaggagatcctcccgcctcagcctcccaaagtgctgggattacaggcatgagccactgcgcctggcctaaaatttttatttgttttttggtttttagggtttttttagaggcagggtcctgctctgtcactcaggctggagtgcagtggtccaatcacagctaattgtagccttgaacttctgtgctcaagtgatgctcctatctccgccccacgagtagctcggactacaggtgtgcactaccgtgcccagctaagttttaaatttttgtagagacagcatctcactgtgttgcctaggctgatctccagctactggcatcaaggtattcccccacccccacttggcctcccaaagcactggaattacaggtgtaattctatacccagccacaaatttagtgtttaacaaactgccaaattgttttctgaagggccttttacactgtgttaagaatttggaccccattgtaagggcagtaggaggctattttaatatgaatcctgaatttaatattttgaatttgaagaggttgtcaaaccagagaatctgcctagtgggcaggtgaaactcataagtcagactaggattggagatacagaatgaaaagtcatcagcctatgactgattttggaagctattgtaggaatattttccagggagagtaagaagagtaaggagaaacaagagaacccaggaaagaaccctgaaggtcaccagcattttaaggatgctgagaaaaagctagactcaagaggaaaaccagccaggcatgttggctcgtgcctatagtcctagctactggaaaggctgaggtgggaggatcacttgaacccaggtgttcaaggttgcagtgagctatggactacaccactgcactccagtctgggtgacagaatgagacttggtctctaaaaaggaaaacgaaacaaaaatttgatactatagaagccacgggaaaatgtatttgcaagaagaaagaagtggttggcagtcttggccaaaaaggaattaaggtatgaaatcagtttctccaactatgctctcacaacacggaaaacttctgtgaccaagtgtgtgtttttcctgcactcaccaagcaattctacggcaagtatcagctgggtgtcctgtaattcaactcagttctgttgccatctacctggcatatagatcccatagattgaggggtcaaacctacaagctgcccccaatcctaagccagttgcaagcctcgggttgtttttacctgtgcttctgatcaactggttagaaatcaactttcccatcacctcctcctcagtttcaactactttgctgggacagctcacagaactcagggaaatacttacttacctttactggtttattatgaaggatactacaaagaatacagatgaagagatgaatagggcaaggcatgtgggaaggggcgggaagcttccgtgccctctcctggcataccaccctccaggaagctccatgtgtttagctacccagaagctctttgagcccaatccttttggggtcttgtggaagcttcattacataggcatgattgattaaatccttggccattgacgagcaattcaacctttagcccctctcccttacctggatgttggcaaggtgggactgaaagtcccagtcttctaatcatgccttgatctttcccatgaccagcccccatcctgaagctacataggggctgccagccaccagccatctcattagctacaaaagaaactctcatcactctggaaatcccagggatctcaggggctgtgttgggaagcctgatgaaaatcaaatatttatttcacagtataacaagatgaaattgaaaagtacattagtcttaaagagattgttaatagccttggagagagacgtttcagagaagtggtaaagtaggagcctcattcacagtgggttgcaaaataactagtagggagagtaagacaacagtgaagatggaattttgcctgtgcaagggatagtgaggttagtcaacatccatcgtaatgagaaggagccagcagagagggagggattgataatgcaccaaagttgatagatcaaggaccctaatagtaccagagtggtaaagcataacagagggatagattttaggagacaagaaacactttgtgacatgaggaaaggaagtgaggaccaatgaagatgaagttaggttacagataatggtggtaggaaattgagggagtccacctctgtgacttatagagataacaagaagggtcacttgctaggagtgaaatgggagtgataatactggtaggaagtttgaaaagagtatatattttaaaaatggttgaaaagctactgtacagaataagagagagccagctaaaaaaacagatttctgggttgtattgaggggctagttgggtccataaagcataaattttttaatgatgccaatcttacagttatgtacttttatccagcagagtttagtagtctgggtagagatgtgggaaaggagaccattgtgttcatccaaaactgacatgggagaaagcaatgacatgggagaaagcaatgaatgaactaagcatagtgctctgtaatagacattgaagtcaggtctcaggtctaatcttgactgcttagtgagttaggcagattacttaaccttctctcagcttcagtttcctaataatcatactgaatcatatcagttttctaatcataatcatctattcaggcagattattcaaccttctctaagcttcagtttcctaacaataatcatactgaatcatatcagttttctaatgataataatctgttctcagtgatgggaattaaatggacaagtgaactccttaacgcatagtttgggatacatgatacatgtcaataagtagcagtttttaacattatttgtgacccaattctgtcacttataagctaggtgaccttaggcaagtttctttcctttttatctataaaaaggaaattataatacttgttagggattttcagctgggtatattttgaggaaaagatgtcaagctctacgcctgatacagcctttaacaactcagtaaatgctagttgaagcagaatctgtaaggaattttttagaaaattaggttggaaagttaggtttggaattttggcctttgtcttatcattagtagggtatctttaaaagttcatgagcaggctgggcatggtggctcatacatgtcctagcactttggggggccaaggtgggaggattgcttgaggccaggagttcgagaccagcctggccaacataatgagtccttgtctcttacaaaaaaagaattcatgagccaggagataacataaaagtggtattttagaaatatgcatttataagtagtgtggtaggatctatgtctcagctggatatctccttttcagacaggccttccctaaccaccctgaatctaagatagcagcactccctcctcctatctaatgccttaccctgtatgatttttcttatggcatttatgactgcaattaccttgcttattaatatgttcacttttttactggctccctccactagaatatatgcttcatgagaaaagaaatattatctgtcttactactgctatatctcagcacccagaatgtgcctagcacatggaaggcattggatctgtttgttgaatgaatgaaatatagtaggaactggaagtagagaaactagttaagaaattattggaatgatttcaacattaggacataaagatctggacaggaataatgatagcaatggaaacagaaggaacaaataagaaaaattgaaaaccaaatacatcatgttctcacttataagtgggagctaaatggtgagaacacatggacacataagaggggaacaacacacactagggcctatccgagggtggaagaagggagaggatcaggaaaaaataactaataggtactaggcttaatacctggatgatgaaatgatctgtacaaccaacccccataacacaagtttacctatgtaacctgcacatgtacccctgaacttaaaagtattttaaaaattacaaagaaggatgatttttgacatattagagggcataataagaagcaggcaataagaatgataccaagatttccaaactgggtgattgatggagtgacagtattgtcattgaaggtatctgccttcaataactttttatgaccagatttagaagaaacagtgcctggcatacactgatgggcagtaaatatctgaatgaatgaaacaaaatgggggaagtcagaaggttacatgtaagatacattatatgtttaaagaagcaatagaacatctaagcagatggagaagaaggctaaaattctagaaagaataaagggccttgggatttacaacattcaacagaaaagctgcagccctagagataggcaagcagcaggattatggttttaagaaagtaaagacacaaagacacgcctatagtcccagctacccaggaggctgaggcaggagaatcgcttgaaccttggaggcggaggttacagtgagccaagatcgcgctactgcactccagcctgggcaacagattgagactctatctccaaaaaacaaacaaacgaacaaacaaaaaaggtaagtaaagacatttagttccaggaagggaagagatagctacgaatattacatgcttcagaaaactgaagaaaatggggactagggaagatctttggatttagagatttagaggacatgatctgggaaagaacaatttaaatacagtaatgaagtgaaagtcatattacaaaaggtgtgaagaatgagtggacagtgagataaatttcacccacagaggtaatgagaagagagacactgtggtgatctgaggtggagtcatttaagggaagcttagcttgccttgttttgtttttttatgaatacagaagcatagtttagagagagagcagaaagatccatagcctaagacaattgtcaatttttaatatgcacaagaataacatgggaattttgtttaaaatgcagattgctagcaccacttacagagaatccgattcagcaggtctgcagagcaggacatttttaaacaaataaccctcatcaccaccaacccccaacctgcacccaggttacaactgtagttaagtatttagaccgtactttgactaacactagttcagggagtaattgaagtaaaaataaatggatgagaagggaatttgatttttaaaaaccaaagtaaagggttaagcttcaggaaagagaagaagttcatcttctttattttttaattttaactttaattttttttttttattttggagacacggcctcactttgttgcccaggctgggcagttgctcagtcatggctcactgcagccttgaactgggctcaagcattcctcccacctcatattccttagtagctgggactacaggcacataccaccatgcctgcctactttttttctatttttatttttgtagagacaaggtctcactatgtttgttgcccagcttggtcttgaactcctggcctcgagcgatcctcccatcttgacttcgctaagtgctaggataacaggtgtgagccactatgcctattcatcttctttaaaacaaacggaaaaagaagatggtataagagaaattttgagatgttcggaactgagtttccaggagatttttcaggtggaggagggcaaataaggtttgcttcatttgtatgaccttgatttttttcctttgagtgggaagaaaggttatctactttgggcagatatgagagaactaagagtgtgaagaggtttggaacagctgctctgggggctgcaacagtcaacaaaggatgaacataagcatcgctgagcagcattaagattctgctaagtaggtggcatatgagtttttggtggacccagtcggcagttatttgacaccttttctaggcaaggaatagtcctaaaaacatgtatcttctaataattcatcctggctccatcacctggagtttacttaaacctttttggatgctttcagcctacgccacttcctacaataatgaactttatatatttactgtataaagtatctaaaagttacctttcaactcaaaagatacttcctttgatttgctagaacatatttacatttgttctctccatactgtttaaatttttctggatttgatcacaagacatgtaatgcttgccatcatttcaccaactgttatttctaagaccagccctgttggaggtatatattttcacacgggcaccagaagttaccacccagtgctctattaccatagctgtcaccaagcgaattcagtactctgggttagggcaaaggaaaccaacctgctgagttttctccaggctcgcaaaaacgggagtccgttcagatgaagagggggcgaagcacctgggcactgtgttgttattctactcttaatatatgcaacaactctgagatagataacggaatctccccatttacaatggagaaactgagactcacatgcctgaagtgcttcaggtcatagaggaaagaagctggagagctgaaagtcacacccacctctgtcttattccataccccatactcctttttatatcatgctgcatttggtgggatactgtccagccacttttatttttatgcataaattaacagtgggactattgactaattaacagtttataattgggagcaacttcttaccctgtaaagatcaacaattaaagacatgcagcattgggaatttaacatatggaaaatttttcatctgtttctgtgatcttttaactgtcttaggccattaggttgctagcatgacacatagaaactgtatattcttcatgaggacagataagcattatgaatagcaagaattttaaagttttctgctttttttcattaaattctgatggtacccagcattttagtcttttagtcacagcagtacatttccatttctgacataactatcatttgacacatatagggattatttttccttaaatatgtatctttacattgctcacatggatgcttatcatctgactattcacacactcttgcctcatcttcctatattttatcagtgaatatttattgagcacctcttttattctagccattttgctaggtatcccaaggaaagcctactgtgttctgaaaaattggaattcattaattaaattaaacaggactaacatactatacttttccatccagagaaatgcaaaattataccttgattcaagacaaaatagtttgtccctcccagccatagagaaagctgagttgtttgttacttttagatcttaggtacagaatctgataaagtctaggtggttctgtataccagcagttgaatttataatcgtagagacttgccttaaatatatgatcagtttaggtaagttcgagaaattctgaagtgtcaattatgttgtattagtccgttttcatgctgctgataaagacatacccaagactgggtaatttataaagaaaaagaggtttaatggactcacagttccacgtgactggggaggcctcacaatcatggcagaaggtgaaaggcctgtcttacatggctgcaggcaagagagaatgagagagccaagtgtaaggggaaactccttataaaaccatcagatctcatgagacttattcactaccatgagaacagtatgggagggaaccccccgcccccatgattcaattatctcccaccaggtccctcccacaacccgtgggaattataggagtttcaatcaagatgagatttgggtggggatagagccaaaccacaccatatataaaaatagtatagataatagttatatggagtactacccactgaagggatacatgtttacctgttcccccaagttaggtagccagaagtgttgtgtttgcattgttggcacaacctgtcaacattaataataactaatttattaagtacttctgtgtgccagggattgttcctaagcttcctacaagaataaatttatttaatcttcctaagaatcctgtgaagtgggtacagttgagcatcccaaatcccaaatgctccagaatccaaaactttttgagcactgacatgatgctcaaaggaaatgctcactgaagcattttggatttttggattggggatgctcaaccgtaagtataattaatgcagatattctaaaatctgaaaaatcctgatatctgaaacacttctggtcccaatcattttggataagggatactcaacctgtactacttactctctccatttcacagatgaagaaagtgaggtagggaaaaagataagtaacttgcccaaggttacagagctggtaagtggcagatccccaggcagccttgctgtatagcttactgtctcctaaccattattctatgctacctttcatgggccctcatgttaagagtaactcttcagtttagcaaattattctgcattatatgatgagcttacatataatagcaataatagaccagaagcggtggctcacacatgtaatcccaacactttgggagaccagggtgggcagattgcttgagttcatgtgttcaagaccagcctggacaacttagcaaaactccatctctacaaaaaatacaaaaaaaaaaaaaattagccaggtatggtggtacatgcctgtagtcccggctactcgtgaggctgaggtgggaggattgcttgagcccaggagttggaggttgcagtgagccaagatcgtgacactgcactccagcctgggcaatagaaccagacattgtctcaaaaaaaaaaaaaaggcaataatgtaactaggtgaaaggagagattcagttcttctctgtggtttcttatacacaatcaagattctaatatgttcatagttaattcatagtgtaaagtttgggtattttagaaaaatgtgatgttttctgatgtgactttacaggagtgggaaaggcatagaaaggcagcgctggggctagagcaccatagtctttataaataaaatgtattgtgttatcagtattggctctgggccttgatgggtagtaaaatatttaggaactgagaaaaatgattaggtattagatcctgaaaataaaaatttgctttttgcatttcttaaaaagatttcctacgctaaaagggtggcagtaagtttaaaaaggttttagttactgttttaaaaaaataattgcatagcatatttcatttactcaatagccacatgtggatttttggatttgggatgctcaactgtaagtataattaatgcatatattctatggatcatttatggatccataaaatattctaaaatacttatggataatttctggggaaaaattgcaagtctttttgaatgaatttaggtgtcagtagtaactcattttgatttctttaattctctttgggggccttgtcaagaaaaatttgagttaagagatatatatttttttctttcttcactagaactcttttttttttttatactttaagttttagggtgcatgtgcacaacgtgcaggttagttacatatgtatacatgtgccatggtggtgtgccgcacccagtaactcgtcatttaacattaggtatatctccaaatgctatctctcccccctccccccaccccacaacaggcccgggtgtgtgctgttccccttcctgtgtccatgtgttctcattgttcaattcctggccatatcatcaccatgaaaagcaggcagctgaggaatgtgggatttgagtgcacaggaaagctaaagggacacttcaacccctattaatggctttattgctctatttaaagactagagctattgctctggccaacatggttcttttttgttttttaaactttagtaatacagtcgattctcatgtggtagttatgttctgtaaagtcactgcaaacattgaattagtgaatactggatcattgcccctgggggaaatagggttaggttcctgcaggtctctggtcacatttcatcaactgatcaatacataacctcattgtatgtctctgttttaggacatattatttaatatgtattgattcaattacattaatattatatattaataatcctgtacaagaatatatgtcaacagtattgtgccagaagcactgtaactcatgcctgaacgaagtttccctaacacacatattttctctgaaagggaaaatccttcttgcacttaggaacactagacggcacttgagcactataattgggaccattttaaacagtgaaatcatcagtaaaaggcacaaaaatgtgaaagacgtggcgctgaagagaccacagaaaagacatgcacttactataggagaactgagacaacagagcattgccatgctaagctgcatatgggaacatggctgtcatgtgactcaaatttttttgccactctacacgtggattacgtcctcagatgaccacaaaagtgccacaactattgatttggagcttgcagataaattttagtgagtaggcatatttgcaagtatggaatccctgaataatgaggatcgactatatatattaatgcattctacattttaaaatgaaaagttaaaatataggactcgctcatccctacctttttcaccccctcctggcatctttcctttctggaactactatcagttttctacatatttataaatatgtggacttacagaaatatatataattttttaataaatggatctcatgatatatactattgtgtggtttgcttttttctcatgtgttagagatctttccacgtcaatatacacagaattatttccttttagtattctatactgtttatgcaccataatttttttttttttttttttttttttagacggagtcttgctctgtcgccaaggctggagtgcagtggcacaatctcggctcactgcaagctccgcctcccaggttcatgccattctcctgtctcagcctccggagtagctgggactacaggcgcccgtcaccacgcccggctaattttttgtatttttagtagagacggggtttcaccatgttagccaggatggtcttgatctcctgaccttgtgatccgcccgcctcggcctcccaaagtgctgggattacaggcttgagccaccgcgcctggcctatgcaccataatttaaccattcctgtattgatagatatttagtaatagtgctattataagtaatagtgcggtgaacatctttgtacctgtttctttttccctatatgcaggtttttctgtgggttgcatatgtaaaaatgaaattgctaagctgaaaggtgtatgcacttgaagtttccttagaaaggcagttgtgtcaggtcctctgggaagctgacactgagacagagttaggactgcaaatagttcactgagtacctgtgaaagataggcagtcagaagctgaaggaagggaaagagctcagactgatttacatctaacagttacagcctattcagtggggcactctggagtgaagattgcctattagaaggatagtactaccagttggttagaaatagccaggccctggtactcccatgtattcagttattgacctgtgactgccagggaagaaagtggcctgatcttgaaagacgagggagttaagtcctaaaggcacatcagaactgaactgcaaggtatcttcaagggagatcttgagcagtgtacttccatggttgctactgcagtgtaggactgtgtagcatagcaaataacacagattatagagccaaattcccaaatccaacatctctgtgtaagaaagatgttactctacatctgtgtgcctcaggttctttatccgtacatctgtaaaatggagaaataacagtacctccctcatagggttgtgaacgattaaatgagctgctgtatacaaaggacttaggatactgggatatgttaacactgtataagagttaactgatgctgctgctgcaacatcaacatcaacccaaaaggtgcaccagtttttcttccaaccctctcaacaatgtgtaaaagtatattcatttctccgtatcttttccagtgctggatagtataaatctttttagcttttgaaaatttgatggccccaaaaatggtattttgtcttaatttgcatttctttattaagttgaacatcttttcatgttactggccacatatttaatcttttgaggttttaaattttttcttattaatgtttggtacctagtcatgtattccagatattgttatatagttgtgaatattttctcccagtctcacgttgtttttcaaatttatttttcattattatttatggtttcttttgacaaagatgtttaaaattttgtggatcagtttttttctttatgggttcagggttttctttcttacattgaaaagactttcctactccacgtttatagttctcttttttatgtttagctttgtaaagcctcttgaatttatttttgttcataatttgaaataagtatctagctttatgttttcctcactataaccggttgcccccgtgttcttcattaactagccctttttctcccctgatatttcttgatgctatctctgctgtattctaaattcctatatatatactgggtgggaggatattaacatttttaaaggttttaatatgtgttgccaaattgcgctgaggaaatacatatagaaatttatgtttttactggagagtattttgttgagctccccaacctgtgtttcttgctgttgtttttagtttttgccacgttaatagtcaaaatatagaagttttcttggtttgctttaaaaaaacaaacaaaccaggttctcattctgtagcccaggctgaagtgctgtggcatgatcatggctcactataaccttaatctcctgggctcaagtgaccttcttgcctcagccttctgagtaacctccgtcttacatggtggtatgcgccaccatgcctagctaattaaaaatccttttatagaaatagggtcttgctatgttgcccaggctggtggttttcatttctttggttactggaaagactgaatttttaaaaatgtatatacttttgatgttctgtatgccatcttatatgaattgcttattcatatttttctccatttttcaattttgattttaggtttcttgttgatttgaaaggtatcacatataaagactattaccccttcatgtgtattgcacagaggttattgtttacctttaaatttatggtatttttctttatagtctgactttgtatgtatacctagaaaagttttccctattcctaagaccacaaagtcaactagaatattttcctttttatgattttaatttttatattaatttgccatcttattttgctgcatggtaataagtgggaatcttaattcttttataaatgttaagccagttacctaaaacagtttactgaataatccattctttcctctgatttgtaatgccatcttatatatcctagctctcttggggtgtttgattccgtattgttgattgatgtatctattcctgcaccattactacacactcttcattatcgtggctgttgtatccatgccatggttggagagctcaccttggaaagtaagcactctgtggaagtatcatttcaaaactgactttaattttggaaattaaaaggaaaacccttcttaagctagagtaagtggagtgaattgacttggatcctgcctgggttcctctgtcaacattctgttttgtggtctttaaataacatacttgattaattccattggacatgaggtaatggctgctcttaagctattctaaagctagagacagaactgtacaaaagaattgtcagcaccaagtactttaatttaaaatattaaactaaaaaaaatagttccaatgttttagagatacctttcaggttaaatacaattggttaggtctgatcatttctatgaatagaaggaagtattgaaggtaaacctgtttctagagcagagattctcaactagggacagttttggccactccatctcccagggacatttgacaatgtctcaagacatgttgattatcacagctgttagagggagagagtgctactgacttctagtgagtaaaggccagggatactgctacacatcctacagtgcccaagacaaccccagcaacaagtaattatttggtccaaaatgttagtagtgggccaggtgtggtggcttatgtctttaatcccagctacttgggaggctgaggcaggaggatcacttgaggccaggggtttgaaatcatcatagggggaccccatctccttaaaaaaatttttttaagtagatggatgtggtggtacatgcctgtgtcaggattgtctaagtcttagctacttgggaggatgaggtaggaggatcacttgagcccagaagtttgagactacagtgagctatgatccagcctgggtgacaaagtgagactctgtctcttaagaaaaaaaaaaaaaaaaaagtgaatgctgctgaggttgagaaacctactgtagagaaaactcaaactgagagttcattttttagtgcagtccagtctgacaactgctgtgtttaatatatgcacaagtaatttactattgaagtaagagaagacctttccaaaagtatggtacaaaacctagaagctataaaagacatgattattaaatttgactctatggctgggcgcgatggctcatacctgcaatcccggcactttgggaggccaagacaggtgagtcacttgaggtcaggaattcaagaccagcctggcaacatgttgaaaccccatctctaattaaaaatacaaaaattagccgagcatggtggtgcacacttgtaatcccagctattcaggaggccaaggcaggaggatcacttgaacctgggaggtagaagttgcagtgagccaagatggtgcctgcactccagcctgggcgacagagcaagactccatctccaaaaaaaaaaggactctacagaaaaataaaatttctacatacaaaaaaaatctaccataaacaaaagaaaaataacaaactaggctaaaatatcaataggtcaaaccacagacaaatggctaatttccttaatatttaaagagttcttgtacttcattaagggaagtaccaacaacagctccatgccccttcccccatacctcaccctacacatctcttcatctatatcctttgtagtatcctttatattaataataaatcaataagcataagtgattcactgagttgtgtgacttgttccagcaagttaattaaacccaaaaaggggattgtgggaaccccaacttgaagccagtcagaagttttggaggccccggcttgtgactgactggtgtctgggatggggtgggtggcagtcttggggactgagccatcaacccatgggatctgatactatctccaggtagacagtgtcagaattgaattggaggacacctggctggtgtccactgcttggtgtgtgggggagaaaccccacgcatttggtcacaaaagccttctgtgttgctgtggtgtgacagaaaaaaacatggtttgagagtttttttcctatatatatgtggaataatttggcaatatctgtgaacattttaaatgcatatactctttaacccagaaattttatttctaggaatttattctacggatatagtttcatgtgtgaaatgaatttcgtaacgataaattaggctgtccattgttattgtttgaaataacaaaagactggaaataatccattaaagggaaatattggagagttgcctcaatagacaactgtacaaatacagtatatctatatgctagaatactatgaagccctttagacaggatgaggcagccctgtatatgctaatatgtaagattctctattatatgttattaagtaaaattgccaggcacagacagtatcaggtattggcaagaatatgtagagcaagtgggacccttatacactgctgggagaaaagtgaattcggacataacccctttggaaaacaatttggtattatctaataaaatttaaagatgtgtatgaaccttataacctaccagttttacttattaacagattctagaggaattcttgctcatttccccaggtgacagaaatgttcatagtgccatttataagaaaacaaaacagcaacaaacttctagaaatctgtgtccagagtagaataaataaatgttgagaacactatacagccatgaaaaataaataaattataacaatctgaatcttaaacagtcatgttgagcaagagaaacaaactgtggaaacatacatgtaataagattggattccatttatatgaagtttaatataattcattaaactgtatgaaacattaaacatgttgtttagggggaaaaaaaattgtaaaactacaagcaaggaattaataagcacaaaatcaaggagagtggttacctcaggagagaaaacgagattagagagggcacatgggggattcaaaaagtaatagtaatattctctcatcttctttttttttttttttttttttgagacggagtctcactctgttgcccaggctggagtacagtggcttgatctctgctcactgtaacctccacttcccaggttcaagcgattctcttgcctcagactcccaagtagctggtaccacaggcacccgccaccacgcccagctaatttttttttttttgtatttttagtagcgatggggttttgtcatgttggtctggcatgtctccaactcctggcctcaagtgatccacccacctccacctcccaacgtgctgggattacaggcatgagccaccgcacacccagcctattcttccttcttaaactggcatgtggatgcatgggggttcatgatatgatagttttgtttaaccttatgcaattttagaaatattttatatttactaattattaaaaataagttttggaaagtaggtattgaacattatatatgttactgtgactgcatgggtcatttaaaaaataatacacagacacacactcatgctcttgtatatgcgtacattatccctcctgtaaagatacacaagaagtggtgcttgcagccaggcacgggggctcatgcctgtaataccagcactttgggatgccaaggcgggcaaatcacttgaggtcaggagttcgagaccagcctggccaacatggtgaaaccctttctctactaaaaatacaaacattagctgggtattgtggcgggcacctgtaatcccagctactcaggaggctgaggcaggagaatcacttgaacccaggaggtggaggttgcagtgatctgatatcatgccactgcactccagcctgggcaacagagggagactccgtctcaaaaaaaaagaagtggttattgcttcaaggaaaagaaacggagtagttggaggcccattgttgaaaggaaatgtacttatcactttatgctatactctttttgtctttgaatttttgtagcaaatgtatatagtacatattcaaattttagttttaaaaatgtgtgtatagagagaaaggagagtcatttatcatttgcgagagacagctggggaaattccagtatcatttctaaccttgatgactttgcaggttttgccaaaccatataagaaataaaaagaagacacttttttttttttgtttcattttgagccaaagtgtccctctgttgcccaggctagagtgcagtggtgggatcttagctcactgcagtctcgatccccagggcttaggtcatctttgtgccttagcctccctagtaactgggactacaggcacatgccaccacacttggctgatttttaaattttctgcaaagacagggtctcactctgttgcccaggctagtctcgaacacctgggctcaggcgatcctccttccttggcctcccaaagtgctggacatacaggcatgagccaccacacccagccaggaagacaaatttttgttgagaaggtatttcacctctcatgccaatttttccttgaaagttagattccatggaatataatttatcaaatatcagtgatactctactcttagcccttatccaaagccttaccaaccttacctctctctttatattgtttactaaggagtctctggaattttgttcatgttttttaacatctttttgaggaaaaataactttcttaattctcttcataagttctcttcaattcttagtaatcagtacttatattagagcaatgctgaacaatttaaatgcacaagtatctcaccaaaacctttattcaggccctacctgtgataggaaacaaaagtcagtgtctgtacccactatcttgactatttagaaagagaatctactaattggacacctttctttttccttaagactgttcacagatttttttttcacattttcattttagagtaataatttgggtcttattactaaattaaaattatttaaacatgtcaaaggcatttatctccataaagtgtttaatccattctagtttgtaaagataggggttttttttttttctttacatttattatgtctggtatagatgattaaaactttgtaagcgtaacctgtatttagctgagtcaggaattctcttaatagtgtaagtctctagcccactgaaaagtcttgccttctctccatttgtttttgagggtcaacaagtctggtcagcttctgtgcaacatcatacatcagtgtattaccaacggccactgcaaggattgatgctgtttccactgggtagcatggcatccgcctggtcaccttagtcaacacactccttctgcttctgtgtgtgtgaaggagtcaacacactccttctgtgtgtgttagtcaacacacaccttagtcaacacactgcttctgggtactgctacatccacaccactgtttcctctaggttaagtgttgatatactgttatctcccaatgacaggacgctgaaatgaactacattatgctctactgaaatagtttcattttatgttacaccctgacatttacagtaccacaacaggattgccacttcctccagtatcttgcaaacttttaaaggaactagctatttttcctactacccttgcatcctccttgtgcttagatacaaatccaccggaggcaaatacaagtgacaccatgcagtactcagaatcactccttctttatgatggatggtaaagacttcattactagcttaactttgcttcctagactttttctctcatgaaagtaaattctttccagaacaatcatcagtctttaatgcaaataagttgcttgaaaaagatttatccttgcagctcaagtcccaaaaattctatcccatatcaggttttgtaatggaaagtggatcagtaggtgttgctcacatagcaagctgatacttgtagtcatatcaacctttagccatcactttagggtggaaaagaaatgacttttcattatgcctctcttatatgcctgtgtttttcactaactttagaggaagagtagttaggcagccttactgacttgaatagtacaaagcatgccaaaactgtgaagctgtttggtgatatgtcctccacactgtggtcccaaaagaccagtaaacctaaagggactaatatgggccggcagggggcgaggcagggtagaaccttggggtatattcctgctttcagagaggtggcaaaagtaagcctggataccctgtgctagactttgtagctttgcccggaagccctctctatttggggactaggcttatttagttctctttctaaaacgttttgacaaatataacttatattctaggacatctgccactgacgcctgagttcagacattaattgtcaattctgtagtctttttttccttcaagtttctcttgtcgcttccttttctccctcctttctttctttctttttttttttttttttttttttttgagacagtttcgctcttgtcgcccaggctggagtgcaatggcgcgatctcagctcaacgcaacctccgcctcccaggtcaagcaattctcctgcctcaggctcctgagtagctgggattacaggcatgcactaccacacccggttaattttatatatatatatatttttttttggtagagacggggtttctccatgttggtcaggctggtctcaagctcccgaccttaggtgatccgcctgcctcggcctcccaaagtgctgggattacaggcatgagccactgtgcccggccttctccctcctttcaaattagacaaacaaaaatattttagtgtctctctgatttctctatgtttacatttcactgtcccaggaaccagcctagtccgttaggaaccaacatactccccaagacacatctcaaatgacagtttgctggccatgttaaaaatgcatttctgattctatttagggatacctttagtccatgaaataaatgagaacattatcaggattcataattattatctggatatgtccctaaaatatagcatgttttgctgacttactgaaatacatatttgtttctagttttttctatttcccttcctctcaaatagttaattaaatagtatcagtgacctaggaaagtcactgttcaaacaattccttccttaaaatgaagaattatcgactattctctaacttagtattttagagagagagagagagtataatgtgaaaaaatgtggtgtctttattcattttttgttgctataacaatacctaagactgggtactttataaagagcagaaattatttctcacagttctggaggctgggaagtccaagatcaaagtgccagcagcttaggtgtctggtgaaggaccaatctctgctttcaagatgggtccttgatgctgcatcctcctgagggaggaacactgttctaacatggcggaagagagtgaattcattctcacaagctctttttatggcagcatgaatctgcttataagagtggagtcctcatgacctgaacaccttccattaggctccacctcccaacacagttgcattgccgattgtttccaacacatgaattttgggttgcacattgaatcacagcatgtgagttctcaaataacagacacaaaagttacatagaagagattgatagttcattcacttaatatttattgcagacattatatgtcaggaactctgctaggcattagatatatattggaaaataagatagatactggccatatagagaacttatctagcagttaacagacaacaaaaaaataaaaataaatataattgtcatagtgctataaagggagaaatgtagttttaacaggaacctattaacaggaagaatttacgagggaagtcctccctaggaaaatgacatgtaaactggaaatgaaaggaagtgcaggagttagcaagaacatgagcagggaatagttctgccagcaaaaagaataatgtgcaaaaggccctgaagtggaaaagagtttggtgcttttaggagctgaagaaaaccaatgaggctaacttgtgtagagccaagtggggggagtgagattagatctgtctgaaaaaaaaggcatagttcaggtaatacaggacctggtaggccattgtagagattttgttctttatcctaacagtgatggaagccattaaaatgtttaaggtaatgtgacaaaaatcagattgcatgttagaaacagttgttctaggccgggtgtggtggctcacacccataatcccagcactttgggaggccaaggcgggtagatcacaaggtcaggcgtttaggaccagcctagccaacatggtgaaaccccatctctactaaaaatacaaaaattagccgggcgtgatggcgtgctcctgtaatcccagctacttggggggctgaggcaggagaatcacttgaatccaggaggcggaggttgcagtgagccgagatcgcgccactgctctctagcctgggtgacagagcgagactccgtctcaaaaaaaaaaaaaaaaaagaaagaaacaattgctttgcagtatgaagaagaaaggattggaagggataagaaatgagtgctgagaatttactttgacttgggttgggatgttggacatgtagacagagaggacaggatagacttttgtttaggaggtaaattccacttgacttagtgatttcagagtgggaacctatgggggaaagaaggggaaggagttaagaataactgacctgtgcaactggatgaatagtggtgccattgagaaggacactgggaggtttaaatggaggataagttcgttttcgtatttgttgagcttgagatgcctatgaggcatccaagtggaaatattaagtaagcaataagcaggaatctggagcttaagagagatgtcttagctagagatcaatttgtgagtcattgtcttttaggtgataattgaatcagtgaacccagctgagattgcctaggaagaatatggagtgagaagaaaagggcagcttgggaacaaacttgacaactctttggtgacgttctgtataatttttattctgaacagactttggttttataagaattgtactttgaaataaccttggttgttttaactgagactttctgttgtgatgtagtaaccctctctctctcgccagatatattgtcatctttttattttttgtatataatctattatttattcaaacagtgaatagacttggccattcattgatcatccagaggtaatataagtgatgttttctaagcatctgggttaaacagttttgtctagatacagtagtaagaaccattcttactatattcttgtcctataaatggttgaggtgacagaatgtttagctgtctgttcagatgtaataaggaaggttgaattctccttggcagccttttttcatgagttgttgggcatctctcagagacagctctagagataataaacgtttattattctggtgtcctgactgatgtcatctcttattgcctaagcctcagtctgggattaagatggtgggtgtattagtccattctcacactgctataaagaaatacctgagactgggtaatttataaagaaaagaggtttaatgattcacagttcagcatggctgggaaggtctcaggaaacttataatcatggcagaaggtgaaggggaagcaaggcaccttcttcacaaggtggcaggaaggagaatgaacgcaggaggaactaccaaacacttataaaaccatcagatcttgtgagaactcactatcacgagaacagcatgggggaaatcacccccatgattcagtttcctctacctggtctctctttcaacatgtggggattatggggattataattcaagatgagattttgggaggggacacagccaaaccatatcaatggggttttccccctttgccactaagtagccacagaaggcaggataagaaattgacaaattggccaggtatggtggctcatgcctgtaaccccaacactttgggaggctgaggcaggtggatcacttgagctcaggagttcgagaccaggctgggcaatatggtgaaaatgtgtctctaccaaaaatacaaaaatcagcaacgcgtggtggcacatgtctgtggtcccagctactcaggaggctgagacagtaggatcgcttgatcccaggaggctggggttgcagtgagccgagattgcgccactgcactccagcctgggtgacagagtgagactctgtctcaaaaaaaaattgaaaaattggactcaaaatataaaacatttgtccttcaagagccattgctaagaaaatttaaaagcaaggctatgggggaaatattggtaaaacacatgtcagaagatggacttgtattcagaatatttggaatatataaagaactctttaatcattggacaacttgacttttttaattgataaagattttaacaggccagagatggcaagtaaatacatgaacatatgttctatatcattaaacattagggaaataaaaccacagtaagagacctctacatgcctacctctacatttttagaatggctaaaactagaaagattgaaaatacaaagtgttgatgagtatggtgaacaactagatttttagatattgctgctgggaatgtaaaatagtacagctggccgggcacggtggctcacacctgtaatcccagcactttgggaggccgaagcagtccagtcagttgaactcaggagttcaagactagtctggccaacatggtgatactccatctctactaaaaatacaaaagttagctgggctttatggcgcatgcctgtaatcccagcaactccagaggctgaggcaggaaaatcacttgaaaccagcaggcggaggttgcagtgagccgagatcgcatcattgcactctagcctgggcaacaggagcaaaactctgtctcaaaaaaagaaaaaaaaaaaagaaaagtacagctactttagcaaacagttgggtagtttcttataaatttaaacatacacttaccatatgactaagcttttcactcctaggtattaacacaggaaaaatgaaaacgggtctttacaaagacctgtatgcaaatgtttatagtagccttattcatgattgcatatgatttcatttatataaaattctacaagaggcaaaactacactgttagaatgtagatctaccttgggagcttgggggaggaggctaactgcaaaggagtctgggaactttttatggtgatgcacacattctatatcatggttgaaatggctacatatatttgtcagaactcattgaattgtacattttaaaatgtgaattttattgtatctaaactcgacctcagtaaacctaatgtcagcatttgtgaagggttatcagaagccttttaggatatcacttgtaaaatgggacagtagaccaaaagacaatgaagctttttgctcaaaattccatgagtagtggtgcctgtggatagaatgcttatgttcagattcttaatcccacacgactgcacaattcccttggcattaactcacaccctcctatgtattgtgctttttaactttctgtggatgtgtgtctggctgtgtgtatggaagttctggaaacacaggggtcatgtcttcatgtgtccttcatacatcctacagtgtattgcacagatcttgtgctcagtatttgcggaatgaatgaaagcttggtatagcacgcttgtgcccactagacttggacagaaaagtcaggcatagctcatggtgtggtgctaggcttctcaagatcatgagaaaccttctctaaagtatggtttttctagaccaccatctctttgcttaggagatcatggctaccacaaatgtaagctaattaatgagggattgattttatatatttctgcaaaagcttaggtagtgttttcagaagttgaaaattggggagatatcaccttacatttttaatcttatgctgaatttaactacaatgagaaaacaagctcctcttaaagattaaatggaagaagagatgtcagaactagaacttttgtcattctccaaagctctccactcttaaatctatccactttataattgaggcatcacactgatggcacagagaaacacttgtctcagtgttaaacttgctttcctcatatttgtgaggctctaaacttttacagttctgactcatttaaaaacaagtggatctacataaattggacatgaattcatgatttttcttctaagtctaaaaaagcaagagactcagaggtactatgagacaacaataaatttaagagaatactaaaataaaaaatatataaaaaagagaaagatagaatcccaaactatgtttctcttatttcttttttttcttttcttatatttaatttatttattttagagagagggtctctgtcacccaggatggagtacagtaacatgttcatagctcactgcagcctcaaacttctgagctcaagcaatcctcccacctcagcctcttgagtagcttgaaccacaggtgcacatcacgatgcccggctgatttttttagtttttgtagagataaagtcccagtgtgttgcccaggctcaaactcttggccttaagtgatcctcctgcctctgtctcccaaagggctgggattacagatgtgagctgagccatagcacctggcctatttccttttttaaaagtatatcgacatagcaacacattattgataatatttaacatctatcaagttcttactctgtgccaggcatttgttctgagtgctctgtatacattctctctcttaatacacacaatactgggaggtcattctgcatttactgaggaagctgaggtacacagaggttaattaacttgcccaaaatctcacagccagtaagtggtagacctggatttcggtcttttttcttttgagatgaagtctttctctgtcgcccaggctggggtgccatgacgcgatctcggctcactgcaacctctgcctcccaggttcaagcgattcttctgcctcagccttctgagtagctgggattacaggcacatgccaccattcccagctaattttttttatttatagtagaggtggggtttcaccatgttggccaggctggtctcgaactcctgacctcaggtgatccacccgcctcagcctcccaaagtgctgggattacaggcgtgagccaccgcgccttttttgagaggccagatttgagtcttaatccagaacctgaactcgaactgctgatatgctatctacctgtgaagacaacacatacatgactaaatggtttagaatttgatttaatgtcagagaattactgtactcatgtaaattgttaaggaagtacaatttagtagagaaatgatttaaagttgtttaataccggaatatcaactagttgaaaaagagcagttactttaacagacctggagatcataaatggatcctttgctcttgtgactttataaattcctgagaaggtagtagtgcacattttctggtcgatgcaaataggtaagacaaatgtgagtgttcattttgatgtctgagagtagactataaatagccaagtttccttggagataggataagagcctaaagttgatgtagggaatccttttgttcttcagacaaagatattgggatgtttctttaaggagaataaaccgagagcagggtgttccttgaacgtttatgagaaatagtggctagtgtaggaagaggttacattttataaggaacaaaacccaggggagcctctcctgtgaactgacaagaggaacccaaagatgacatctccctctatatatatgtttttttacctcccatgaaagtccttagatgcactatcactgtgcttacaaaattgtgattaagtctgttctgatagaagtctgaatgttcctggaggtatttttaggaatactgttcattttctttactcaatgaatggtgttcagggaagttagcatcatgtgctaggaagttttgaagtgggtaattcaaaacctgggttttagtctcagcgctgctaattaactttgtatccttggattaatcatctaatctctctgggcttcagtattttctaaaccctaatttggggagattagaacagatgatctctgagatccctgccagctctaaattctctaattttatgactgcttttggccaggagctttacttgagagctgctattgtctgctcattgcttgcttgtttcttgatcattgtccacaggcagtccttttctgtgaggctatggggtcattaatgtttagtctttttgttaaaatacttttacagataattccacagtacttttctggccacaagaattaacctaccaaatttaactttcattctctttaccagtctcaccttaatccagctcagttctgtgtacaaaccatggaggttattcattcaggtgaaataaatgggttacttctgccagattaatctgggaagaaacagtaagtatccttgaatggaattcttccatgggagtttctcttgataccctaattgaaatggaatagaaaatgcagacattgtaatttaaattccattttaaccttctacctgactcactttggtttatgctaatttctttggcatactcttaatttcttttagatccagagcatgtgcttaaattcatacatgattgaaagatttcatagtgtgtaatgtaaatgcaattagcacacttaaatttaatgtgtaatatcgtataaacattttagaattttaaaatttaaagcaaacattctttttttttccaaagacagaattgtatggatttatctacacttagataagacagagtaaaaatacaaaggttctcaccccctctccccacgtcacctccagttctcttcaaccagagtaggctactcttggcagtatgacaaatatccttccacatattttctatacattatatggatagtttaaacattgtggtaagcttttctttaatgaattcttcatgcactatatgttaagagcttcaataattggcagagtcatagtgccatagtgaggacagattctggtagcatgttgtacttgtcaataaagcagattttaaactagagatttgctgctagttagtatttaatgtctttatgggattaaacctaaggtcactttagggagcaagagctaataagctgtaatgtgagggcagtgttgggtatgatttagtcaactgtaaaataaggcctccaaactacagtcatgcttacaaacaggtggtaatagttgtcttttaaatcgggatagagggaacagccaacaggatgcaaggaaaaagaaaatcaaacttaaaggctaatgatcattttttacttgttatataacaaacattttgttatttcattataatagcaaagctttctcaatctccaggcttccggcattggtattacaataaaatccatccccagagcttctatttcagcaagcctgaacttgccttgtgtgtggtcatcaatctgaataatatactaaaaagttgaacagggaagtaatgtcctgactactttttatgaccaatagccttagcaccctttttatgttggaatgcaagtttcatgagtacactactgtgttaaattggtgtgtcttgtactgtcctgtgtatgttttaacaaaaaaaaaatatatctaatttcttttcctgaaaactattattcagtgcttacagttctgattgccttccaggtgttatctcattatcttgtttaattctcacacagacctaaatggtggttgtactatttttttgctgaagcaggcttggaaagattaactgacttgcccaaattagtgacaaaactgaaattcaaattgtgacctgttgttgagtttaatttctggaatggcaaagtaaggacctccaaaaatctgctcctctataaaagcaacaagtacactggcaaaattattaggtcaaccttttcagaactctggaaattaaagcttgcaacaattgaaggagcattcgagaaaattgcctgtatttgggtaagaaaagcaaactttgtggcagtttcaattgtgctaattccatctacctgtccccagtacccttgaaaaccagtagcctcacagctatagtagctgtgaaaactagcagcttagcaaccaattgagagggcagggggtttggtactttttaaagccccatccccagagaattgtcactatttgatcggtctggcagctcactgaaaatttcaatttttagggcttatctttgtttgatcagattcagagtttgctctgttctattcctaggcatttgttaaaaacagtcagcagttgttcagcatcacaggttcctgaggtattggggtaacaaaagactgacaggcaaacataaaggaaaatttgaggaatagaatgtccataggagtctttgaaaagctccaacttatttctgggaacctgaagggccacacacatgtttgggactgtccacatacccaggcaacaactgggaaggccctactctctcacctctacctgatttaggactcaatgcaagcaggaagtgagggccaaggcagagttgtaaattgtctgctgcagcattgatgatgtgccacagcacagagagagaccccctcagcaaaggctgagagtcttattggttcaaagaatgtaaagaaaccttattctaaccattagctgactactaaactaatctaatagatgaggccacacgcaacaaaggatacagactttacagaatgattccaggaaggttagtaaacagtaacaacaacaaatcctggggaaggaaggaatttgatttccatagttgtcacattatattattcaaatgtccagttttcaactaaaaattacaagacacacacagaaacaggaaagtgtggcctatacacaggaaaaataaaagcgttcaatagaaactgctcctgatgaagcccagacattggacttactagacagagtttaaatcagctgttgtaattataaatatgttccccaaaataacaaagaattaaaggaaagtttgaaaacagtggcttaccacatagagaatatctaataaagagatagaaattattttcagaaataaaatagaaattcaggagttgaaaagttaaatagctaaaacaaatcagaagtagaaagaatcatcaaacttaaagacacatcaattgagattattgcatatgaggaacagaaagaagaaataatgaaaagtgaagagaacataagaaatgtgggacattatcaggtatatcaacatacacataacgggaattcctgaagaagagagaaaaaggagcggaaagaatgtctagaaaaacaatggctaaaaactccccaaatttgatgaaaaactatacattgaaaaatctaagagattctaagtaggatagactcaaagtaatatacattcagaaacatcatagttgaaagacaaagacataagagaatcttgaagggagcaggaaaacagtgaatcctcatatgcaagggatcttcaatactattaacagctgacttctcatcaaaaactattaggccagggaacagcgggacatgttcaaagtgctgtatcactctcggctggatgtgttatggtggctcacgcctgtaatcccagcactttgggaggccaaggcaggcagatcacttgaggtcaggagtttgagaccagcctggtcaacatggtgaagcatgttgtttagtagagaaacatctctactaaaaatacaaaaaaattagctggacgtggtggcacatgcctgtaatcccagctactcaggaggctgaggtaggaggatcgcttgaaacctggtaggcagaggttgcagtgagccaagatcgtgccactgccttctgcctggacaacagaatgagactctgtctctaaaaagaaagaaaaaaaaaaaaaatcactgtcaatcagtaattctatatccagcaaagctatccatcaaaactgaaggagaaatgtagacatttcaagataaacagaaatggagacaattcatcacaagtagacatgttctataggaaatactaaagtgtgtccacaggctgaaataaaaggatactagtcaatattttggatccacataaagaaataaagagcactggtaaaggtaactatgtaggtaaatgtaaaagtcagtacaaatatatttttgcttataacttttttattttaaatcaataattataaaagtgtgttaggcttatagtgtatacatataatttgcataataatagttcaaagacaagggagagaatggagctatattggagtaaagtttccgtatgctactgaatttaagttggtatttaaatgattgttggatttcttttgaggtaatattcaccattttaaagtgtacaacttatgaagtccttaaaatggcctaaaaaataaaatgtacaacatagtggtttttcatacattcacatatatggattttcttatagtattgtgcaactatcaccaatgtctaattccagaatatttgtaacattccaagaaaaagaaaccctgtacttcccaatttctttttcccccatcctctggcaaccactagtctattttctgcctctttggatttgcctattctggacatttcacataaacggaatcatacaatatgtggtcttttgtgtctggctgctttcacaaagcattgtgttttcaaggtttatccatgttgtaacatgtattagtagttcttttttttaattgctgaaaaattcattgtatggctattttgttttttattcatcagttgatggacatttgtattgcttctactttttggctattatgaataatactgctatgaacattcatatataagtttttgtgtaaagatatgtagtctcttccaaccccaagttggtgcactgcaggacaattcaattctgacactaatcacctggagttagtgcagacctcacaaattaaggactcagttctccacaaattcagatgctgcccccaatgcagatgctatccacaaggtcagggggtccccaggctacctctgcttctcactggctacaactttaggggttcccatgatctcttcaggttcagtaaggagatacagtgctttgataggagcccagaggacaagcactcaactcaggatgggagtgtaagagcttgtcaaggaagatagcccaggagcaacttctaagctgcaactggaatttctagtcataggtactagccaggaaaagaggtttgatagagtattgtaggcagagggaacagcatatatgagggcctggggtgtgtataatataaggagatatatgaattaggaattaatctaagaattagagcatcaagtatgaaaagaaatgaaagactagaagcagtataatccagacctttacagcccattttaaagagtttggatttaggacagagagtcactatagaagagccagatccaagaaagatccctaaagaacacaaaattttaacaaatgggaaagaaaaaagtgtgtatgaaaggaggagaaactaaagaggcaggaggaaacccagtagatatggagggagttaccaaaaccaaaggaaatgtgtttgaagaagctatatcaaatgctgctaaaatgtttttagtccaggactttaaatgttaagcatccattagagttggtgttatggagtgagtgagcttcacaagagctctatcaaaatggtagttggggcaaaagccaaccttcagtaggttgaagagtgaatgagactctgggaagtgaaggcagcagaggaggaggaaatctggccatggctgggggcacgggaggttagacaaagcaagacagaaacagaaagcatgatgcccctggaggacgtgttggcatatgggatagttttgttttatggtaggggagacttaaacacattcaaacatttttgagatccagaagaggatagatatgaaaagagaaaataatgtattgggcaagatcccaaagaaggggaggatgggatccaaaacacaaggagaaaggattgtgagaatgaaagaatgaatgtgttcagatacatttgtaagtttgatggtagacagttgaggatttgctgtctgatggcctctacttttttctgagaaataatagagactgatacctactgaatatgaaggaagtggtagattttttaaaggagagtgcaggagtcttggaacagcctcagcaaagaacagtgaagcacggaattagtgagacctaattagtttctagacagagatgacggccctgagattaaaatttagaaatttacagcagcacccgtctgctctgatgtgattttctccatcagcattccacagcctgaaggttagtacaagaaggaagaaatttctattgagtcagggctatcatttttgccaggtgggtgcatgaaaagataaaaggtggtaacataatggatcaaggactctaggctgggtagggaaagacatgaaggcaagaggaaagtgagagactgggagaaactgtaaggatgggtgactgtaaactcccgggagggtaagaacaggtgaaagtcacaggaaggcatactacagtggagagtagggctcagccccagcctattatgttactcaggttttcagacactgtccatgtgtggctcattaagtttctttgatttacctgttcactctttttttttggccagtttgctatttataagcacctatatcctaaaatacaatttagaaatcatagcagataaaaatcatcaccactagctatgtttctagaggaaaaaattaggtgtgtgacgtttttaagttacccgtaggctgttgttttgtttttgtgcttctactcattcagagggcgagctgccagcgtctgacttacccagggaggtgcacagggctgtgtacactggggtctttccccttcctgctccccatcttcacgtgcaatccaattctaaatttcttcagccagcccattgctaaaacatgaaactccgtaatttcagttcaattgggatactacccctcgctcaaatacaaatgctcttgggaaaggcagtatgttaagcttttatcaatcattaagacatttgtggtagagtattttttggcctgtgtaaccagtgaaacagcttgccaagaacagattttatttccccaaggaggaagtagagcaagagatccacatctgtggtagggattgggcactccaaatcatagtacctagagctgacagggagagccccgtgagaggaggagagcattgtccggaggaggaaaacgtaacagggagatggaagaagataatagctaatgttaacttcgctatttttgctcaaatccaaccctgtatgggaaaacgctctctctggccaggttggcaagcactccacatgatttgctctgacagactggtggccgtgcgcctttctgccttacagcccctgtgttacagattttctgtgacactgcttttacatgtagtgatgacataccttataatcatcctcactgtggcaacagacatgctcagactggctgtattaaatcgttttaacagtgtctggatttacagatgatgagcgtcgaagcttcttaagatgcccccacttaatggagtaagactcaggatgactttccttttgtgtgttatgctgcacaggtgagatgctgagaggcatgtgggatgctgtagtttctagttccatttcctttttcctattgtgtacaagtcttttatttggctgggttagttacctaggaaacagctgcagggtacagatggattggctgtttggggaatggaattacaggccccttcaagaggcaaaaagacctgttggataaaacaaaaattcgtgaatggctgagcttgtatttaataagtgtgcagaaaccacattaagatagctctacagtagagaacttatttaatgcagtgcgattttaaatttagcttgtttttaatacatttaaactcacttaatgcttatgaattccactactgcaggccattttggggtttccagtggagtggaaggtgcagttccctcctctgaaaagctcatgtcctgtttggggataaaaagaagctaccttaaagtaagtgcatggttgtatgatacagactaaatgtgttaagggaatttagaagaagtaaaagatcttgactattaatgtgggtgatgagtctgaagctcaaggaggtaattccttgaggtaaaatattaaatttgaaggcctggtgaaagttcgggtactaacagacctgaatttataagatttaatagtaacagcacagttagccttgcaaattcccccagtcagcttacagaaaatatatgactgtgttataaatgttgtcaacttagagtctcactcaagaaaatgaactttaacaatgttgactgaccactgtttgcattagcccttgcatatttaaggaaagtctatttttactgaatgtgtgagcatattagttgttgaatctctgactgctactatgctgagcacgagagagactcagcaaaatatttgtgtattggctgggtgcggtggctcacgcctgtaatcccagcagtttgggaggccgagacgggcggatcacgaggtcaggagatcgagacgatcttggctaacacggtgaaaccccgtctctactaaaaatacaaaaaaattagccgggcgtagtcgtgggcgcctgtcgtcccagcagctcgggaggctgaggcaggagaatggcgtgaacccgggaggcggagcttgccgtgatatcgcgccactgcactccagcctgggtgacagagcgagactccatctcaaaaaaaaaaaaaaaaagtgtattgattttcttatatacagtatgccttctgtttgtcgattagcattagctttttttcttctagaatagagctgctatttggttttgatttattgtgataaggaatttgataaatacaggactatagctattcttttaaagctaaaccgtggtcagattatttgcagttttatagaaggtgttgaaattttcgtgcttgttctgtttgtagtcacttggtgtggtgtgctagacagaggaggaggaaagcaattccactcagaatctacaggcacaggaggttaagttaaatttcatttctaacgctgagagagtaagaaagtcaacataaggatactcaaatatttagaaggaaagttcagttatgatgtactgaacctacaatttttaatgtttaccagcaaaaaaaatcaaatgtaaatctaagttcactaggtatgtagttacctttgtaactgtacagactttgtatgttaaattgagaagaaagttgctaatataataattcataatattgcattttgtcagagggtctttcattgccagcagttacatcttttataaatggaacagtgactagaaaaggataatttgttaacggtcttttgctgaatgatcaggaggagtttcctgttaagagttctcgagcactgctgtgaatgccttctttatttccaaaattacaagaaaatgccttatcataagacactccctcaagtttttttttttttgttttcaaggagactttttagtgtttttgtttaagaacagtcatgcaattccctggtgcctactcacctctaccaaatcctctcttctggtttcaagcaattaccgtgaaacttaaaaggttagcaataaatagtgtgacaattttttttttttactgatttacttctctttggcctatgaagtcaatcagctccaagtagaaggtggtgtgtggcatagtgtgtggcatttttgtgaagatttgtgtactttctgtccggtctgccttcctcctgcctgtgataaccccataagtataatgttgcttgcacctgggcagggatcaccagatgggtatagttattagatgacttgggagaaaaagtacagcttgtttattttcttctctgcttaacagttagcatttgggggaggactcaaactcaactttgagagaactgatttcttgtttcattttatttcaacaagttgctttatttctaaaaatacatcaatggccaaactcaagttgcagaaaagcaccctccttccagcagccccacctagccacacgtgcacgtgcacacacaagtccagccctgctctgtcttcccaccagggcagcttcccaaaatgccactaggaatttcaccagttcccttcacagaagacatttgttcgtggcaagtgctatgatttcgaggtcaatgtcttttttatttttgtgttcatattgagaaaataatgctggccaggcacagtggctcacacctgtaatctcagcacactggaaggccaaggcgggaggatcgcttgagaccaggagttctagaccagcctgggaaacatagaccccatctctataaataaaagaatgtagaccaaaaaaatccccccaaaatgcaaaaatctgttatgtttctaatagctccagaaatttccattcctatatttttggtaacttttcccatttgccattgctcttggaaggggaaacaagtagtttttattgagaagtaccattgaaaacattcttcttattggggaagaagatcaaataattgctctgtcacctttctaatctaagtttttataaattaccccaaatttgattgagggagggcccttgggtttgacatgagaacatccttatggaaaaataatgcttgatgttttaccaaaatcacttttatttgaatggggagagacactttaagaattaccttcataatttgcctttgtgattttctgtgaagcatgccagccatggtttggcagtgtgaacacttgtaaactctacaaaaattggtgaatataccaagtttgggacagagggccctcctagtttttccaacattttcttgagtttaatggaaaactacttatactgtaatattcttagaccttatacctttcataaacatattgcttctggcatttaatctattatttaattttatttctatattacaattaggcatatttcaggtttgtcttcaatttcctgaaaagtgattttcttttcagccaaaatgaagtcatatacaatgagtcttggatctaggaatcaaaaaataccagttctttctgccagcatgcaggctcagtgagggcaggaacctcatcctgtctgctgttatttccctggagcctagaaaaatacctgacacaattactcagaaaagtatttatttaatgaatgcctgagtgaactgcctgttatgacttttctgaggtcatttgttatttttttaggttcactttgtatgttaaactaagtattactacgttatgaactacagcagatgctgaagagtaggacttaggatgtgcttgaatgacccacgaagagataaatgagatttaagaactaaaggggtggtggtgaggaatattccctggacaggccaaacccactaaagtattcccaccatttgcatctccccaggagcactcactgtgggcctcgtgcgacagtgtcaaacaatccatggacgagaccggacgtgcatccctccccggcttcccccggagtgggtcaccacactgttttttatcatcatgggaatcatttcattgactgtcacatgtggtttgctggtggcttcccactggcgaagagaagctacaaaatatgctcgatggatagcattcactggaagtaagtaacctgtgcttactaaatttgtctagaaggcacccacccacactggtatttttatgaagataatcaagaatcagtaataaggacttcataatcatcaaagagcaccacttgtgtatggccgtgagatagactctacacagtcccatcatttcttcaaaactctttctgcaagaccaggacatccacaactttaatcactttgtatgaaatgctattttaatgaattttatttttgctcagattgtgacataagtgttccaggtttgtgactcagagttaccagtagcctgagtcttttcctcttcttgaagctattggtatcatctatcaaaataaagataagtatagaacaaatacataaaaatataaattagatgaaggtggaaatattttttaatattgattttgagtttctgctgtatgttgtaaccattgaaaaatcaacacattttgttatttaataattgtttatcaatatttcttactccattaagctctgcccaagggtataagcttatatattacacattctcttgtactttgcaaaattggtttaatttcacaacacatcagagatttatctcaagttaaacagaagaaacaaaaatgcacaaagaaaagacatttctgcaattctgctttcgtgcttctttttctccaaagcaattttgcaccccaggggttatttaacaatatctgaaaacatttttggtagtcacaactagggggatgctggtgggtagaggcagggaggctgctaaacgtcctacaaatacataggacagccccccacaacaaagaattatctggttccaagtagcagtagagccactgtttagaaatcctgctctaaagaaacaggagaacaatacctatgcaaatgagacttttaattcagtgccttaaaataatctcaggtttgcatacatttttaaaaataaatataacagctgactttctcttgatattttcatttagaacgcatataattgggataagggataatcccttgtatccctattaatgttaaaactcagtttatcctaaagggctgcaggagagtgatattccttcatgagcctctgtttcttcctgtattctctgaaattgatactctttaatgtgtatgtttctgactctgtttatctatattgcccttaatttttaaatttagatcaagttgccttttatataaaaaaggttctccatccttgttaagcagagtgaaacaagttggtgacctttcccctgtccaacagacctcctgagacaattcttttctggagagagggtccagaagcaatcgtagaaacagtgcggctaaagttaaggatattgatgagaaatttaaagagaatctgcttctttatcttttactcacagattcactaatccagatagaaatcactcttcaaggagtgaaataatatcaaagaaggatttagtttctggatttagttgaaatttgggaatgcatatgccttgaataccaaaaacctaaaatatgatttagcaaggtagtgtgagtcgaaacgttatatgctctcatgagctatagattcttatgacccaataaagggaaagaactaggattatctgttttccattccccttaagcagagaatatttaagtatgtgtagttgcccccaaatgcaatgtatttttttctttattttttaaataatttaactttttgaaataatatgtgcatatgatgcataattcaaaatctctgaaagggtaaccatgtgaaatcatatttggccctgtcacccagccatcccattaacccctttcctggaggcaaccatttttaccagtttctggggtttcctactagaggtattcagtgcacagaaacatatctattatgtgtgtgttccatacatacatatttatgtaaaattttttctactgttctgtatcttggtttttaaacgtaatatatctttgagctaatttcatttaagcaagcatagagctcccccatatcccgtgacagccccaccgaggacctcctggggctccctagtcaaacaggttaatgagtctaatggctcaaggcttctgagaacctccctggtgcatgaggaccttgagggtgaggataagggctgccttgcttttagcttccttaaatacattgtttttggtaccagaacgagtggctggggtgacagttctgagagggattgggcgccccctagtgtttccactccacccctgaaaaatgtactttattatgtgtatttctattcccgttaagctatagttttcataataatgtaagggtgatatcttctgatggccgtgcacagtggggaaatatgtctcagagaagagcccccacatgatgggggttccctatgggggcaagagaaaccaagatgagtcgtcctgttcttcaagtttggcccttgttctttcctttgccaccctgatttccaccctcacctaccagtgcacctgatttctgactctcgccaccaagaaatctgtgccatggaggatatgaaattgtgtctttacaaacttatttaggatccaaagctcagccttcaaagtttgatattatcagcattaataatattttaagatctaaagtaacttaatagttcacaatagcttaaaagaaaaactcatccacctgcattaaatctgctcccaggaagtatagagaacctgcttccttggatttaaaactaaggttaaacaggacttcattgttcccttaaaatttaagccttttctaacaaatttggaaaatatttaactcttgaaaatgttaaactctttggttgcagaatgattactccattataaaggatagatcttttttagagtagaaaataggaaatgataggaacaaagttggcatgtcaacataatgaacaaatttaacatctgcatattcctaaagtacttttctaaattacttgtttcttgagattagtcaacattaagaaaaaaattgttttacaacaataattttgccccattgttttttaaattagattgtgtatagttacctaaattgtggtttcattttactcaccagaccatattaagctgtggaaccattagaaattggtgacagacaacactgataagtgggcattggcagcactaatagttatttgttgctgactatgcaacaaaaaagctaaaagctataaaacataatgcctgaatttttcatttgttctatagtagctatctaaaaaaatccaagtttgcttatgtaatattatttggtgtggtcatttgcccaaaatgaaataagctgtaagtttgtataatataaaataatctacctaaatcgtacaagtaagagtgctgttgtttcttaagctgatgtattacttaagcaaatgttttttctcattgtattgctggagttattccttctggaaggggttcctaattgacttttttaaaactctgaaagttttgttgattggttaacacacaaaaaaatgtagagacgagtgtcagctgaaatgtttatccaggactctgttagtattgctgggggatagttttcacctggaggtgaaaacgcattcagttaataatggaaggtccaactcttcatgtacagtgcctagtaatctgtcctcacattacactgaagaagtatttctgcctccagagaaagttgaaggacaatgaacacttgagcaatatgctttcaaaaagcaaaaatattttcttggaaaagctagcctatctgtaaatagtttgtgttcactaagaagaccatttctttggtagcacaagggagcaggccatttgctgaaacactggactgtggaatcacttttacccggacattgggttttctgatatccttttaaaaacattttaacaaataatatactcctttgtgtttacatgcaaaactcaaagaaggttacctatcctccctgactttaacctacctctctgggtattcagaaaccagacagagattttattttttggaatattatccatgataagagataaccactgtgacactttactaatcccagagatctgaggttatttctactagctggttttattttatttttatttatttatttttgtattgagacagagtctcagtctgttgcccaggctggagtgcagtggcacaatcttggctcactacaacctccaccacccaggttcaagtgattctcctgcctcagcctcctgagtagctgggattacaggcttgcacctctacgcctgactaatttttgtattattagtagagacagggtttcaccatgttggccaggctggtctcaaactcatgacctcaggttatccgcccgcctcggccccccaaagtgctgggattacagacatgagccaccatgcccagcctctactagctgattttaaatcagagtaagataagtgatgcttatttatatgtaccttttctccaattccttctcactaacactgagaggaacagagaattgtcagaatagtaactattgtgataatggtatgcagcactcattcagcacttactgttacctggcactgtgtcagggactagacattattttatttatccttctagtatttcccccattttcagaagggaaccagaggcttaagattacacagctagtaggcaatagagctggaattgagcccctatctgactctagctagtgcccttaattactattgtaaatggctaggaatcgtatttgtgaggatttggtaggtttggaaaaggactttcttaatcctgatattcagaattgtcctaaaacttacataaaagcctaacctagcttttactgtattgttaggcttcagggatactatgtgacctgaaatatatacacatttttaacaagtggtccatgttttaacaggtttggccagcccttcttacaagcttcctttgtgccaaattttcattgttttttgaaatcaccaaaccatgttactaatgttgtgttttggtttgttttacagtgatccttttctgtatggctgccctaatatttccaataggattttacatcaatgaagtcggaggtcaaccttataaattacccaacaacacagtagttgggtcatcatatgtactttttgtcttatcaattttctttacaatagtaggacttctatttgctggcaaagtttgtttaccaggctgatgaatgtctaaattgcttgactcttattattttttattttattttatttttttatttttggagggtggagaggacaaaggcgaggcatctgagcaggcctctcatgggaagatgctcagatgaaactgatgctgagaaggaaaaaaaaatgctttggtttgttctcactatgcactttggatttaaaaaaaaaaaaaaaaaggagagccttttccataaccaaatacagacaatattgactaaatctcctgagcatattcaggcagtcaggtctgcactgtgatagcaacctagagaaggagaatgctttataccgaaaagcatgtggccctttgtgactctgttattccgtttttaatgtctaatgattcattagaggaaaaaaaaaagtctaagtatttatgtgtcatggtggaccagagggatgcaagagaagttcatgtggggctggcctcacctcctaagaaattagtgttcacaacttccttgtaatagtatgagcctttggcaccagaatggattgccgttgcattactgcaccaagaagccaatagatcaaaacttgtttgctaaaatgtatgtaaaaattctgaaattccctctctctgtgtacaaaaaaaaaaaaaaatcaaacactaagacacatgttttgggtgggtgggtgggggaaatcttccttatatttatataaatatatataatatatatattttgctgatgcagtatacagtgtgtatatatgtgtgtgtgtgtgtgtgtgtatgtgtgtgtaaatttatatacacacacatgcaaacagttcctggaagagaattctgaatgctttgctagcaaaacactgtggtgtgcaaacctagaacccaatagaaaaaaaagccatttatctgaaggctgcatagtggagagagtcttcagtttacctcattctttgtagcagcccttgattttaacaggtttttgtaataggtacagataatcccatacctttctaggtgcgattttaagttaagctaaaaattatttgtagggttaatttatttgtatatgatagtagaaggtaagatcatgtcaaaccttataatttggggaatctgacactatttaaattattggcaactgttgtctgttgtacagagattctttttctactggctcagtctgttacattaataatgcattttatatgttcaggcacactttacataaatacaaagttcgctagtaaatatctggctattttggctatttacaacactaatttcattatttttatctgtaagcattattaatacatctttaccaaaacctgagcaatacaatattttctttatatgttatatgcctttgtttgctaaaagctaatatttttgcatttactttaaagggctgtactaaacccacagctttaagttcttccctaaaagaagcattgcagctaacccttgaactcacagttttaaaatacagtatttctcttctccacatctccatgccttcgcatcaatgcttgtttttcctggtgaacactatagataatctcctgtttgaaatgtgggacagggtgtttcatggcagtggagctaagtttctcctctttatagtgaactggtgacccaaatgtccctgtcatttatagtgaactgatgacccaaatgactccctgtcagtagagtcccatgtggcccatgcttcacacaagcagaaatgaacgcactgtttttaaggctagattatcagttctagaatgattacttcaaagatgggagctacctcctcagatattcacactatgaaatggaggtgcttgatgtgtttcacactggcttgtttgacagtcttctatcttactgttaattcagcagtattttattgtgaaagaaaaccccagtgtttgagctcactcaggaattggggagagagatggaccaccactgtggtgcatttcttaagtgttctgggagaatgtcatacttttccttcccagagtaaaagaaacctttgggagatcctgagggagactgtttctccccaagtatgatgatgtctagtcaagtctaagaataccactggacatgttctatggacatttgggattgcagttgctattctgatttgattggtcctcagtcaaatggatcactttgaaggaaagctttggttgtcaccgttatataccactgagataaagtgttagcaaagtatggttcaaattaacttatgacatgaccaagagcttttctcttccaaaagatgaattgtattgtaaatagtttctcaaaatatttttaactggatcatgagcatggggagagaaagtttctcagctgctaagaatttccccactgtttacttctttcacttatggtggtattgcatttaagattacaaaatttaaggttttatttgtatctattacccaaaccattaaattgtctttaatttcattgttgtcttggaggtccagtgcatacagggctgatgggggaaaactccctctagccagtcagcactctaacccaggattaaaccatcccatcaagtagtatgtgaagtcaagtcttcgtactcttgcagaccagacattgaaatggattcattcatatagatttctataaatcctataagtgaaaagatagacaactgtccgcagttgcttttaaaaaaggtcactataataagtactatatagtacagtattaatttatagcaggaaatcgtatcttgtaaactgtatataaaacactgttttatggtgcaatcatttgtcaaacttttgtctgtttcattgtttttagagtgtgtgcattcttctcatacctaagaatatcactgtaaaatctgctgaaaactatttttaggttttatttgcacaagactgaattagtttgacatttttggaagctcctattgaacatacccaaacatctgtaaacatgaaaaatcttcaatttattaaaagcaaacatttcagtatgattctttccaaaggtaatccatgttctatgttgttaatgtgtgtatgtaatttttctgactcttccacctcttataaacctattttctgtttcatttgttttgtttttgaaggatggctcttttttctttttaatgttctagatgaccaaaacactattggtttttacccttttgcctaaagctttgatatccccacttgatgttctgtgaattcactgtttaatctattaagtgaaataataaatagtcctggtgacaaacaatctgttgatttagaggaaaggccctgaaaaatacagtattggaaactaactttgcatatgctgttagctattattttgcatcatgggcttcatgggaagaacatgttgcatttattttgtctttattaaaagactactagccacaagttactctgattatagtaactgttttatcaacccacttcatctttaaaaaattaaatttacattcacaattcaaaacagtaagctgtctttcagaaaatttttgaaggataaaaacatgaaggaaaaaagtggcccgtgtaggtaggattccctacacaggacttttagttgtatcacctcaagagattttgaagtttgtgatcaaggtctgtatattatcccaaactttattaagaattgttttctaattggttataacatttttcaattaatagtttcaaaacaaattgttaatacaactgtataaaatgaacataattttcctcacttgtatttttgttattgagcaagtttatcaaaataaattgtctactaaagaaactaa

SEQ ID NO: 1545 - DNA, 37731 bp, Homo sapiens
taagaggaaacgctggggccggcccgctcccccccacgtgtccgccggagtttctccaccagcaacatggccgccgcctgagaggagagccgggccgccgccgtctctgcagcccgcgggtaactgggccgttgccgccgtccgcgctcggcccccgcggagaggtgagtcccgtcttggcagtgcccgagctggggcttgagccggaccgcactcacgacgtgggcctgggctagattcccgagtaggccaaggaggcccgcgccgcgctgtgcctagcagctggaggcctctcgggactcgggcggggaggaggggcagccggctccaggccgaccccggactctgacttccttgacctgacacctgggagttggggaggccgcggccgacgctggcggcggtgactcagggtccagccgacctgccctatccgggcctgggaggcctcctacggaagaaacacctgtccgcgcgtcgggtgtagtggcggctcgcggcagggactgcgtggtgggcgtgagaaggggggcctgaccacccgcgagggagcagaaacccattggacagcgaggctcgggatcggcggcccgccccgatgggcagggagggcacctgcgcctgccggagcccccacttcgcagctgaaccggattagcctctgcccggcgaggccagggattcctcattcatttattcaggcaaccattcagtgtttaccgagccaactctgtgttccggatacagccctgaccattcggtccgaggaggtgtcagtaaacaaacaaggtcgttcctttgggttagctttagaattccttgggcttggaggcggaaagaagagatcttagcgatctccacagtttcctcatctgtgaaatagagataatagaaattcctacctcatagggttgtggtgacggctcagtagaaaccgggtgacgctcctgcttgcagcgtttgacttgtggcttagcgtcattacccgcttacgttggcagaaaacatgttgtcaagtaataacaaaccttcccagaggttacgtttattagcgtcctgtccttactccttccccgcaggggtctggaggtcggtacttagtttccctactttagggatgaaaatagggaggaataccaaacccagacaactcaggtgggtcacagatgccaagcagctgtggtgggatttgaacctgcacagttttgttctcgggtccaagctcttacccacttaaccatactgccgtttatcagaaaaccgtgcagtatagtggttaagaataagaataaggatctttgacatagcgagacccaagtttctgtcctcattccaccttggatgagttgcttatatctgaacctcagtctcgtcatttccaaattgaagatgataaatctctattgatagggctaatgagaagattaaatataaagtattctttgtactatattgagtgtcaacttcgtgccaggcactgttctaggtattgagagaaccagcactggattttttttttaaagtaatgctccccataacagctttgatgaagtaaagtatgattgtctgcatttcatagttgaggaaactgaagcactgagaagccttcatggagcttacgttctattgcagaagacaaacaacacctgagcaaatagaccaggtagttccagattaagatgagacccaccaaggaaagaaaacagagatgtggtagggcctgggaggaggctgggggaggcttttaaaatagggtggtcagggaacctatcctctcctgcaggcggtgatgatatttaataaaaaggagcaaccttggaaatccctgtgggagaatagatgatgtgcaaaggacctggggtggactggggcttgccttgttggaggcccagcaagtggctaccagcctggatggtgaggggaagacagagacaagattatgtagggccttaggtggctcatggaaaggagtttgggttttattttatgtgacagtggcagttgacaggtcttaggcagggaaataatatgatttactttttttttttttttttttttgagatggagtcttgttccgttgcccagactagagtgcagtggcaagatctcggctcactgcaacctctgccttctgggttcaagtgattcttctgcctcagcctcccgagtagctgggattacaggcgtgcatcaccacgcctggctaatttttgtattttaagtagagacggggtttcaccttattggccaggcttttctggaactcctgacctcaggtgatccgcctgcctcggcctcccaaagtgctgggattacaggtgtgagccaccgtgcctggctttgttttccccccagtagagatcgagtctcacactgtgacccaggatggagcgcagtggtgtgatcatagctcactgcagcctcaaactcctgggttcaaccaatcctgctgcctcagcttcccaagtagttgggactgcaggccatgccaggctaaaatttttttttaaagagagaccggggggcggggggcgcctcactatgttgctcaggctggtctcgaactcctggtctcaagcagtccttccacctaagcctcccaaagtgttgggattaccggcatgagccaccatgccagcctgatttacttctttccaaagactcactgttgctgggagacttggaggtaggtataaggagccgtagggagacttggatgagtgcttttcacattgcaggttaaaatttattagtgggaagtaaaatcaatttaagggaattgaagctagcattttttgttttgaatgaagtagaaaacatcacggcctgacatatagtagggacagttatagttacgtgaaaccttgtttcagttatgcaactgtatgtatgttctgggttatttatatgagatggatttcttactgtggtggatcttaggctgaaaactttgaaagccactgagttggatcacctcggcctggaggatgaagggaggtgacactctttgtatcaacccagatgtactatccagaggaaggagctccagctctctagctgacagggcacctcagcctccctgatccctggcagggcagaggccaacagggcatagcaatagccaagaaagaacaattgcgtcttgggaacctcccaggccccagcctctcagttgtccactgcccagctgcagagaaggcaggagcttgacatatctgtggcacttggcagccggtgcagatggggtgaggccttgggctctccgctctacactgccctctgtctgcacagcagacagtcgagatgcactgaaactgtccagatgcgactcctgattttcattccatcctccatctctgggactgttacgatagctgtttccctgaagtttctctttctacccgctccatgtcttcctctgcccgaaatccttctgtagcttcctattaaatagcattcccatggttcatttatttagacaacaaacatgtattgagtgcctgctgtgtactaggcacttggggtaccacaagggacaaaatagaccaaaatctctgccttcacatagcttacagcttagtggcaatagagatgggcacagatgcagagctgtaaactgtcacatggtgatagacacctgctatggagaaaaccagagcagagaagggaattgaggggtgggggaggcagtttgcaatgtgatttggagagggaaggtcttagccacaaggtgacatttgagcaaaaaccggaaagaggtgaaggggggaccatgaggttatcgggggggtagagcagctacaaagccccagaagtgggtttggagcagagaggagggtaggaggcttgtgggagatgaggtctggcaggtcaaggggcaggagattgtttagggtttacatgggatgataaagactttggcttttgtctaggtgtggtggctcatgcctgtaatcccagcactttgggaggccaacacaggtgaatcacttgaggccaggagttcgagaccagcctggccaatatggcaaagccccgtctctactgaaaatacaaaaattagctgagcggatggtgcatgccaattattgcagctacttgggaggctgaggcaggagaatcacttgaacctaagaagcagaggttgcagtgagtcaaaatcacggcagagcacttcaacctgggtgacagagcaagacatgtcttaaaaataaataaatattagatagttcaaatgttaagtagatcagacaaaaatcatgctggtctcagccgggcgcagtggctcacgcctgtaatcccagcactttgggaaaccaaggcgggcagatcacctgaggtcaggaattcaagactaacctggccaacatggcaagtccctgtctctactaaaaatagaaaaattagccgggcctggtggtgcatgcctgtaatcccagctacttgggaggctaaggcaagaatcgcttgaacccgggaggcagaggttgcagtgagccgatcgtaccaccgcactccagcctgggtgacagagcaagactccgtctcaagaaaaaaaaaaaaaaaaattcatgctagtctcacccaagagcagaggtttgggaactgctgaggcctgggggtgcctgagtaccatcctacctatgaccacccctcttctctttgggtatgtgaaggggcagaccagctgaaatactcaacctgccccgtggagacctacagccttccctcttcctggaatttctcctcccctctgttgtcatgacttgcccaaagctctctcttcttccaggcgcacctaacgtgcctcctccccagcagaaaggcctttcccgcctctcaactcccctacctgtacctgtcacctgaggtcagacagcctggatttgaagtccagttcatcatcctgcttgctatgtgactttgggtcaaaatgcacacagtatctctgagttccagtctgttcattataaaacagtgacaatcaccacacctcatagggtcattgtgttgaatacaggacagaagagtgtgtgaagaggtcatttttagaccaaaaacacagaagagtcatctcactcaggattcgagttaaagtcagcttgaaaatcaaatatcagagagctttggactgtctgtcttcctgttcaacttctggctcctctttaaagcgtccccagggccctcagttctccagtgttttaatcatggctgggaccagccaacctctatccttctgtctggcagtgaattctctgtgagcagagaagaaaccattaaagccagtcatttgcctttccccgcaggtgcagcccacacttgttggcttggtctacccgcttgcacccgctgcttgagtgtttctttttttctttatttcttctggctgatggggtatagggttggtcatccattgttgacttcaatgtagatgtagaaagaaggtcagttggttggttgtgggctccccctcccagtgcagggcctgttgcagaataggcacaaggaaatgttggttgaacgactgatggtcccagtctctcgccctcctttgcagatcgagctgaaggactgcgcggctggctctcctctagtatggccaatgaagaggatgacccagttgtacaggaggtaactgctgctctctgtcccctgccgccggggctacaggcagtggaattgggtcctttccatgtgtcctcaggccagtctgggacctgttgatgttctgggacccctaacccttgctgttccctctgcctggtcccctctgctgtcccccagacccctgcgtggctgacctctcccttccttcaggtctctgatctggcatcacctcatcagggaggccttccctgactgcccttccacacccagctcccctcctgcaccctcccgtgcctctctctgcccttaccttggcggtaactcatacttggcctagcccccgtcatcccctagatatcagttgattgctttctttcccgtccactgctgtgccgcaaagccgagtatagtgcctggcacccaggtacccggcgactatttggtgaatgaatgaatgaataaatgggctcagcagtccctccttcccaggcttacgcagatgtagtcattcagcagctgttcactggaccactgtgtgctgggggctgtgacacatcagtgagcagggcagggtccccttccctgggaagctaatgggctgtgggcaagactgatgaggcaggagtctccgggtacaggcagtgggaggcagatttcccttttttttttttttttttggagacagagtcttgctctgttgcccaggctggagttcagtggtgccatctcggctcactgcaaccttcacctcccaggttcaagcgattctcctgcctcagcctcctgagtagctgggatcacaggtgcccatcaccacgcccgactaattttttttttttttttttttttgaggcggagtctcactctgtctcccaggctggagtgcagtagtgttatcttggctcaccgcagtctctgcctctgggttcaaacgattcttgtgcctcagcctcctgagtagctgggattacgggcgcccgccactacacctggctaatttttgtatttttagtagagatgggatttcaccatgatagccaggctggtctcgatctcctgacctcaagtgatcacccaccttgggcctcccaaagtgcagagattacaggcatgagccaccatggccggcacaggtttcccttcttagagaaagctgttgatagtcaaactcacctttcagaatccttttaacccaggacttagacctttggaaggcaaaaggcaaaaagtaactgcatctgccttcagcctccttatatgcggagcctgacctccagtgggaagggcaggggcaaggagaaggtcctcggagatgaatagaggtggtttttccttgcttgggggatgttgctaagttattagatgtgagttatttagatgcatttaagctgcatctacactgcagtagcaggagttacaacaggggggttggtgatgggatagaagagtccaagggactccgaggacagaggcagtgccctctgcagccagggggcctggaatgcttcctgcccaagttgtgcctcagccaagtccttggaggagcgagcagtcaaggctcaggggaggcatgtgtgaagggctctgtaggtatagggaaaagcatgtgcaaaggcccaggggtaggagagcatgtggtttataggaggagttaggaagcaggaaggtaaactgctgcgtggcggggtgggggtggttagtgttgggaagaaaggaagtggagccatcagtcacaaagggccttgcagaccccttaagaaggggtgacaggctggtccaggaggggcaggtggagggcccagccaggaggcacaggcctaggtgagccctcgcctgcctgcctctcagaagagcatttgcccaggctgtaggacgtttcccgatcagtgcagccccagggaagatgtgtgcttactgggggattgtgaacttgggtgggggtaccaggtgaactcttgccctggttcccctgggagctttcaggagggattcctgaatatacccagtgtgcagccttggatccgcttgcttttagcatgagctgagctatttcctccttccccaaactgcttccctgagccactgcccttaactgaagctggaagcgctggcatagcccggggaggtcagcactgtgtccagtctcccggttaagtcgtcttcccttcttcccagatcgatgtgtacttggccaagagtctggcggaaaagctgtatctatttcaggtaattatgggacttgaaggtaaagaggggagaagcaggtgtgggtgggtggtgtggactcaggaacacgggcaggaaacgatgggaaacctcagctagggttctcggtgtggagagtgtcatggggtctctttgctttcgtgggtgggttaatattggtctcatttcaaagatgggaaaactgaaggaacacaggagaggcagaagtgtgcagcagttaaagctggggctctggggtcagaccggattgagatccaactccatcacaccatagctgcgagaccgtgggcaagtttcttaatccttctgtgcctcactttcctcacttgcaaagtggtgatggtgataatgcctgcctcataggtccccaggaggacaggctgagtccacagtgaagtgtttaggatgccgcctggcagagagttggtgccagtgatgatggccgctgttgtcatggaggctccaaggggcagctccatggcagcgtctgtgagccctcagtcctgccagctgcgagggccccgggttgctacctctgccccctccccttgctgctgggccagcagcttgtcattgtggccaacatgtattgagcattgaccgtatgcagactgttgaaagcatttacctcagttacctctttaaccccacaataaccctatggtggtgattattacattttataaccgatatattgagatagaatttacacaccacacagtttccccatttcagtgtgtaatgcaatggattttagtctactcatggggctgtgcaaccagcgccacagtctgttttgggacagttttgtccccctttaaaggaaccccttgcctattagcgatcagtctgtgccccccattcccacctccaaccccaggcaaccattccccttattttctgtttatggttttgcctattccggacttttcacatagctggaatcatgcagtatgtggcctgctgtgattggctgctctcactttgcatgatgttttcagggctcatccacatggtagctatagcctgcatcaatatttgagcttttcttttttttgtttgtttgttttgagacacagtcttgctctgttgcccaggctggagtgcagtggcttgattgcggctcaccacaacctctgcctcccaggctcaagtgattctgcctcagcatcctgagtagttgggactacaggcacgcgccacaagcccggctaatttttgtatttttagtagagatggggtttcactatgttggccagcctggtctcgaactcctgaccttgtgatctgcctgcctcggcctcccatagtgctgggattacaggtgtgagccaccgctcccagccaatatttgatcttttactgatgaataatgttccattgtatgggagaccacagtttgtttatccattcatcagctgatgggtatttgggttatttctactttttggctattataaataatgccactgtggacattcacatagaagtttttatgatgaacgtgaattctcatttcttctaggtatatgcctggtagcagaattgctgggtctgcgtttagctttttgaggcactgctgggctgctctgccccatgttgccttcccacagttagagtcagtgttcatatcccatgatgcacatgagaacgtgaggcacagggaggccttcacgggcacggaggcctggggcatgccacagcagcaatgttgtaagcctgtgctgggagggcctggcctccactccctggggttcacccttatgggccgtgggaatggggcctgtcctgtgtgcctgctcaccctgtttccttgactggctgcaaagtgatggtggaggtgccagtgacccccgtgtgtccagagttccaaaccctgagccaccatcggctctgtttgcctcctccgtgctcacagcggccttgggaggtgaggatgcttagcctcagggaggcgaggtgcctgcctgagtccacagttagcaaggggaaggatgaggactggaagccaggcctgtgatttcagaacctgcgcccttcagccttcccacccccagtcaggtgatctcagaactgcccccagccccagcccaggaagcagggaggagtcacggctttgctgtgtgagtgagcttttaggaaatgaccgtctccttgcgctagaatgtagctgatctgaaagggcctattttccgcactgccatacctccaccaggctcattctacaggctgtcatgagaccaggcagagcttttgaggaggggtccagactttgactccttcacctgagagagagagggacagtgtactgtgaggacagatgtggacaggagcccctgcgtgttgagcgcattgctgtgtgagccattcacataaagataagagcgggccatggctgcctggctcccttttccagcatcttgtgaggaagctcacacaaccagataaggagagcgaatggattcacgaattcccacctgcccgtcgtctggcctcagcagtgagcagcacgtgccggtgttgctttcactctttgcttcctcatggactccttttggtcgtccttctctccccggatggcctgtccactggtagttaggccctggacccccatcctcacctcccatggccgtgctctgtgggttcctggagcagcagcgtgccggtttgggttcctgtgtgtagacacgtccctcggaagtcagagacatcctgcagtggccctttggaaggaggccgtggggagctgatgagaatagggctgcgggtggagactggcaggggtgcctcatggtagggctgggcagcttgtacccttgtggtagggtaaggccagtctctgcttggggtgggcttggagatagctgttgattcttggccagggcccagctctgggcatggctgggcagagtggacttaatggctcccttcccctccccagtaccctgtgcgtccagcctcgatgacctacgatgacattccgcacctctcagccaagatcaagcccaagcagcagaaggtggggctgccccctgagggcagttggggccgaaagagagggtgatgagggtgggagctggtggaggcgagaagctcagagaaggagtcattggagaagtaggagaaccagcaactcccaggcccttgaaagctgaagaaggaaagtgtccagaaagacagggatgggcagctccagagaggccagggacgcatgaggctgatgaatgagagaatggggccagatgtgagcttaggttcccaggataagacgagggcgggcgggtgaacatggagtaggtttgatgggaagagaatctagcgcctatccatggagggtctgcagctctagcccctccagccacatggaagtgccatcccagtattgccagttctgctggcttttcaagagaagtgggaaataaggatttttatgagaaatctcttgatttttaaatgttggcacctaatttaggtctttgggagtgaagtagaggacaaacaagattacaggactctccacttccttctgacatttttgttggaatttgggtttgtgacccttggtgtggactgaagtccaggggcccttggggacatgtgtcagtctcgcttccgggcagggtcctggttaggaggtggccatggtggggttggggtgtcccttgaggagccatgccttggggtcctcatagctggtgggggtgcttggtgcctccaggtagagcttgagatggccatcgacaccctgaaccccaactattgccgcagcaaaggggagcagattgcgctgaacgtggacggggcctgcgccgacgagaccagcacgtattcctcgtgagtttccggccccaagcctgtccggtttccctgcgttcacacaggagcctccaaaagaccttaaagacattgaccccctttgccccgtcactgggctccccaccagtgtcccagcctttggagggctgggcctgtctcagactctgccctcctgaactagctggtcccagagctcctacccactcctcgtctcttggtctacaaacaaggccatgggttttctcatccccaggctgccctcctgagacccgcgtaggctgccctgcggccttggtccctggctgtggcacttcagaaagtgtctagggggtggggtgcgctgtggccacaggccctggctcggagctgccttcccctgtgacgttgcttctccctgtgctccaggaagctgatggacaagcagaccttctgctcttcccagaccaccagtaacacatcccgttatgccgctgcactctacaggcaaggtacccggggctgggtgtcccgcggtggggacatggcattggggggggctgggcagggagagtacctccccagcctggtgtccatctcccacctgccctgaaagctagacacctgtgggggccgggcaggtgtggaaataacagaaatgacacattgtcaggggactggaagtggccacctttgtggactgctggctggacactgcctgaccagatggggtggggctccaagttcatttgtcctcccgggacacagatacatacaagtagctaacataagtttagggacagaattttgtctttaaatatgaagcttatgacagagcaattccattcctaggcagcatctatccaaaagaaatgaaaacatgtgtccacacaaaaccatacacagttgttcacagtagcatcttcatgatagccaaaaagtggaaacaacccagatgcccatccgctggattcatggagaaacagaatgtggtccattcacgcaatgggatgttatttgaccatggaaaagaatgaagcagtgatgctaccacgcagatgagccttgagaacattgtgctaagtgaaagaagccacatgcttcttcactcgcagctacgcgctgtgtgattacgtctcagtcagcgaccgaccacatactcaacggtggtcccataacattataatggagctgaagaattggcttacctagtgatgtcttaatgagcctgaccctgtgtaagcctaggctaactcgtatgtttgtgtcttaggtttttgcttgttcgtttgttttgttttgttttgagacagagtctcgctctgttgcctaggctggagtgcagtggcacagtctcggctcactgcaacctctgcctcctgggttcaagcgattctcctgcctcagcctcccgagtagctgggattacagacatgcaccaccacacctggctaatttttgtatctttagtagagatgggattctgccacgttggccaggctgatatcaaactcctgacctcaggtgacctgcccacctcggcctcccaaagtgctgggattacaggtgtgagccaccatgcccggcctgtgtcttagtttttagtagaaagtttaaaaagtttaaaaaaaaaaaaaaaaaggtaaaaagcatatagccgggtgtgttgcctcctacctgtaatcccagtgctttgggaggccgaggcaggcccaggagttccagaccagcctgggcaacatagtgaaatcccttccctacaaaaaatacaaacattagctgggcatggtggcacatcccttagtcccagctactgaggaagctgaggtgggaggattgcttgagcctgggaggcggaggttgcagtaagctgagattccgccattgcactccagcctgggcaatagagcaagactctgtcttgaaaaaaagcatatacaataaagatatatttttcataaatttatttattgatttattttttggagagggagtctcactctgttgcccaagttggagtgcagtggctcaatcttggctcactgaaacctctgccttccggtttcaagcagttctcctgtctcagactcccgagtagctgggactacaggtgcacacaccaccatgcccagctaatttttgtatttttagtagagacagggtttttgccatgttggccaggctggtctcgaactcctgacctcaggtgatccaccagccttggcctcccagagtgctgggattataggcatgagccactgtgcccagccttttttttttttttttttttttaataaatttagtgtagcctaagtgtgcagtctgtatgaagtctacagtagcgtgtagtaatgtcataggccttcacattcactcaccactcactcatccagagcagcttgtcctataagctggttttagtcttttatactatacttttactgtaccttttttatgtttagggttttttgggtgtgtttttttgttgttgtttgttttggggttttttttttggagaccgggtctcactctgtcacccaggctggagtacagtggtgatcatagctcactgcagcctctatctcctgagctcaagcaattgccttccctcagtctcctgagtagctaggactacaggccatgccaccacatctggctaattttttaaaaaattttttgttgaggtggggtcttgctatgttgcccaggctggtctcgaactcctgggctcaagcgatcctcttgtctctgcctcccagagttctgggattacagatatgagccactgcacccagcctaggtatatttagatacacaaataccattctgttacaactgcctacagtattcaggggagtaacatgctgtacagtgtgtagcctgggagcaataggccataccatagagccgaggcgtgtagtaggctctgctatctgggtttctgtgagtgcactctgcgatgtttgcacaacgatgaaatcacctaaggatgaatttctcagaacgtatccctattgttaagtgatgtgtggctgtatgtgaaatgtccagaataggcaaatgtacagaggcagaaagtagattagtggctaccagggactagtgggagagtggagtggggactgcctggttctttttgtggtgatgagaatgttctaaaattggttgtgctggctgcacagctttgtgaatacgttaaaatacattgaattatggccgggagtggtggctcatgcctgtaatcccagcacttttggaggccgaagtgggcagatcacctgaggtcaggagttcgagaccagcctggccaacatgataaaatctcatctcttccaaaaagtagaaaaaattagccaggcgtggtggtgagtgcctgtaatcccagttatgcaggaggctgaggcaggagaatcgcttgaactcaggaggcggaggttgcagtaagccgagatcgcaccactgaatatcctgggcaacagagtgagactccatctcaaaacaaaaatacattgattagtatgccttaaatgagtggactatatggtacgtgagtcttgtcccaaagctggtaaaaagtacaaggcgcggccgggcgcagtggctcatacctgtaatcccaggactttgggaggccaagacgggcagatcacaaggtcaggagatcaagactatcctggccaacatggtgaaacaccatctctactgaaatacaaaaaaatttagctgggcttggtggcacacacctgtagtcccagctacttgggaggctgaggcaggggaatcacttgaaccggggaggtggaggttgcactgagccgagatcatggcactgcactctgcactctggcctgggtgacagagcgacactccatctcaaaaaaaaaaaaaaaaaaaaaaaacagtaaagtgcttaagtatttagtctcaaaagcaatgaacgaaactaatctgaacacttaggaaacaaaatgggataggatcaaaagtagtgtcatataactcgcgcgttctgtttagaacccatgtctcaagcatgtaattcttgaaagccacatcccttgcagcgggagggaaagtcatgatctttatcagaggccatgtggacactccacccagttctagcagggcctcttctccagccacagtggcactagtggacttcctagtggaacgggtgggattttggcgggaaaagatggaggataagaaggagaggaaatccaggtgtgtggggcgggacagtaaggctgagctggccgaggcctggagggtaaacagcagggcgaatttgatgaggattagctgcctagtgttgcaaagcgagcagctggggagaggggcgtggaaccagactgggaggtgggactgaaggaagtggcttcgaacagaagagtccaggttcctgtcctagtctgggctgtgtgcttgctgtgtccagcaggccaggtggaggtggggatggtccctggcctggtggtcccaagactctaggattgggggctgcagcgggaatgggaggcggtttgatggtgggcctaggccttcacgggacttggtgactctcttgagccaaactgggtgggtttctagagttgagtccaagcccttcttcctccgccaggtgagctccacctgacacctttacatggcatcctgcagctgcggcccagcttctcctacctggataaggctgacgccaagcaccgggagagggaggcggccaacgagggtgagcccgggatccccagccctgctgcctgcctgccttcatcctggtgggatggcttggtcctgggaagagggatgggatgataggatgtttagcaggatccctggcctctacctactagatgccagaagcacccaccccacagtcgtgacaatcaaaaaggtcacattgcccagtatccccagggtaaaggggcaaaactgtccccgattgagaaccactggcttaggcagctccctctgcgaggagaactcccagcaccccggcctgaggcttccctggcgggtggggttgagagaagggaggtggaggctccccaggactgcagtcagtggcttgtctctcttgcagcaggggactcttcacaggatgaggcggaagacgatgttaagcagatcacggtgagccctggcccctggaggaggagggtgctgcctgggcggcagcaggaccagagaccaaggggtagcgggtcttcacagaatgcaggtggagcagacagggcccatgcttttgagccttcttgctgggctacctggagggaacaacctgagttgttccagctatacacaagatggaagccctggctggatccaggagatgtgtgcctggggcttggctagagtcacctgggagcaggaagctggggccaggagccctgaggacccgcagaccagctctgccatgaacctgtatcttaacagagccaaagtcaattaactgtgattctatcctctttatggggcacggatgaatagttttcgttttaatagttattcctgaattttaaagatttttcaaagaatcttaaccttccatttatggtttgtaaagttttccctatttaagcatatttagattaaaatgagtagtaccaaaagaaaaatgctacacgtagaatgatgatacacaagtatggctagagagtggtgagtgtttggaagcccttgaggaccggggaacacgggcgtaatggacatggaggtggcgcagggagctcatcctgttctctccgtagcttattaggaccttagaaactcccttccgctctggggaacttagaaaaggcatcctgggcctgtctgctttaaggactctgctggctctggcgcctgggactctaatccccctcaagcctctgggctgggcaggcacgagcaagtataagccgttccctggcgtgtgcaggcagctctgggagggacacggttggaacggaatttaaacgacctgtgctaggaaaggaagggagagtggaaaacccctatacggagttctctggtcttctggcaggggctgagacggcagtccagcaagggtcacaggcctgacggtatgacctcttccccttcccaccgcaggtgcggttctcccggccggagtcagagcaggcccgccagcgccgtgtgcagtcctatgagttcctgcagaagaagcacgcagaggagccctgggtccacctgcattactatggcctgagggtgagcggggcttcgtggggtcctgggggaaacacctcggtgcccggaagggtcatggtgtggcctccgtgtctcaccttgaacttaagtcaaattcatgagtcatagccacagatagaggatcgagtcctgtgggcagtttacacttcactccagccgagccacttagcgtgggccccaggagagcaagaggaaaagatgcgagtccttggttccctgggtggggtttggcccctgggcatgggcatcttgctgggcttgcagtggggctagtgcctggtaacatattttcgctgcagcccaggccctaaacgcaggccagatgcattctccggttctgtcctagagggtcggtcatgtgttgccaccccagagttcccagcaccacctgcccaggggattttcttactgtgcttggttttcatctggtacgctgactttatttacttttatttttatttatttattatttatttatttattgagacagtctcattctgtcacccaggctggagtgcagtggctcgatctcagctcactgcaacctccgcctcccgggttcaagtgattcttctgcctcaacctcccaggtagctgggactacaggcacctgctaatttttttgtttttgtttttttagtagagatggggttttgccatgttggccaggctggtctcgaactcctgatttccaagtgatctgcccacctcaggctccctaagtgctgggattacaggcgtgagccacgaccacctggccctggtgcattgattttagaacctaacccttgaaactgtgtactgagtgagggatgcttccaaagacaccatgggccagggctcccaatattttctggggtggggaacaactcctgatttctctggaaccttcttggaagagatttgtgttaacagacccttagactcggggtcaaacttctagacactgctgtttcctgctgtgtgaccttgggcatgttagctaacctctctgagcctcagttttcttaattataaaatgagagtagtaataatagtacctaccttgccaagttattttgagggtgagatgggttagtatatttacagtcagtggaacagagtccaccacatcctagatgcccagtgaatgttagccatcattttgtcattgctggtggtgtacctgtgttacagacaaggcatcgaggcttgggggctggggctgggcaggtcataaggccaggaagatgagtggctgaggccacgtcagaggccttgggtgccgtgctcaggaggttggatgtggtcctgtggctggccatggagtggaagacgggaggccttgggggagggggcccaggccagggccatcagctgaggctcctctcacaccctgccctcctccaacaggacagtcgctctgagcatgagcgtcagtacctgctgtgccccggctcaagcggggtggagaacacggagctcgtcaagtcacccaggtgggatgggctgggccagcatgcaaactggatgcctgcccagggtccccaggggtccttggtgtggatcctcccagaggactgtggcccctcctgtagcatgagggtggagcccattgtcccctggagaaggccaggagggtgggcctggaaagagatggtccacttttctgcaggggctcagggctgctgggggagggcgggggtgggctgtctgcaccctctccccagaccctcacttgggtggctggtgaggagggtccagcctggatcagccctgagcctctgcccctgccatgtccctgcagtgagtacctgatgatgctgatgccacccagccaggaggaggagaagtgagtagaggcggcaggacaccctctccctttccgggctggctgcctctaacccgtcccctctgcttttcccagagacaagcctgtggcccccagcaacgtcctgtcgatggcccagctgcgcacgctgcccctggccgatcagatcaagatcctgatgaagaatggtgggtgcctaccccctgcccacccgggggccccagtcccagtggctcctgaggaatggactctgtgggacagtgaggaccaggggacaaggccagaggcccctgctgcccacagcctgcccagctttgcagctgcatccttgtctggaaagataacgcaggacggcagtgcggccagctcccgcaggcagcccgggttcccgtgaatgtaggacagtagtgtgtctggcccccacaggcgggctcgggttcctgtgccatgctcaccacttgtctgccatgctcttgggcaggtcatgaacctttctgaggctttgtttgtttttctgtgaaaagagactaatgatagttcctgggggccaatgtgaggaatcagagagaggaggcttctaaagtacagggccttgcaggcgaacacggactaggggctttttgttgttgttgttgttgttgttgttgtttttttttttaaggtttttttaaaggttttaaaggttttttttaaaggttttgctgtgtaactcctgggcccaagtgatcctcctgcctcagccttccgagtggctgggcctacaagcagacgccattcactgcaccggctcaactagggtcattttcatgacaatgtcttcactggcattgcttctgggtactcttgccagacctggcaccataaggactggtctccttttctcagaggactctgagtgccagaacctttagggtacccgtggctggtgaacaacagacctgatccttgagttcagaatggagccgcagaacctgggctcgtcctttgagatgccaccatgagctcttaggagtctaaggagagaggggagctccatgatatgctcgggattttaggcttccttcctgcagaggacttcgaactttttttttttttgagacagtcttgctctgtcacccaggctggagtgcagtggcacaatctcggctcactgcaacctccgcctcccgggttcaagcaattctcatgcctcagcctctggagtagctgggactacaggtgcccgccatcacgcccagctaatttttgtatttttagtagagatggggtttcgccttgttggccaggctagtctcaaattcctggcctcaagtgatctgcctccctcggcctcccaaagtgctgtgattacaggtgtgagccaaagcgcccagccaaattttggactttccctgggccctgcccagggctcacttgggcgggagcagagcacagtgattgagggtaccaagtggagccaagtggcttgggttcacttcctggctctgctacttcctagccaagagatcatgggtgagctttgaagcctttccaggtctgagtagtaatagacccttcctcctgaggcacccctcaagtcttccttaaggggcacttcatataatcctcagatttcatgaggtgcccagtgcctggcatgtagtgagcagcctgagagtgtcagctgttggctatgatgggtgtcattactgttagttatcacattctggggttattacatgaacttgaagctatgcggactctcggtggaggggagggaagggcccggcccctcttccttgtctgatgtctcctgcgtcctcctcagtgaaggtcatgccttttgccaacttgatgagcctcctgggcccctccatcgattccgtggctgttctgcggggcatccagaaggtggcgatgttggtccaagggaactgggtggtgaagaggtaagttgctttttttattttttatttttatttatttttttccttgaggcagagcttcactcttgttgcccaggctggtgtgtagtggcgcaatctcggctcactgtaacttctccctcccaggtccaagcaactctcctgcctcagcctcctgagtagctgggattataggtgcccgccaccatgcccagctaatctttgtgtttttagtagacacgggtttcaccatgttggccaggctggtctcgaatcctgacctcaagtgatccacccacctcgacctcccaatgtgttaggattataggcgtgagccaccgggcccggcctacgctgtattctcttaatgggagcatttggtccttttaaatttaatgcagttactagtgctttgggtttaaatctacagtgctttctatttgtcctgcctacattgcatttaaactgttttttgtttttttgtttttttttttgagacagagtctcgctctgtcccacaggctggagtgcagtggtgcgatctcggctcactgcaagctctgcctgccgggttcacgccattctcctgcctcagcctcccgagtagctgggactacaaggcacccgccaccacgcccagctaattttttgtatttttagtagagatggggtttcactgtgttagccaagatggtctccatctcctgacctcgtgatctgcccgcctcggcttcccaaagtgctgggattacaggtgtgagccactgtgcctggccgcatttaaacattttttaaattgacacataatgtacatatttatgggggcagtgtgaaatctaaatacatgtatacaatgtaatgatcaaatcagggcaattaacatatctatcccctcaaacatttctcatttttgtgttgggcacattcaaacttcacttttctagctatttaaaattatacaataaattgttcttaattatagtcaccctgtagtaccctttgtcctgcctacattggatttttatatcattcttaccatctgctggattcatttctgtttctattttttcctgctaacttggaagttacactgtttgggctcatatattgattaccctacagttttcagcttacattcatgacttaacacattttaatgttaattgctgctttttaccccattccaatctattcagagatcttagaatattttatatctatcctcatacttacacactgctagattggtatatatatatttttttacctttttaatttgccaatcttctctagtgttccaattttagtatatgtactgccgaagagagcacaggattggtgtatttttattttttttttgagatagtctctctctcttgcccaggctggggtgcagtggcacagtctcagctcactgcaacctctgtctcccgggtttaagcgattctcctgcctcagcctcccaagtaactgggattataggcgcttgccaccacgcccggctaatttttgtatttttagaagaggcagggttttgctgtgttggccagctggtcttgaactcctgacctcaggtgatgcacccatctcggcctcccaaagtgctgggattacaggcgtgagctaccgtgcccggcctggtgtattttaattctctgtatgttttcagccccataagacattactgtatccagtcaatcaatattctttactcgcatgtttataatttagtcatcatttctttctgcatctctaagtttctatctgggatcatttcgttctgcctaaagaatgctatagtatttcctttaatgtgggtctgttggtgatgcatttccttggtttttgtgtgtctggaaatgtctatttcacctttgttctagaattctagattggtggttattttcctttccacgcgttgatatgattttgttgtgttccgacttcattgtttctgttggcagttttgttcttattcctttgaaggcagcctgcctttgttttcctctggctgcttttaggagtttctctgtttttggttttctacgggttcgtttagatgtgtctttaagtgtgaattttttacatactctgctggggatcacaggtcttgagcgtggggcttgatgcctttcagtggtttctcttcggcgaatcctcccctagaccatgtgctgcctccacgagaccatcagtttcaagggattagggatgtctgttttgactcctgctttatgttcccagtacccggaataatgcctggatattaccagtgcagacccttggtaaataatgtggctacgttttacttgaattatattgattctgaatgatgtagcattaattgcattaataactcactttttaagtaatgtagtttaaggtgagcaatgtgacaaaatgtgaaatgttgaacattttaagaaaatacaatgccttgaaagctcctcatagttgtagagtatattcgtgttactgccacctggtggcgcccttgcactgctccacaggtgcccagcgcagtttgtcagcaccttgcggctgttgtcctttgttacacgttttcatcatggaaggcttttgcaatggcgcatcgcgtattacataggaccacgtgtgtatatttacaccataagtgaatgaaagccaagaggggtcctcccgtcacacacctgaggacactggcccagagaggcatgggacttgccaaaagtcttgcagcaaggcagccgcagagccctgttaaaacctaagcctcatggctcagccctgggctctgcacccagcactgcatgtgtcccctggaggtgctgccccttttagtttcgccctgtcctggggactggaaggtagggacttggggactgtgggcatttcacctgccccggcacttctgtaagccctactctgctgctgcccatgctgccatgtcaggggcccctgggtgagggtcctgtgtgtgcctgtgaggagacaatgcaaaatccatgcctccattcagtcactatggctagactgctcgttctgtgccatggaccgggctctcattcagacactgcccctggggatggcggctgttacatttgagctccctgaatgcagagatcatggcatggaccaggtttgtttggtcagcacacacttaataggtaccttcgctgtggtggcagcgatgagccacatcggcagagtccgtgtccccacagagcgtggccttgcaggatgagtgacagttggttgccaggtggacctgagcagggggaggaggagggcttggcagcagagggagggacagtcagagcacaggtgccgcagcaggggctgagccggggttgcagggcctgtggctggagctgggtcagggctacactctggagattctcgtgccctgctgtccaaggccccggcctttcctctgaagttccctgaaccttgagtgctgagcctgttctctccgagggctaacatgcctcccctgcctctgacctcggttcatgcccacctgcccctttcagcaggtggccaagggcttgcagatggcttcatccctggttctcttggtgtcacgtgcagggaccagttgtcttccagagtcctgggctccttgaggtcccgggctgttcctcaccttgtctgtctctgagcccgtgacctctccctgaatgtgcaggggtcttaggatgaggctggtgtgcatggcgggttgaggggtaataagaggaagaactggggggatgtgtggggtagaggggtgcttctttcccatgtctgtgttcacagatgtggctcctaaggggaggtcttggggctcaggcctgtacccagcccacggtggaaagaagcatggactggggcttggccgggaggggtagcggtagagggggctcagggcagggactgacctgccatcctcacctgcattggcagtgacatcctataccccaaggactcgtccagccctcacagcggcgtgcctgctgaggtgctctgcaggggccgagacttcgttgtaagtaccttgggttctctggactcacggtgggggcgtgggaagaggggggcagcggtgcagggcttctgaagaccggggcccggcagaggctccaggtggaggcgggtgtgtgaggaggccctggcctctgcctttctcctccttcctctcagaagcctggagtctcgggctggaaagaaccttccagttcctctagcgcagtcggggggtgggtcaagaagcacgtttcattcggcctgagtggtggtttagaaatattgccttggttgtcagattttataaattgaaattttgatgtaaaaaaaatcttgatgctagacagatgtctagctgtcaagggtaattggactccctgacacccctggggccacttccccacaaggcgctggcggtctccagttcaccacagtcccaggtgcctttgcctcccttgtgcctgtccctggagtttgggactcctgagctggtgtctcccttcttcccatcaccccacccatggcctccctcccaaggcctggaactccatgcagctgggagccacagtcttcctaggcttggtgctggctgaaacgtgctgcccaggagctgtcccacaccccttggcacgctggtgtgccgtcccagtcacaaggcagcccttaagctgaaggaagcatctgcctcttctcttcctgaaggagcctccccaactcctctgggcagtcggtgtccaggtgcccgagcagcatctttgctcctaggggtcagcatgtaacaatcaccactcccaggcttgcctccccagatacagtgccgtttgcccccagctgcccctgcccgccccgctccagtgtgtagacactgtcagaactggcggcttggtgggggtgtggtccagtctatgttagcgtaggtgatagtcatccattccctgtgtctctcagccagccacccttctctctcccagtcaccccacaaatctaatcagagtgcaggggagctgttgaggcagagtgggggctgcagggggctgagagcttctggaaggatgggcggcctccaaccagccattagcagccaccactgtgaagtgccgcctatgcagacagcgtgtgtctgtgggagcccctcccagcccgagtcctcatcgtatcctcggagctgggcagggcatccccagggagcgctgtggtctaggtggggtgggatggtcccatggtccccttggaagagatgggcctggagctcctttatggaggagaaaaggagggaggtgcagagctgaagggactgcctgaggccacactgttgggaagaatcaaggccaggagcctaggactgtcccaggctccagctcccaggcctgccaggtgagttcccgggacagtcctgggagcagtccgtggccgcccctggaatgtgctgcttcttctccctcagatgtggaagttcacgcagagccgctgggtggttaggaaagaggtggcaaccgtgaccaaagtaagtggcgtttttgtggtctgaggcccaggctgctgctggaggggagggggctggctgtgcctcacgctgggccccctcccctccagctctgcgccgaggatgtgaaggacttcctggagcacatggccgtggtgaggatcaacaaaggctgggagttcattctgccttatgatggggagttcatcaagaagcacccggatgtggtccagcggcagcacatgctgtggacgggtatccaggccaagtaagcaccctgggccagggaggggcagcccggtgatcccagcaaccctgcatcctggggagcactgtcagggtggatccgagcaatctctagaaaccccacatctggggagagcgcagttgggctggatctgggtgtgaagggcaggtgggggtccgcaggccccacgctcctcacccacactgataggcattgctggctgatcccaccatcctttcagcacaggacacacagccagtacctgctcatcagggtggccgtgctctgagggctcagggaagagggatgtgatggagagagggagcactcaggagcaagagctggggcctggggaccagaggggtgttggcagaagactgatggggtctgggtggtcctggggctgtgcactctgccagaagagggactcagtagggctggctgagctccaagcctgcgctgtcagtaaccagcgtgtcctggggcctaaggggtggttgtttctcttgtgaagcagatggtaggggacgtggtttaaagttaatggggttactcttcttttcagactggaaaaagtctataatcttgtaaaggaaaccatgccaaagaagccggatgcacaatcaggtgtgtgaggggctttgggctgggaggccccggctcctacactgtggctccggaagggctgctgtgctagagcttgtcaggcccggacctggagagggtggagggctctcaccgttcacccttcaccctccttcctttcctgccacccacagaccgcagctggtcgcttgcccagcagcagagcctcagggacggaggcttgcggattccagggctgagtctgggttccaggtctctgaggctcactcaccctcttgggtcaacaagcgggcccggaagagctgctggggggaggaactcagcagcacccttccccgcatgactctcggcacgctgggacggttctctcttccactgatggggtggctgattttcgagaaaggttggggatgagaccaggacgggaccacttgctgcagccccgcggtcccctgctgggcttttggcttcagatccctgtgccctcctgagcagtgctgcctccctccccgcagggcctgccgggctggtctgtggggaccagcggatccaagtagccaaaaccaaggcccagcagaaccacgcgttgctggagcgggagctgcagcggcggaaggagcagctgcgggtgcctgcggtcccgcccggtgtgcggatcaaggaggagcccgtgagcgaggagggcgaggaggacgaggagcaggaggcggaggaggagcccatggacacttcccccagcggcctccacagcaagctggccaacgggctgcctctcgggcgggctgcgggcacagacagcttcaacgggcacccgccccagggctgcgccagcacccctgtggctcgggaactgaaggccttcgtggaggccacctttcagagacagtttgtgctcacgctgagcgaactcaagcgcctcttcaatctgcacttggccagcctgccccccggccacacactcttcagcggcatctcggaccgcatgctacaggacacggtgctggccgccggttgcaagcagatactggtgcctgtaagtagagccctgcctgccaggggcatggggggtggggggtggggagaaccagctgttgggaggccacgtggggacacgggaggccatgcttggtgagcatctgctctcacgtgggcctaggtgtgacatgggcaagtcagcctctctgaggctctattctcatgaaatgggatcatgttgggttttatgtcacaggactgtggtaggggctaaatacggtgtctgaaggcccggcctattgcctggcctgcagcagggcctagtgaaacagggcccctgcctggtttctcaccctgtcccccaccaagaacacctgtttcctactagctttgccattgtttggaatgatttaacttctaagatcgtttgatcttctttgcaatctgcagatgaagaaactgaggctccaaggaatgaaatgtacgtttaaaggtcactacctaggaggtagtagagctggaatttggacctcagtatagtggcctggagttttgaatcctttctgctcagctaagatgagctgcttccccacagctgcgccacgccccagcttgggcctgggtcctggcggcctccctgtgcatcagaagcaagctgaccagctcagcgctgtgctctcagcacttccagtgccaggccttgagtgtggtattgcaagcctcctgccccttccccctgggctgcttttctgtcactgggaggggccctgacgggggagcagagtgcttgctggggaccgtttccctgcgctgaggatagagagcgccaggtgctgcctgaggcacgcctttcccgtgctccttttccacaaggctctgcccagacctggcagcaaaatggggtgaggtggggctgtggtggtctctaagaaagcattgatgttttcattgccaaggtcaggagcgggcctgcagccttgggtgatgatctgaggccaaggcccatccctgtgtatgaggaatagaaactaggacaggaggccttgtggagcctaggctgtctcaggggatcggccctgctggcaggcagccccctgtgggaggtactggcagagttcggagctcctgcccacccagcacatgggtctgggtctccacaagctcacctttcttcatgagctgggccaggacaggcaggacacctgcctgacattagttgttttgggccgctggagtggacagaggtgaggggtgggacatggccaccctcagacaccctcacccctccttccggaccccctctgtccatgttgctttggggtggggccagcgtctccaggagacaccatggccctaactgtaatgctctccttgccatcctgacaaggagactgtattgtagtcacatccaagacgtaagagacctccgatcccagccacctctgtgttgtacatgagggagctgaggtccagggcaagtgaatagatcgagaacttgacttgaactcctggttctgctgcttattagctgtgtgaccatggacagtgagcaaacctctctgagcttacttttccccatgtactacctccccagtttctaatgctcaaatgcaaatgtgtattggaggcctcacagggcttttactggtagtaaccattattgctacttgtgtgatggaaccaggactggaaactaccatcccagatgccccctcccctgtccccttctctccaggacccaggcctgtgtcacacttgtcctggtctacctttggaccaagtggcctggattgcttgggagtcaggcagtgcctctaacccacactgacatggtacatgtgggaagcagttgaaaagaacccccagggtaccccaagagttatggggaagggggcgcccctccatcagggttggcatcttcaggagggaggactctgggtgttaaagcacagttgagttggtgccaggctgatgggaaacagacgcagcttccccactgtacggaggatatctgcagactcgaagccgggcatttcactgggcccatcacactccccctctcgctgaagccctgtcaggccctggggggtgtgctggcctcctccccatggtgaggtgagaggcacaggtttgtggctgcccaaggccctcagagatggtgagtagcagaagctgggattggaacccatgttcctgcatctgggctggggcagacagggagggatgaggcaagcaaatggatccatggggtagagatggacaagcaactcacccctgggccttggtcagtttcccccccagactgctgcttccccggatgagcagaaggtgtttgccctctgggagtctggagacatgagtgatcaggtgaggtgaactttgctgccatcttcccgaagagccaggggggtttcctgcagcgttggaggccttgggggacatgtgcacccaaagtgcagccacacatttcagattttctggcacactcggttttaaatatcctgctccaactctgtacgctaacaaaataagctgtatgtgccaatagtttgaacctaaaccagtggttcccagatgccagtctgtgagccagctccatcagaatcatcttttaaaaaatacaggctgggcgtagtggctcacgcctgtaatcccagcactttgggaggccaaggtgggtggatcacctgaggttgggagtttgacaccagcctgaccaatatggtgaaaccccatctctactaaaaatgcccatagtcgtgggaggctgagacagaattgcttgaacctgggagagagaggttgcagtgaaccgagattgcaccactgcactccagactgggcgacagagcaagactgtgtctcagaaagaaaaaaaaaaaaaacatagattcagttctgttcagtaggtatgcggtactgtcctaggtatctgaatttctgtaaagcttcctgagcaactctgatccagccaggcttatagagcactggtgaagcacatttctcaggcggcctctggcagcaggaatcaaaaggattccttgtcagatgtcaggtcctggacttttaggttaaagaaattggtcattttgcctctagtcatactgtgatggggagggtcacaggtgtccagtgcccagaaatgtgagtggaagcagcagcgccttgcgtgtgtgtggtgtagtcatggaccctgcatcccagcttttcttaggccgtgaacgtacctaatttgatggtcgaaacgccagtcggtctgaccgtgtctaggccctgctcctaaggtgtggggagaagggagtcagcagaaatcccactgagctctctgtccccagctgcctcttaggggagccaactggcaggctgaggatctaaggggctggggccttttcctgagcaagcttgagtgcttttgtccagaatagagggtatctgaaatactttgataacaaaaaggcaaaaaaacaaaagtcataaatgcagatttttaaacatcaaatcagactagaagttttaataggaaagctcttgcactgctggacctgactgccacccctcagaggtgaccacttttattactacttttttaatagaaacagggtctcactatgttggccaggctagtcttgaactcctggcctcaagcagttctcctgcctcagcctcccaaagtgctaggatcataggcatttacatcaccaaaagataccactaaaatagctgcccccatttaaaaaaaaaaatcagcctgtcattagcaatgggcttcccattgtggtggatgagatttagctctcaactattttaggagactgtagagatagatatgttacgccagttttttttttttttttgagatagatagcgtcttgctcttgctcttgctctgtcatctaggcctggagtgcagtggtgccatctcagctcacgcctcttgcgttcaagcgattcttgtgcctcagccacccgggtagctgggattacgggcttgtgctgcctcacccagctaatttttgtatttttagtagagatcgcggtggtaggggtcggggggtggtcccaccatgttggccaggctggtctcgaactcctggcctcaaatgatctgcctgccttggccttccaaagtgctgggattacaagcgtgagccaccacaccaggcctttacctctttttaattggctatcattgtttatagcattgtcacagaatgaactgaaaatctatccattgtagagccaaacatcagtaatatactatgattgcatttccttgttcactgcttcctgttttcacttgtgtaattttctgaacacatgtgtaccgagggtgatactttgcttaattaagcctggttcccgggaagcctctccctctgcttctccagtgagactcgctcttccccatgtctgttgctgaattctggaatctctgcttcttccttgctttagcttctgaagagacagaggagttgtctgcattctttcatgtcttaaaatggattacaatacagtattactgtttgtctgggactagaattttaagaggcaaaggatacttcatgtagcagtcagctgtttacatgaaccatagcaaaaaaaaaggagaatcaaatccatctcctcttaatgtttgcagaaagatgcaaacaaaaccagctaagtatggaacaatgtgtgaggttatcaaagtttctatttttacgtgatcaaatgatttgcctctcaaaattctagtcctagacaaatagtgatacatgaagcatccttttttttttttttttttttttttttttttttttgagacagagtctccctctgtcagccaggctggagtgcaatggcacgatctcggctcactgcaacctccgcctcagcctcctgagtagctgggattataggcgtgtgccaccacgcgtggctgatttttgtatttttagtagagacggagtttcaccacgttggacaggctggtctcgaactcctgacctcaggtaatccgcctgcctcggtctccccaagtgctgggattgcaggcgtgagcctctgcgcccggcatgaagcatctttaagagagtttccattgtttaagttttcagagttgttgaaattccataacattctccttcttggtcttttaaatttggcctgtattctttcctttatgccaaactgcagaatttttcattattctgtatatcagtcagtgccatttcagctgtgccctggtgcgggtcattattgtactagacaattgagttcttataaaatcctgtgagttgttacttttttttgtttttttcagaattcttatgacagatattagacatactgaatccaatcttttccatttttattttggggtgtaacgtattttacggcatcctgtttcatggatgcagtggcatgtttgtgcattaagacttcacaccaattttgacaccctcttctcatctccgtgcagcttagattgtcgcttcacctgcttgctaagtccgatgcacgcctgcattttaccatgcagaaatatgttcaagccactcatcctctcatgtctcttcaccagttcttttgttatgctggcatatacctttgtttttatttatattcaagtttccagacatagcattaatgcctttacttttgtgtttttatttctgtacactgtcttgctgggtctctagagatgacttggctcatctttaaccagaggtgctgcgtgagggtttttatcagagactgcaacacaaagtcaggtgcatggcttgggtgtcttgtttggggatgtttctctttttagatcactgtttcccatcataacgtgtttttgctactaaagcatcgacaggttttgcttgaaattttttccaaaaattaccgggtacgccgaaacatgatccagtctcggttgactcaagagtgtggagaagatctcagtaaacaggaggtggataaagtactaaaggtacatccattttgtgcataacaaacaatatcaaaggctctggaaggggctgacagtgtgtagaagggactctagtgtctttgtgtatatgaaatcaggcttccttgggaccactccccagtcagtcttgtcttgagcaactgttaatgattgattgattggcattggttggggaagggggtatgtgccagaggactgaccccttcaaacaatatagtcacagtggtgtccaagggaaagaatacagccatggatgctttgtttctctttctggttgggccaggccagtaatgcccctttcatccctcttctctgcttgtcactagagacagaaactaaaaaccatggcttcaggctgctaagagcctaaaacaatagaacaacaaaaaaatatggtaggttggatgagcttggcagtgggtaggcgtcttctaaaatgatagggcctagttgagaatcctcactctactctcccttgaattttgaactatcttctgattgttgccatagccacacacatgactttcagtagaatccattcttaaatttagtttaaaaaggaatatgatctgtttactatatgaaagcacctaatgtacaacctataatgcttttctgaagtgactgtagtacaaataccaaccatatttgcagcaacactgagagacagaaaactgatgacaatgtcttgttttgattaaacatccagagccatataagtaatactgttttttaagcacccttgttctgggcatgtcagtatctgtatttcgtagacccccttttttttttttttttttttttttgagatggagttttgctcttgttgcccaggctagagtgcagtagcacaatctcggctcaccgcaacctctacctcccagtttcaagcaattctcctgcctcagcctcctaagtagctgggattacaggtgtgagccaccatgcctggcccaccctcacttttaaaatgcccctgaggaatggccaggcgcggtggctcacacctgtaatcccagcgctttgggaggctgaggtgggtgggtcacttgaggtcaggagtttgagaccagcctgaccaacatggagaaaccccatctctactaaaaatacaaaattagccaggcgtagtggtacatgcctgtaatcccagctacttgggaggctgaggcaggagaatcgcttgaacctgggaggcagaggctgcagtgagccaagatcatgccgttgcactccagcctgggtaacaagagcaaaactctgtttcaaaaaaaaaaaaaaacactacccctgaggaaagggtggctggtagtagccatggtggtatggttaggcagtttttgatttcccatttgtattctattcactaatcataaatcgagtgttgacattgtggacagaatgtaattagctccttttcctgcaaaaatctgtgcttaccctgtttctctctcataggactgctgtgtaagctatggtggcatgtggtaccttaaagggacagtacagtcttgacaatagtagcaaactactaacccagcaaatctaagcccaaggaagaagggcggaaccagaagtagggcctcgacttgcttcagacgacacagagcaagaggaactgaccatctcatgacctgtggcattgcacggtgcagtggacagaagggattatcctcagccagtcgcagggtcagcttaagttagttagatcactcccagaagagaccagctgggaccttctttgcagtacaatttgaaattcctgatgtattttgcttattatttggtttcattctcataataaagagagtgtatactgacatgggcaggatgataaaaatcatggtttaatattttcttttgtaaacttaatgccaacaaggtctaagttatgtttacaacatgaagaaaacctcaaagttcttaatttttaaaatgcctagaagacaatatttagtcttggattatctatctgctaagacctccaccaatttcattaaaccaaattgaattattctattcttgggattctgtggccacttcacctttgacaacaacctactttatgtagcagtctcaactgtttacatgaaccatagcaaaaaaatcagaatcaaatccatctccttttaatgtttgcagaaagatgcaaacaaaaccaggtaagtatggaacaatgtgtaagtgaggttatcacactttgatgtaaaaatttctattttgtgtatttttaaaataaatgcaaacactaaactagcatcatggtgctatcttcaaatggttacaggaaggcgatcttgttgggctcagcgttacgtgtatctagagggaacggagctaatggaggaagacagagcagcactgtccactagaaagaggcgagtcacgtacataattttgaaagtttctagcaaccacattagtttaaaaaggtcatgttagcatattatttagctcaaaatatctaaaacatcaacataaggtaaaagtcttcaaaatctggcattttacactttcctcaacactcagtttggactagccacatcataagtgctccgatgccacatggggctatttgcgacagtattggatagcacagccctagaaactgatggaaaaaataagagtaagctaggttggatgacatgtgaattttggtatctagataaggctttcgccatcttttttgtacaacacagtcactaattgtctgaaggtttaaatgacggtctatgctatttccccactccccccaaaataaaacatctaatattttagctatagaatcactaaggcattgatcaaggatgtactttgccaaataagtatttggtaacatcacttaacaagttgatcgtgtattgattctgttaacatatgtgaacctgaaaagtaaagttaccaaaagcgatttggaat

SEQ ID NO: 1546 - DNA, 37731 bp, Homo sapiens; identical to SEQ ID NO: 1545

SEQ ID NO: 1547 - DNA, 37731 bp, Homo sapiens; identical to SEQ ID NO: 1545

SEQ ID NO: 1548 - DNA, 37731 bp, Homo sapiens; identical to SEQ ID NO: 1545

SEQ ID NO: 1549 - DNA, 37731 bp, Homo sapiens; identical to SEQ ID NO: 1545

SEQ ID NO: 1550 - DNA, 37731 bp, Homo sapiens; identical to SEQ ID NO: 1545

SEQ ID NO: 1551 - DNA, 16076 bp, Homo sapiens
tttaaaattctaataaaataaatattttattaacgaaagtctggaaaatgtgtgcactaaaaagtgactataaatgttaaattaaaaaaccttcaaagaacacatatcacacattcaatttttaaaactttatataaaagctctattataaatacaaagctaaactatctgagtactaacaacacagttcatacaaagaaacttaacagtagtaaaatacagatatataagatgcttatttttggtcctttaggataaaagaactaagttggtttttttcacatggctccaggcacaaaaatagaatataagatggtaactgcaacattcttagtgtttatccttgtaattctttaaatgtcaccagtcataatagcaatgaactcctcttggtttactgtggtaagaaagaaaatgaaatagtcagaaatataaacattttattttttcagaatccacgactaccattttacactaagtatttaaaaaattttacattatgcaaaattattacattaagacatggctttttgcttttacttctttgttaggaagtggaacatgtttattaaatgtaacttcttggatgcaaaaatacatataatgtgataaacattacaaattagtattctataatattaactggggaaaagataatgttaccaaaaaagtcaatcacagtcatatttgtacatacttgctaaaacattttaaatgcttgacatttcaaggttctttaaacaaccctctttataatctttattctactagttcatttagcaaatccttcctttacaagtaagcttgaacatatcatgcatgtaaattagatttctaaagaatgaaaatataataaaattataaaaagaagttaaattattattttttgaacttttatatacttaaaagcctatgttaaagaataattaaaaccaggtcaccatacctcaaaggtatcaataaaaatggcaatttgaaaagattacagatgtaatcttaatcaccaaagtaatccagtaactatatagatgtaaaggcagaaaataatcatggataaggactaatttttagtttgccaaaattataaatatagtaagaatctccaatttataaaacataatgtttaagacagcaacctagaaataagaaatcagataatcttatagaatataattttgaaaacccgacatatgcgcacgtatcaattaagaaaaatgttcagaagatacttctggtaagtatttagcatttagccctaagacttaatacatacctaaacaatgcataaattatgaatgataattttgataatgccaaaagaaaactacactgagacttaagacctggtctctagtcacagctctgcacagaacagctctgcatctcatttccttcatctgaaaacactgaactatgagatgatgttttagattgtttaactcttatttaccatagaaggtattatatgaaaatactccattgaatcaaacatttttaagtggctagtgaatgccaacaccacaataagtgttgcgtaatatatcaaaacagacaccaggcttcctattctggaatacattaaaaccgaaatgagaaagatattatatgatattataaaattattgttaactttcttaagtgtaacattggtatcatagctttatgaaagatatatccttgttcttagtagatggatatgctaaaatattaaaggatcaagtttttgttttattattaaaatttaattaattaattaattaatttagagaccgggttatgagactggctaatcgttgtatttttggtagagattaggtttcaccatgttgccaaggctggtcttgaactcctgggctcaagcaatccacctgcctcagcctcccaaagtgctgggattacaggcatgggccatggtgcctggcctaaagactgagttcttgatatatgaaatttattttcaaatgattgagaaaaaaatatacacacgacaggtaaagcaaatgcggtaaaatactaattactaaatctaggcagaaggtacaatggtgttcattgtactagtctgacaatttttctgtttgagaatattcataatgaacagttagaaaaaattaaccaattaaaaaatgttgaggagataaaacatggtcatagggaatgaaaagaatatatactgcactggttctagaaaccacatagaaaaccggttttgataactatgttagtcagtttttatacttgaaacagaacaaatgttttataacacaaaatactatttattattaaaacaaagaccaaatcagtgttgaaaaaaaatccttcacaatggtaaaaattattactaataagaaaaatttaggtaaaggtaaatcattacttgggctctaaaataaaaatacagaatttggaaaggaagtagaaagagagctggggtgggagaataccatcagaaatacagtcaaagaaagaatagtgtatgcctcacagaaataagctatgagttaggaaaaatgcaccctccagaagctgacagggaactatgaagccatgcaatcagtatttaacatctacaaaacactatgacaaacatggtaagaacgtaatacaaaatctgtaatactccaaactactttcaagaatcttacaaattgatgtagtgatctttaacctttgcagttaaatagccatgtctgaatatcttaggaaagctatgatccctctctctttccaataaatacagttcaaatatataaaattattaatcagtttagccagtgtgcaccttcactgaagaactcccgatttagactgaggcatctagaccaaataggaagcaagagtatgttcttaagaactgtattaagagaaaaaacataaaacagccttagaatgatttgattacaaatcattttaacagtgtaatacatccatgattaaaatattcaaaatccaaaaagtacttgttacttaaagatctagaactttttcttgatctgtaaaatttcaatactcaaactgcaaattttaagtttcatatataagtttgaaaaccacaaaacacttaatttttatattgtttatatacaaaaactttaaactataatagcatttcaaaagtatttaaaatacggtcagccttctgtaaccacaggttcctcacatctgcagattcaaccaactgcagatgaaaaatatttgggaaaataacacaataaaaaataatacaaataaaataaagtataacaatttacatagcatttacattgtattaggtattataagtaatctagagatgatttaacgtatacaagaggatatgtgaaagttatatgaaaatactatgccattttatacaagggacttgagcaccatagattctggcatccttaagcgacttggaaccaatcccctgtgcttatcaagggacaactgaattccatgattcatacctaaaaacacactacttaaacccaagaaagtaaaaattagaaagtggctcaggaaattaaactagctactttactttaattgtcttgtagacaattaaaagacaatcttctatatctctgtgcatttgattttataaccttctctattaacaatatcttatatcaagttcctatatctaataaatctaccacaatgcctagcttaaaataagctttggtaaaacatttattgaatcaagaaaatatgacactttgtttccttttatactgccttctttaacaaaatttttcatacatcaaccatttcatagagcaaatcttattacaagttgctaacaataagaattttacagaactaagtagattaagtaccttagagaccatctggctttgaaggggaaaagcaaatcttagaattggaagttccaactgagtatgttgctaatacactgcttcctataatagcatgtaatttttaaaactccataaacatagaagtctagttaatattttacttcatagcccgaaaggcaatacaatattacgtttaaaagcacattctttgccattttggagatttgattttgagttctggctctaccatgtacagtattagctttgtgataacctgggcagattaataatctctcaaagctttagcttcctcatctctatatatgcatctattatacacatgtataggtataatactatatctactttacaagttattatggaaattaagtgacataattaatgctaatatccaatatagtagctgctaaataaatgttaaaaaacatcatcattatttaaaagattatccattctggcttttcaaaacgttcctttcattttttccaaaagatgtgctgtgttttattttatatatgctgttgagggggcagggggaagtgactctttctgtatcattaccacagctttatgtctatcttgtagtacatcttatttacctttaacttcacattcaccatgtttattattctatatacccaatatttttaaaatttcattgctcttagatactgaaaagcatgaaaaagtcacaaagagagaagaacactaaagtccacaaaaaagacagcaaggtctaatctttagcagtttaacatacaaataaagtggtttttatctcaacaaaacttagtttccagccaaaagattccatattaagtgtatgaaagtatcaaaacaatttgtttctctaaatgctataggccttcaatggaagtctcatgattcatagagcgttatgggaagcttttgggaaaaagatggtgtttaatatttacctgagagaatgaatcacattttagcaggcagaaattaacaattagagcattctaagattaagaaacagcaggatgaaacgaatagcataaaaatgtgttttcaggatagcatatgttgacaaaatgtgtacatacaggaggtgagggttaaagaagaaaagtgaaagaatacactggaaagtaaaatcagttactcaaggtgggatagatcatagaaggctttgaactttactctgtaggcactgaagaatcgtttcaagtgtctaaacacagaaatggcattatcaaatgtatattttaggaaaagaatgataccaagagactgaagaagagattagagacttttatatgccgaaagggcaattaggacactacaagagactgcaaagtgaaagcaagaaccacatctgcctttttcattgtgtagcaccagtcaacacgcaggacactgcacccagtaggcagccaaggcaagaataaatgaggccattataacattcctaactagaaattagggcctgaactaggacagccacaatggacaaagataaaaacagattcaaaacatttgaaggggaaaatcaatagaacttagaacttagcatgtaggttgagggagaagccattaaagactgaaattatattgaaaggctgaaattttggtggtttcaccttcagagaaaagtgaaggaccttcttgaagtataattggttttagagatctgcttcattctaaattgaatatgtgaattatttagacagaaggtccattacaagaagcagttaagtttacaaaaaagtcttgcaagtcatttggttttagaaaaatgtattacatgtgtagcatcaggaaaacctggaaaatacgtttcacttaaaacttactttctccatcaccatctttgtcaaattcttctatcatagctcgaagttcttcatcactcatgttttcacccaattctctagcaacacgtcgcaaattcctcaagcttattttacctgaatcatcatcatcaaatagtttaaatgccttgagtatttcttcatggggatctctttccaatatccagtctgtcactacagtttaaaaacatatatattttaataaacctgcataatcacaaaggcattcatttgtgaaatcaactaaatattagatgagaattaaagctgtgactgtcaacttttagtctgacaataaaatgtcaaatgagatccccaaaccccgagataaacctgaaattagaaaaatcaaatccatattttaaatgttaaccttttttatcatgagcaacttgtcttattataaaagtaagcaaaactatatcacacagaggcaaaataaaaaggactacatttataccatatttatttaagatctactattatcaagaattgtactaggctccactgacatcaagcacacaaggagtgtgtcatctacctgtggagagacataccaacaaaataattggagctaactaaataaaagctgcttgctgactaaacgtcatactaacactgattcttcctcaaatttaatccaacttcaaaacaagaaaaactgcaagagacaaaaagtactgccatcgcagacacaggcacaatctcagacagcatttgaaaattccactaatacctttgtgattagaagaacctcttggttttccaaaatttacaaagtagtaaataggatcaaatctgactatagcaggaaagcccacccaaaaaaaacctctgcaaagaaggtctccttaaagcttacccattttgtttggataaatcactctcagacaactaactaaaaataaatgtagtttcaaacctcaatggtaattgtgtattttaatacactaaatataatcacatgtaataacatagtaataagcttaagtattttcaattttaccagtctttaatcaatagccacaataaaaattaaaataaaaatctatggcataaaaattggtaagttactaaataaaattctaacagtatctaaataagtatctctgaagtaattatatacactatctgccactacaagaaaaggtatttatggcctttactatgctattaaaaataactcggtcctgttgaaggttacagaatcattaaaaaaaaaaaaaaaagcaactgcttatagatggaaaatactggaatgtttaaggaacccagaatgaaaaaaatacaatcgaagtctccaacaagctgttgttttgctgctgtttcacccgtatttggttcaataatcacctattcaaatgactattatatcatctacacatattttcaatagtttccttttatccattaattttatccaaaaaggcttccaagtaactaattgaagtatattactgtaagtatgcaaatcatcaaagctcataaatattcagtcaaaaagaagctggcatatctacagccataacaccaaaataaaataccacacttaactctatggcacatactcaacttattttgaatttagtcccaacaaaaaagcaggacaaggaaaaaaagtgttaagaaattttcttcaccaattaaataatttacatgacaggtgaaccaaaaaagcagcttgctgaaagtattaatgtacttaaagaagcaacagggtgattggggaacagatggggctccaagatgtataaattcttatcccactggtactttaattgtgttagttatttcagagctatgtgtctatatattcttttatcaatattcttccttaaaatgcagcttttcttgggaattataaatgctcatcattttggacagcaaaaacattacctaatatataactttataatgactctcctccatgccttcaggttctattcttgttccacaaagtagaatttaattataaggaatatatttattttcaatgaaaatattagtaaactgatatagaggcagttaaggtgggtttcatttatttcacaaaactccaaatttctgtccatgcaactgtattttcaaatgatttaattacacatactatcagaaatgtacttcatcaaaatactttcttagacctttaatgtgtaaaaatcacttaagaatacggcaaatccaaaaacatcacatcaaaagtaaattaaaaattattataggtaatgctagaaatacagctttaactgtatttctcaatgtctttcggaaatttctatccaaacataccagttagacatgttggactccaaactcattccactaccaccatagtaactgcagctgcctcccctaccccaaccaaaagataacagcaacatttacagctagattccatatttgaaaagcataaatcattttcagtcccacaaacttaatcaggtcctatagtactgagaatactgttttttttctaatttatttattgttttaaaacaaggtctcgctctgttgcccaggctggagtgcaatggcgtgatcccagcttactgcagcctcaactcctgggctcaagcaatcttcccacctcaacctccaaagtagctgggactacaggcatgtgccatcatgtctggctaattttttaaaatttttttgtagagacaggatctcactttgttgccccagctggtctcaaactcctgtgagcgagcaatcctcccgccttgacctcccaaagtgctgggattacaggcatgagccaccaagcccagcctcttttttattcttaaatgtattttcttttcaccctcgccatcctcagcgaaaaaaatagtattttctgtctgcagtctctcttccttccaactcatcatcaataatactctcatcagttttctttctcaaacatatcatatccccttcccttaaaaattgtgaatgatctctgctgactagaattcaaaatcttcatgttttgcaagactttaccaatctggcccaatcctatgtttccagtcatttccctatgtctagcccagaacactacctagtttcccaaacatgctatccgtctagtaccattctttgttgttgctgctttctaagcctagaatgctttttctctactcttcctggcaatcttggaatgaaatcttactcacatttccaaaggcctaaatttaaaatctcctctgcaaagacttcaattcctctagatcagggattaacaaatctttcctgtaaaaggccaatagtaaatattttaggctttgtagagggccataaagtctctaactactcactctgccatagtagcacaaaagctgcataaaagaaggggtgtggtggtgtacaagcagcagctgaatttggtccaaaggctatagttgctgacttctgtcctagacaaaattacaatttaccacatagtactatagcctgttgtcacctatatttacattgtaaactccctgaaagaagaaccttttagtaacttttaattaagtcttcttcccaaccccagtacagtacctaataccaaaaaattcagtgttaaataagcaaaatgaagacaataatacagtattacaatctcaatcagcaataataagtagtacatgtcaaaaatagtgtacaaacgtttgacttatgttagtcttaaagacactaattcctaaaatatctatgttactcactagcctcaggctgtcttgactctaaacttaaattaaatatattttaaagcttttttccagtactaggaagagtctataatagttaactgccaaacttcatccagatatatctgtggaacagtgtccttgggtagttcataaaactaggactcaaatgttatgatttagaatcatctgtcccaaagtataaaacatattaatctgtggtcagtgattagttaaaaataatcaacaaaaggggtaatacatagttcctgaatgattcccaaacagtaatacatttttatttgacacctggtactctccataggtagccttaagatagctaagatacatgttgaccctgtcaaaaggttaatcttttagtgtcaaagctgaagtttagccacatctatttattctagaaggaacccagtatttctgctctgttaataacatagaacagatggggtgtcaggaaaaagtggaggtggcatgggattctggtcccaactgccaataaaaatcacaatttttggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactctgtctcaaaagaaaaaaaaaaaaaaaaaaaaaaaaatcacaatttttaaattgtgttcatttaaggtgaaataacatattttgtaaaattattagtgatgatacagtgcttacaatagcctttatgaaaaaagtcaataaaaaatatacacaaagtctattttatgtcccagtgatgcatatatgattatttcgagcccctgaaacaaagacaattttttaaagtaataataatagcaaatgcttagtagcacttacaacatgctaggcccttttctaggtacttcacatatcattaacttaatccttagaagaatctcatgagagaatacaatgatccccactttatagttgaaaatgaggcatggggtattaaaaagaccaagttccagagctgtaaagtggcaaaaccaaggtatgaaccaagggaatctggttccaagtgctaaaccactatactgtactaaacatacctggattatagctccttcctaatagtaccatttccactatatacaaacaccttgtttctacaaataaacaatctaaggtaaaactaggaatactacgatcataaacttcaggagagtgtccattctgggagaacaaaaggtggctctctccctttcctcaaataattaattctacaaattagaggaaaaaaggaaaatgtccccaatggacaagttgcctctctaaacagtcatatattagttcataagttgaggatcttctgtgctgtgttttttttctcttaggttcatcatttattttccatctcaactgcttatgacttgagcttttggatttaaaaaactgactaatgacatgaatctaaattttctctgcgtctactaattgccatttctttttgcttcccctattgcttcttgattaatatttaaaataaggggtttgtgtatatagcagaatttgtttccaaatttttaaaatatcttaaaatacttatatgatgtgcttatatcgtgacccattggtttagagaaaaaaaaaaaaagaaataaacctgaatatttacatattttgtagataatattctagacaatacatttaagttataatagcaacatccttgccttccggactcttctattttgaaaaagcctggtctatatatgctataaataattcactaaaatcaactataaaaaaatttagccatattaagcctatgacacattatcttcagttggtggtactaggatgttttctcctgcttccagtatgcccactgcctcctttactactaccctctaaacagatgactttatccactgagatcaaggtcatccagaggatgtagcctctcataaactttgtcaacctgaagtcgtgcatttcatctacagccaaagataccaactactaccagttccctcttctcccacttagccaacaaaaatcacataccagaaaggtcttgggaaacattttccaaacagcaggatatcaaattttctgttttattaagcaaaaataattttttgatcacccttcaagttttatcacataatataaatacaaacaacttggaaaagcatctttctataaaaagctacacaatagttccttggttagaatcttcacaacaaaacaaaagacaaaactataaatctcagagcaaagccatattttttctttgaaaaaaaaaccaacaaaacaaaactgagtaagagtcacattatacaccagtgttctataagaaaattccataacctagagaatttaaaatttaaaaagtgatattaatcagacaatttcctaacagctgctgattacaaagactattaaaatacacaccaacttcattaaaatcttcaaaggtgattttccctgtggcttctctgtcataatctttaagaatcttcagtacatcagctttttttacatcaaaccccaaggctctcattgccaccttttggattaaaaaggaaaagcaaattataaagcactctttacaaaagaatttctaattattaagtttttacatcttaagagatgacaacacattaataaaatataacttttttgcatgttttacctctttaaaatagcagtgatagtgtaattgttcttcactactgaaattaagtatgcataagttttttcatttataaattgcattttttatatgacaaagtaaccaacaagtgtttacagattttactatataaaatgcactaacttattgcacagataatttgattgttatttgttctgaagggattaacaatcaaaatgagaaaaaggcgtggcataaatattaaacagttacatgatagaagagataaaacattaaaacaagaattatcatcagtctttccatgattagttaccaggtaaatgatagggctaaggaccctgagtttagagaaaaaagagattttgttactaataataaggaaggagacatattactgactagagaagtcttatttggaaagattcaaactgttccttgaaggatagatgaagaggagcagtagggtatttgggaaggatgactggtattaaaagaaacactgaaacgaataggttcgaaggacaatgaacagagcagtttacctcacctgaattagaaaagttcaggtgaggtaaactgctcacctgaattaggaggtgaattccaccttaattagaagagttcaggaggaagaaagcagttagcaaatgaaaaaagtagttggtggcaaaagtgtagagaacattcagtagaaagcaaaggaatctgaactttaagtagtatacaatgaggagttatggtttatgagcaatgaacaatttatgagcaatggtgaaagaatttttaaactatctaaattcagtggtagtgtacaaggtgaactagtaagaaatcatttaggaagctccaggtatgaaataaggtcccaaaccaagatagtcaatggttacaaatggaacagacattataaaggaagatcaaatctgggtaaccaaaaaaaaaaaaaaacaaaaaaaacagtgggaaaagagagccaaagaggactgcaagattgagaaagctagacttagcaggcctattaactgcttttatacattctatcctgtcactgcatagttcctatccctacttggaattctaatgcttaaaaatcccttacgaaattacaaaaattaaaactaccaaataaacacttacattcacctatccattaaggccattaaaaatctcaaaatactatctttcccactgtgctgaaagtaagtcccattctaccctaaacccaaatctctccttataccctgacaaataataatttacaaatctctccctacactttgacattctaggtcttaaagctgacatttttacctattagcatgtgtcaacatcaaacagcactaaagttgtttgcaccagagaaagtggattgagactatgttactaacaaatccaaattataagattaaaagacaacactcccacagtctgaaaacagtatgagtcaccaagaaacaaaaacaaaaacaaaaaacagtgaaaagaagatggtaagaataaattccagtttgaaatcctttaattatgacagtgaaaaataagcaccttccctgggaatgtatttttacatttaaaatactattcgttttctcatgtgaaaaagattttctaaaaactatgttaggagttctcttcagttttattacagcatctaactatgaatgcttaaaatgccttcatagttccaaaaccaatttagttaaaataattatttagaaatgtaatgtaaagcaactgtaaaaatgcaaatcattttaacacagaaacaaatattttaaagtataccattacctttaattcatgataatctattgcttcatctttgtctgtatcaaatagttcaaaagcatctttaatttcttgtttctgttcctcagacagttctcttctttttttcctctttgttttgtccactacaagctcacttctatgaaatggaaagaaaaagcccttagtccactttaattctctttactaacagaaattagccaataattaccttctaaatttcaaaaaagaaagtactttggagaaagatagggaaactttccctttatgagtcaatgacctgtttattccatagtctaaattgctataaatctgaacttcgcaaaactaaagagtgttacagattattaaaagaaatgaggaccaaacttttctttttcccagctttttatttattcccactaatgttactgtggaagaaacaagaactgtgaataagcaacactacttttatgtctgaaactccaaccaactccaaccaaaaaaacaaaaacacgttatcctacaagaatgttaaagaatttaaaaaaaatctccaaatgaaaccaaaattcataactgacaatcactatatatcggtttactgttgatagttctgataattatgttcataaaattacaaaaaaaaagtgaattaacttatacagtattttagcactgttggttcaaaatgtttttagattacacgtttttaacagtttggcaatttatgtgtcatttcctccattgatattaacaaaccatcgaaaatattaatgagtctaaacatatgacaaatattagatgccaatatacaatgtttgtgcttcattctatataaaaatgtgatgagtcttgtctcatttaacatgtaaaccggaggttaacttctcataaactctggaaacgcttaaagaaaaaaagcaaaaattattttaaagccagaaatgttttccttaagagctgcccatctaaatgtgctccaaattttcaaatggagccgcaacactggaataacgagttttgaaacacaatccggtaacacattaacatgtcaaaccagttgactgtacttaaaacacctatctagttgcatttgaaagtcgttttggtctctgaaagctccaaaaaaaaaaaaaaaaagctaggaagtgactagtaggtgcagtataacaaagctgaggaagatcttcctttcatgagacctgacttgacacaaacttgggtattcctggggtcagtcttttccttcctgagacttttggaggccaagtccagaaccgacccacccctgaccccatccaagggtaccatgattatcccttagcagaacatggaatattttcggagtgtcgtaagtgtatggatagttttacggtacaacgtctacatagtgggagagggcaacagagggttagaggttagaactgaaaggtaaaaaaatgcaagaaatttaggaaatccaagagacagactgccaattaaagtcactaaaatgggtctccaattacaccgtaaagcagggccctgggagaagaggaaagagtttttgttatttccaaaatttataggtgggtgattgcattagcagcggagcagccgaggtggggccctgaccaggcacacggatgaatgaagggatgtccgcgacctgatctgagaaacaagagtagaagcctcgcgatatttcattcccacctcgctcgcaactaagcccaaccttctggcagtccaaagccctacgcgctgacagaaataacctccttagcagaaatgcactggtctcgttccctgcagggcatcagagcccagagggtgagtgatccgggcaggctgccctaggctcctttcccgcgtcccaaactacatcccctgcctcgcctcggccccaaacgtcctcccttccacacacaccctccctgggccccgctccggggtgtggagagcactgccgcctccttattaccgacctcagagctaaactcattatctcttcgcacagagacgttcctctcaagaacgattttaaccccctacccaaggcagcaagacgcccacagccgttcaacagacacgaacgacctcagcggcctcagggacctcccacaacat

SEQ ID NO: 1552 - DNA, 16567 bp, Homo sapiens
attgaaataaaatgactaatatttattacacaagtgcttagttacacttatctgaaaattataataggacaattggtgcatgtcacattcatattactatccatataagaacaaatacatttagtcaactatatcaggataacacacaaggtttttgtttgttttaggcttctcagttgaaagaaaacatcgagtaaggaaaatgaatttccagtgattaagtattaacaatataaataataaaaattacttctaaatgtcttacattttgacaactttgaattatacttacatactaatatttccaaaaatcatttaagttacaagggtcactgtcagggtgaaaatatattttgaaaagctttttaaagatatgttattattatgctttaacatcatttcatttattcttggcacacacggcatcttggaaagtaaaaatacatcttgccaattttctgctattgtgcagttacaagagaaagagaagtgtggggcagacagacctgtgttcagttactagctttgtccaaaattgtgttgaggctggtcaattaccttttggtgctgggagtaagattaaattaaataatgcatattttaaatgtacagcatgggcactcaataaatgatatactttaccttatttattcacattgaagtaatagcaaaatatcacagttctatgttgtggtacaatttgaaaaactgaaaaaattgggaaattaaaaaataataatgtgttttgaaaaattgcactttttataaataaatccttcagcaggtttaaatatttcctaataaaacttagtgcctactataccctgattttttaaaaaaaggcctaaaatatgataaaaatggtcagtggttaaggacttttggttttcctttgtgctattgatataaaaataatggctttatttaaggcttagtaagtgattatttgtagttgccctgaaccaaatcattattctcaatgttgcactcagttgaaagagacctactaccttgaatgaccatcatagagaaatgcccatgatattctgttaatataattgaaccaatcataccctcctttttgattgaagtaaaggttcatttggtggcatgtggcagttcagcttgtctcccattaacaatgactcatatacacaatcacaaatcaatttttctcatgctaaatatgtgatgtttggaatatactggattcctgaaaattaaatttatattttcacaaggaatagactattctagactagcaatgcttatatccctattcttggattgttttgtttccaactctgactatctaacaagttcatccttccaaatttgactcaaaaacccctcctccagtaaactttgcctaaccaaagttcacacccctccatttatgtcccttacacgcatgtataatgtacattaacttgcatacactattatttatattttgtgtgctttcgacttttagttataatgttgtctttgactttttttagcctccacagtgtttagcgctgtgctacacatgtatatatgtggctgtgtgtgtttgcatgtgggattgtgtttgtgtatgtatatgtttatgtgtgtgtgagttgaatgaataaaaaactaaagaacctgggcatctgtagggtagaaaagttttgtaatttttcagaaaccaaaattgctggatcttcctaacattaaaaaatctgatttccaaagcgatttcagtttggttttagatatgtcaataataaaaaggcagtgggaaaaaactgtttaaaaccctttatgaaatattctaaaaggccttttagcaaattattattaacagcaccaaactaaaactttttactaaatagtggtataaccttttatatgactttacgaacatagacttctctattcaagacaaagaatactgaacaggaataggtgttgtgaatcaggatacaaaaggcaattcactctaagtcaatagctaatgcacattttgcaattaatttaaaaatccctctgtagtacatatgcatgttaagtaaaagaatagctgcagatcttcatagttgttttaacgctgtaaaacataacacaatactgaagtcgctatttaacaggaaaaattttgttcataatagctgttaatattaaaataggatataataataaaaaattattctcaatgtgtatattttcaaatttgcctgacagtgtccttttaagaaatctgacaatttgtagttagataacagacatttgcatttcactttcataattgaaaatattacctacacaataacaaacaacaatatatagtagctttttactgaagcactctgaaatttatatttaaagctttgcaataaagcaaaattcactgtacttttcataagttatattacataacatgtatgctataattatacaaagaataaatacatgaaatgaagcataaaaaattcaggaccataacaatggaatgttttagttgtcattctcaatgttactttatatgtctgcattaagttctaatgtattttaaacccaagaacctttatctttaaataatacactaaaaatatcaagtttaaagtataaacataatactctacatgcctttttttccctaggtcatcaagggaataaaacaagaaaaacagaggcaagggcagttctcttgccacaaaatctctctttgcttccccataaacctttatgtcatttctagagcatatattacaagatgacagctttggcaaagtataagcttatttaagtggcttctttcttggaagaaagaaaacaatttaaactaacaattttctttttggcttattcattctcaatctttctctgatatataatagtggtataaaagcacttcatgaaatgctcactattaatcagttaaatagcacagaatgaattaatgtatataattaatcaaaatatattatcagtatagatactagggcgaggtcctagaatttgttacacgtagagctaaacttgcaagagatcgcatggcaaaagtagaaactttgtgacatatcccagcttttgaaatatagttagaagccaatcgaaaaagcctttcagcaccaaaggtattgaagtgcccaggaagcaccttctctaccagacctctgtccactaattctattagacgttcacaagttccaacatagtcacttatcctgctgtatgggagccagtcaatcagtgatccatcatacacgacgtctccactgaagagaatctttcggtctttgtcatgtaagcaaatactgcccctggagtgacctggcatgtgcataacagtgagctgtctgtcaccaaggttgatcacatcccctacaaatggaaacagagtttacagataaacatgttgtatacttgacttagcatgtaaagcatactagagcattatatgcttccaaagaaattgggaaggatgacactttatttcataaatactgtatttcttaatgatgatttaaaaataagctgcctatagttcattcctattgtttgctagaccagtgtttgccaaagcaagtaatgtggaacactacttctacaggctatcatgatacataaatgaaaaggaggtagttctgtggtcaaataatttgaggaactctcactttaaagaaaattaagcagctttcttttcagaaagacttctttgagcttttattatatgaatgtatactgtggatatatacaaagtagatatagttgtacaatttctcaaacttatttgatcatgaaacttttacttttcagcacatctatggtaccagtatcctgttgacacaattaatgaatgttgctctagggaattttattgtattttgcctcttgtatcaccctgtcagaattagggcttgaggaattgatataaatcatgatgctctaatatgtgagtaataatctccttaatctctgacccaggaacctcaagtcttctgtcagaatacattaaactctggcaggctaacttgcaaatagggtaaaatctcagacttcagttaccgacagcagagaggaaatggagcaacatgggtggaaaattgctctgtttcactggaattaaattagtatgaacttgaagtaaatcatggtaaattaaaagattcataatgtaatctctagtgcaagcacatacacaggaaaaaatttaaaaatatatagctaaaaaataataaaggaatcaaaatggtgtaataatcaggatttggtaaacataaaaaggcagagattgtcagactggattaaaaatcaagatatatgcagcctacaagaaagaaactataagaccaaagacacaaataggttgaaaagcttaaccatattaaatattactgttaagagaactagggcagctaatattaatataagacaaaattgatttttacatgaagaatattactaaaaagaagtaattttatgagaatgtacattaaatcaatacattgataaataacaattataaatgtacatgcacataaaacatcaccaaaaatacatgaagcaaaaacaaacaaacaataaacaattcaacaatgatacttggagagttcaatattcttctctgtgtaattcataaaataagtaaatagaaaatcaataaggatatggaagacctgaacaactcttatcaaccaacttgacctgacaaaaataaaacactttactccaaaacagcaaagtacacattcttttcaactgtagttgaaatattcaacaggctataaagctaggccataaagcaagaatcaataaatgtaaaaggaataaaatcatacaaagtatgttctctgcctacaacataattaaattagaaataacaaaatgaacagaaaattgataacatgtagtctttttgtttgttttttctgagacagagttttgctctctcgccccggctggagtgcagtggcgcaatcttggctcactgcaacctctgccttccaggttcaaacaattcttgtgcctcagccagctgagtagctggaattacaggcgtgtgccatcacgcctggctaatttttatatttttagtagagacagggtttcgccatgttggccaggctggttgccatgttgccaaggctggcctcaagcgatcctccctccctggcctcccaaagtgctgggattgcaggcatgagctactgcgcccaaccttattatgtgtttttaatagacaaaaaataacaaattaggaagaacaaaaataaatatgggcaatattcaaatatatgtaaagcaaacagcaaacttctacattgtttatggatcaaagaagaaatcaaagggaaatataaaaatattttgaatgaatgaaaacaaaatcaaaacatatcaaaatgtatagaatacagctgaagcagtacttagaagaaaacgtattgctttaaatgcttattttataaaggattaaatgtttaaaatcaacaatcaaattactatcctaagaagttaggaaaagaagaacaaatcaaacacaaagtaagtgttaatagaaataataaagggcagagcaaaaataaatgaatacaaataccaacagaaaaaaacagatgaaaccaacagttgtttatttgaaaactacaacaaaattgatacacctttagctagacaaatcaagaaaaaattagagaagatacaacttgctaaaataggaattaaagaaggaacatcactacagaccctgaagaaattaaaaggagaataagggaatattatgaacaattttaagccaacaaatttgacaacttatttgaaatgaacatattcttaaaaagagacaaattatcaaaagtgatccaagaagaaatgaagtctaaataaatgtatatcaagcaaataaattgattaacaatttaaagtctccccacaaagaaaagtctgggctcaaaggcttcattgatcaattctgtcaatcattttataacgggacaatttcaaccctataataatttcaacccatataaagactttcagaatacagatgagaaatctaactcagttattaccctcataaaagccagacaaagacaatatattaaaataacaacaacatcaggcctggtgcggtagctcactcctgtaatcccagcactttggcaacatgtgggaggactgcttgaggccaggagtttgagaccagcctcggcaaaatagtgagacctccatttctataaaaattaaaaataaataataatttaaaaagccaagtagggtgttttgtgcctgtagtcccagttactcaggaagctgaggtagaaggattgcttgagcccagaaatttgaggctgcagagatctatgatggcgccattgcactccggcctgaacaacaaagggagactctttcaaacaaaacaaaaaaaagcctatacacaaatatacctaatgaatgcaatcttaaaattattgacaaaatattggcaaatcaaatccagcaacttataaataggaaaatgaccaagtgaagtttattccagaaatattaagtttggtttaactagtgaaaataaattaatgtaatatactgtattaataaaggagaaagccatatgattatctcaatagatacataaaaagcatatgacaaaatccaattctcattcatgataaaaacttccagcaaactaggaatagttggggaaggtcctgaacttgataaaagtcacttatgaacatctataggtaatacctctttgaatagaaagtctcctaagataacaaggcaaggatgtctgctcttaccatttctattcaacattatactgaagatcctagacagtgtaataagccaagaaaaagagagtaaggtctcacagattagaaaagaaaatctgtctttatttagacataatcttacatacagaaaatcctaagtaggaaaaagctagagaactaaaaagtttaccaatgttacaggataccagatcaacatacaaagataaactatatttctatatgcttcaagtaactatcaaaaatgaattttaagacatttgactcaaaatagcatcaaaaagaataaaatacttgggaaaaaatttgacaaaagatgttttgtaatatatgaacactgtataatgaaaactacaaaaacactgtcaagagaaattaaagaagacctcaataaaaggagagataggctatgcttactgactgtctcaatatcactaaggctcaatattgctatgatggtaatgtaacccaatttttccaatagctacactgcctaataaaactttctgcaatgattgaaatgttggttctcaatactgttcaatatggtgtggctaatggtgcttgaaataaagctagtacaattaaggaattaaaattttaattctaaccaatcttaattatttttttaaagagatggaatctctgtcactcaggctaaagtgcagtggcccgcttatagctcactgtaacccctgaactcctgggctcaagggatccttccaagtagctgggactacaggtatatgacaccagcccagctaacttaaaaactttttctagagacaggatctcgctttgttgcctaggctagtcttatactcctggccttaaatgatcctccagcctcagcctcctaagtagctgggattacaggtgagtcaccatatccggtaatcttaatttaaatttgatagccatacatggctagtggctactgtaatggccagtaaaaattcaacataatctcaatcaaaatcttgatcttttttcgaagaaactgaaaatctgactctaaatttcacgtggaaatgcaaatgacctagaatagccaatacaattatgaaaaagaggaacacagtaagaagacgtatactaatttcaagagttacaataaaacatcacttctcagtcttttggctaagatcaagtgtacaataaagctacagtaatcaaaatattgtgttactgactaaatagacataatcgatataacagagagtctgaaagtagacacaatattgtcaatagatatttgacaaaagtcaaacaagataattcaacggataaaatgacagtctttttgacagactggactgggatactttgtatatccatttgcagacaaacaaataagaatcgagaacctctcaacccttacttcacaaatattcacagaaattaactgaaaataagtcataaacctaaatatgggagcttctagagaaaaattaggggaacatttttgtgaccttgggctagacatagagctcttaaatatgacacaacaatcataaaacacgagacaaaaattgctaactggacttcaagttataaactttcttgcttaaaaagacaccattaagaatgaaaaggcagggcacacattgggagaaggtatttgcaaaatgtacatctgataaaatcttgtattcagaatatatagagcttgcataactcaataataaaaaagctgaatttttaaaaaagattttaatataccatttaataaagtggatatctgattagcaaataagtaccaaaaagatgctcaacatcattagtttttagtgaatgcaaattaaatcacaatcaagtaccactacacactcactagaatggctaaattgaaaaggattgacaaaaccaagtgttgaaaaagatgtgagctgggcgcactggctcatgcctgtaataccagcaatttggaaggctgaagctggtggatcacttgaggtcaggagttcgagatcaccctggccaacatggtgagaccccatctctaccaaaaacacaaaattcaccagaggtggtggtgcatgcctgtaattccagctactcaggaggctgaggcaggagaatcgcttgaacttgggaggcagaggctgcagtgagattgcaccattgcacttcagcctgggcaagagagagactccatctcaaaaaagtaaaaaataaaaaaatgtagttgttgggtagaatgttctgtaaatatctattaagtccatttgttctagggtatagtttaagtccattgtttctttgttgactttccatcttgatgacctgtctagtactgtcgacaagtggagtattaaagtcccccagtattattgtgttaccatctatctcatttcttatgtctagtagaaattgttttatacatttgggagctccagtgttaggtgcatatatatttagaattgtgatattttcctgttggactagtccttttatcactatatgttcctctttttgtcttctttaactgctgttgctttacattttgttttgtgtgatataagcctgcttacctttggtgtccatatgcatggaaaatctttctctacccttttaccttaagttcatgtgagtctttatgtgttaggtgagtttcctgaagacagcagaaacttggttggtgaattcttatccattctgtcattctatatcttttaagtggagcatttaggccatttacattcaatgttagtattgagatgcgacatactattctattcatcacgctatttgttgcctgaataccttctttttttggggggggcggtttgtttgttttttacattgttattgttagatgttatataggtactgtgaggtttatgctttaaggaagattctattttgttgtatttcaaagttttctttcatgatttagagctccttttatcagttcttgtagtgatggcttggtagcagtgaattccctcagcatttgtttgtctagaaaagactgtatctttctttcatttatgaagtgtagtttcactggatacaaaattattggctgataattgttttgtttaagaaggctaaaaataggaccccaatcccttctagcttgtagagtttctgctgttagataggttttcctttacaggttacatgatgcttttttctcacagctcttaagattctttcctttcatcttgactttagataacataatgactatgtgcctaggtgatgatctttttgtgactaatttctcaggtgttctttgagcttcttgtatttggatgtctagatctctagcaaggctgggtaagttttcctcgattattccttcaaataagttttccaaacttttagatttatcttcttccttgggaacaccaattgttcttagacttggacatttaacgtagccccggacttcttggaggccttgttcatttttttttaattcctttttcttcgtctttgacggattgggttaattcaaaagccatgtctttgagctctgaggttctttcttctgcttgtttgattctattgctgagactttccagtgcattttgaatttctctaaatatgtccttgatttccagatgttgtaactgttttttatttatgctatctatttcactgaagaatttacctttcatatcttgtatcatgtttttgatttcttacattctattcatcagcacatggaacattctccaagatagaccatatgataggccacaaaacaagactcagtaaatttaagaaaattgaaattgtatcaagtgttctctcagaccacagtggaataaaattggaaatcaactccaaaagaaaccctcaaaaccatgcaaatatatagaaattaaataacctgctcttgaatgatcattgggtcaacaatgaaatcaaaatggaaatttaaaaattctttgaactgaacactaatagtgacacacaacctatcaaaacctctgggatacggcaaaagcagtgctaagaggaaagttcatagcattaaatgcctacatcaaaaagtctgaaagagcataaataggcaatctaaggtcacacctcatggaactagaaaatataagaacaatccaaacccaaacccaggagaaaaaaagaaataaccaagatcagcctcccgagtagctgggattacaggcatgcaacaccacacccagctaatttttgtatttttagtagagacggggtttcactatgttggccaggctggtcttgaactcttgacctcaggtgatccgccctcctcggcctttcaaattattgggattacagacatgagccactgtgcccagccaccctactatttcttttctttcaccttctctgtcctatctctgcatccattattctaaggctggattttccaaactggtcctcctacttattttagtctttttctctcctagttcccattttcctgtactgatctttagtaagtttttcaactttatcttccagacctgctgctacataatttctgatgttttaaattctaagagttttttttttttggtgaatattgttctatttatttttaaagcatccttactgactcttggatatcttgaatgcaatagcttgtcttatccccctgatgatattgatgatagttccccactctcaaattgctttatgctgtttgttttaatagctgatctcatgttagagaattttctgtttttttataatgcttggttgcctatttaagagttggggggcatgagtaaaaatggctattgtcaaaaagacagaaaataacagatgctgacaaggatgtggagaaaggggaatgcttgtaccctgttagtggggatgtaaattagtacagcaactacggaaaatggtatggaggttcctcaacaaactgaaaatagaactaccatacgacctagcaatcccactgctgggtatgtacatccaaaagaaaggaaatcagaatactaaagagataactgcattcccatgtttattgcagcaatattcacaatagccaagatgtggaattaacctaagtgtccatcaacagatgaatggataaagacaatgtgggaaaatatacacagtggaattattcactcataaaaaataatgaaatcctgtcatttgcagcaacatggatggaactggagggcattatgttaagtgaaataagccaggcacaaaatgacaaatatcccacgtttatactcatatgtgggaggtagtgctagtatggtggttaccagaggctggaaagggtaggggggaagggaatgaagagattggttaataggtacaaaaatacagttagataaaagaagtaagttccagtgtttgatagactagagttaacaaggatttattgcatgtttcaaaatagctagaagatttggaatgtttctgacacaaagaaatgataaatgtttgaggtgatggatattctaaataacctgatctgatcattacattgtatgcgtttatcaaaatatcacacgtaccccataagtaattacaactattaggtatcaattaaaaaaaagaaggggggacaagaaggctgcttgcagcacatgcatggggcctggtgaccaaggcttcacagtagagaaagaggccaggatttcttaggtattcctctacattggtatcttagtctttcttctaggaggcagattccctagataacatttttctaatttcctacctgggtggggaaaggcctggctctcatccttctaggaaactagtagaacacacacacactctttctcctgtctctcatccttctagaaaactagcgcgcgcgcacacacacacacacacacacacacacacgctttctttctcctgttttccatactgagcccttaagctcaacagtaatttggcatccttcaatcaagaaactcctttgttttactatccccagagaataaactaattggatgggagagggaggggcattcactagagttttaagagcttcttaaaaggttttcaagaaattctgcttactcttccctttgccgccactgaggtactactgcctattgcaaattcctgagttttttaaggcttcagcggtgcaaactgaattggctcttaatttccctttgctggcatagtataaaactgttaacttagtcaccacatctactttctagcatccaaaacagttccccccgccaatggggatttaaattgaaatcacgattttttcacagttcaacagtgcttcggaagagagccaaattagatgtgtctgttcaatccaccaccttcctacaacctgttttagcctctgcaaatgacttaagtccacctgaaaccactcctctgagataatatcttggtgacactgggcatatggtttaaacatgtatgtaatagggatcacaatgccagaactttgtatcacttgactatagtgaaaaatgggcaaaatgatgtatgcccactcgagaggtatgtactatgtcaatttaaggtctgctgctatcttagaggaagataaccatttcactattagtagggcgagttgcttttttatccagaataatgcactggaagatatggctattctctccttgtccctcatttacaagtcggcttttgggttagagatacagtgcacagatttatgcttctccatgacaagtgatcatcaattcattaaaggaaatgtaataaatgatttcagctccttgcattctaccaaagcaatgaagactttatgctgttcatgtgtgtaactgtatacaaatttttaatacaaatattttatgtatcctcccaggcacctggattatgttaacagcaagttagcaggccacatcattcagaagatacgggaaattaatattcttgagaagagaggaaattagacactacctgagagggtggggcatccagctcctaatgaaaaacaacttttgataacacggataacacagtactatcaccttcaaagtgtttggtaaacattaagctttcttttcacccttttaaaggcttaaagcaccacacaagtagtttgcaggcccctttcagctccaaaaatgttgggattctaccatcaactggaaacctgggttctagtcccagctctttccgagatggggtatgtgacctcacacatgatactcagccctgcatgggttctttcttcatctataaaaaacccctatcattctctcacctttgatttcccattgctgacacagaatcaaaagtaaatttcaaaagtaatttattcttttcaacaatttaagtatattttaataccaatgtaaacatttttgatccgggtgtcagaatttagtctgaatacctatcaactgcatggaaatgttacctctaaaagtacccatttttatcaagaaatacagtaattaggtgtgactttaatgtgaattaaaatttaatgtacatgtactttcatctcatattgtcagataatgtaagactcttatctaaatcagtttttttttttaaatttagatttaaaactttaatgaagacttgttcggtgggtgtgaggtacagaatcttgcaattttttttttagcaccgataagcagtacaatattgcaatttttaaaatatctcaaatgaagatgtcatctgtgagataaactgatttttgtaaaatatttcattatttgccatattgtttggtcataaagtgagcttcattatactgcagcaactgaatttttctaccatatagaggcacgttttaatataccacattggtaattaaaatgatctcacgctaaaggaaagaaggggcctttcacattctactcaaaatcatcatatatttatgaggcaggatttatgtatgttctgcatgccttgatctattgtgcctagattcatatcctagcttttatcatgatctggctcaggcaagccatttaactggggggtcagtggcctcactttaaatgtgttgtgaagataaaatgaaatcaaaagtattttaaaaagaaaatagaaaactaatataccaaatattgctgatgtggcgaattagctcaattatttaagtccctacgtagggagaatgggctgaggccctatttattttcattccatgaatttctctctgaattccatacttgtctttcacagagccaaagaggaccatggctacctatgcattagtccacataatttacctctaccgaaaattacttccttattgatctttctcaggctttgctttcaaccggaccaaatatctgtcataaagtaagactcagacatattctacgtttatgattactattaagcttttgcaatcgtgaggcaacatcaagaacagaaacctatctgaaaggtttccaatcgcattagcggattggaatcactggtctgatgactctctaaggctacaggtgggaactgcccatacccggtggggaccaagctgatgaagtctgcaattctcaaaagcacagatcatgacatgcactctccgtgaggggtcattccttaaaagtctgctcactacgaaagctcctggaaatgtcgggcaggtgcttagggaaagaatgagaaatccctagtcagtcacaagtctttgtagtgttactgctacagccgatgcaggaaagtggctagggagggggtggtgccggctttcaaaggagtactcagaatctctacacgatgccagagctggtctctggcagggaaggctgtgatggccttgactctggtcaagtgggtttttactcagggaagggtgaaacagaagtggctctgcgaggtgccaaaataatcccctttatggccacgcaagtctgcaacatgcggcactcggacagtctcttcccaataccctcccttaacgagagcgcgcgcccgcgggggcccattaccatcctgcaggatgagggtgggctgcaccgcctgtacccggaactgtctggccctccagccggggctgggcgtccgcaccacctcgctatcggaaagccaggtcacggtctcaaagttgtccccgcgagccagcgcctcggcctcggcgtggtgcactgccacgcggtcgaactggtagaggccgccggagtggtcgaagtgcacgtgggtggccacggcaagcagtggccggcgcgccgcgtcctctttggcctctcggtcctgcaagaggccggaggagtacaggtactccgggaggctgcgcagccccaggcctgtatcgatcaccacgtcctgctcggagccgcgcaccagccagatgttggcacggttgcccgactcgtagaaacgttcttgaatccagaagataccatcgcctagagacttgtgggcgtaccactcgagcgccgacatgctgggcaggggtgcagccaggcggggtgagtgtgggcgtgcgagtctcccacaggctgtccacacacagggcactgcggctgtgtgaagcggtctgcctgcagccagggaggaggcgtagagcgaggcgggggcgtgggatgcgggggtcggaataggaggaggaaggacgcagaccgacgctgcccgtagcgtgcgctcccgcacccttccgccaggtcggcagcaagcagaggctgcgccaccagcacgggggcgcaggagctaccgcagcctcggcagccgcaccacgagagagctttaacgcaggggccactgcagcagaatggagactcaggtggcgaccgtttcgccaccccgggcgtgtgacagcagaggcccgcagtgagggtgggaagagctagaaccgcccacccactggctctgcagggcgcgcactcccagctggcgcagaaagtgtggggcctcgcgggttg

SEQ ID NO: 1553 - DNA, 39690 bp, Homo sapiens
cactccgcggtcctggtgccgcgtgcaggtcggtgcgcgcttctcccgaggtggaacgggcggcagtcaagcgccggcgttctctgccgtcaccctttccttgccggccggcacttcggctgcagagttttgcccacgcttcgagacttagggagcaggtaaccgaggaagcaatcgaagacttgggaggggtggtgagggtagaggggaattaaaggggcacgtggaaaaggtgaggggaagtcaggggtagagattcattaaagcgcctctggtttgaggggcgtttggagatagcttggtacctcccctccttgtcctgctcccttcagaattttttaagtccaatttccagatcttacctagtctctactcctaggactgtttgcagtgagttagaagggtatttatgctcttactgatagtaggttattttcaaaatccatggctttatgattttttaggcactagtcattgccgcagattgcagctgaggaccgactattcagtatctgttttcgtaactgttggcactttatatcgtagggaagggagttgttaatatggtttgtcttttcttataaaaaataaaattctatatccaccctttttttaattttattattatttatttatttatttatttattttggtttgtctgcccttggaagagagtaaagcgagttggtagaaaggctcaaataaagaaaaggagcacctggtgaggacgggaaaagtgaataatgactgggtgtggccccgccagccacataaatcatccgctctgttaacatcaggtcactgtctccactccccgcttcccagctattgaaatatctatttagggtttttgtttgtttgtttgttttttgagacagagtctctgttgcccagtctggagtgcggtggcgcgatctcgtctcactgcatcctccgcctcctgggttctagcgattctcctgcttcagcctcccgaggagctgaggttacaggcgcctgccactgcacccggctaattttgtatttttaatagaaacggggtttcaccatgttggccaggctggtcttgaactcctgacctcaaatgatccgcctgcctcggcctcccaaagtgctgggattacaggcgtgagccactacacccggccagaagcatctatttaggcttcagaaattcccttgagaacttaactaacctcttaagttagtcaggaaaaatgataaagagactcatgagacagcattacaaaagaattatgataacctttactgtgacaactactaataagccttcatggaaggagaggtgtacgctcctttcctaccctcctaaagtctttggtgggcatgcagcttttctaaatactttgctaatcttcacagagattattcggttactcagctgggggctttccttatgcacaagtcgctgagctgggtaattcatgaacagagttgtgtaaaaaggtcataatctggattctcaggagtttgagggaagataatgtctgtacacaattacttgcaaaataaagcattacggggtatgtaccacagaggaagtaaaagctagattcagtaagaatacaggtggaagggattcgtgaggagtggcttttgagctggccttaaaagactacttttagggcattctcagcagagtaatatagggccctcagtagtctgggtactttttctctaggcagaagcaagccactagtggtgaaatggagtgatatctctaccaggccatgagctcagcaataatttatccaataatcattggccttttgctaggctttcgttagtaatggggacataaaaaggagaataagtttccaaggagaccttcacacttccaggtccccctgcctgcatcccacatctcactggatatccttttttaattctctacatggctctttgccttacttttgtcaggcttatgctcaggtatcaccaagtaagagaggacttcttcagccaccctttccacaatagcatccatgtttcctgtctttatttttcttatcatttcctgacatttcctataaaatatattttgtcagtttcttaccctagactatgagcttcatgagaggagaaattttgttttgttcactactgtattcccaattcatagaagacggcctgacgatgagggtgcttaataaatacttgattggattgaagaggctccctgggagacagataagagctgacagttacaacatgattgtaaaaagggcttaaaagcagagtagtacttgggaaacacagagaagggagaggcctacctccatgtagggtggaagaaattgtcatggagaaagtgtcatttgcatggcatctgaaaagaacctggggcttaagtggatgtggcaggaagggcactccaggcatgcaatggttgacttggccacagcgtggggtgcctgtggtgagaggcagaaagactccaaagctctgttaaggagagtcacatgtcaagatttgtattccagaaagataccctagactgcagagtggattgaaagggagaatccggccacaggaagtttatttgttctgttttagaggtccaggtgagagatgagagggtctgaactgaagcagaggtggaagaaacagaacatgggagagagaacagagctggtaaacctctactattagatgaggggttggaagtagacaggtcagaatacctatcctgattgtagcaatttaggggtcattcatcaggaataataccgtgacttgactttcactgcctcctctagcttctatgtctgcttctatctgtttgtgcatttattcatggagctgacgttgttactggtggagggtgtccaggttcttggcgtcttgaacaaagaattggacgaaacgcgcaaagcaaagaaagaatgaagcaacaaaagcagatacttactgaaaatgaaagtacactccagtgaggcagtgggtggagcatatgggctcaagggtccccttacagaatttgtgggggtttaaataccctctaggggtttccatttagttacttggtgtacaccctatgtaaatgaagaggatgaagtaaagttacaaagtcatttacttggcatatgccctatggagaggatatttcctgtcatagccgtaatgtgaattggccttttgttccctgcctccagaccctattttcctgcctcagtgtggacaaggaactgtgtaagacgtggaggacaagacatttcagttacctcataactcataaaatgttagaactaggaggaatttcagagattagctcagcatctgctaggacgttgttttggtagttgattaaaattgacttttttatttcagctcttggatgcttaaactacacccattttcaaacctctcagaacaattctgaatagaaattttcaggagacatcctgaaatggaaggggcaatgctactgattttacatttttaattgagtctgttttgcagttattaattcacttcattgaataaagacctccctgggattaaaaaagtcttctaaccagcctagacctatgcttcctgaagtgtaatgcaaatggaagaacagtggaaaggtaaagcagtcctgcttttgttaggaattagctttgcgtctttaggtaatcaagtaaccgcttagggtgttgctttcctcttctgtaaaatgggaggtttaatctgcgtggttctttttttttttttttttgagagggagcctcactctgtcgcctaggctggagtgcagcggcgcaagcaacctccacctcccgggttcaagtgattctcctgcctcagcctcccgagtagctgggactacaggcgcgtgccaccatgtccagctaagcctgtagtcccagcactttgggaggccgaggagggcagatcacgaggtcaagagatcaagaccatcctggccaacatggtgaaaccctgtctctactaaaaatgcagtggttcttaatttgggttgcacactgtaatctcctgggatgctttaaaaagtcctgatgcttaaatggtacctccagagcttctgattttattgttctggggtgaatcctgggttttcttttctttaaaacctctctcagtgattccaatgtgcagccaggtcccactcaaagaaagggggaaaaaagccttaataatgggctgactgaattgtccttctgtgggtagatttgctcatcaaatcacagtgcacaaatagggtaagcttgacattaattgtggagctgttgctatataggaagcactatggtagacagtagggaggataaaatccctgcttaacacagaaccaacaaacagccaggcgcggtggctcatgcctgtaatcccagcactttgggaggctgaggcaggcacatcacctaaggtcagaagttcaagaccagccttgccaacatggtgaaacccccatctttactaaaaatacaaaaattagccgggcttggtggcaggcaccagtaatcccagctactctggaggctgaggcaggagaattgcttgaacccgggaggcggaggttgcagtgagccgagatcgcaccaatgcactccagcctgggcgacagagcaagagtccatctcgggaaaaaacaaacaaacaacaaacgaaaaacataggtgaaactcctcccctttggaaaagatcaatttcccaaaagtggtattctatttctttgaaaattgacaagtgtggcaacatatatcacctgaaattttttttttttaatctgtgttttaacaggaggatctttccaagagcaatgtgggatgaagtggttgttgtggttgctgagggacttaaactggcttttttggtgaaaagggatgtagcaagtcagggaggcagagggagtaagttgcagtggaaagactggtattcaagacatgactatagtgagtcaggagaatagggtgcaaccatcttaaaagggctctgagtaaatagggagtttggatttaattcagttagccaagagggaagatgaggagagtagcagaatcaaaactgtgctttaggatgagtaatgtggatccataaattaaacaggaagaacaagggataccacaaagtttgcagttaatcagaagtgaggtgaaaaaggactgagctggattatggtagagaaattgcaaagaaagtgacatttagaaagaatatgattgatcagtgctctctggctcctagcacagtgcctggaatgctcaatattggttgaatgaatgactcaatgaaattgggccatatgaagtagagaaacatttggagcatgaggaaatatagaaagcactaaaactcctttattctagagtttggtgtattgaaaaaggaatgagacagtggttaactcaaccacagtctcacttgtaggctgtttctttcatgatacatttaccaggatccagggactctctctgagctctgcaggagaagaaaatgaatttatcagctcctctgtgtacagggtaatggattcatgaaaactaacttaaagagatgggtttgtaggctggaatgccacataattattaaatgtgtcaaaagctaggaagtttttctggcaagggtggtaccttcgctaatgatagcaattcatacacccaaagattgcttgataaaaatggaaatttagagtcaatagagtttgttatttttcaagagctgttccatgaagcagtgctagctggtgtcctctttttttagggtgagttttccaaacttttccagggcccacctccaaagattctggtatggtaggtttgagggcttgaagaaagcctaggactctatgtttagcaggtcctccagttaattttcatgatgaggaaagtctggtaaactttacctggaattgtttttaatctttaagtagtggcaaatcctggactggagtgcagcccagtggttttgagtaggcctagtgggctcttgcagttgtttcttagagtgaaaggtgtgaccccttctgctcagcagttttgatacttgggagatacgctttctctaggctcagcatatgttttagtgactcagcaattgaaacaagtccatttggatattttcctgcttttttaatgtagagagatgtaataagctgggctattaaaataaatatagttcctgtatgaactttatttcaaggtaactaaataatagataagagaaattgatccctggtggaattccaattaataaaacagaaagaaagataaaatttgtataccaccattttgcaattcataatggaaaaattgatctagattgtgatcatcagtgactgctaaaatcattaggtgaaaactgatggacactttatacttaatgaaatagaccaacacctgaacccatgaccagcctgatcaataccaagagggagactttatgttcatcttgatgtaatagagaaggaaagagagagcatcccttttcagtattcttgaaaaaaaaaaaaaaatcaaacccaaatctaaacctctagtttacctgtttattggaaatacacccagagaatacaggaatatgttaaatcacatctcaggtataaatcagtcaaatccagaatatgggaaattatatagctttgctactttcaaagtatggtttacaaaccagttgatgtctcctgagaccttgataaaaattcagattctcagtttctgtctgcagccaactgattcaaaatctgccttttaacaagattcctaggtaattctcttgtacctaaagtttaagaagcattgtatagggcactgacctagtttcttagacaaatagaaagaaaaaaaaatgggaaaaccattacagtttaaaagaaagttaaatgtcatgtattttttatatcttgatttgaacaaattaactgtaaaaacatttatgtgataactaagaaatgtgaatgttagttctatataagatgatggtatagagttattgttaaaattgtagatgcaatgttattgtgatttttttaaaagcccttaactctgagagaggatacatactgaagagtttaaaataatctgaagcatgggagtagaaaagtatagttaaagtacaatagtcatatacggataattttgaagctgagtagtgggtatatggagatttaatatactgacttttgtgcatgtaagtatagtaaatgtaagtattagtaaaccaaaaaaggcatagacttgtagtttaaaacgacaacattaaagatgacaaatcaacttttagtgttcaagcagttatgaaggaaaactcaaatatggaggcctgcagggataaatttacgaaatgaataatgtaaaactatgaaacccaaagggagggattgaaaccaactttgcaaaagtcataactgagaaaattatgacagtgaaagatatcagacctaattgatcccatcttgcttctaacctctgaactgtccttgttcattcttgggcgtgaaaccacctttgcaaaattatgactgagacagtgaaagagatctaacctaactgtgactccatcttgcttctaacctttaagctgtccttgttcattcctgggcataggctgaactaactttgggaggaaattagtttatggtttgaaacaaagacgataacagactttcccaaaacaaacctcctccttgcctggggactagactgccattgtcggactaagaaattattcacaagattagaaattatagtttcggagtcatgcagctggaggctacaagattctgaccctccctaaaccactccaaagatcagtgcttgagatattttgcagaccctgcacttgatggatcagggggcactacccagatcgattaactgactcttctgatcttgtggcccccacccaggaactgactcagcagaagagaacagctttgacttcctatgatttcatccccgagccaacctatctgcgcttccagttcactggccccctacccaccaaattaactttaaaatctctgatctctggctgggcgcagtggctcacaactataatcccagaactttgggaggccaaggcgggtggatcacctgaagttgggagttcaagaccagcctgaccaacatggagaaaccccgtctctactaaaaatacaaaattagacaggcatggtggcgcacgcctgtaatctcaactactcgggaggctgaggcaggagaattgcttgaacccgggaggcggaggttgcagtcagcggagaccatgccattgcactccagcctgggcaacaagaccgaaactcctccgtctcaaaaaaaaaaaaaaaaaaaaatctctgatctccgagttttcggggaaactgatttaaggaataataaaactccggtctcccgcacagccagctctgtgtgaattactctttctgtattgcaattcccctgtcttgataaatcagctctgtccagacagcaggcagggtgaacgccttgggcagttacaaaatcatatctgaaaatgttctcagtatcatagccattatgtcaaatcaaatgccgtgcattctacttgagtaattcacagaaaacaggaaacgatgtttcattacataaagatgttgaatatatgatttgcttctggggccttaaatgtagaaggacattaaaattggccatcattggcagggtgccattggccgggcacggtggctcatgcctataatcctagcactttggaaggccgaggcaggcagatcacttgaggtcaggagtttgagaccaacctggccaacatggtgaaaccccgtctctactaaaaaaataagccgggcatggtggtgcgcgcctataatcccagctacttaggaggctgagacaggagaattgcttaagtgagggagggaggttgcagtgaaaaaaataaataaataaaatatttaaaaaattaaattggctgtctaaaagtgcaatgccttgttactgctattccttgcaaatgaattaaaacttggactgccacatcctgagtgttacatagatttacagcaattatagttatcttacctttaaggcaaatatttttaagttgctaaggctaattttataattttaaacctcaaagatgagatctatgaagtccttgattctacatgtgtattttaactcaactactccttagtagctaagacttccaccaaaacagttctaccaatactcttaacatttgctgtgtattagaatcacctgggaagcttctaaaactgactcttgcccaatcctcaccccaagagatctggattgattggttcagttcagtgattcacagaacttagcatacatagaattatctggaaggcttcttaaaacaccagtgctgggcccactcacagtttcttttttctttaggtctgtggtggaactcacagtttgcatttctaccaagttctgagtgatgctgctgcagacagcactctttgagaaccattgctctagtttcttaagccacccaagtcattctaatggcagccagggttgagaactgagagccgcttgctttgtagtgttggccctgtgataaagtgagctgggagttttcagccttttggtccaaaatagtgcctatattcaaattgtagacagtaaaattgatataaagacgtagcaccttgttggttttacgtagtgttccttcaccattaatgtggtagactaagaagggtaacattaatgaccaggcaagaaaccctggtgaagagtagagcagctgtgtgaagtactgtggcttgcataattttgcaaggagggcaagtgagtagattcagaaatgagactgagctgatggggccaaaaccaatgccactcctctgacttcctccgagtggtccaggggacataccatttctctcttgggttcaaggggttaaatgaggctcagtattatcagcagggaaagaaatgtaaagaatgtgcattataatcatcactacagttgaatgcagacttctattgaaagaactctagcgtagggatccctgtttatacattggcagctcagttctcatagtataatcagaggattcaaacgttcaatacaacttgcatatgtgatatcactcctgtctccaaaattgaagagtacaggtttatcataactttaatgattttaactgtttttctctgaattttttttttcttggacaggcatctttcgagtctcattgatcccattcccatttctagaaggaagacattggactagatctcagggattcttccaaacactcacatgctaagataaatcatttaaagtcttaaagtatatatgactaatgatagtttttatgttgacatgaaagatttcttctcctcatcagcctggtcttgtcttgtgtccactttttatgtacattacatctgagatcctactgccaaaccacagaagggtgggtgaattgcgtggactggatgtggggcagtagtgggtgagggggttgaagccatcattatcttacctgccagaggtgtgtgagtgtgagcagttcaacagtcagttgtcacatgtttatttgtgtacatgttttgctttccaaaagtattttaagtcaactgtgctacttaaggggtgcagttttatattttgctttaaagtgttgatttcttttttatatgtgatccagtaaatcgtaatcattaatagtgcctttcagaatttgcccactcatctggtataactggttctgatggctgggaataaaggaagaggacgtgctgcttatacctttaatattgaggctgttggatttagcaaaggtgaaaagttacctgatgtagtgttgaaaccacccccactatttcctgtaagtatatgaacagttgaattctcatagtgtgttttttcatttttcagagaatattaaaattctatatgggactggatgtatgattatagcatcctcaagtataagaaagtaaaggagagtgtgtttcacttacctttaaatattttcatgatctgctttcttaaaatatagaaaacaaaactgtatacatctttccatgaatatatttagtactatgtgaaccagtaaagaattagttttcaattcttacaacttgtattggtgttattgataaattccaatatgaaaataatagttttaaaagtcattaggttttataatggttctcagttcgcaccctatcacaccttcacttaatgattttcttatcttgtatctatagaatttaagtttgctccttagtataccacttgactttttcccccactgaactttttttgcttattttagtgttgttttaaaatttagtgagtatgctgcaagcttaatttccataatatataatgttttcgctttatgtttagtttagaatgtatccagggatctagatgtatcacacaaggagtctctgcgttttgctcttggtattttacctttttgatattcagcgcagcataaaaacaaagacaaatatctcaggtattggcataatgtcactttacagtgcttttaaaaacaagctcttttccatgtgtgaggagattacctctaaacactggggatgttagtacatagtatttctttatacttggaataaaattaaaattccttactactgggtaaaaggctctgcccgatctctccgttctgatgtctctctgaccctttttctaccactgtcctcattccccagctacgcaggtctccttgggtcctcaggcctttggccctgctggttctctgctggaaccatctcttctctttgcatggatggctccctgattttatcccaatctctactcaaatgtgacctccccaagaggccaggcatgctcaccctgcatagattccacctccatcctccatgcactgtcagtcatttttcctttacccaccttcatttatttttatgtcatttgtcactatgtgaaattgtatgtcacctcatttgtttactaatttgttgtatgttgctctcctagaatgtaagttccctgtgggcagggactttgacttatttatcatggtatcctccatagtctaaacatgttgagtactcaataagtagttgcagcatgaatgtatacattcctaatcaaattttgaaaatgtaccttatctttatcctctgaaatcagaaatgtctttactaggtaccctggagatccacttgttaatgaacatatttgtgtaaatatatacacacatacaaacgcgtatttgtgtatatgtatgtgtgtgtataatttttaaaacttgaaatgcagcttcaaactccatcttgccatttattcacttctcaatttcttcactgtaaaaggataaatattggtagccctttcaatgagatactggatgttggatattgagtatattgtagtcatagcaaccacttactaaatgatagctgctgcttttttatttatttatttttttccaataataccaccactagctgaggttaataagaacctaaagcagctgctctcatttgggtaccttagtttttctttttttttttggtacattaatttttttttttttttttttttttttttttgtgagacggactctagctctgtcacccaggctggagtacagtggcgcgatcttggctcactgcaagctccgcctcccgggttcacaccattctcctgcctcagcctcccgagtagctgggaatacaggtgcccgccaccatgcccggctaattttttgtatttttaatggagacagggtttcaccatgttacccaggatggtctcgatctcctgacctcgtgatccacctgcctcggccttccaaagtgctgggattacaggcgtgagccaccatgcacggcctggtactttaatttttaaagtagataatcacataggtcaacagactgtttggcaaaatgattattggtgtagttttcagggccaataggaaaattacgcatctttcttacctctaatagaagagcaaagtaggaaatgggttaacaggttaaatagactacagaagttcatcttttaagttggttgtaaaacttagtgcctgtaaaacatagtatttcaataaaactgctgttttctataatacagataaaagggatattaaaatacataattgatttgaaaaaaatctttgtctcttaatttaaacaggatacagattataaaccagtgccactgaaaacaggagaaggtgaagaatatatgctggctttgaaacaggagttgagagaaacaatgaaaagaatgccttattttattgaaacacctgaagaaagacaaggtactgtattggagtctttgattatgtggcttaatgtatacagatgaaacagtgtttaagcacaagatatataatcatttaatgttgattgattcgattcaataaaaaattatcaactactttgaaaaagctatttatgttgctttaacagaaaaaatactttaaactttttgatattttatttttagaaatatctttcattataattttatatgttcagtgaaaattatgaaaaacaggaaaattttaaaaagtaaaaattacccattcttatgtctagagaaccactattaatattttagtatatattccagattttttcttatgcatgtatattctctttacaaaattagattcacattactttgtatcttccttttttcactcagtagcatattagcattttcacatatccttattattcttggaaaacatgacttttaatgactggtagtctactctgtggatatattattattaactgtaactaatttcctgctttttaaatattattttcagttttttgcttgtatatataatgccgtgattgttatcattatacataaacctttatgcatgtctctgattatttaatatttaggttaaaaaaatttttgagacttaattttgtttggtttatcatttaggtgtttgatatgatgtaaaatatgtattcattggtgctgcttagggaagaaaggaaacattatagttggagagggctcaacagtctcaggctagaagtgggaagtggttttataggaaaggaaaccattcctgagtagctgtttagcacagcagtactatattgatttttcactttctgcccttgattgttgagattagagagactgatatcatctttgagttctcaaaacaacatcattaaaacatgagaaattcgtagtgtcatctcattccattcgtattaaaaatgcattccatttttcctctctctctagaatagtttgaattggctgagtcaaaaaaggaagccttatgtaatgatcttagcatgtgcttataattataggaagcattttagacaaattcatttaattctcaaaacatagctgctttaagttatataatggtttgataagaaatattttatctcaaaaatacttaattttttttttttttttttggaaatgggatggagtctcactcttgtcacccaggctggagtgtagtggtacaatctcggctcactgcaacctccgcttcctgggttcaagtgattctcacatctcagcctcctgagtagctggaattgcagacgcacagcaccatgcccggctaatttttgtatttttaatagagatgtttcaccatgttggctaggctggtcttgaactcctgacctcaagtggtctgcccatctcagccacccaaagtgctgggattacagacagacgtgagccaccatgcccggcctaatactgaaatttttaactctcatgatgatgttgcatgctttcgtctgtttgagttctaaaataaaacttttcattttaaagattttaaaaagtaagaccaaatgaactaatcagtattcattcttattagaaaaaatagtaatgcagggtatactttagtgcttttaaaattgatcttttctctatgacacagatgcacttaggtgaatgtggttgttattaaagcacatgtctaatttaaaagtatgtcaaatcagactggacacggtggcttactcttgtaatcctagcacattgggaggctgaggcaagcagatcacctgaggtcaggagttcgagatcagcctggccaacatgggaaaaccctgtctctattaaaaatacaaaagttagccaggcatggtggtgcattcctgtaatcccagctactcaggaagctgaagcaggagaattgcttgaacccgagaggtggaggttgcagtgaactgagattatgtcactgcactgcagcctgggtgacagagtgagactctgtctcaaaaaaaaaaagtatatcatataattaaagcatttatgtgagtgttttagacagggatattaaaaacataattttgttgttggtctatgggagtggttggctagtacttggattaaggggcactttatctttgataactatgcaataaagtatttcaaaatataagggttttttttttttttttgcttttatttctttcaggggaaaactcttgtatagaaatttccaaattgatacaagtacattctccctgagatcttcatgtttacttctgtctttttttattttattgttttatattttattttggagatgaggtctcgctctgtcacccaggctggagtgcagtgggacaatcataactcactgcagcttccaaactcctgggctcaagtgatcctcccacctcagcctcttgagtagctgggactacaggcgcacacaccatgcccggctaacttttaatttttttttttttttttgtagagacgggagtcttgcttttttgctcacactggtctcacattcctggcttcaagtgatcctcccatctcggccttccaaagtgctgaaattacaggcatgagccaccgcacccagcttacctctgtttcctgatatagtgtttaaaaaacacacgcatgttaaaaataaaggtttttctataaaatatatacatttatatgtgcctatataggtttatataatatgtgtatatatgtgcatacataaatttatataatatccatgctatgagtgaaaaagaattggccagactgaagagaacgaccctactgtcagagagaatcatattccggatagagatgttgcatgactgtaccttcgccaggtgcatcacttaccacctgtgtgctttaggaaacagagacttaagggctactgtaaagaactaaatcactagacactaggacagacaaatagggtgagagatctcaagacttcctgatagtcaagtggctggtggctcagggcattgagatcagtcctcaagaactgatggcatggaatgaacatatttcatgttgcgatgtcttcaaagtttgtttttaatgttttcaggtaggattatagaaatgattagtattttctttgcatcgaaatttgttatttatataataaaggaaaaacaccaatgaatattattttagtgaattttagctataagagatcgtctagtctagtggttcccagctcaggttcctgaaccacagggtcctctgaagtagaaacatgattctgacagtggtgatagtgtcataagtcattttcagaacctcaaagcttaatggaaattatacatttacttaaatacatccacaggtctgttactgaataaatggaatttggcttactaattcttgatataccatcagtgtccatgagacccaatataaatttttgacgttttttttttttggagcagttcttattgtttgtatgattaatattgataacttttattcttgcatagaggttttctaaagaagaaacagacattttcttaaaaaggaaaactcattttatcatagaataccatatcagcccattggacccttttatatatctaaaataattatggaatctgagtgatcttattttttctctatattgaaataccttgctactttatcatcatacatattatctcatcactattcatcagacattccccactatgctgaaaaaaagaataaatttaaaaaatgggagaatgatgaaattgactgtgcaattcaaataaattatcactattatgtcatcatatagttttcctatggtgttgtccaaagcattacatctgttttttaagaagttataaagtcttcagagactcttatgtttgtagttgctctgttttaattttcatttaatacaattgaaaatttcaaaaatttttaattttttgctcataatgtctaaaattgacagaaaaacatgttccacaattcttagacgaatcagaagtcaaatgcaaagagatagatagctctctggatgctcatgatgatgatgaaattgattgtataagcaaaatctcagactgtgagtcttcagatgacagtgtcttcaatgaattttctcaaattcaagaatcaatgagtaaacactgtatctccaagaattaaaaaggaattatggtggccttctacagtcaatctttgaaaaagaactcatcatgtaatactttgtaacaaaaacctggaacatcctgtttgctaaaatgagacgatcatttttgttctatgatatttgtgcaccaaaattaatttgatgtgttttgtaactgacaaatgctgaacataaaggcaaagacaacaatgattgaaaggaaattgattatatagacatgaaattgttttctggattgattgtgttaactggtgattataaatttaataatgaaaatattttgcaagtatagagcaaagaagatggctgggccatcctctcttcaatagaagtatgagacatcagccgggcgcagtggctcacccctgtaatcccagcactttgggagtctgaggcaggtggatcacgaggtcaggagatcaagaccatcctggctaacatggtgaaaccccgtctctactaaaaatacaaaaaattagccaggcgtggtagagggcacctgtactcccagctactcgggagactgaggcaggagagtggagtcaacctgggagtgagccgagattgtgccactgcactccagcctgggcaagactccgcctcaaaaaaaaaaaaaaaaagtatgagacatcaaagttttttaaagtattgcattttggatatgtaagtacaagaagaagaattggaagtagtgataagctagattctactagaaatgcatttataatctgaaattatttagatgatacacatatgagaaaaccagaggaaattataagttagaacctattaaagatgtctttggaatctgggatcaggacgtacagaaggcatatattctaggtttgtatgtggcagccgatgcacagaaaactgcattcaaatgactttgcccattttggttaaatttaccttcaaaatcagtaaaacatgtaatataaatttggatttgctatacttaattgcttagtaaaatctccaataactttatttatttatttttatttgagacaggatctcgttctgtcacccaggctggaatgcagtggcataatctcagctcactgcagcctccacctcccaggctcaagtgatcctcccaccgtagcctcccaagtagctggaaccactggcatgagctaccatgcccagctaatttttgcattttttgtagagatgggggtttcaccatgttgctcaggctggtctcgaactcctggactcaagggatccagctgccttggcctcccaaagtgctgggattacatcctgagccactgtgttgggcctagttttattgatttttaagtaacagctttactgagacataatccactatataaaatttactttttaaagtgtacaattcagtgacttttaatatagccacagagttgtgcaatcaacaccactatttaattttttttttttttttttttttttttttttttttttttttttttttttgagacaagagtcttgctctgttacccaggctggaatgcagtggcattatctcagttcactgcaacctccacctcctggattcaagtgattctcttgccgcagtctcccaagtagctgggattacaggcacgtgccaccacacatggctaatttttttgtgtttttagtatagatggggtttcaccatgttggcccggctggtcttgaactcctgacctattagcaatctacctgccccagcctctcaaagtgctgggattacaggtgtgagccactgtgcccagccactatctaattttttagatgcttttcatcatctagaaaagaaattctgtaccctttagtagtcattccctactctccctccttccaacccatggcaccagaaatctgctttctgtctctagagattccatgtcatataaatggaatgatgtaacatgtgtctttggcttctttcacttgccataatgttttcaaggttcattcatggcttagtacatatgagtgcttcattcctttttatggctgaataatattccactgtatggatatatgccacattttgtttatccactcatcacttgatgggcatttgggtcagttcacttttgggattacatgagttatcttgtcataaacattcatgtacatgttttatgtgaagacatgttttcatttatattgggtatatacataggatcatatggtaactctgtatttcacattttgaggaactgccaaacagttttctaaagtggccacccgattttacattcccatcaataatgtatgagagttccaatttttccatatccttgccaacatttcttattttttttttattctagccatcctagtggttgtaacacagtatctcattgtggttttgatttgaatttccgtaatgattggtgatgttggacatcttttcatgctttttgtccatttttgtatcttctttagagaattgtctattcaaatcctttacctctttttaattgggttccaataattggttttcaatatctgttcttttatctgttatcttttttatttattctctgtatttcattatttgaaattaacttaaaaatattttaaaatataaaaagtggtctactgtacccagagaaaaagggtaaaaactgtttttttccggtatactgagggttaaaattatttaaaatatggaaactgttttggagaaaattcttaaaaagaagtcattgtgttacaaattctaggaatctctcatttgtgctgacttcgttttatagattaaaaacttggcaagattagttaaaacattttacctgaagtcaaacagttaaaatacctagaaaaacctgatctcttggtctctgatctactacttattttggttatctttctctaatacgtggttgtattatttggaagcatatacttgacatagaagaaaaatcagtatatatttggtccttgatttttatccattcatctttagtattaccttccctttttcatgcctaactcctgaactactttttatgatgaacatggcttcaagcttttgtgtgatagtgttgctttccaacttgtgctgctggaaaagagtttgtgccctccttaagggtgtttcttgtgataaggtggactagtctgaatcaagagccgcagttatggctttactggttttggcaagctcagagggttcctgcagagttttcagcaattggcatgtagggcttgcagcttgctcatttatgcctcagatcagtaacccctcaccaagtccatccttgcctacccctaccctttttcccattctcttatgtacaaaggtgggaaactccctgtatgtaaaattaaaaatgttgtctgttgttttcaataatcttaaaggaatggcttaagttcagggttactgttgattttcctaatgagttctttattcttttttcccctagatattgaaaggtatagtaaaagatacatgaaggtatacaaggaagaatggataccaggtaactacaaaacacacaatatgaaaacagtttttaaaggctgtctctctcacctcatgttttttttttagaataagttttctatttttaccataggaaaactgagtctggttcttttattgtgattaattagtaatctgttagaaactaaggtgaaaagatttttatgctaaaacaaggaagagttgaagtgcttttgtggaagttcttaaaatatatatatatgtatattttattttattttatttatttttttgagatggagtcttgctctgtcgcccaggctggagtgcagtggcacgatatcggctcattgcaagctccacctccagggatcatgccattctcctgcctcagcctcccgagtagctgggactacaggcccccgccaccatgcccagctaattttttgtatttttagtagagacggagtttcaccgtgttcgccagaatggtcttgatctgacctcatgatccgcccgcctcagcctcccaaagtgctgggattacaggcatgagccaacaccccccacccttaatatacattttttacaaaaataggacaggccaaacaaaccctttgaattttccaatttaattagccacaatcacaattttaatttgtaataccagaaagcacaaatactatgctcctgagcaattttagagcatttgaagagaaagcaaaaatctcgttttaaagatattttaagccaagctcatggatcttcctttcttttaagcagacatagactagttttagttgttaggcttcttcaaaagaaccatatccaaaaagaagctttaccttgggtatggacaagttagaagggtctgtaaaggagatctcatcccactcattcattttgcaaataaaaacagttgtcatagaaataaagtgacctgtcaggccatgtggccaatactgttagaacccaggtcttctcattttaattcacattctttttatgtctctgtccttggtcttttatggaaactccccttatgtaaaaacatagatggcattaacagccttatcattttcacagattatagtactatcttttcagtgttggtaaggttggggcaccctggaaacaacttaggtctctcatttcttccgtttcattagtattcatctctcaaatgattctctacatattccgtcatgatctaaaatgaatagcttataaaaactaaaatatattcaaagcaaaatttatttttcaggtaaaatgacttgagatttaaatgctttgtaaaaatgctccaaattttctttaaaagcaggcaatatttttaaatcaacttttatgttgcttccatttcctgtttaactctatgcttaaaaattaaaagaaagtgacacattagaggaattatttagctaatacaagcaaaattatttattggaggagatttgtttttgacagctatttatatttttaattttaaagttttcagatattacaattgtttatttcattttgcatgttttgggattatggtaacatccttttgaaaaaaaaaatttgttgcataagaaatatatcaactacagaatatatcaactacagaaaacttatgaaatataaagtggtcaaataaatataaataatacttaagaaaaactgtcataattccaacacccacaaataattaccataaggtttccttcaccaaaaattttatagcactatttcagagctattgtaataaattttctttataggagaaaatatatcattgtctgtaatatttggatttggtttttatatgtttcaagctaaatttgtaaagtcagatactaaggcactttattgtcattttctggacaactgttgtgtccttcaaatagttatgttcaatgccacaaattcctagaggaaactgcaattttttattttttattttatgtacagattggagaagacttccaagagagatgatgccaagaaataaatgtaaaaaaggtacattgactaatataatagtaattcaggtaggaaaaggttatttcttacattctgttaatatggatttgtcaacccaaagttatactcactgttcttaatgcttttcttattttgagccagacaagggatctcatgcctgtaatctcagcatttcgggaggctgaggtgggaggatcacttgagcccaggagtttgagaccagcctgggcaacatagtgagaacttgtctctacaaaaagttaaaacaagtattagccaagtgtggtggcatgcacctgtagtcccagctacttgggggtctaaggtgggaggatcacttgagccaaagaggcagaggctgcaattagcctaaactgcaccactgcacttaagcctggaagacagagcaagaccctgacactctgtctaggacactgactctctccctctctctgtccccccatgtatgtgtgtgtgtgtgtatatatatgcattataactattttgctaaagcttgttttttgttgtttgtcttttgggtgttttttttcttagttgttgccttttctttgtgtatgtcttattttttaatttttaaatgttttatctttttttaaatttctgtgtttattttagatacaggggtacatgtgcaggtttgttacattggtatattgcactcaggtagtgagtgtactacctaataggtagtttgttaactcactccaccccgtcctcccctcccgactttagtagttcactgtgtctgttgttcccatgtttatgtccatgtgtgctcagtgtttagcgcccacttataagtgagaacatgcaatatttggttttctgttcctgcatttattcacttaggattttcctttagttatggaattgtggagctgctaagaaagacttttcaattattgtagaccttttcatttgcataactgcagattttttattatactggctacattataaattattaactaaaacattttaaaattgggaaaccaataaaatggagctttatgttgtatagaagaatgccaaagtgaatgtttacagtttgtttttctttagtaatttcattcagtaaatagttatctattattgccagacattgtgctgacaggaataaaactgagcaaagtgggaataatccttgtcctcatggagcttgtagtcaaatggggtaaaatcactaaagaaaaacacactgtcctcattgggaagggttctttgaggacatggaattggagttgagattgaaggatgaataggagtttactgagacatagttgtgggagaggaagtagggaaataccaggtttgtgagagaaaatcagaagttcagttcaaagatgttacttatggttcctttgaaatatacaaatataaatgttaaatatattcttggatacaggggaatggacctcaaaatggagatagcagtcattatcagagatatgatcattgagaccaagagaaaggatgagatggtctagggcagaattagataattagaagaaaggagagcctaaccctgagcttacaggaatgccaacatttaatgggctggtagaggagattgaatggcaaagaagggaactggaaagagagagggaggaggagaaccaggagagcagagttacacaaggtagtctggtatttcggaaggtggtcaacaatgttaaaagatgttagacattgctgctaagaggtcagataggacgaagactggaaaatgttcactcgtttttgacatgttggttattgtgacctcagtgagagctttttgaaagattcactgaggtagaatccagattggaatggcttaaccggtaaatggagcttaggaaatggagacagctagcatagatgagtcttcttagaattttgctatgaagaatgaagagtgaaaaaggaaggtagtcagagaggttaagaacagtggggttatcaactaagagaagagaagagaaggaattcctattccccgttttaacacctttattgagatataattgacatacaatacaatgcacatatttgaagtacatacacaatttacattttttgcacatgtgtatttaaggcagagtatttttattttattttaaagatacagtatataatcatatttagcttgcataaagaatattttgaaatatgacaatttatcttctgtcttttataccgttggtttttattgggcaaatatattattttcataataaaatacatgtgcatgaatgatactggtcatgtcctagaggatcacacatctgtagttgactttaaagctgagaaaaatgtgttcattttggaagagttaatgttttcaaatatgttatccctgggattttatacccacattaatcagtaaaagctcccaaagtgtcaggatttccatttgttaataaacaaagcaacaatgaaactttctcattttgctctagtattttttattacatattgtgtaatttttatgtcttgtttctgataagcttgtactgtcctttatgttaagatgtcctccattaatttacatggaagtaaacagtaacaacagagtcaaaggctgaaaacagttgtttcttgaagaaccagctactgccatgtgttaaaagaaactattcaaatatatgcagatacttggccaaagatggaaaaaaaaaataagtttacttacctggccatattctctagtatcccttcaacaaaggtttatgttatgaaattaaataatttgataaaaagttcttagaaaaagacttcatgatgtaagtagaatacattcttagctaatgttttttggcattaatattataataatttattgagatcttgttcatatgtgatgctatattttatgtgttacagttcatattaaacagtctttgccctcgagggggtcagagaaagttacccatcattaaatctaactattacttttgtttgagaaacctcactaatacatatgtttgggagctctgagctcagtaattccccaaggggcaattcagtataacacagtaaattgtaattccatcagttatgggtcatctaccacaatctaaaaattttcttttgtaggttaaatgttaatctttaacaaaattacatctttctgagccacattttcctcttacaaagtaatttctaagtgtttagctttattttggaaaagagctgtaatactctttgaccacaatgggacaattttgtagcctatcatattgcttcggtaactgactggcagaatttatatgtgaaatacttctctagaccctgcactttcagaatagcctcaaaatgcaatatttttgataggagtaaaaaaaataattatgtagcccaaagccattacaacattttatttcacttacatgcttttgagttttcagattcatatgatgagtatattcagtttattttaatctttattccaaagatacttctgtgttgcactgtcatctctttcaccattggtaaatgaacatatttgaagtacagacactttacattttttgcacatatatatttaaggcagaagtatttttattttattttaaagatacagtatataatcataattagcttgaatgcagaattttgagatatggcagtttatcttctgtcttttataccattggtttttattgggcaaatattttcataataaaatacatgtgcatgaatgataccagtcatgtcctagaggatcacaaatctgtagttgactttaaagctgaaaggaatatttatcctgcacttcctttttattttacacacctgctaagattcctctggttaaaatgaagtacacttaccagtgaaggagaagccagtgcaggtggatttgtgggagcctttcactatactcttggtacttctctatctgaggcaacattttagcagttttggccctaatgatattaattgccagtaccaatgttcagaactagtaaaaaatatagttaacttcagtcttaaaaaaaaaaatcctactacgtgattatcatttattcatcatcattggaaaattggtgaggtatgatttgtttattctttgagaaaattaatttactctgaaaactatgtgactgcctaggatgcagtagcacgatgctggacagcatacgcaaagacaaggaaatataatacagagttgcagttgcagaaaaatgtgttaactggtagttttacttcagcaggcccaaaacccaaaaaggcaaaagacgcaggcaaaggcacaccactcactaatactgaagatgtgttgaaaaaaatggaggtaaggttttcttcttactatacaagtgaactgaaaaaatgtaaaagatcctacctcgttttgctctgtttcaacctttcagcattctcttactttttaataatgtaaatttggcagaagcgagcccaacatataaggtaactgggaaggtttgaactttgcaggctgggagatatggagggtctgtcctgtccttcgttaccactcacctggccacttacctcaccttctgtcacctctttctttttcactgtatccccctttccgcttatatttgaatcatgcaggcagagagaaacatgaacaagttttaaaaagagttacatatgtaactcttttaaaaacctctcatttttcctcctgttggttaatatgtacagttttaatgctttttttttggtcttaagtattgaagactcttgagggaaaaatgtattttatagaacttatttttatagctttctttatctaaatatttcaaaaataaaaaaatgtagattcagaaggttaaagcactgaaaattttaaaaatttaatttttcaaaaataaaaaatgtaagattcagaagtttaaaacactgaaaattttccctcctattcctgtccctagtcatccagttcccttcctatagacaaccaatgttactagtttcttatgtcttttttcagaagtatttcatacatagcaaatacgaggtttctttttctttttaaagacagagatagcatattacattctgcgttttcattttatcacttaactgaataccttggatgtggttccatataagtctgtgtagagttacctcatccttctttttttttttttggctgcactataaaaatgaactgtaatttatttaattaatatcctacataattggatatatggacattatgtttcatctagtgttttgctgttattaacaatgctgcaatgaattcatgttaagtatgtcatttcacctgtgtagggtagatttctagaagtatttggtcagtacataaatgtgcactgtatgaaatggatagctattgttacattgctctttatggaggttataccaatttactaccgttatcaatgcatgcattgtcttgccttggtgatgatgatgatgacagtaacagctaacactttattgaaacttattctgtgccagcctccttgatgagctctttacatatgttatgtccataagagttcataacaacaaggagaggtggatattattccttctttacagatgaggaagtcaaggctttaaaatttttacttgcctggccaagttggcacagctatttggtagtggaaactcatatttttattttattatttgaccagtactggagttagagacaacatgtctgaaaaataaagccagagtactgatgaaggagcagtgataactgtcaggtttaactatggcggaatgatgggaatgcagttctagccagtttgtattgactgaactcaggttctggctattctaaaagcttcctggagaaaacttgctaagatgacatgtgccgtaaggaagattgatctggacctctgggtttctccgtgtaacaaactgtgtttccatattgtctacatttaaacacaattttcaggacacacactggaaaaactggaaatttaaatctagaaataccaatgagtttagaagagcaaaagttgttcccagatgactttcttattgctgattttttcagcaaaagcagttccaagttttttttataatagagcattcgtggatggagagggagtgacatacattcaaatctcatgattaatgtgtgagtaattagtggtaaactaatatctgaggtttcttatttctgcataacaggaggctctgtatggtggctgtaaggctgtataatatttaaaccagaagaactgctctctgtccataattgaacactgttttcagtatctttatattattcattttattcttaaatctgtaaagtagtaaagttagatggttaaatctcaacaggagagaaaatggagactagtaagtagaagagctgaaactagtagcttaatgcaaaaggaatgaagcaatgagacaatatatgtggctttgagatcaatttttattaaaaagttgcataaatctacttttaacctattttatgagtctgatttagatctgtgtggtggaaataaagatgaggatttttttttttaaaggtatttgaggtagcaataatagaaatagagacttcctggttcctatgtggcactgaatgaatactgtatttaaaaagtacttttggccaggcgccgtggctcacgcctgtaatctcagcactttgggaggccgaggcgggtggatcatgaggtcaggagatcgagaccatcctggctaacacagtgaaaccccatctctactaaaaattcaaaaaaaattagctgggcgtggtagcaggcgcctgtagtcccagttactcgggaggctgaggcaggagaatgatgtgaacctgggaggtggagcttgcagtgagccgagatcgtaccactgccctccagcctgggtgacagagcaagactcccatctcaaaaaaaaaaaaagtacttttacataactggtttaaataactgtgttcttaattataaaaataaaataatagcatgttttttagatatagtgtgtaccctgcacagagctaaataaatatggcactacaatttcctattaactatacaacttattggttgcaggtctttttactgtgatctgattaaaatagtaaaaaaatataatattaacataccatcaaatatgtgtgtgtatatcttattatagatgctgcaaaagatccataagcacgattttctttacttgcacttttccaaagggattgccagttggaaaaattgcacacatcatattgtagtaataactcatataagacaacatatgagtcagtatcaagataaatcatcttatgtctgttaccttggtcttatttgttctgcctgagtgggttaagcagacaggaaaggtggagtttgaattttgattagaaattgagcctatctaatgtagtctctctgttgtctttgatttccttaaattcaaatttgaatttaattacaaggatttttaaagataagcgtttaagaaccagtaaaggaatagctaagttgtagttactccagatataaaatctgctttctctctatatgtaatctacaaagcaaataccttataatagagatggagtgtttgcagattcatgcattagtattccaatttctgtttaggaataatcacattttagctgaggtgacttatgccttaattatgcgtattaatatgtgaaattattgactcctggaaaacttgtgaaattctatcatatgtgcaaattgagcatagtacaatttagtgaacagatagtgacagtaatgaaaataagtcactttttattaaatgaaaaaaattgttggtagtcataatagaaatacaaagatgtaattttaaagttaattttgtgtactattccctgatggttccacttgtggataagtgggactctcatggaatcaaagctttcctaactctgcatctctcttttgtcttctcttttagaattcctaataattgctagtattgactgtgatttgagttttaatttctctctttcttctcaatctgccagatatattaagaaacaagaattcctggcaacaggaagtaaataatgagagagaaaaaagataaagacacagataaaatgcaactaggataatctaacccaggatgacttgctattataataatagtattaaatggcctcatgtataaagtgaaacatagacattttgagataatactattaccttatttttccccttttatgttagaaggaaaacaaaataacattctaaaagttctccataaactaagtcacctcaaatattttagaaggaggtaagatagaccaccaggtactgtggctcatgcctgtaatcccagcactttgggaggctaaggtgggcagatctcttgagaccagcagtttgagaccagcatagccaacatggagaaaccctgtctctactaaaaaaattagccaggcttggtggtatgcacctgtagtcccagctacgcaggaagctcaagcaggagaatcacttgaacccaggagaaggaggttgctgtgagccgagatcgtggcactgcactccagcctgggtgacagagcgagactttctctcaaaaaagaaggtaggagataaattataaaaaataaagcattgtgcattagagctgataagcccaatattaatctgaaacccaattattaagtaacaaaatcaaagaaaatgctggtttagtggtgagacagtaaattccttctttcttgagttgactcatagtttcctaggtggtagccaggaggtggtggtaagatgggagtagaataaggtgatagataactgttcccttaaggctaagcagggaagtcagcagtctagtggtttccatacaaattaatgaaactcacttataccaggaattggaaaaaagaggtgatggtgaaaaatcagatgaggaaaatgaagagaaagaaggaagcaaagagaaaagtaaagaaggtgatgatgacgatgacgatgatgccgcagaacaggaggaatatgatgaagaagagcaagaagaggtaatggttcatttggggatggtagcaaaattaataaggtttatctaataaggaatcagatatagagtatgtattgaaatcaataaacagaaaccaagatgatgggaaccagaagtatattattatcaatggcatcgattccttgctatcaagagaacttccttgctatcgagagaactattatagcattgaaattataatgatgtcaaattgaatataggaaataaaaatgattggcaactttgtaagtataaatctgcaagttaaggagattgatcagattagtgcagttaagatttaacaacataaaaatttaagtcagcaattcaggtaacggagggcttaaccacctaggtctagaggagaatccctgcagtgtgtttcaaattccaaagtgcatgtggatactatcagagaagattgataatttaacctcaggtatctggctgagtcaggactctgtgttttccatttgggatgtctaacttttagaatgaaatgcacatagtacatttcagaattagctggagtcaatcaggtatttttagtagggtaactttgcagaccacagcctcttcgggactttgtagacacctcagaccgtaaccctaggtggagagtttcttctccattctggtgacctttgtcttcattccatttcagcctcttataccacattctcaaattttgcttctctggaaacttccaactatgaaatctttactataattattttgcattaaatttggtattcttttgaaatttgtattagtataaacagagaagtgtggatacattttttatctgtttccaagtggctagccagctgctaacctcatttcttaatttgctttcctcgttgattttgaaattcttctggtatcagctattagattctcatttctacttctgttctctgttccattgatctattttgaaccaacactaagctgttgcaagtagtagaagcttctgattatttgttaatgttggtagggtatgtcttccttcctattcttttttcacaattttcctgaatattctgtctattctttcagatacattttaagtctaaacatttaaaaattaaatatgtcacatttgtggtagatcacatttgtctccagccttcttttcagatcattcatgtttttatttccattgctctctgacatgattgaaactgtcagtacttctgatcatctctttcccctttattggttctctgttttaattttcttttctaagaaacttagacccttgctcgcccttcatcttcttttttgccattattgtctcttgtcctcccagcgcacacactagaccaaagccaactttgatcatttccattctctacctattttccctttcaaatctgacctattgagcatttcttgggaatcacagaaattgatgcccctcaaaaaacactagccccattttgctggataacatgttttctgtttttaagtcagctctctacagcaattatttttgatcaacttctttcttcttatttccctttgtttactaccttttctttcactcttagcaggtgataataccttcatacgggaaatgaagtcatcaagaggaaactctattaaatttcatgtcctctgccttcaaactcagtgtcttccttcctcctcctctttttttttttaatcaagggaggaaatcccctttatcctatttggggctaacggccctatccttttttggaaccatagtcctccagtcatttccctttccatatttttaacctctttttctgcttgtctcttccattcatgaatgttcatttcccattgtaaaacatgttcatttcccattgtaaaatatgttgtccacattctccctcatgccatctcttgaaaagcttctttagctgtcatcacccctccccctcccccaccattagctcttttcaatcttagtttcacctccatcctattcaaataattgcttttgacaaatagaagtagcttaaagaaagaaattattgctaccacgctcaccatagacaaattttagcctttatgtcacttaacttttttgcagcatttaacacttctgacagctctattattaaaatattatttcctggccaagcgcagtggctcactctgtaatcccagcactttgggaggccaaggcgggtggatcacgaggtcaggagttcaagacaagccttgccaacatggtgaaaccctgtctctactagaaataaaaaattagccaggcgtggtggcgggtgcctgtaatcccaactacttgggaggctgaggcaggagaatcacttgaacccagaaagcagaggtcgcagtgagctgagatcgtgccactgcactccagcctgggcaacatatatatatttatgatttcctttatttaaattcaacaatttacagcaattatatgcatcttctatatgccaggcattgtgctaattgccaagtcttagacaaacatggttgcttcccttaatttttgttacataatgcttttcgtttttctcctatttctggtacatttttatggtctctggagttctttctagtctttaaatgtcagtattcttcagggctcttccctcgggcttctttttcttgctgtaatctctctgattgcatccctccccatagttaccctgtataaacatgtaactcctcagttctttttcattcaacctatagtaagtgtacactaagtatatgcttggaattgtactaggcaatgggaatatgaagataagatacagttcttctctcagggaaattactagagagacaaaaaaggtaacagttaatatacagtgaataatgctgtgatacagtagtaccggatgctatagcggcatataagagatgctgtgggcacaccaaagtctattttaggcatatcaaagatgatatttcaaagaagacaatttaggtgatctgaagagctaatcagatcaagataggaacatggaatggagtggacacttgcagggagaaaaaagaacatggagagaggcttgcaggtgatgggagtgtagcttcttaatttaactgaccagataaatcggtatggcgggactagagggtgttaagtgggcttgtgttgagagatgaagctggagagatgagcaggtcattaaggactttgaatgtcaagctgagaaatttgactttatcctgagtactgtggggagcattgaggggttttaaacagtggaatggtataatcatgtttatattttagaaagctcagttgctttgaatggaagagccaagtttgggtcatatttgaaagcttattgctgtaaaccagtggttttcaatactcttgaaaggatatttggtagtgtctggagatatatttggttgtcacactgccatgggggtagtagggtggtggtgctataggttctagtttgtgtggtcaatactctagacaagactggcatttgcaatgctctgttgacaatgtctgcttgcactgagttcaggatcaagaccatcctggctaacacggtgaaaccccgtctctactaaaaatacaaaaaattagccgggcgtggtggcaggcgcctgtagtcccggctactcgggaggctgaggcaggagaatggcgtgaaccagggaggcagagctttcagtgagccgagatcgcgccactgcactccagcctgggtgacaagagtgagactgcgtctcaaagaaaaaaaaaaaagattactaacgtcacacaattaccaaatttgaatcacttaaacagaacttggaggaggtactcatgtctaaaacacaagtgacatatgcttgatttggaatactagagtatcccttccttattcatctccactttatgtacaaatcggcttacttttatttctacacaagtgttcttgccaaaggtctcctttacaatgagacctcatttgaactctcaaccatgccaccctcccctggtacacaggccccaagcttcacccaggtgtctaaatattgccaaatttttttggcaccagaaaagccaggccaactttccagagatgggaatggtcttagctgaatgcagaaacttaaagtatctagggaagaaaaagtaatgagataactatctaaagaatgcatatacagtgaataatgcatgttacctttcttgcattatgtaaatatattaaaaatcccactatccagatttaaaaaaaaaaaaaaactttggaaaaaaattagtaaaattgataggagactttcttttgagagtagtctgtatttcttactatagatagtagagatgtggacattaatttcttattatagcagatctcaatcatgtgcaaaaatgtagtgactagtaaaagaaacacccatggtcttatcactcagctttaacaatggtcaattcatagctaatctttcaaccactcattcatctacccaatccctccctgtccacccatcccattccccgtgccccatgtgccttggattccaaagaaaatcctaggcatcgtatcatttcatccacaaatatgtcagtatggattcaaaaataagggctctttaacaacatcactgtatcattataacaccccatacaatgaaatataattccttaatttcatcaaatatctggccagtattgaattttcttggttgtctcaaaaagtttgtttgttccaaacagaatccaaatacaatccatacattgcaactgattaataactcttaggtttaatttatatccaaagtggatttttgattgtaagatactggaggcccggaaaaataaataagaaagtaatatttgaatttttgatagaaagcacagatattttctgagttatttgcatggatgatagtcttattcagccacaagaaaaagaaactaagaggtcctagatagaatataatataggcatcttttggatttggtttggtatcatgcctttttttttttttttaataggaagtaaaagtctttctggcttatgcttagttatgttttatgactaaaaatctcagtactggtgtagtctaatggatgttaatgtaaactggctttttttcttgtctgtgcattttttgggtaagtgtttagtggtttagctaactaaactatgtatcatcccagtaagctgtaatgtgttagtagctatattatcctattgagatggtatgggcaacccttcatgttctcttagctagttagtgcctgacaagagtggaaggtggtggtcttaaggaagaaagcggcacaggtaaacacaagtgaaaactgttgtgtttttgaagcagataaaaagcagagacttttaggcctggaatattttcttactactcattcattttaacgtttacaaaggaatatatcatttcacttaggaaaatgactacattaattcatactttgaagatggagatgattttggcgcagacagtgatgacaacatggatgaggcaacctattaggcatgaaatttttcaaaaaatatttttatgatgcagcttctgaacatttggacagacttgatttgtattttatttctgataaggaataagtacttgtttctgttgttttggacaaatagttgttaccaaaatattcaaaaccactttgagtttacatactagttaccttaaaaattattccctgacactctgacattccttctaaacacctctgccatctctcttatgtactctcatgggtttttttgtatgatttgaatatgaatgtgcctaaagaatttttgctctcttaatctatgtatacatacttgaacaaatcattcttgcttaactgctgatcttttgtaaaactattgctagtcataatggatttctataacctgaaagttgatataatacagcacgtggagcactttaaaaacaaagaaacttgaaaataattttattttttacctttacatggtgtgttctagactactgcattatgactacataaacctacctgagctcttacaagtacagaattgtgagacagaggttttgtgatggaaaacatacacatagggaaaaataccaaactgagcaatataaatttcacagctcacatcttagccagtacaaagaaactttcacatggggtgaatattataatacttgaatttgagacttaatactgtatatgaattaatcatcccactgtaataactgacatcttcaaatagttgggcttatgaaaaatttgactaagacattttattttatactttatgtaaatgtgaaataagttctggtcatataaatatgtagaatgcatgtgtgtgaactctatgaagtgaagtgtggtggccttttatgtttcagagtactcaagtgtacaattgatttatataaaaatgcaaaatgaactcaggtcattttgaaattaatattaatatttttgttgtttaactttaaagctagctcccctaactttatatattttttgggaaaaaatacctaaaaacctcagcctacaaagactctcagaaatgccaaagattttcaaggaaattcatattatatatttcaaaaatgatttatcaatgttatctaccaaaagaaataattttatttttcccctttggggagatattatcctctaatatgagaatcagatccctagattctatttctacctatactattaaactcaaccttgaacctgagcttggttgtttctgtgccttagtttctccactcgtaaacaatttcctataaaaattgtttaaacaccaaccaaaatttaccatatgtattcattctcttgccttaaagatcacttcttaacttacatttggctctcaccctctaaaaatttgtagtttggagagtaactgaaagcacaattttaagaaacatgttttcctcacaaaatatattgtaatctgattttcctatcttgtattcatgcagaaaattggagaaaatgtgtattgtcttgtgccattctgcaatatgaatttctcaggaaaaagatgtttcaatggcaatactttcttaaataattcaagatgggtgtgaggacctatcttattagtttagtgctgtgttaaccatttgtgaattacttcttgtttaaaggaagttgtcaaaaaattttaagattctaaatggaatacacgaataaagtaagccttagaatagaaacctcacaaaaagttgtcatttgcggttgataattaacataggtgttttattctctcaactccttagtaccagagccaaatacaatttagttttcagaaatcttatcaatattgttctatttacctacttataaatctgcagataaccacttgaaccaggcaaatacactgaagataaaggttatttctttttttagctttgaatttgtcatgaccattttagtcttgcagatagcagggcagccccttggggcaaggatttactctgggaggtaccgttaagagccttctttccccctttgaaagatccttttacaatgttaaagtatactagttgcaagaacaagcaggatttgcaggttgctttaccagcatgagtctcatttttctggcttaaaatctgggactgtgaaattattccataggaaagtgaatgttattttgcagaattagcctcttacataaaagtatttgttgaagtgtctttaaaattgctatcatgagcaaaactggttgctgtaatgcttgtttttctgtatttatttacacattaaattcttacaaaacaaaatgtgttcgtttgttttatagtaagatgttttattttgaacttatttaaatgtttatttgttagagaaaactaatttgttaatatagatcttaactagtaactattaagcagggatgtttgttccaaatattcttgaataaacaatcaccacaaacaa

SEQ ID NO: 1554 - DNA, 13958 bp, Homo sapiens
tttagattgaataagagaaactttattacatgttggagatctttcaaaatatgaaaaataaggggcaaaaaattttaaaaactggttttacagatacacatgctaacaatgttctacagttacatttgtataaaatacattatacaaaagatttatagattttgcatacataaaaattaaagcattcagatatttctatgatctaacagtgcaatatgcacatacgtggaagaaaatactgattacctgagcaacatttttgtaatgcaaattaaaaatgaatccatcagtgcaccatttaaatacagactttaaaaaactccacctttaccctgtaacactgactagatccttgcttcatgatatttctaaaactaagcatatccttcatattttcaactaggtaattttagaagtagatactttaaaaaagaactaattactaagtagtggttcatttaaataactcttcaggacactgaaccaagcaggtagagtccaggaaaagaaaagctgtaaataaaaagtcctttggaggagataatttaacatgagtcttctaatttttaatgtggccagcagagtgtgtaaccatttttaacatatcttttgaaaatatgaactccataacttcctaggagtgagatagcaaagaaattttattttaaccgagacttcataaaactatcagctttttgtttacttgctaactccaaaattttaagtaaaccaaatgcaatgattctgctgttacttttacattgcatacaagtacatgcgtgcacacatgcagacacacacacagacacacatgtaaagcaacaaattcaaagaagggtgtcaacacaattaaaatccataatgttaaacaataactgtgcttgttagttatacaaggtaatttgcatttgatataaacttaacttacattagtactttttagaaactaaaattattccaaatgtattaaatgcttagaaaattcatttctttcctaaacagattagaaccataattcaatatgtaacctttatatagaattatatgtaactcaaattatattcaattaattcaaatatataatttaaatacagaaaaaagaaaactacctgatgtgttataaggatgtatatttccttcaaaaaaggatactctgcaagacaaatgatttttaatcaacaaatacacagcacaccttattcctttaaaaaataagttacatattttggaaatcgaacccataacaatttcaaagtacaactagcaaaaaaagtaaggaatcactgactgtaatttcatcaatttgatgtaaacaaagttcttcaaaggacacctggcctgtttaccctaaaataatctgcattttcttccttaaaacctcatttttcagcagacttaataaatacaatgtaaaatgaccagttaacactaagcataaattatatcacactcttcttttcaagatgcccaaggcacattaaaactactttttaaatgtttaatttactaagagaatcatttgcaacttccctattaaacactttttggtaattgtctaaggtcctctaatatttgcaagggctttaatgtttgacttctttgtcctgtcttttcctgatggtcttctcctgaaagtacataaaactgcatttgccataaatatttacttattctgagttaaatttgaaatatataaaatgacttatcaaaagcctgaaacatcaacaattaggaaataatgcccagaaaatgaggtggtattatatatcttaagtatatattatatacaaaacaggcaatccagactccaccaaatctcatttctattgaagaatcattctggttacatttttaaaacacatacttttaaagattaaatgatggaatcagtatgcaaatgcttcttacttagccagactgtagccgactcaacagatcttaaaaagaggcactaccaccccctttcaagcaatctatacacctttggcctttgtttcccaatttgatgctatatatagagatcaggaaaaaagtctaaattggatattttctctttgaaaaacagaggttaagggattactaaataatttgtctgttactgctaatataaaatacctctactcttttttgcttaatgaaccattttcttcaacagacctcaaaggcagttttgacccaattatttgtgcttgatggtgaaaatggagacaaatttatatagcctatgtaacgaatctgattggaccatatgaaataatgcttatttttaattctgaaacttggatttacttacataaagcagtaaggcattaaatgtaattaaggcatgttactgtatgtaacagcaatgatttatcacagtatataaggaattatttcctaaataatggtaatatgcacgtttaatatatttttcatcatcaaaactacaaaagtgctttcaaatatcagaggcaaatataatcattttaaaaacagatgcacagaggtgaggttaaagggtctgtcctaaagaaagcattcttaagacaaaaattactgtcaggtcttcacctattccagtgttctactgacttcccaaccataatacattattttggggtcttgaaaatattttaatctatttcttggcctctgttgtaggaattataaatcactttcccctttctctttgtacgtatgctttcatagcacatgtgctaaatgtattttttaaaagttttgaaggggtgtgttacgtatcctaccatgaataattttagaatcaaattttcttgcaactgaatattttgggggttcatagtagtaaatttttttcagctgcagacatctgatgctatcattctgcatcataaatttaacattaataaactttttaaaaattacttaaaaaaataaaatttaaacatgcattttaagaaaaatgatacatcttccaagttaagtacttcctaaacacacatttaaattaatttctgcttgaaacattcacacaccagatttatggatcaactgctctcaacatcaacaactagttgctcaaaaaattttcaaagtgtgaaacccttttgttaaaaacaaaagcatcctcaatctctctaaattctgcctttgaagctattattggatataactgattcaccacattccagatgcacatgtgaccactaacatttgattatgagctaattgctatgtttcctgttgagcagcaggtgactgagaatcttgactatacagtttatgatcatcttgttggctgaaatgtattcctttagttggcacaattccattttccatttctctctgctgtgatgggggtgtgatttttgaatgtaaatgtgaagagtccactgttgaatgatgactaacatccaccttagctaaaatttcataatacaacaaataaaacactggtgttattatacctactatcaacattatcactacagctgtccaccaccctattccccagtctgctccataataggggtctttacgttgagtgtttttgttatcaggttcaaaacgcatttgttgtgctgttaaggccgatactacctcattgaggttctctctcttattgtctgtacactttactatttgttctatgtctcggtctacttcttttaaaaagctaccagctgagtcactgtaagcaagagaatcattagctggcaaaatttcctgttgttcggaagagtattgaacagatgaatgacgtgaagtctgtcttccttttggaggacaaagtgtttcggtcaaggaactgaacttttttactggaattttgatagacctaagggcaaaaaagtcttgatcactgatgagattgttaactctcttgatatctgctacctgtgggggggaaaaaaaagcaacatacaactgaattccaatcaaaataaaggcagcaatagtcattcattctagttacttttggaggaaaaaaaaagttgaattattagtagtattaagttgcacccagagaaattttaattttatttgtagatgagaattctacaccactttagatgtaccaatcttaggaaatcaccaactactttttactatcacccatatatgttagtaacactaattaatgctatttaagtagattctagaatcctttgctgcttccctttgtgcatcatgcataaataccacagtccttctgcttgtaaacaatttgtgaaggaaggattatgggtagttatgttctttattccagtttggaaactggaatatagacaaatgctacccaactaaaactaccatattttatcaaaactaagatgccataactctaagatgcagtattattttatgtatatctagggaaaaaaaaaacttcaccaaaaattgaagatgccaccattccaaaaaaagatgctaaaatgtgtggaaaagcatatataccttagaatttaaaaaattggtaatttatcccccttatttctgaagccatttccctcccaaacttctcagtgtaaatgcattattcaactactttcaagattaatcacttttataagctttttctctatatattatacattcctcaacctgtttgtattatcccatccactgtgagataacctgtctgtatatcctattccactgtgttgggggaagaggggagtgtctggcagattaccaattggtatgccaggctctcccaccatctattagtcccattcatttccatcaatactttaaaacctaatcatgtatcacctgattcatgtcagagagataaagtgggtctagtatgaagcttagatttctggtttggtcaacttgatggacgatggcattcattgagaaatggaacactgtggagggtaaaaagaggctaaatgcagattttagatatgctgacttggagctgcttgagatacagaagtggaagatgttcaggacagagttgtagatatatgtctgaaactcaagaacgatctcggctagagacacagatttatggactatcagcaaaaatgtaattgaagtcagccagacgtggtggctcatgcctgtaatcccagcactttgggaggccgaggcaggtagatcacctgaggtcaggagttcaagaccagtgtggccaacaggtgaaaccccatctctactaaaaatacaaaaattagccaggcatggtggtgcatgcctgtagtcccagctactccggaggctgaggcaggagaattactggaagccgggaggtggtggttacagtgagcagagattgtgccactgcactccagcctgggcaacagagcgagactccatctcaaaaaaaaaaaaagtaattgaagtcaaagaggtcaaagagtagagagattcactagaaaaagcctgagagaaaaaagcaacaagatcatccctgaagaactccaacatttgatgggtatgctgagtaacaaaaatccacaaaggagattacgaatggccaggaagggaatatacaatagtggttaaaagcatggataactgggtttgaggcatggctttgacactttctagctgtatgacctggggcaagttgtttaacctctttgccattaaggttccacacctgcaatatggcagtaataatactacctacattatagggttgaggtgaacattaatgatttaaatgttgtaggacactcagaacagtgatttatggtatgtcatataaaagttagctattattaaatgttaatagtaggaaaaccagaaacctgaaaagtcaaggtggtcaagcagagagggtctttagcagggagtagtgaacagaatccactgtagattcgtgatcaagtacaatgaagactaaaagaggtcaagctggaaaaactatcttgcaatgtatgtgtggggggattggaaggaaagggttgaacaataactaaaagatgaaacagtaaagataaagtgtgttttatcatcttactaccttcgcactgttttgtcttatagcaaatgaagattcactgaaaaatcccagtctgaccccattctctttaaatgctcttttgcttggtattgtgtactcttactaataactacttaatactctttttgaattagggttccaaggtttagtatctacctaagttatctccctgaatatccctataatgacttctatgctatgccaacttccttggttgcattcaagattccaaccttggactttttattcttctcatcacagttgtataactgacagatttttaataattcttaagattatttctaagtggaatataccactagctacttactgtattttttaaatgatagatccttttataatgataaatatttttataattttttttgttgcttatgcttccatcaaaaaggagcactgcttatcttaactaattctgttcatccctttcccactatagtggctgatatgtccccacccaaatctcatgtcatcttgtaatctccaatgttaggggtggggcctgggggaggtgattggatcatggaggtagatttcccccttgatactgtcctgagttcttgtgagatctgattgtttaaaagtgtgtggaacctcctccctcactcgctcttcttcctgctccagccatgtgaaaatgcctgctctggctttgccttctgccgttaagtaaaagctctctgaggcctccccagaagtagatgctgcctgcttatgtacaacctgcagaaccatgagccaattaaacctcttttcttataaactacccagtctcaggtatttctttatagcaatgtgaacacagactaatacagtggccaatgccatctctccatttaagtacttttcatcattctcatttcacataagcattcagctgatatatcctgtgatttcccccaatacattaacacttcttctctatccttatcacaaatattttagtctaagtcctgatcatctttattattccagtaatctctttattggatccccttcaattcatcagcaggcccctctgctattctgtatcactcctgttaaaactctacaataattgtattctcttactatatggatcaaacttttccattctgtatcactcctgttaaaaccttacaatatttgttctcttactgtatggatcaaacttttccatagtgtctcaaagcatttcatcccaaatagtctgtgccactcacttcggaaataactatgaaaattccctttgttgtttaccatatttcctccttgaaatcttcttcacatcactgttgaatgcctgaaacatctttacacctcattggaaatatgacctatttttaattattcagatggtatgttaaatttccctaagaaaattttctaggttcattaaaagaaagctaatgtcttataaaactactgaatcacaaactctcctctcggatctgtaccttgatgttttttagccttgtgtctcattttgaagtgtattccaccatctaccttctatgacatattctgtaatttatttatcaatggtcttatttctctacaaaacatttactcacatgtttatttgcatttagaaataaacttagatattttctgatttaataatggcaagaattgatgttttcatacatgagcaaggtaggaggaaaaaactacccagctcttacaccacatcaaaaaattcattttaataaaatattttattaaattttaatatcaaaatttgaaatgttttgatgaattgtgaattgtaataagaaatgtgaattattgcaatagttgcaaatgtagaagaaaacctcatgaccataatttttttagaatataaatacatttatataatataaacttatagacatgtgtgttcctattgcagagaagtattacaggtaatcaataaaaggtttttcaagtataaaaatactttacatcatgaaaaatttggggggaagatgaaaatattaatgagaaaaaggaatgatataaaatctcatgctattgaaaaaagagctctcatacacacactttccactttttttaaaaatacaaatttcaggtagcaaatcctggtggtacttagaattctgtggatgcatttaaagagcactctaacagtcttatttttaaatgttaatacaacattctgaaaattataccatttgtaactatgttaagtcatgaggaagaatttaggaagttcacttaaaaatgtgcaatgaggtacatagtacatatatttcaaaattctattgggagtatgagaacaaaaagtttgaaaacaaatgttctaaccagtttccatatcaatgtggatataaaaatatcctgctaaggcctcaagatggacataatgacacagagagaaaatgggtccaaatagagtatagtatctattaaaattaaaaatacacctttcctcttatctggcaatcccacttttaggatctatcccacagaagtaaaggcagtgccatttaaagatatagttgtgatgatatttgccacacaaggtaaaacaccaagaaaatcctgagtatcaattaatagggcaatggcttaaaaatactggaacgttaatactacagacattatacaaccatttaaaataatgagttaataaggctttgagggatggtcatgagggtgtccatgatacactaaagaatgaaaaatgcaagttgcagagtaaaatgcataatataatccacttttaaaaatacaaagattactaactccccaaatatgtatatataaataaatacttatgagcacaaaaaaaggtaaagcattcctacatgccaaagtgttaatgctggttatctcaagaaattggggcagggaaaagcttttccttacacatttccacattttcttaccatttgaataagaagataacatagttgagtgtttttcaatactgaaattcgtggatttggaaatacacagaaattcaagtatttgttaaatatttaaaaagtaaacatctacaaatgtgacacagatttcttttttctttccttttttggagacggagtctcgctcggtcgcccaggctggagtgcagtggcgcgatctcggctcctgcaagctccgcctcccaggttcatgccattctcctgcctcagcctccagagtagctgggactacaggcgcctgccaacacgcccggctaatttttttgtatttttagtagagacggggtttcactgtgttagctaggatggtctcaagctcctgacctcgtgatccacccgcctcggcctcccaaagtgctgggattacaggcgtgagccaccgcgcccagcccatgtgacacagatttctatgcaaaaaataagagcaaaaaatggagaaaggaataaacaaggtaaaaaaggacacagaatttatttcagtgtgcgtaaacaaataatttcttctgaattgcattatgtaatattaaaacttaccgtacaacagtactgaagggctattgcatttaatgtatctccttcttgtatatcttttgttaatactataatgtcgtcaagtctatctcttgatgtacttcttcggactttctcttttcctctggatcgaagttcatacacttcagcatcctcctccaaaatatcactgtctgaacaatttccaaatgcatgtacttgaccacttgactgaactcctggaagaggaaaactacgattctgatgcctccctgccataatgttaaaatctggaggaaaaaaaaagcagagaaaattttggaatgtagctgatccaactgactgatttgcatgcatcgtacattcaggacacaatcttttgtttttgttttaatggttttagttatttaaacatttaggtttaagttcgtttttttgttttgttttgttttgttttgagatggagtctcactctgtcacccaggctggagtgcagtagtgcgatctcagctcactgcaacctttgcctcccaggtttaagtgattctcctgtttcagtctcccgagtagctgggattacaggcgcccaccactacgcccagctaatttttgtatttttagtagagacagggtttcaccatgttggccaggctggtctcgaactcttgacctcaggtgatctgcccacttcagcctcccaaagtgctacgattacaggtgtgagccactgcgcctggcctaggttcaggttttacaactgttaaagtagaacaaacgtatttggcagtggagacaaaggtaagggaagaagaggtaatctcctctattagatcatatatcactaaacacgtggagtaattacatattaacaaaggcaaattgctataattcttttggtaaaaatataacttataaaattaaatactataaaatattacattaaatataaaatcgtaaattccccttattctgagtatgtgaagaaaatcagagaaataattgtgttatgtcttaaaaacttgtgactatataacttatagctctgatggaatcaaagcatgttttatatacacataatactttcatgaattcaaaactttccagcttgttctgcatttcaacttcattcaggattggagtatctttcgtattacttcctcctggactttggtatttatatttagtgcagatatgcctgcaatataggttatgattttgcttccctggaagcaggaatttttcttccctggaagctttttagccaacttagagtcctcatcaaattcaacttatggtccataaagactgtgaacagattttaggttactgtgttcatttatactttagaaaaaccattgtaagactgactgggagctgacctaagttaaaaacaggcatcaatgaatactttttgtttacttgcatactaactctcaactcaccatcatcaagttgatctatctactctctttaattaggaacacaagaacctaaaaaactaattccacattcacagttttggcttcgtgttaattattcacataagaaggggcagactgctttcagttcttgttgggaaagatggagggaagtagtaagaagcactttggagataaaattctttgcactcaaggtggttcagacatgaagagagggagtaaattaagcatcacaccaagatttctgatttgcataatacattgtggtgccattctctgagatatggaagaggagctgggggaggaggtgcatggctatgattatgaattcctctaagatagtaaaaaggaatggcaaatagacaaatgggctatatagtcaaactcagagaaaaggtctaggttagaaataaaatttcatgactaatttgcacatagatgaaaatgaatttgtgagtacatatattacctagagagtatagaaaaagaagagggtccaagactgagccttgaagaagtccaaaattcagtatcttggtgaaaggaaatcagcctgaaaatatggataaggagtgtccagaagagggagaaaccatggaagtgttatgtcatggaagccaaagcaaaataacatctcaaagactcactattttttgaatactatggatgagtaccaagcgaaacaaaaacaaacaaacaaaaaacagaaaagaccaactccaaaactctgagtatataaaatggatgacaataaattacaaaggttgagaatccctaacccaaaaatccaatcttaaatactctgaaatttgaaatactttgagtgctgacatgaagccacaaatggaaaattccacaactgacgtttcagatttcagattaggaatgctaaacctgtacaggtattctggtgatgtgcttaggtaccctgaacacattattttttcactgtattaatggtatttttttttttttttttactgttaagcacttatgtgtgaaaaagtgtaagaaaatgactgcttattagtagcatacaaattcagagttaggaatgacggtgatgccaaacaaccacaaattttccacaagggtggctgagatagtgacacttttacctgctgatggttccaggtacaagaacttttgtgcacaaatcatataaaattaccttccgactatgtgtataagttgaatatgaaacacaaatttcatgttcagacaggtcccatccccaatgtatcttattatgtatatgcaaacattccaaaatccaaagaaatctgaaacacttccggtctcaagcatttcaggtaaggactacccaacctgtactttctaggcatatacttatcataaaatgctttaaaactatttaatatagttgaatccaacccttgaaaagcactttctgaccttgctctaatggcaatattataatgctttaaaagctcaagagttcctattcagataacacagataactaatagctatatgttaagtagattatttcaactgttctctgaagtgctacattattaccaagaactaggattcctaacttgacagctatgaaactaaagaaaactatcacattttatatctcaaaagcagttttgaagtcatgaccacatcttttcctccaaggataacagttttatttccactcatttaaccaggtctttttttaatcttgtgtctttaacctagggaatgtctttgaatcctgtagattccaggcaaattttatacatatgtatatttttctggggagaattttcattgcttcatattctcaaaaggcatccatgatcaaaaaagttaagacttaatatacagcaatttacacttggctataccgacctacttatgtgtcttgttagacagtttcaccctaataatttgtacttagaacttcaaaattggcttagtagtgcagctaactgaaaatcactaagcaatgccccaaagccattttagatacttgtttctatcaacctctctccacgatatatttctaaatataatttaaaggtcagaacttcacctgtctcactatctctccactcccctttataatgaaatgcaggcagctgactatcgtgttacaaatctgggtattctgaatgatcaagaactggctgtgtcttcaaccgaagtgaacagactgacccaggcgatcactccagtctactactcagagattagaaaatacataatatttaagtcatctggctcaattctattcacctctcttaattctcttagagcaggaaaaaggcacgaactccctttcagaaacttggaacaagcctgcgtgctacctagattacgaggggccacaaaacagtgttaaagcattcttcagctcagtctgtaactgaaaacggtttcccaaacaccttcgtactgtagaatggctgctgggtgtttcgccttgaccttctttaactaagcaaggtgcaataagagggtcacagggcacaagttaaagctgcaaagggacagaatcaaaggcaccctatccgctgccagggacaattttgttttttaaaacttaactacctcctccctctgtattccacacgtcaagtttttctttccctgctatcgtcagcgaagattacgtctcagagtcttctgtcacagcatgacacttgaacgatgtgacaagatgccgtcagcgaatatttcacgccaacataaagtcgtgggagaaatgctgtgtttgggtgggaaattagctgcccaggtaatccagcaggtaggcgtccttcctctgagcctcagtttccccgacagtgtgacaagagggcctggcagggctggtctggaagttcttccctgtctcgggggtgtccgccacacgggccgagcccggccctgcagcccccaccacacctgtggccgaggctcagcgcctcccgtgaggacgcagctggggctcaaccccgccctcctggaccgggctaccctcacctcctgccaccatctttacctgtccccgttagcagggagcactctgcgagaagatggccaaaaggtccgccgccgccgctgtcccgggtaagttcatggccgagcctctgctttgggctgaccccgtccgcctccgcctctgccgccaacgtctcc

SEQ ID NO: 1555 - DNA, 46817 bp, Homo sapiens
gcggcggcgggcccaaggcgtgaggcgccgcccgggtgtccccgcggcgcaggaggcggtggagcgcagagcgggcgagcgcggtgagtacctggcccggcctcgcccgccggtccgcgactcccgccggctccggcccgggcggtgcgggcgccggggctgcgggctcctgtgtggtcgggtggggtcgcctagcggaccggtcctgcggggggccctgtctctcagggatgagcctgccggagtcggcaccggttttagggaaagcgcggccagagacgattggttcgcttgtcagtgttgggttttgttttgtttcgttttgtttttacctattcatcaccatctctgctcctctcagtggataaactttttaatcagtggtgacctcgtcatcgcgttaaaatagttctgccctcagcccctctttatctgtagatggcagagcgagcgccggtaaagatgctctgtcgtggagggctcagtggggcggaggagatggggagcctctggcgttgtcggagaatgcaccttaaaaatgactctacccttgagcaacgcaggaagcacgacagtgatacttctgtttgtgatgatggtattggcggtatgatagtttgattatacatctgaagcttctcttcctgagtccttggcttgttaaacttggaggtattttctagcgtgcttttgagatagatatgggatgtcgtgacgtttcaccgtcattcaaggctcgcgggagcagggccttcatgtctggtaattaatgttgttttttgaatgttgtattaaaatagtagcttcgatcttggaagtaagaagccaagtattttaggactgagtgttagcgttcattttgtattattgttcttgtaccatttgtttaaagttgtcatgtaactaaaagaatgaaaaaagatggatttccagtatttgtggctcagaggattttggcctaaataaacacagttccaaccagtttagaagctgcatttttctctttgtttttgtcgaggcataaaatacatatgaaatcaataagagcacgaatcttaattgtacagctcaatgaatttttacatacttattaccctgtggaaccaccagatatatcaaattataaccatagaacatttccatcatcctattttcctgtgcttcttccaagtcagttatatccttgttttcccatctgtattctaacttctcttatctgcttttagttttctctgttttgagcttcatgttaatggaatcacgtagtattctcagcatattgtttgtgggacacacccatgctatttcatggtattgtattattactgtgtaatagtctattgaataatatgtgactactcttcagttgatggacatttatgttcccaatttttgtatatgatgtgttttggatattaagaatactgtgggcctggcgtggtggctcaggccttttatcccagcgcttggggaggccgaggcaggtggatcacttggtcaggagttcgagaccagcctggcaaacatggtgaaaccgcatctctactaaaaatacaaaaattagccaggcgtggtggcgggcgcctgtaagcccagctacttgggaggctgaggcgggaggtggaggttgcagtgagccgagatcgtgccactgcactccagcctggacgacagagcctgactcggtctcaaaaagaaaagaaaaaaaaaagagtactgtggacattcttgtaaattaaatgtcttggtgagcatctgtatgcatttctgtcagctatagaatgactgagtcatggcataagcagaaaattaccaacatggagtcattaccaaccataccattaccaaccaaaggcagaaaatttaaccaacatggagtcatcttttttttaatgtaatagaatttgttattttaactaatataacattcaaggttggttttaaaaaagcataactattatgagttcaagacgtaagtgattcattcattaccatgttattatttaccctttgaattgcacatttatgactgtcttctgtcggactgtcattgtttgtttaactgttagacaagtctgttagagctggtgaggatctgactctgaagtttagcataacatttacttaagaactgtattactcaagttagtggttttttagaggaaatgaaataccaaaaggatatgactgaaagtggattgaagaatcacgggactgcaagtcaaagaacttacattgttattgtcatgctacacaagcactaggtataagtgtaaaattgaattatagggctagttacaaatgtgaattcacagcaggagtacagtgattttcatatggactgagatactactagcacatttataatgtgaacacacaacaaaaatcactaaacatttgtgggaaatcggtagcatctaagagaagcttcagaccaaacaaatacagaactaggcactgaagcagtggagctaatgtaagacaaaagaaagctttaaagtaagtattagtatcttcaaatttgttaaggtattatgcctactgaacacatacaggctgccatgaaaaaaagcaattgattcttgaatatttaaacatggaaagtaggaaagggccaggtgtggtggctcatgcctgtaattccaacactttggaaggccgaggcaggaggatctctggattccaggagtttgagagcagcctaggcaacataatgagaccctgtctctacaaataattttttttttttttgagacggagtctggctctgttgcccaggctggagtgcagtggcgccatctcggcttactgcgagctccacctcccaggttcacgccattctcctgcctcagcctcccgagtagctgggactacaggcgcccgccaccatgcccggctaatttttgtatttttagtagagacgggtttcaccatgttagccaggatagtcttgatctcctgacctcatgatccacctgcctcagcctcccaaagtgttgggattacaggcgtgagccaccgcacctggccacaaatcatttttaaaattagcagtatggtagtgcacacctgtcgtcccagctgttcaggcagtggaggctgccactgcacttcagcctggctgacagtgaaactgtctcaaaaaaaaaaaaaaaaaaaaaaaaaaagaaagtgggaaagactacccatgacatgcaaagtagatctagaagagtcaatatacatctaataggagttccaggaggcattagaaataggaaaagaagaaataaccacagagataacagagatcgcgaaggtaggagtgtccaggcacagtcttgggcatcctgagccagggagaaataagtatcagaggacaaaggactggcaaatatagatcaacccttccctctctggtctgtttctttgtctgtacagtggggacgaacaagaagtatgccttttctgagagcttatggaaagatgtgttaggtttgctgactgttccccactcttcttccctaccagctcacagaagggattggggttgtgtgcccttatatgttgtttaacctttttatcacatgtatttattttgtgaaatttttaaagtgtaaaaattttttagaagttaaagcaggggttgccagtatggctggctgcctgttttagtatagcctgtgatctaagactggcttttacactttttattttttttattttgtatttatttatttgtttatttatttatttatttatttttgagacagagtctcactctgttgcccaggctggagtgcagtggcgtgatcttggctcactgcaacctctgtttcctgggttcaagtgattctcctgcctcggcttcctgagtagctgggattacaggtgcatgccaccatgcccggctaatttttagtagagacggggtttcaccgtgttcctcaggctggtcttgaactcctgacctcgtgatctgcctgcctcagcctcccaaagtgctgggattacacgcatgagccaccgtgcccagccctatactttctaatgctttggggagaaaaagaaaataatgcttcatgacccatgaaaattatatgaagttcaaatttcagtgtcccttggaacacaactatactcattcacttacatatcatctgtgactgcttttgtgctgcaaaggcagaatcaactggttgtgacatttactgtctgacctaaaatatttgctgattcctggtttagaggtcagaaatggacttatgcatatataggaattttgctaatgataaagatggcatttcaaactagtgacaagagcatggattgcatggtaaatggcaagaattagctatctatttgagggaaaaattacttttattaggattacttcaggtagggaagctaaaatcaagaaataggaaaagattgatagatttgagtctattaccaccaccaccaccaccaacaaaactttgcttaataggaaataatatctaacagttactgagcacttatgcttgtcatgttttacttgaataagtgttataattatactctaaggtaggttctgtaattattcccacttaacagaggaggaaactgaagtttacatatattatggaatttgtctgtaatgaagagtagaaaaccatgatgcagatctttgaattcaggccatctggctcccaagcctattgtggacaagacaaactgagaaaaaatatttgcaacatggtaacaccattttgtaggtactatctacatcagcacataaagatgtacctaattcctttaaaatattctgttgtataaatgtcttcagttaatttaacctttcctctattgatgaacattaagttgcttataattttattttgctgttacgtgtaacactgataaacatcctatgtatgtgactttatatagtagtatggatacttctgtagtatagaatcaggaaagtggaattgtgaattgctggattaaacggcctgtgcatttaaatcaagtttgctctccaaaaatgtgtgtgtgtgtgtgtgtgtgtgtgtgtgtgtgtgtgtgtgtggaatcataataaaggaatcataatatcttggaaggaacattgactgttcaggcaaaactgcctcatttttgagaggaggccctgagaggtgaagtgttatgcccaagattacatagctattaagtagctgttacacttgactctttaactggtttttgctgtgccacagtttggcacatttttctcctttgtcttgctgaaatccaggtaccatgattatagttttctccagaaacacgctgttaaaaggatccatttgatattacttgtccttggtactcagcacagtgcctgacacacagtaggtaatcaagtatttgttgaaaaagtgctgctttcagatgatcagtacttacagaccacttattcaataacatgttgacaacccatgcatcactgtaatacttatcaagtaatcaagaacttatcaagaaatgaaacattctgatctcctccttcctagatatttacacttcataatgctttagttttctgactggttatgttttccaaataattgtgtggctttgtttttgctttgtaaaaaatgaactcaaaattataaatttagtttttgaaaaccttaatgagaaattgttctgtgcagaaaatttaggaagattatacagaatatgttttataatacactcaaatggattatatctttcagagggcagtagattagtcttccaagttagcttgacatactgcatgcaatgtacatgtcctggaaatgatgcataacatttgtgttcatagtaccaaaaattgtgtataatcaagattgagtaaaaactccttaagggtcttattattatgtaagggaccagtgctgtagcattaactatctttaacacttctgttgtctccaagtcacaaggcaaggagaaaagatatggtaagacctttaaaggaatatgtaaatatgtagtactctatttttggggagatgaggggcttagttttgttttttaaatgcaaattcataatcaacaaatctttatacttcagtaaacaaactggaggggtttttttttgttgttgttttacaaatgcctttttggcactgctactgaatctgacttggctttattttttaaacagcttcattgaggtataattgacataaaataaaccacatatttaaagtgtgcaatttgataagttttaacatatgtatacacctgtgaaatcatcactgcaaccaaagtaatgagcaaatccattactcccaaaagttttttcacccctttttataattccttcctggtaccacctcccacaggcaatcattgactgatttactttcagttaactacaaattaccttgcattttctaaaattttatataaatagaatcatatagtaagtacttctgttgcctggctcctattactcagagtaattgttgatatttatccatggtgaagcatgtgtcagagtttattcctttttattgctaagcagtgttccattgtgtatctgttttactacagtttgtccattcacctgttggtggaccctgggttgtttctggttttgggctctacacctagaagctgctatgaacatttgtgtacaagttttggtattgttaaagtataaactgaggcagaataaaattttaaagagttttgtctgagcaaacagcaattcatgaatcagacagcaacaaatcaaaagtgatttgggactccaccaaaggaatgcaagtggaagacttctataggatgaacaaggaaacaaggcaaagaaaatatttgattaattatatttatatagttgccttgtttagtccatcctattggaaagtccctagttatgtaagttagttgatggcttctaattggcgtagcctaagtttgtttgtttcttttttttttttttttttttttttaagagacagggctagagtgctttggtgcgatcgtagctcactgcagctttgaactcctgggctcaagtgatcctcccacctcagcctctcaagtaaccagggcaacatgaactacagacatgcatcgccacgcctggctaattttttaatttcttatagaggcaaggtctcgctagctatattgcccaggctgatctcaaattctggcctcaagtgatcctcctgcttcaacctcccaaggtgcttacaggcatgagccaccatgcccagcctgatttttctttaatataggcacagacaaaaaataaccaaagtttacatttgcaaacagcccaaattaagttttgcttctattgcttatatttgcaaggtcaaggttgttttaatggcttaactggctttgtccaggggatttacagacctggtctccatcttattttaatagtatgaatatgtgctttcatttcttttaggtaaatatctaggaatggaatggctggatcatatgagtaggcttactcacttattaagaaacttggcctggactacatagcaagactctctctctaaaaaaagatttttttttaattagccaagtgtattagtctgggttctctagagggacagaactaagaggatatatgtatatatgaaagggagtttattaaggagaattgactcacaccatcacaaggtgaagtcccatgataggtcatcagcaagttgaggagcaaggaagccagtggtggatcagtacgagtcccaaaagtagggaagctaacagtgcagccttcagtctgtgcagccaaaggcccaagagcccctggaaaaccactggtgtaagtccaagagtccaaaagctaaagaacttggagtctgatgttctaggtcaggaagcatccagcatgggagaaagatgaagtccataagactcagcaagtcagcccttccatcttctcctgcctgctttattctacccccgctggcagctgagtagatggtgcccaaccagattgagtgtgggtctacccctcccagtccactgactcaaatgttaatttcctttggcaacaccctcacagacacacccatgaacaatactttgtatccttcagttcagtcaagttgacactcaatattagccatcccaccaggtgtagtggctcccacttgtagccccagatactcgggaagctgaggcaggaggatcacttgagcccaggagttaggctacattgagctataatatgatagaggcactgcgctacagctctggtaacagagcaagatgctgtcttttttttttttttaataagaaaataatctaacttgttaagttcataacttattaacaaaactattttatattcccatcagcagtgtatgaaagttctagtccttccacgttaacaacacttggtatggtcattctttttaatgttagccattctatttttagcccttctgtgtagtggtgtcttattatggtttgatttgcatttccctaatgactaacaatgttgagcatcttttttttttttttttttttttttttgtggagacgggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccgagcatctttttcaagtgtttatttgaagggttcaggccttttcccacattttaattgagttgtgtttgttattatttcattttgatcattttaaaatatattcttggtacaagtcctttataagacgcatgctttgcccatattttctccaggtccatcacttgtcttctcattctcttaacaatgtctttgaaagagcacagattgctaattttgatgaaattcaatttatcatttatgctattgaatatcatatctaagaaatctttgcctaactcagagtgacaaagattttatcctatgcttgcttttggtttttttccatttaggtctatgattcaccttgaattacatgctagtggatgtggagtggtatctaattgtgcttttgatttgcatttcctttttggctaatggtgttgagcatcttttcatgtatttatataggccatttatatatcttctttagagaaatgtctgttcagatcttttgcttgtcgagttatctttttttttttttttttttgctttttaaagtaagacagacaaatgatttacaaatgttctctaattgtatgggttatttcttcactttcttgttgatgtcctttgcaacacaagtttttttattttgatgaggtccagttaatatttgttttgtctttggtgtcatatctaagaagctgttgcctgatccaaggtcacaaatatttacacataggttttgttctaagagttttctagttttgactcttatattcagatatttgacccattttgagataatttttgaatgtggtgtgaagtaggagtctagtttcattcttttgcctgtaaatatccagttgtcccagtactatttattgaaaaaactattctttctcccattgaactgccttgctattcttgttgaaaatcaactaaccataaatgtgatgatttatttttgggctttaagttccattccattgactatatgtctatttctatgccataccacattgtcttaattacctggggctctgtagtaatttttggaattgggaagtgttttccttcaatttcatttttcttgttcaatattatttgggttattctgggtttcttgaatttgtataaattttaagatcagcttgccaatttctgcaagaagtccactgggattcttgaagaggattgtgtttaatctgtacattaattggggaatattaccattttagcaatattaagccttccaatcatgagtgtggtgtctttctgtttatttaaatcttaactttcttccaacaatgttttgtagtttctatgaatacaagtcttgcagttcttttgttaacattattcctattttattctttttgatgccatattgtatacaggattgtttttttaatttcattttcagattgcttgttgctaatgtagagaaatacaattgatttttgtatatcgatattgtatcctacaactggctgaactcatttattagttataatagatttttagtgaattccttaggattttctgcatacagatcatatcatctgcaaataaggatagttttacttcttccttttcaatctggatgccttttatttcattttcttgcctaattgccttggctacaacctcctctagtacaatataaatagaagtgacaagaacagacatccttgtcttattcctgatcttgggggaaggcatacagtctttcatcattaaatacaatgttagctatgggttttttgtaggtcccttttcttagattaggaaggtgtcttctagtttattgaatggtgtttggtttggtttggtttggttttttgagatggagtctcgctttgtcgcccaggctgcagtgcagtggcgtgatctcggctcactgcaacctccgcctcccaggtccatgtgattctcctaactcagcctcctgagtagctgggactgcaggtgcatgccaccaccacacccggctaattttttgtatttttagtagaggcggggtttcattgtgctagccaggatggtctctatctcctgacctcgtgggatctgcccacctcggccttccaaagtgctggaattacaggtgtgagccaccgcacccagcccctattgaatggtttttattaggaaatggtgttggattttgtcaaatgctttttccatgtctgttgagatgatcaagtgaattttgtcttctattgatatggtatattgcattaattgattttcagatgttaaaccaaccttgcagtcctgggataaatcttatttggccatgatgtatgattcctcttatatattgctgggttcgttttgctagtattttgttgaggatttttgtatttatattcatataggatattggcctatggttttcttttaatgtctggatttggtagcaggatgatactgaccttatagaatgcttcctcttctattttttggaagagtctgtgaagataattcttatttaataataataattcttatttaaatgtttgctaggctgggtgtggtggctcacgcctgtgatcccagcacttttcgaggctgaggcgggtggatcacctgaggtcgagagttcaagaccagcctgaccaacatggagaaaccccatctctactaaaaatacagaattagccaggcgtggtggtgcatgcctgtaatcctagctactcggcaggctgaggcaggagaatcccttgaacgtgggaggcggaggttgcggtgagctgagatcgcgccattgcactccagcctgggcaacaagagcgaaactctgtctcaaaaaaaataatagtaataataaataaatgtttggtacattccaccagtgaagcctcttggcctggacttttcattgtgagtagtttttttattattattaattcaatcttttgtcatataagtctattcatatctggtatttcttcttaaatcagttttgttagtttctatctttctaggattttgtccattttattcagttatcttttgaagagatttagataataatgagcaaaaatcttagttaccaatgtcgttaacattaatgatgtttttcattgctttgtataaatccatattcctttctggtattatgttcctctgcctaaaagacttacagtacaggtatgatggtgatgaattcctttagctttttatgtagagaaagtattttgcctttttcaaagataatttctctgggtatagaattgtaggctggcatatttttctttttagttctttaaagatcattgttccactgtctaattactttcagttttcaaagagtaatctgtcattattatcttttgttccttgtatgtgatgtgcatttttcatgtggccagtttaaagattttctctttacattggatttgagcaatttgattatcatgtaccttgctataattttctttatggctatttgggattggttgagcttcttatgtgtgtttatagtttccatcaaatttgggaaattttcagccttatttgtttaagtatttctcctgactccttcccccttctttggggactccagttacatgtatattaggctgtttgaagttgtcacagagcttatcaatgctttgtttatatttttgattcttttttctttctgtatgttgcatagtttcttttgctacatctctagtttactaatattttcttctaaaatatctaatctgccattaatcccattcagtgtatttttcatctcagacactgaaattttcatctcctgaagtttaacttggatctcttttatgtcattcatacctctacttaaatttttgaacataaacatcattttaaaaatacagttatgatagctgttttggtgtcctttttctgcagattcccacatctgtcagttctaatcattggtcagttttaattgttgatttttttcattatggatcatatttttttatacctggtaatttttgttgagatgccagatattgtgaattttattttgttgagtactggatatttctgtattcttataaatattcttaaggcttgttgtgctattacttggaaataatgtgatcctttcaagtcttgcttttaagatgtattggcaggattagtgccatgtttagtctagagctaattatttcccactactgagacaagatttttttgagtgctctaccgagtgccctgggaattctgaggttttccagtctgtctgttgggaacatgcactaatcctggccctgtatgaatgctgggttctgtgtcctctaattttgtgtgtggtcctttccttagcccgttagttgcctcataagcctttacttatcagtgctctgccaaatacccatgggatatcctattcagatttctggagttctctctgtgtgcagctgtatccactctggtactatatgctttaatcctagataccttggtctcttcagactatgagctgcatcccatgaactcagggaatctgctgggctctgcttaggttcccctccttgtgtggctcagaaactaaggcagtaagctggcaaccacttgtttcttgtttctctggggatcactgtcctttgttacctgatgttaaatatcttgaaaatcattgtttcatattttgggtttgttggcaggaaaagttgtttgtttgtttttggttgtttcaagacaaccaaagagagcaaatctgagagtaaatctggcccgttacttcatcttggtcgtaaaaggaagtcagttttttaagcagttttagagagttagaattgatggcttgtaaggtttctttcaatcctgagatctttggcttcatattacatacctttaacagcttattttcccatcttcacattatccttttctctcctcaaaacacttaactatctgcatttgtgcttagaaggcttgttgggattaactctgggctgtgaatgaaccgtattcatgatacaaacacatttcatagaatgatgacaatcaagatgtaacaacagaaaaatgttttctataatattcttaatatatttatatgatagaacagctataatgtaatcttctagattatggccaaagagtttctttcgggaactaggcaaataagattttaattgaaatctttcatttttaataaccacagaattatgcaacttttacattctgaagtaattacagtatcctttcattttattggaaaatattcaactgtaatattaagtaggatatctcaaaacctgtatttcccttaaagggaagaggaagaaaaatgaccttagctttttaacactgccactgataatttccattctattttattgaaaagtaaaccttcagtagtgacctattgtctgagttatagctcatagtctaaaatacattgtgtatataaagaaaacatatgaggtaccatattaataaaagatagtggtagttctgttacccagtttcacttcagttttgagtataacatgcttaagtatgtatatctttattaattaaagtatgtatatctttattatacaagattatgtctccacattttcagttctttttcctaataaatgggctagtaatagttaaaacagataccgctaggtttatcttttaaataatgaaattcaagtgttttcttatgctagggattatggttttgaggtatggttaagtcctggaaataatactagttattttttgattagatggtatttcttaaagccaactattttttttctgtttttttctacatcactcaaacaagatttataatcagtaagagagatgctgtaatagtaaaagactcccttggccaggcgcggtggctaatcccagcactttgggaggccgaggcgggcggatcacgaggtcaggagatgagaccacgatgaaaccccgtctctactaaaaatacaaaaattagccgggcgtggtggccggcgcttgtagtcccagctactcgggaggctgaggcaggagaatagcgcgaacccaggaggcggagcttgcagcgagccaagatcgcgccactgcactgcagcctgggcgacagagcaagactctgtctcaaaaaaaaaaggactcccttgtagtgagttaaatttttcaagatacttggttatcatttcgtttactaaaataataaatgactaaggagagttaagaccattatttgtggtatattggccataagaagttttcttctgtcctatgttttatacagacatgttaccaaaaaaaaaaaaatacgcattgcagcatttgccacagaaagcatccaggtttttctactcattaaaaaagtggctaggactgataacctgtagtgatcttccaggttttgctgcagtgagaaaaccattactgttaaaaacctgctgtcatatcacattatccttctcaacaagcactttgttacaatggaagttctctttgcagtggagtcctccttgcctcccttgtcctaagttaaacctctatttttagagttaagaatcattaaagacatggaagagttcgcacaactggttgtggcatgaacgatagcatgtaattttataaatgtataaatggtttttgaatttttttctctgctgataaggatgattaaattcttcatgttttttctttatatagactccaaacctttctagacttgtaggaaatctgttgatgcataatacagtggaaagaattatgtgatctaatgtgcaaataatctactggaggacattggatataaaaatgttttcttaatgtgtttttcagatgtctgtgagcttttgaagttgttctttcccccacttaattttaagtctcctagattggctgagctgagcagtagaaattaatgaggtagaatgcttgagttgaataaactgggagaaaatctctctctccagtaaaccgttattactgtaacagaaacagtttctataaactcagttcccaaatggtcataagctttagttgggaaatggtgcggtaattgaaatactatgttaataaagagttataggcaatataattttcaaataattagagaacagtagaatatatgtaatacagactatgctgacgtaattttaatgtttctttgattcaagttatagctgtgtagacataatagttaaaagtattatacatagtttattgttttttaaggtattttaaaaaattctcccaggccaggctcagtggctcacacctgtaatcccagcactttgggaggccaagacaggcagatcacctgaggtcaggaccagcctggctaacatggtgaaaccttgtctctactaaaaatacaaaaattagctgggagtggtaggcagatgcctgtagtcccagctactcaggaagctgagatggaaggatcacttgaacccaggaggcagaggttgcagtaagccaagattgtgccactgcattccagcctgggtgacggagtgagactccatctcaaaaaaaaaaaaaaattctcctagtatttactgaatattctaaattatattagtacctctcatagttctctgcatgtagtagtcacgtagctaagtttactgaagccacaaacaaatttgatatccttaagggaacaaaattctgattgattctgatctgtgtctttcagaaaaatcactaccaatataatggattttatatatcagattgctttattctggatatcatggtaacaatacagaaagtatacataatttcccatttctgcaagtagtcatgactgctgaagaaagaaaaacttaaagctacggcagaattattttatggaaattctgattttgtttttaatttttgataactttttactaaaggtatgaacacacaaagagcttattttgttaggcaaatacacattaataagaatgcctagaagaggactgattcttcacacccggacccactggttgctgttgggccttgctttgctctgcagtttggtattatttatgtacctcctggaatgtgccccccagactgatggaaatgcatctcttcctggtgttgttggggaaaattatggtaaagagtattatcaagccctcctacaggaacaagaagaacattatcagaccagggcaaccagtctgaaacgccaaattgcccaactaaaacaagaattacaagaaatgagtgagaagatgcggtcactgcaagaaagaaggaatgtaggggctaatggcataggctatcagagcaacaaagagcaagcacctagtgatcttttagagtttcttcattcccaaattgacaaagctgaagttagcataggggccaaactacccagtgagtatggggtcattccctttgaaagttttaccttaatgaaagtatttcaattggaaatgggtctcactcgccatcctgaagaaaagccagttagaaaagacaaacgagatgaattggtggaagttattgaagcgggcttggaggtcattaataatcctgatgaagatgatgaacaagaagatgaggagggtccccttggagagaaactgatatttaatgaaaatgacttcgtagaaggtaatgtgaaaaatatgttggtcaatattatgttagtaagacaaatgctagtattgtatgctggtattgtattgtagtattgtactgtagacaaatgctagtattgtattgtagacaaatgttagtaatataagtcagtcattatccacagtattaaaacactgaaagtttttgcacttcattgcaccaagaattttaagtggccttctggaaaaaggtatgagatcataataaaaatggagaataaggactagggaaatagaataaaacagctcttgttgcatgtgtatgatttatattcctcacttacctgatcttggtgttcttttttatgtttttaaaaaatgtgtaaactaaaactcaaaacttgaaaaccatttgataaaggaaagaaaaaattagtagactcttagctatttttcgtattggaggaaggagaagctcatgtctgaacaaggggttatacatagtttaaaaagcacatttggcatttggaaaagtaaggaaatacctgttttcctaatacatatttcagaaagggtatggaatttttatgtatcaagatgggatgtgactcagaggttgaagaacactgctataaaatttaagatattgattgatattaacagtaataattctagatccctacccatctcctttacactcactgctagacatttaattgctgacttaaaccattttaaaaataaatgtttcttgaaagttctctttgcttgattctataaactgtgttatcacagtggtccccagcctttttggcaccagggactggtttcatgggtgacaatttttccatgggatggtgaggatggttttgggatgaaactgttccacctcagatcatctggcattagttagattctcataaagagcgtgcagtgtagattccttgcatgtgcagttcacaacagagtttgctctactttgagaatccagtgcagccactgatccgacaggaggcggagctcagacggtaatgcttgccaggctcccatcactcacctcttgctgtgccgcctagttcccaacaaacaggccacggaccagtagcggtctgtggcctgggggttagggacccctcgtatagcacatgtagactttttgactccaaatcatcatggccatcacttgctgcactgtagcattattataatacactgaggcccttggaggccatcagggagggcattatgctttgcagtggcattgcagctgcctttccttgtggcctcctcttttttctgctgtcacttcctgccatttttgatggattatttttctcaaaactcttctgatttttctgcaagctcagctttttgtcttctcactgtatgtttgtagcttatggcagaattggaagctgcggaggaaataagataactaagtaacatgtgtaaaatgtcctcacatcagctctacctaaaaagaaagggagctgtgccagttttatattctgcagctcctgcttttgtcttataactctccttggattctgatacttcaggatttttctctaaatggaacatattctgttcctcacttttcctctactgtgccactgtctgcccactgcagggagaataattactaataattagtaatgacaactaattcctatccctcttctaaactttagctcagatatcacttcttctgagaagtcatctgcaacctcaggtctaagacagcagtacttctgtgtgctcttgtcacctgtacattcatactgcttgtcacagtatgtggcattgcccatttcctggtttgtgcttcctactaaagtgtaagcctcaggagggttgggaccaagtctattttattcaccattttatacccagatatttactgagtgactcacacatctgtaggtctaaccttcttctctctcctgagcgccatacttaaaaatcagattgccactgggcgcagtggctcactcctgtaatcccagcactttgggaggccgaggtgggcagattatgaggtcaagagatcaagaccatcctggccaacatagtgaaaccccgtctctactaaaaatacaaaaattagctgggcgtggtgacacacgcctgtagtcccagctacttgggaggctgaggcagaagaattgcttgaacccgggagatggaggttgcagtgagccaagattgcaccactgcactccagcctggtgacagagtgagactccgtctaaaaaaaaaaaaaaaaaaaaaaatcagattgcctcgtagatgcgcatgcttttctctcaaaggcatctcaaatcactgtgtttaaatctgtaccaatttttctttgacttcactctagtcagtgattttatatgtatgtatgtatacacacatatatatatacagatatatatatatatcacatagcactatattgttattatttgtctatttttctgtctccttcactagactggccctgtcctcaaaattgagaccatgtggcactctttgtatcacataactgacacgaaggcactcgatttcttttagttgacctaaaccaatagaaattttggctcttgggtctagattttaatattgctagaagtaatttctttatttatcatgattaccatattgataggctctagtatttttaaaaagtcgtatgtaaaaaggaacaattgtcatttgtagtatattttatagattgaataaaataacagaacagtgaactttttttttaaccttttcttttaagcgagtaattgttactgtgcagtggggataagtattttcacaaataggtaaaaatcctgcaggtctagtttaataccctttatgtttaagtgagtaaaatctgtcttcccattgaatttgtaaactttgacatggagacgtctttgttcctaactctttcctttaggttattatcgcactgagagagataagggcacacagtatgaactcttttttaagaaagcagaccttacggaatatagacatgtgaccctcttccgcccttttggacctctcatgaaagtgaagagtgagatgattgacatcactagatcaattattaatatcattgtgccacttgctgaaagaactgaagcatttgtacaatttatgcagaacttcaggtaactgtcagggcttaatgattaagctacattctcctaaaaaaaatcacgttttactcagatttccttaatttatcttcaccgattataattacttagaataattttacaggctttaggggaactttatttttttatattctctctttttttaaagcatgtgtagtatattgtgttatagacaatttgaactatgaaataaattaagagtgacacctattagaaactaaatttgatggccttgataattgttttgaattcattttaagacaagttgaatttttaaaaaatcaactttactaaggaataatttacatgcagtaaaatccacatattttaaggatataggtatcatgactctttttttatttttatttttttttttgagacagggtctcactctatcacccaggctagaatgcagtggagtgagcacagttcactgcagcctcaacctcctgggctcaagtgatcctcctgcctcaacctcccaagtagctgggaccacaggtgcatgccatcttttttattctttgtagagagaaggtcttgccatgttgtccaggctggaatttaatgtcttttgacaaacgtatacactcacgaaccaccaccccaattaagatacagaatacttgtgtctcacaagaaaatccccttgagaatgatttgagttttttaattgaaatacatttagacatacaaacattaaactaaaaattggagaaagttatttcagcttgcaaagcagagaatttgtaaagtttttttatgttatcaaatttgtatattttaaaatgctgaagtgttaaataattatctacacattatgaaaactatttgtggaaaatgctttttgatttaacagtttccatgtttctaatactttaatatttttaatgttttagatactttgatatactggtttaatgctttgtgatcctagtctttattctcatattgaaattgttggatttaaaaggttaattaaaactggtctgcagctgaatgtctggcagtcatacttccaagtgagatttactgttccaaatagctcacttgagatccgatttcctaaagcatttttttattgcctttcttggaattactttcaaaggccacattattatttacagtaagtaatctcagtcatggcaaatatttattccttaatgatagttacaatttttggaattagccagtctgaagacaaaataactcttaatccaaaaggtcagtatttatttatgtggttctgaaccagttgagtttatttccttgaatagcttgtgatttgcttctgaaagcaatccaaaagcaaaagttcaaaaaatgttttgaaataatggcagcaatgtcagactgcttccatggccctccaaggggtgcactcattcaggcatagaccttgtgccttccataattcatcagtattgccacatttatgtttactactgtgtcagtaatgcctcattttcttgttaaagcttcatgtggttgctttcttaatgaatagtgcctcatgttttcttgaataaacttttatttttcacttctgttagggatgtttgtattcatcaagacaagaagattcatctcacagtggtgtattttggtaaagaaggactgtctaaagtcaagtctatcctagaatctgtcaccaggttggtgaaccacatctgcagtgaaggccttgatatataacattgctaaaagagaatttcagatatgtaatgagttaataatttttagtaactattatttaaaaattggctgagcatgtgggcggtggtggtgatgataagttcctcatttcacatgcaaccctacatgactcaacttcccttcactgcttagcaagcagcctggcatgatgctttctctgtggcccactcaccttctgtgtatttgctgctgctttcctttttttaaaatctaattccttcactttgacataatcatcttctgaatttgtctcttttttgtcacctttctttccttccatttcctcaggctccttcttctccccctgctaacaatgttgaggtctcccatatccttaagaaactcccactcaactctgaagtgcccagccactactgttatgtttctgtcctttcacagctcaacatcacgagacagtagttcatagctaagcaagtcatatagtacctggcacatagtagatgctcagaggtttgaatggatgaattagtaatcccttagtacttaattattaattctttagcctctcagcctttttctttctaaatcatgggcccaaagataacgacttaactgccaaattcttttctgttattctttttcattgcttttttacctttgacaacctaaccagtatttctgtcttaaaatgttcttcttgtgtttgtaaaatgtaactattttgtaaatgtaagtatgatgtaatgtaaactattaggttgattatcatctctaaccacaccagctctatatcctttacttgcttctttacctttctgccagttgtggccatttgccaagagcccagatttgatcagccattcttctcaaatcattcaactcacattcattgagtcctgcctactgtgttccaggtacactgcttgggagtttgactggggtagttggaagaagagtgggcgtagatgagtgaatctgagtccctgacctgcagggattctcagagccttgatgtatatagacacaattcactgtcttccccttccctacaccagctcctcctcctgatggccctctttcagttcagagtaaaaccattttcaccatctgggcatgacttctgagagccacagtcttttacttattctttgcctccagttacctctaattagttagttcctacttaattcacaggacctcttctctatctcttccttgctactgccaccaccctaaccctggttccccctccctccatttcttcccttcctgtccctccttagtgtttttagatcacctactaagtgccacaagctcacactggtaatactgaagtattgtcaagacacttctgtggcaaatggtgtaaacctaccttgagcttgcttgaggaaaataggagcagtattgaagaatctcggatacctcccagaaataaagggattgttacaaccaaatttggggaagaaaatcaaaacaactcttgtttctcagggattggaaccagagacttgaataccatcaaaattctcgtctccttgtctgtttttctctgcatgttgacttcattctcctgttgcagattggcttcttccacatggtgagggatatgactgttggcggctctgggctcacatcttctcagctttgccatcagagaggaaagagctttctcccagctccagttgagaaaatcccagggaaggacattttgcccactcttgagccaatcactatggccaggttgggtgggggtattgggactggcccagcttaagcctggtctccacccctaggaaattactgtggttggggtgggcagagagtgaggggtattctgtgatcagtgcctccacttgatgctgagtatgtggggtggcaatgggcagttttcccccaacagaggagagatttatattccttaagacggggagaagagtcctaggcattcagagcacttggagtccactccatgcactatttgagcctttgttccatctctccattacccattctgtactgttgtaagtgtaatcctcctaaaatgttacttttttgattaggctgcaccctagtgcagtgagtgattctccagcttcagtgccagagtcaccaggaggacttgtgaaaatgtagaggcttctctccagccctagcatctgattcagtgggtctggctgtagtctgagagtttgcttctctaacatgttaacacaggaagctgatgctgtgggtttgggggcctcactgtgagaaccactgccctagcagaaaagtcctgctgattctctttgcctttaggatactgaccaatttctttaaccttgcatgggaggtactcttcactctgacccttctctcattgttcccattttaagattccgttgacccttatctcactgttcccattttagggtccttttctaccaatctgatttgtctgatcccttttctctaaaatgctttctacattcttacctctttgcctttgagaataattattttgaatgacctttacactcaccactgaattcaacattttaaccaaggcataactcacgttccacttctaacatcttctctaactactccagacatgagcgatgtatttttcagaactgctgttcattcattcattcagcaaatatttattgaactcctactctatcaggggacactgcatccatagtaatgaacaaaacaaaatccctgctcccacagagtgggagagacactggaacaaatatgtctagcaatatgaaggaaaacagctgaggaagaggatggagatgaaggagtgggaggtggcagctgcttctcaagtagtattagggaggatccctctgataaggcgacatgtgtgcaaagacctaacggatgcaagaggagagtgatctttgtgtgtgttatccatttagaatgcattattaacagacattacagctatttttccatttgtgtatttttcaactccccaaaaggtgtttaagattccaaaggtcagtggccactttaacacttttggagcctcataccaccaacatgtgcctcaaattgggcatttggtgaatatctctccctgatgataatcatacacatgaagctgggattttctttccctttgtgaatgtagaaccaatataatcaaatatttgaagtgtaaaacatattttgtaagctgtgttgaaggaagaaaattggtaactttaagtgggacttatcatttgttgtgtgtgctttcctcatagtgagtctaattttcacaattacaccttggtctcattgaatgaagaatttaatcgtggacgaggactaaatgtgggtgcccgagcttgggacaagggagaggtcttgatgtttttctgtgatgttgatatctatttctcagccgaattccttaacagctgccggttaaatgctgagccaggtgcgtaaaatgttggtagatgagctgactatagaatttagaacgttgtcagcatgtcctatagtttgaatcaagtgattttgagggagaagttttagttaaaccccagtatttttttaagttatattaggcataatttaactggaatactaaataggaaattgaaaatttgaccctttgaaattcatatcctttgttctcttgggtccaacttccagtgactacatttgaagccaaatatggaaatgcagaggaacagggtatctacaaattgatgaggtgggagcagtgcaggtcagaaaaagagctaagcagatggtatggagatgtgtgtgagagtctgaagcactcagctttgggcatatagcgtccacacatgcaaaaatacccccatgcatgtgtgcacacacactcacatggaagtctagatgcagatagtgcttggtctccagactgtgcattttgggatgatttactatactttgctttaagttgtagatattttttgaaaattaatgagatagccaggtgcaggggctcacgcctataatctcagtacttcgggaggcttaggcgggtggatcatgaggtcaagagattgagaccatcctggccaacatggtgaaatcccgtctctactaaaaatacaaaaattagctgggcatggtggcgtacgcctgtagtcctagctactcgggtggctgaggcagaagaattgcttgaacctgggaggcaaaggttgcagtaagccaagatcatgccactgcactccagcctggtgacagagtgagactccatctcaaaaaaaaaaaaaaaaattaatgagaagatgacattttttgaaatcaaattttaaatgctttttagttcatttaaaagaattaaaagtattaaagaggctgggggtggtggctcatgcctgtaatcccagcactttgggaggccgaggcgggcggatcacgaggtcaagagatggagaccatcctggctaacacagtgaaaccccgtctctactaaaaatacaaaaaaaattatccggtcgtggtggtgggtgcctgtagtcctagctcctcaggagactgaggcaggagaatggcgtgagcccaggaggcggagcttgcagtgagctgagattgcgccactgcactgcagcctgggcgacagggcgacattctgtctcaaaaaaaaaaagtattaaagaatctcaacaggatgagtaagttgaggaaatctgttatacaaacatggtgactatagttaataacaatgtattgtatacttacaaattgctaagccagtagtagcattaaaaaatgttcttaccaccaaaaaaaaaaaaggttaattatgtgaggtgatgatatatgtttattagcttgatttagtcatttcgtagtgtatgaatgtagcaaaacataatgttgtacaccatttttattagtcaattagaaaaacattggggtgggggggtgctgctgagcacagtagctcacaccttaatcccagcaccttgggagtctgagacaggaggagcacttgagtgcaggagttcaagaccagcctgggcaacatagtgagtcctagtctttaaaaataaaatttttggccaggcatggtggctgaatgctttttagctcatttaaaagaattaaaagtattaaagaggctgggcgtggtggttcatgcctgtaatcccagcactttgggaggccgaggcaggcggatcacctcagtcgggagttcgataccagcctggccaacatggtgaaaccccatctctactaaaaattagccaggcgtggtggcttgttcctgtaatcccagctacttgcgaggctgaggcagaagaattgcttgaacctgggagacggaggttgcaatgagctgagatcgccagcctgggtgacagagcaagactccgtcttaaaaaataaaaataaaaatgttttaaagaatctaatagcaaatggggtttttttaatgtagaactattcatatgcaaatgattgccttcttattaattaggttagagatagttttcaggaactctttgagaacctaatgaataaatgaaggttaggtttattttacagcatgaaatgcaaaatgtgaaagttgaaggagacgtatttgcttagtttaaaagaaatattttatatccagaaatagatttgcctctggaaaattgaactccccatccctaaatgtatttgaacaaaggtagaatgagcatctgctagggatcttgtaataaaaaggttgccatgttactcccacacttcctgacaatcactgaacacttcatgtgatcatatctgattgaagccagccatagcaagggttgcgtctcctgagggaagatgggctagttagcctttatggtccttttagatcagtcagtttgaatgctgatgacaaggtcttctccaagggctattatatcaagtaattttaacccttgtcttcccgacttttccagattttggttcagatttattctatattttcattattctctgcatatctattcattgtacagtattctttgaatttactctttctaatgattcatttttgacaggtggatttaacagacgtttctaagtttcatagtgattatcagaggttaatctacgtttattactactgattagatgaaacaatgagtaataaatgactcacgtaatgaatacacatctccccaaagtcaaagggaataaacgtgaagcaccctttagtttgttttttcctctgttcttttgcaaggttatagttaacctactgatatgttacaaaatcatcatattcatcaaattaacatgatgttctgtagcctgaatattaaaaaatagataaaatcatgtataataagactttgataaaacttaatagatattgcaataaagaacagttcttcataacttctttttatgttacaaacctatattttaatttgtaggtaagaaggtgttttaccctgtggtgttcagtctttacaatcctgccattgtttatgccaaccaggaagtgccaccacctgtggagcagcagctggtgagactttcacattttcagttatgaaagactctaaagatcttttctagatgtttgttgtgtaagtagaaaacaaagtttcaataaaaaactgtatttccatgagcaaagtgttaaagaaaaactatagttattgtaagcacatttccatagttcctctttatacccccaataagatgcttttcacatttattgcttcagaattaagtgtagggggagcagagtttaggtcataaaggaaaacctcatgtcccagaatgtggaaattgtacagtcatttctaccagcttatttttactaatactaaaaatttgattttaaaaaccctactaactagaaattaaatctactctgctaaataagagggaatagtatactctggtaaattacctggaaagtcatagaatataaatgccatatatcaaaacttacagttattgccaaagctaattttatgtaagttttttaaaatttttaaataaacattattttataataatttagatttagagaagttgcaaagatagtacaaagagttccatacttcacccagtttcctctaatgctaacatcttatgtaaccatggtacatttgtcaaagtgaagaaattaatattggtaagttactgctaagtacactaggattacaccagtttttctactaatgtcctttttctgtttcagaatcgagtcgagaataccaaattgcttttaacataatcttttattattaatactaagaaaaagtagaaatgattaagaagtcactttaagatgtttaaaaaaatgaaaaataacttcaaggaaagtaataaaggcagaagttaataaaacaaaaatagattgagaaatatagaagcttatgtttatgtacaaaaaatttaatcataaagtagacagatttcaggtaaaaaggaaaacattggaaattagaatatgaaaacattgagataaatcaattttatagggtaagttttctaaattataaataaatgaaagatttgagaatttataaaatatgaacacaggctaagttcatgttagtattttatgaataaaagaggtgcaagtgggccgggcatggtggctcacgcctgtaatcccagcactttgggaggtcaagacgggtggatcacaaggtcaggagttcgagaccagcatggccaatatggtgaaaccccgtctgtattaaaaataaaaaaattagccaggcgtggtggcacgagcctgtagtcccacctactcaggaggctgaggcaaaagaatcacttgaacctgggaggcggaggttgcaatgagccaatatcacgccactgcactccagcctgggtgacagagtgagactccatctcaaaaaaacaaaacaaaaaaaaggtggaagctctgaagaaattaagagccatttaaaaaacagttatcaaaaagttaccctgtaggtatataaatacaatgttttaatttataagcttttccagactctcaaagagcaggtaatattagcaccatatgatgtacttaacatattttatgaggccaccattatcttcatatcaacacttggcatagtacacacagacacacacacacacacacacacacacacacacacacgcctctaccttatctataggccagtattatgaatataaatacaaataggttcaaaatggcaaactgagcacccacgtctgccatatctgacggtgaattattctgaagaaaagggtacattagtactggaaaatgagagaaggtgttagcagccgtaagtcttgagaactttctgtaagacgatagcagttagcgtaagatttctggaggagagaacagactagaatgtgttcaagagaacagtgagtgaagatggggctgctttgcatcctctgagctcatagcagacagaatggagggagcctggaataaacatgcttctctaggtgtgctgagaagcaggcatcacagggattgaccctcagtctaaggcagtgcatgtggtccctggagctggagaggctggtcggggtggctagggagcccctagactacaaaagtgaactactgttagcgcattccccctgagaccctgttctaatctccttgactgtgactggagataggccattgtaatcaaagctaacagccatggacttctgaacaatacttgaaacaaaagtgagtagcaattaaccaagactaaccaaacatttgaggaaaaacaatactatgaaagaggcaccaagtgttaatacacagaaaaattaacacatgagtatatgaatacagatagaaagtaattttaaaatatatctttgaggagattagagaaaatgttaaattcataaaacaggatttgttgctttaaaaaatcagaacttggaaattgtgaaaatatttttaaaatcagtaaatggtctgaatagcagaatggttacagttgaatcaaatttgtaaactggaagacaacccaactggacacgtaaagttcacgagataacatgagagaaaaattaagacaaggaagatcaagccagaagctcccaaattattaataggagttcagaaaagagagaatattgagtggaggaaatggaagaaagtttccagagctaagcagaaacaaatcttctggtgtttggagaacaacagtaaaaggacaattctaatagcttccagagacactaaaaatagcaaaacccagtttgttcacaaaggagtgacaatcagattggcattcgtcttctttttgaaaacactggtgttagaaaacaataaagcaatactatgaaaattctgaagaaaagtaactttgattctagaattcatattcaacctactattttaggacaaaatagacatttttgagctttcaaggactcagaatttatttctcaacagacctttgtaatcgagtccagcaaaatgataaatgtatacattgagagaggaggacctgagagtaaatagtggtgaacaaccaaaaaaattaagtctaaacatttgttgatgtaatagtgtaaatagttatgttgacataataaaaaggcaattaataccaatttgggattaagatgtcagcgggttatgtacatggtatacttatgtgtattacctagctgtcagctgagagggcctagaaccagtgacaccctaacagtaacaagtacactcagcttccaaatcttagtttctaatactattctccaatcaaacgagccagaggtccacggagaaatggttgattccagggcaggggcaaaaaatatacaagaagaccctggagcatcttacagtgccagaaagtaagaaagcactcaataaaaagatagggggaatatgtcgaaggggcacaggagccaacagaaagagctcccagtgcccaagctggaacaacctgagcaatgaaataaataacttaaacctggattataacccaaagcatcaagtaaatagccatgagtctatactgatacaaatgagtgagtgaatgagcagataaatattgagtgactagactagataggaaagaaaagttaagtcttccttacagaattccaaataacttatgtagatactccctcttccagtaggtggaactaggggactcactttcaaagaacatagtatggaaagaaaaaacaaacttttcacgggagaaacccagcagacaccttaaccaagggataccatgtacccatgacatgacataatgagaaggacactttagctcacagtcctcttccaaaaacgtagataacttccccaggaaagtcacagggaaagctgcagcaagcccacattgaggagcattgtacaaaatacctgaccattcttcctcaaaactgtcagggtcaccaaaaacaagactgagaaaccatcatagccaagaggagactaaggagacatgacaaccaaatgcaatgtggtgccctggactaggtcctagaatagaaaaaaaagacagtaaagggaaagctggtgaaatccaaatgaaatctggagttgagttaaatagtaatatagcaatgatggttccttagttttgacaaatgtaccacaacaatgtaagatgataacattaggggaagctaaaactggatgaggggtatacaggaactctctttactgttttgcaacttctttgtaaatctaaaattattccaaaataaaaggttgtatattaaaattaattaaaacaaaaagaggcaaataaagtcaacatagaagcgtgaagggaatgtaaaagcatgctaatactctttttttttttttttgagatggagtttcgctcttgttgcccagcctggagtgcagtggcatgatcttggctcactggaaactccaccttcccgtttcaagcgattctcctgcctcagcctcccaagtagctgggattacaggcacacaccaccacgcccagctaatttttgtatttttagtagagatggggtttcaccatgttggccagactggtctcgaactcctgaccttgtgatctgctggcctcagcctcccaaagtgttgggattataggcatgagccaccgcacccggccaaagcatgctaatattcttgcctggtttggagggttgtaggggaagaatgatttgaatgctgattcattctaggtgttgcatagcaacttaagtttaagcacttcaagttctagtttcaccacttgtaacctttgcaagttgcttaacttttctaagcttcagtctcctcacttaaaagacaaaaacttgttttccttgatgtttaaagctatattagaagtaaataagaaggaaaaaaatgggtaagacagttgataattcacatatttaaatagtcagccttactaggaataatttagaacagcagtataatgctttgtttctgctgttaggtcactgcttttaaaaagcaaagccatgtgagcaagactgggggatgggagctcctccgtcgcttctgttggggattcaggccagttctctgagtcgagttctaaacagattcatccctctgatccagtaatttccacccccaacagtctttcctggggaagtaatcgagctacatgatggtaatatgcataaattgataacattaaaagcaagcaaaactctaataataaaaggataaattgaattatggtacattctctggtgaatattgcatatcaaggaaaatgtgaaaaatgtaaatacagccgtgtaaatgaagaggaaaatgtaaagctaaaaagcgggaaatagcgtatctatattttaggtaacatttaaatgatgataatagctaatatttttatgaaccccttactatgtgcagggtacttgttctgttttgcctacacattaattcatttaatcctcctaacaacctctgaggtatgtagtattactgccccatttttcacagctgtgctgcagtcgagtgcctgtccaagtacacactggcctgagtaggcccaggaggctgggtgatgtggctccgcagcctccactcctgtccactgtgcacactgcctctgttatattaattcatcaaatattgagggtccctttgatgccacgcactatccaccactggcaccctgacacttagaccctaacagatatggctgttgctcgtgaggatctttatttattaggaggtgacagaaagtaaaatcagataatgcatgccacgtggatcattaaaacagactgagttgcaaagagtgactccgtggtttctgtggcttgtttggtcagaaaggtgtttctgagatgaagctgagcagagctgtccaaagaacaggaaagaaccagctaggctgtgattgggggatagtggtttcaggcagaaagaacagctactgggtttcctagggtgtttggagcacagccggtgaggggcacatagctgggccagggcatgtagagcttgttcagcctctggaaggcattgggattttatgctaagtatgttggaaagcctttggagggagaatggattgtgtgtggctctggctggcagcagccagttaggctttcacagtagacaaggggagatgattgtggcttgggtgacagtgtattataattacggagaaaggtttggatatgattcagagatagggctgacagagcttgctgttggattagatgtaggaaattagcaaaggaaaggaatgggagagcagagattgggattcaactggagccatagtagccatgtgttgtttatcagacatccaaggggaggtgccaaattgctagttggctacagggatctggcattctgtgagaggccaaggcttgggtatataggttatgtgtggataactgcatctcccacatgcttaggaggccagataaaacagtgcaagaaaatattaacaataaggattatggacaatttgagtttccttctactttcctttgtgaaaatgtgttgctttaaaaatcaaaccaatgattcctttttccaagtctgataatatttgaagaatttttagagaaactaagttacaaagttatagtacttatataatcagaattggcatggtgtagagatgtcaaagtgggtgttttgctttttaatactttgtatcagggttatattttaacaaagagataagaatattagagacaggagtggtggctcacacgtgtaatccgagcactttgggatgccgaggtgggtggatcaccagaggtcaagagttcgataccagcctggccaacatggtgaaaccctgtctctactataaataccaaaattagccaggtgtggtggcgcacacctgtaatcccagctgttcagcggactgaggcacggaaatcgcttgaacctgggagctggaggttgcagtgagccaagattgtgccactgccgtccagtctgggcaacacagtgagactctgtctcaaaataataataataatagagtctagtcttcattttgccactaaaattatgtctctctatatatttatttattcaacacgtatttattgaaagcttgtcatgtgcctggcattgttctaggtgctaggaatatagcagtgaacagaatccacaagtcctcccctcagggagctttacattctagaaggggaagaagttctccccctcagctcaaaaaaaaaaaaattgaaaagaaaaatgccaaactcatccatcagctccaatctgagctgagccctcagggctgcctggttcattatgtgttttcctgttgattctcctattctgtacagcagcaatttcagactgtgcccactcttctcaaaatttgtcacctctgcagaccttgatattcctgctatctgcaggaatttctgtgtaggtgccttacagatcactcagattcattatggccagaaccaactccatgttgttcctctctgggctggcccttcccctgggcttcatcttagggatagcaccattacatacccactgttcaggacggaagcctgctgtcatcttggttgatccttctccttcactccccactcctgcccattcaatcacttgctgacttctgtgaagtctctgacctaaatcttttccacattccacatccatacactcttttgcttttggtacataccacagtagcacacactagactagcagcttcccatccctagttatagctgttgcctcttttctttgtagcatgtatcaccacctaaaatgtatatttatttatttactattttcccacccaaacaaaggcgctttgatggcagggactttgtcacctctgtttattgctaagcctcagttactagaaccatatccaaaagattaaacacttgttgaaagtatgaataaaataaaaggtttatcaggcttcaacttgtaagcagaagtgattccaaggactcagtgtcatcaatgccctggttttatatttctttctctacttagacttaagtggtgacagcctcatattaaagctggtttctcgcatggtagaaaaggactttggcagttccaagcttcatagctgcatcgtgcactagaggtcaacaaatgttttctgtagagagccagataagaaatgttttaatctttataggccatacagttctgctgcaactactcaactctgccactgcactgtgaaagcacccatagacaatttgtaaacagatcaacacaactacgttccactaaaattatttactaaagcaggcagcaggccagatttagccagaggccatcgtttgctgaccctgccctacgaccaaatgtcctttctagtgagtctcttagaagaacgaaggagctttgttttccaaagttcccaacaaccaccctggtttacctacttggcctgatttttttttaaatacctattagtgagccagtaagtaagtgagccactatggtaagtggggtgagactgtctcactagtatagagactcatggcccactccgaatctactggtgacagcagcttccctgaattcatgggctgcccagggccaggtaattaccagaacaaaactgtaccaatcaggaagggggttgggggaatggatactgggtaggcaccagataaagtctactgtgtaaggttgatcctgtgtgttacaatttgtttatgcaactgttgtcctagaatgtaagccccttgaagtcaggcaccacaatgataattagtaacctcagcttgcaccttgtacaggctttgagttctatttttatttgttttgtaaggatttaataacataagtgcatgtgatccttaatcagtcacataaatgacaggaaaaaagtatacattagaaaataatttgtttcatcgttgattaaaacttctgcttcttatggaattaaattgttttctgtttttttttttttaactaaggttcacaaaaaggattctggcttttggcgagattttggctttggaatgacttgtcagtatcgttcagatttcctgaccattggtaagtatactttacatttaaggataggactttatttactccagacttaatggtattttgctaaaaggtctcagatttgagtgttttcctactaaagtatgagtgtctaaggttagctaaaaagagaaactggatatacaaaaggcaaaataagtttataattaatgttttgaataggaaaaaaatggtcataaaaataaagtataatatttacttgttcctttaaaatcaaaacacctgtttttaaaaatatctgtttaacttgttacccatagttgcaggtgtttagagtagtcttacaaaagctttctctataactttactgttgtgcccatgggttgttacagctgggagtaatcttggttatctagaccaaggactttcacatttttttgagatgaaacctcctttacttgtctagtgaactgttacacaaaatcccagtatttaatacaaatgaaagaagacctgctctttctagcgcgtcttggaatcacaccttagtcatgcattcccctaagcctaaagatggcccatgaataatttgttctaactatcctgcatgctctgttgtccaggctgaagagcagtggcacaatcttggctcactgcagcctctgcctcccaggctcaagcgatcctcctacctcaatccccaagtagctgtgaccacaggcgtgcaccaccacacccagttaatttttttgtttgttttgtagaggcggagcttcattatattgcctaggctggtcttgaactcctgggttcaagcaatctgcccaccttggcctcccaaagtgctgggattgcaggcgtgagccaccatgcccagcccctagcttcagtcttacccagcaaaatataaagtgtcaaagaatagtttaataaagcaggctgaaacctgattccatgtcttctgattcatttagggctagctacctttctacagcatagaagtcatagaatatattttatatacattctaggtccatatcacattcgtttttataaccagccttttgttttggaaatccccccaccttgtctccttatcattgtaacacttgaataatggaaaatcaggaaataacaataaaaggggcgttaaattaaactgatgctcttttccttgatttcttgcttagttaagcaagcagcatttcactattcctcaaaaatagatttgtgtacattttttcagtatcttgaatgctttgagttccttatctcttttttatgacaattttattgagatatagtttacatatcataaaatttattaatttaaagtgtacggttaaccaggtcatgtagctatcaccaccatcaaatttagagcatttcaccccaaaaagaaatcccatacccattaacaatcactcctcacatcctaccaaccctctttccccccaaacttaggcatctactggtctacttcctatagatttgcctcttctgggaatttaatagaaagcaaattgtacaatatgtggccttttatgactggcttctttcactcacataatgttttcaaagttcatccatgttgtgacatgttaggtacttcattcctttttatagccaaaaaatgttctattgtgtggttataccacattttgtttctccatttgtcagtttatatgcatttgagttgtttctactttttggctattataaatactgctgctgtgaacatttgtgtttaactttttgggtggacatagattttcaattctcttggacatatgcccaggactctggctgggtcatatggtaatcctgtgtttgaccttttgagaaattgccacaccgttttccaaagtggctgcatcattttacattcccaccagcagtgtttaggagttccagtttccccacatcctcattaatacatgttattatctttttgtttctagtatcacccatgatagtggatgtggtattgattgtgactctgattataatttttcttatgattaatgttgttgagcatctcttgatgtgtttattggccatttgtatatctttagtgaaatgtctgttcagatcctttgcccattttaattgggttatggagtttcttgggcttcttgaatatgtacattaatgtttttcatcaaatttgggaagtttcagccattatagtcatctctcagtacctgcatgggattggatccaggataccatgtggaaccaaaatccatggtcgatcaagtcccttatgtaaatatacatattttcatattacctgtgcatatctgcccatatactttaaaccatctctagattgcttataatacctaatacaggccaggcacggtggctcacgcctgtaatcccagcactttgggaggccgaggcgggcagatcacgaggtcaggagatcaagatcatcctggctaacaaggtaaaaccctgtctctactaaaaatacaaaaattagccaggcgtggtggcaggcgcctgtagtcccagctacttgggaggctgaggcaggagaatggcatgaacctgggaggcggagtttgcagtgagccgagattgcaccactgcactccagcctgggcaacagagtgagactccatcaaaaaaaaaaaaaaaaaaccctaatacaatgtaaatactatgtaaatagttgttatattgtatttaaatttttatatttattgttattttttatcgtttttttccctaatatttttgaaccatgttggttgattctatgggatgtggaactcatgcatatggagggctgactgtatttctttgaatactttttctgctccattctcatagttttctcctttgacactcactgtatgtatgttggtacatttaatggtatcccacatttttcttaggctctgtttatttctcttcattcttttctccctctgttcttcagattgcataatttctattgatctatccaagttctctgattgttttttctgttagatctactgttgagctactctaatgaatttttatttcagttactatagtttttaacttcagaatttctatgtggttcttttgatatatatataatttctttattaatactctatgtgatgaaacattgtcatcttctgttacttccttaagtgtgacttcttttaattctttgaacatacttacaatggctgctttggaatttttgtgtattaaagctaatgtctgggccctaacacaggcagtttttgttgcttgccggttttttttttttttttaagcgtatgtcacatcttcttgtttctttgcattcctcattatttctttttcgaaaactagacattttaggtaatacactgtggcaactctggatactgatttccctctaccaccacggcttggtttttttttttccttgtttatttatttattgacatggctggactattttaacaaattatttcttcctccttccccgaccttttggcaatatgaagcctctgctgttgctcctcagggcctgtgcagttatcctaggatggcattggatttagcagggctctctttatctctttccatgcctccattggtatcactcctattagactccactgactgttcactaattgctgtcttgtttttgacaatgctctggggcataaattgctccataatctgtccctactaaattgggcccttttgcagggatagtttttgcagcaagtctttgagatttgttcagaccccaggaggtatattcttactatctctctctgtggttctctctagtaaattagctggcctacagtttagctgttgccctcctggagttaccagcctcctcttaattgcttactaccaaaatctccattattttcaagaggctggaacttctctaaactctgaacttctctacattctattttaaataaagtcagttccttagggaagaactttggagcactttgttcttatggacttcctctcccccgggggaaaaaatccatgaggttttgccctgaggatggggacagtgacacacttattaagcagagtgaccacctctgccctatgagcaggacactgggtaggggcaggaggacccccagtattctcagctggccacacctggaagtggagcctccaccctgttgctgtgggctgggtgaaaaagagctgcacctgtttagaacttagactctttatttggagcttctgttcccttgtttcctttcttcctggtattcccattatacatatgttacatcttttgtagttgtcccaccgttcttagatattttgttcattttattttcagtctttttttttctttgattttctgttttggaaatttttattgtcatatcctcaagctcagagattgtttcttaagctaagtccggtctactaatgaacccatctaaggcattcatttatttcgcagtgtttttgatctctagcatttttttaaattccttagatccatctcactgcttatgttccgcatcttgtgtgttatctgctctttccattagagcccttagagtattatacatagttgttttaaattcccagcctgataattccaacatccctgctgtatctgaatctggatctggtacatgctctgtctgttcatactgtgtttttcttaacttttagtataccttgtcatgttttctgttgaaagttggacttgatatactgcgtaaaaggaactgcaataaataggcctttgatgatgtggtggtgaagtgtggagggagcggaagtgttctgtagtcccataagtaagtctcaatctcttagtgatcctgtatcccagactctgaatttcacacatgcttctcagtctcccctcctctcctggacaggatgactagaaggggctctagttgggtagatttcttcctccaagtcagttaggcactgataaaaccccagcaggttaggctctggttaaataacttctcctaaggacaggctttgttaataatgacaacatgctgtggcatactttaaaatgattaccttttccccttccccactgctggacgcattaagagatttttctctgatcttcaccactgaggacctaatagagctcctagaggtaaaactcacatgagtatgggggtcccaatatgaccaggtccccctggagtttttaacactcagacttacctcccctgagcctccagcaatttgtcgattacagttagggttttcctacctgggtactggtccccacagagatttctgctccagtaagttggaattctttgtatctgcctatctgtctcaccagttttgagggcagtggtttaccctgtgacctcacttctctgtgagagacctaagaggagttgttgctttttcagtgttcagcttttgacttgttaggatggagtgatgacttctagctccaggcatgccagaccagaaactgagaatgccccatttgttttaagtatatgtaccatctctaatattctaagagcttatatctacaaggaagaaaagctgatatgtatcagacatagcatttagtaaagctctgattgtttaatacttttcagagatccccagattattgtccatcctgttaatgtgaaattaagtgggatagaattatttgacaggagccgggcatggtggctcgaacttgtggtcccacttactaaggaggctaaggcagaaggatcacttgagcccaggagatggaggctgcagtgagctatgattgcacctctgcactccagcctgggcaacagagtgagaacacatctctgaaaaataaaaattatttgacaggccaggcacggtggctcacgcctgtaatcccagcactttgggaggccgaagtgagtggatcatctgaggtcaggagttcaagcttacgaagatgacgggattaagagattaaagtaaagacaggcaatcacaagggtattgattggggaagtgataaatgtccatgaaatcttcacaatttatgttcagagattgcagtaaagacaggagtaagaaattataaaagtattaatttggggaactaataaatgtccatgaaatcttcacaatttatgttcttctgccatggcttcagccagtccctccattcggggtccctgacttcctgcagcagcccactccagttagccttctgccccatcactctatcagaattgttctggggaagtttataagtaacatttatgctgccaggtccagtcagttcttcttaaattcttcactgaatagcacacacttgacaacttcttcctcaagacactttcttcacgtggctactacaatggcaccttttccagaattttctccctcacctggggccacttctcaatctcatttcctgacttaactttctttacctctatttaacctctagaaattggcatttcttagtgtttagacctaggccctgttttccttccaaattccttcagtaatttcattcattcctgtagctttaaataatctatggacccattctcaaatttatatctccagcttggccctttcttctttttccactctggggagtttttctatagcccagaaaagcgtgtgtctcaaaggacagaaaatgtggctggtcgcagtggctaatgcctgcaatccagcactttgggaagccaagtgggcggaacacttgaacccaaagttcgagaccagcctgggcaacatggtgataccccatctccaccaaaaaaaaaaaaaaagctgagtatggtgacatgcgcctgtggtcccagctactcggggctgagatgggaggatcgcctgagccacggaggtcgatgctgcagtgagccatgatcacaccactgcactccagcctgggtgacagagtgagaccctgtctcaaaaaaaaaaacaaaaaaaaaaagaaaacataaaaagttaatggtggtgagattataggtgacttgtattttcttctcctttatttgactttttgtagattttctacaggactttgaaatttacaaagtgttcttaaatatttaaccccattttgatactgtcaacaaccaaccttgagctccttgagtccaagtgtcagctcaaaactggacttccggtgactgggagtcactcctccatgccaggtgtctcgtgctacctttttgctgaaccatcccatcccttttgaagcagaacatttaaaattttatatatatccctgtgctctggctaataataggcagttatttatagtgtcaattttgatcttacaggtggatttgacatggaagtgaaaggttggggtggagaagatgttcatctttatcgaaaatacttacatggtgacctcattgtgattcggactccggttcctggtcttttccacctctggcatgaaaagcgctgtgctgatgagctgacccccgagcagtaccgcatgtgcatccagtctaaagccatgaatgaggcctctcactcccacctgggaatgctggtcttcagggaggaaatagagacgcatcttcataaacaggcatacaggacaaacagtgaagctgttggttgaaatcataattaatgcgttactgtatgaaccacaaaacagcactatttatttagccttacttctacttccagatgcagtgcctcttttggagaagacatgtttatttttcatgttctttctgacattactttagcaattcaacttgatgtgagaagaaaaaacaaatgtttcaacacaaaatctctgttttgtgagaatactgcactatggaataattgacaaattgaaatctcatatttgtcccaaaagttgttttgagttagttctacctggtgcccatgttctgattgtgtgtgggattgcatggtgtcctgattgcatctaggtggagcggatggaatgtgctgggccactgttgggtggagagcagcacattcttacagaggagatggagcgttatgagcatagtatgtggataggtatcttcacctgcccgcccctgagtcagcctccttgacttgatagcttgaagaatccttttccactgaaatagaggataattaattgacacatctgaaatccccaatcaatcaatcaagagaaaggtagaactaaaaactccttaacttactgttgcttacacccctgaaagtctgtttttaagcaaatgggtaatagtagaaaataggttagaatctatggcttgattaaaaatatgttattacattatcatgttcaggattaggattagtagtcagttgctgtaaactattttgaacaaacagaaaagaacacggaaacatttttaacagagcatttaattatgttggaatacaggatcctagctctgtctgggaacattagtttatttgagccagctctatcagggtcttcccatggtggttcagaatagatgagcatagcatggttttgtttgtttttgctttcaattttctaatttggcatggatccatatgtatttactatcctttttctaatatattaatatatgctacatttgtatttgcattactataatactttgagttgaaaaagagtttcattgtggagagaaaaagcaaatggtatgccacaagatcactctgatttgagaaaagggaggaggggaagatagtctgaatggaaatctgaaatacggaatgttttagagaaatatgtcacttgcatatagaatgttttaattgaggtataaattaatgagacaaagtgaaaaagaaattatattcagataggactgcactacattatttgtcacacatggatctgttaccatcaggtcaattcctagtatgcataaattttttaacccttttaaaagagacctatgttgaaaacccctgaaaattcactgaagaaaaatcattactctttttctcagtaaatcatatcatctgaaatattacaaatttcaaatttctaggtgctatattaattcaatattacaataactcttacctaattattcttacaagttttaagttgtggtagtttagtgatttttttaaaagatgtgtgaaatgttctctgcaaaataattcaggccactgtctccttttatatattattataattatttattatgaagaccagtgaattacgatatttaaagtgagagaacttaattatttgcaaaggtaagttacagcttgttttttgagagaatcaaatgagtttacttttgttcctgttgtttttaactagctttaagtttaaagatggaagctaagcaatggaaatgctatacgtttttgacatttattaaatggtaccaataaagtattttattaccaaaagttaa

SEQ ID NO: 1556 - DNA, 52433 bp, Homo sapiens
gagccgccctggccttcggcgagaactcaggcgagcgcggcgcacgctgctccggagtcccaccgcggaagttgaggccgcggattccgagggcggggtggagaggaatctggaaggacctggacccggtggaacgcactgcgcggacggcgcctgcgtccgcactcagctgttcagccctctttcttcaggctctcccctgaaagccgtccccatgccggtctcttttttctgccttcttgtttccctccggcgagtcagcgcgactgtgaatttccgtttccggcggtgtccatgctgacctgaggagtcgcggctgcgagcaggttcggtgctgcgggttggggtaggcggcggtggggtccctggttctggggcactgggaagatcgcgagtcgtgcgtgtgggaaggtcctcccccggtcctccgggtcatctttgctcccgaggagcggcatatttctcatctggcggaggtgtcctggggtagttgggtgagtgacgtgatgaatccctgcagagagcccagacggggagggaaggtggctgggcgacgtcgtttcctggcgacgtggtcccggtaggagacttagacctgagctggatctgttgaccccaaattgtgcttttcccaccaagaagaaagacagggagagaaacattagtacaagtgctgaactaaaatatagcagagaagaaacataatctctgaaatcacacagctattcggtttcaaagcgttcctagcgcccagctctcctaactcctggccagtgttcttgacattatggtaatacataaagactttgtttccgctggtgtgtgtctgtgggaagcctctgactcacctccgtgctccagtagcaccctgtgcagccttccaatgtcgcccttattgcgtggcgcggaagataatagtttggatttcctctgcaagtcagataatagctgtatccacttactggcacagtgcctagcacatcgtagacagacacaaatatttattcaacggaatgaatacagtaccttaattgaatgaaatggcatcctgctccgctttttttttttaatcaagctgtcagattttatgcagcccgatttcctaaaataactcactaattcagtgattgccaatttattagccacagattcccaggtaactcagaaatcactggaagggtctctgtaagttcatggggtctccaggtgtcatctagaaccagtcctatctcacacgtacagctatttctatttttcaaatgtatgtagataagttgtaatttaggagttttacagagtcaacaggtactaaaagtaatactgcgatcatattggaggttcataaaaacgtttcacatttttttattaaaatttaagttttagtttaagttaggaaaccacttcatcagtccagttgatacctgggtctgagctgtccagtatggtagccacatgtgactatttggagttagaatgaaattaattaaaaactcattttttcagtttccctaagtatattgtaagtaaccacatgtggctaatggctaaatggctgaaaagtacagatatagtatatttctatccttgcagaaatagatactgctgatgttgacacttaagatgaataaaaagtaacttaaccataaaatgtaatcttaagagaggtaactcatctaatttatagcataacagagagaaatgaaattggggatggttaagcagtttctacccttgttcagtgaacaaatacatcatctcttcataaagaaataaatgaaatttactgtttttccctgggtattgcctggattgtaaaatgcttctcccatctccttaccccaaccttcttccttgtaggttagagttacttgttattggtaaatagccactatggaggctaaggaccagaagaaacacagaaagaaaaacagtggacccaaagctgcaaagaaaaagaagcggcttctgcaggatctccagctaggagacgaagaagatgcccggaagagaaatcccaaagcttttgcagttcagtctgctgtgcggatggctcgatcctttcacaggtatgttaggctacggtctggtcattcttccattgattctttttttaaatagtaggagcctctcacaggtgacatttggattcacgagtctagtccagctccaaaggacatggagattcatggtgtgtggctttcactaaaacgtgagaagcttttcccatagaagctgccttgcctccagcatctgcatactggttagtgtttattgcccaggatacaagaatttatagactttgtttgttcctaaattttaaactgtttctatggtgataagtgtgctttttccccccaggtatgttttacatagttgtaatataaaatacaaaaattacaatatttaatactaacatagctttatttagtgagcccttgtgatatgcctagcagtgtactttaaacattattcaactaaatccttccagcagccttaccagagtaggaatcattcttgccctcattttatgggtaagaaaactgagatcaagaaaacaagttacctccaatcatataaccagtaagtaggagagctaaatgtaactccagcgcctctgctcttatctgctatgatgtactgcctcgctatttaccttttggttttttaaaaaactattaaaatcactcttaaaacagtcagatttaaggagtgtttaattttcgctctctatagtattgaagtcatcttgttacatctttattgaacagcaattatttggatggggccagaagttagcaagttaataattgacaagttaattatatttatatattgtctgttgtactctctataaaatgtgctaaagtactcatagctataagtgtaccaaaaaagtctacttataaggttgataccttttactctattttgaaaatgagtttactatttatttatttgtttattttttaatgaataggactcaggatttgaagacaaaaaagcatcatattccagtggttgatcgaactccactagagcccccaccaatagtggtagtggtgatgggacctccaaaagttggaaagagcactttgatacaatgcctcattcggaactttacccggcagaagttgactgagatcagaggccctgtgacgattgtgtcaggtaggagatgccaccacagacacagagttggcgtggctgttgtcatctgagggacatgcatgcgtttgttgttttcttgagtggaacatgttaaatattgtcatatcatgggacttctcttatacttagtattactaagttggctatagcttcagaaaagggtaagttcccagagataaggatgtgataatgttcacatttcctcccagcactctgggaggttccaaggcaggaagatactcgaacccagcactcgggctggaaaatcaagctttgctgctcgattgcgacaccagccacagtcctcttcctccgtgtagaaggatgtgtggtccagcctcttaaggtgatgctttccttttcttcctggtttcctcctccattttttgtatgagaaatgataatgttcactatgtcttatcctgactgctctttggctttgccaaacatgttccttggaagggcctagcaggcctagtcaccgtgaacacatcatttaacagatagcacgcacctcctatgtgccaggtgcatatgcttgccttatgaagccacattctggtggaagtgcgagttttctctttttcctgtgagaattgtctgctttgggagatggtgacctttccgagtttgagggaaaatgaaacaaacttccagtggtagaatggcaatgtacactctgaaatctcttgttattgcaataatatagttggattgaggcttttctttatctttggagcatccatattttcttttcccttttttgagacagagtcttactctgtggtacaggctggagtgcagtggtgtgattacggctcactgcagcctctacctcccaggttcaagcattcctcctaccttagcctcctgagtagtgtatgccaccacgcctggctaatttttcttttttttccttttttttttttttctgtagagatggggtttccccatatggcccaggctggtctcaaaactcctgggctcaagggatccgcctgccttggcctcccaagttgctgggactacaggcgagagctactgtgcccagcccatattttcttgactgttttatttttaccttaatttagaagtaattattgttatgaatattctgttgcattatgtttgaggatgtttgtagctctagtgggaatacgggaagttttgatagaggcaaagacattgggcctgcagctgaacagcaggatcatggttatcatggagtctgtgcagtcagaattttccctttttgagcacttttattcatctgggtagacttttgatgttatttaaatttagaacacagcaagaaaaacagaatggaatttattttattttatcagtttttgcctgtaaaaatgaacttcttgtatgctcctgtaaatgtatatgatgttttactggatgcagttaaaaaatgaaaattaagagttgatggttagagttttttcagggtctttttaaagtaaaattttcatcttttcacttataggtaaaaagcgcagactcaccattattgaatgtgggtgtgacattaacatgatgattgatctggctaaagtagcagatctggtaagtgagcaggggcagcctggggtgctgatggagacttacagcattgtgataggttatttaccccgtgatgaagggaagagagtcttataattattaaaagaatcatggtcatcatcagtgatacggtagatatgattgaattgatgataattatggtaataaatgttgttatgttaataataaaaatggaatgtgcacaatgaaatgtgttccaaaatctaaaagcaaatcacaggatggagaaaacctttaatgaacacaactaataagagctcattaatatgtatacatatatacgtacaaatatatcatagtaagtaccatttcttcttggactcttcctggcactgtgctaactgctttctacaaatttagcttacataaacccttgatacacccttgaggtgagtaggtattatctgtagtttacataagatgaaatagagcctgccagcagttaagtaacttgtgtgaagttgggacccttgttcctgatggttccagaaccttcatccttaatgataatgctgaagtaagtacatgaattgccctgaagaagtggtcagtttatcaataaaaagtctagacagtcctcagtgtatggaaaatgtaaatgctcttgcatttatggaaatgatagtgttcactattctgatagtctattaactatcttttaaattagcaaaaataaaatacaaattagcaaaaaaataagccatattgattaggaagtgtggggtgacagacaccttgattttttcatttttatttagttttttctagacacctgtttggtgacaaagagctacagattttatactttggcccaggaagactcctaaaatataaagtaaaaagtaatacagattttaaagttgtgccattgtaatgtcagaaaactaaataacattcaaattttgaacatgtaatgttaatattagtaaaaataagtgttattattaacgtagtgtaagcttactaaatcttgtatacttgaaatgattgaaatagttcatagaagtcatttgtttctcttttatttaaaatgtagcaagcttctaattttaaagacatacatattaagagatacctttacttttttttatttttaattattatggatacataatagttatacatatttatggggtacatgtggtattttgacagaagcatacaatgtgtgatgatcaaatcagggtaattaggatatccatcacctcaaacatttatcatttttttgtgttaggaacatttcaatttcattcttatagttattctgaattatataataaattatagtcaccctattgtgctgttgaacaccagaatttattctaactgtatttttgtacctgttaacctttccctctttgtccctccctccctgctccccttcccagcctcttaaccatcattgagagagatgcccattatgtaaatcttttaaagatttttcaaaaggaacacacacatttggtaaagtactctaactgtaatgcagggtgcacacaatgtgcattttctttttccttagtataaccgctggtctctcagatccctgcagagcagtatccttttagatacatataaacacacatgccaccctttaaaaacaaatggtagcttattttacacactgttctatgctttgcttttttcatataatgtattttggaggtatataatcagtaagtactgcagctctgtctcctttttaatataatattccattctatggaggcaccataatttatttagcctagcttatgttgactgctctgctgtgggttgccaaagcctcctgtgtacagcaaaggcacacacagtacgtggatttgggtgtgtacaggcgtgtgtagattaggggaataacactggcttagatgacaaagactggcagctgagggactgtttgctccctgttcttcctgaccctacaatcagctgcttgccccctggcactctgtggcatcaaatgtagtgtgaggatattccgcctgtcctttgagctggtccagtgttgctgaaaagctgtgcttgctgcctcagtccacagtagcagctgtgctttctcacaagcccaccttcatatattctgtggtttcggattttgaatgtttcctagtttaatcaaagatgggcatttctgtttccattttttttgttatttttagttatctatgcaaagataagaacagaaatgtttttaatacttaaactagaaatttccaggaatcaattctgaaattattttgcatctttgaagcatcttaaattttaaaaattggtctcatctgcttatattttcttatagactaccattcatcgtaatcttactgtttttttttttacctaattctaaactggtagctatttaaaaaaaatttctgagcaattgagttatccaaattaacatataagatagaggtttccactgcatacttctcaacaaaaaacagattgtggtttttttttctatgaggcgattgaaagaagaggttggttttctgtacatatttaatgtatttcattgattatgactctcttcccattctttggatgccagagacctgttatttggcttaaaaataccttacagaaaacttgatttctttaaattaggatttcttaggtaagggccaggttagacccagccttttctgagttacttctcatacattaaaattcttataatggaagtttatatcctagtggacattgtcttatgggttggcttttagagcaagtcagagggtggtggtttctctgtctgggtgatgcctgtgtagtcatttgatttagtctggagtgcaacttttccgtccagggccaggtagtagatatttttggctttgtggatcatatcttctgcagctacttagctctgcagttgtagtgcacaggcagccatagacaatatgtaaatgaattaatgtggctatgttccaataaaactttagttacaaacacaggtgatgggctggattttgcccgtggccagttgccaacccttagtgtaggtggtctgttttggtagtttctttgagaaattatgtgttctgcttttaggtactgatgcttatagatgccagctttgggtttgaaatggaaacgtttgagtttctaaacatctgtcaagtacatggctttcctaaaattatgggagttctcacccacctcgactccttcaagcataataagcaactgaagaagacaaagaagcgattaaaacacaggttctggacggaagtttacccggtacgaagagaaataattgttggatactaacagtataatccttttaaaatagactgaagaggccgggtgcagtggctaacacctgtaatcccagcactttgcaaggcagaggcggtcggatcacttgagcctagagttttgagctcagggcaacatgaccaaaccccatctgtactaaaaatgcaaaaattagtccggtgtggtggcgtgcgcctgtaatcccagctactcaggaggctgagaagtgagaattgcttgaacctaggaggcagagggtgcagtgagctgagatcacgccactgcactccagcctgggtgacacagtgagacgcttgtctcaaaaaaaaaaaatactaaagagacattactaaacgtctctctaggattcgcctcctgaatttcctttgtgtgtgtattcacagtccctggcctcctgaattcctttgtgtgtgtgttcacagtctatggactgctgaattcctttgtgtatgtgttcagcctctggcctgctgaattcttttgtgtgtgtgttcacagtctctggcctgctgaattcctttgtgtgtgtgttcacagtctctggcctgctgaattccctttgtgtatgtgttcagtctttggcctgctgaattcctttgtgtgtgtgttcagttttctggaaggtttccctcaaaagagtgcttgtttggggcctcttggtgtatctcatttgtctctctctgtacctgctgcaccaggcagtgtctggctgttttggggtcaggacttaatagagtacctcggaagtttctcccagttacaggaccaggcactgccccttcctttctatactgctctggaccattggccacagaaccgtttctgtgctcagacgcctcacctccctctcctcaccatacttagatggatgccccggctcggctgcagagcagtctgcctctgtggggttctaataaatcctgaaagaagccagcaaggctctggaagcctcaggacagtggctttgctggaagtctcccttcttaggattgcttcttgtttagagcttttattttgttgcagtattgatgataatttaattgaaatttaatttttaattttcctctaatgtttagggtgccaagctgttctacctttctggaatggtgcatggagaatatcaaaaccaagaaatccacaatctgggccgttttattacagttatgaagtttaggcctctcacatggcaaacttctcacccttatatcctggcagacaggtaaaatatgattttaagctttttcttcctgggccatatatttcaaagctaaaaaggctagaaaaagaacagtgataggatttattttgtgccgatttgaataggggggatagaagtgtagttgatggaaaatgtctacttatatcattgctcaaagatgccgtgcctttgggagtaaattaattatgagatgttaaggaaaatgggagaacttggaagtatttaaggctacaggatgtggccccatcctacgttcagcctcagttttcagtgatgctgccttcatgcccgggtgcttgagtccttcgtgtgtgccttctgtttccttcctttgtgctcttcctcgtgtggttttctcagcctggaattccctttttccacctgccagaatccaagccacagtaaaaatcccagagcacaggctcgccctcttccagaaagggattttctgaatatgttcttcactcttccccgaccccaggtggacgtcatctccctgtctggtgtcttatggaatgaatatcactttcagcctagagacacagttgtgtgtctgccccttttcctctggtggatggtgaatggtgcctccttatttctgcattttctagttttctaaatgacgtgcttaatggacaagagtgtgatgaatcattgacacatgaaaggaggtataggaacttttggcattcatttctgctgtgattgaatttatttttctaggatggaagatttgacaaacccagaggatatccgaacaaacatcaaatgtgaccggaaggtgtcactttatggttatttaagaggagcacacttgaaaaataaaagccaaattcacatgccaggtattctcttgttgtagaacatactagaattacacataggattcttgggatggcttcatttctcaggaaaactgaaaaatgaccaaacaagggaagatggccttgctggaggttttaaaagtaagccacctatgtgtaggcctgcaaaggtgttactgaatcccctcttctctgacctcttgtcttgtagctagggggccactgttccagtgtggcacaatgcccttctttagtgttatgggttaagcccttggactgtggatcatatttaaccccctagtcaatggtagatgcttctgacttcttgtcagctgaagctggcttttgggttctgtcttccaggggtaggagattttgccgtgagtgacatcagtttcctcccagacccttgcgctcttcctgaacaacaaaagaagcgctgtttaaatgagaaggagaagctggtttatgcgcctctttctggagttgggggtgtgctgtatgacaaagacgctgtctatgttgaccttggtggcagccacgtttttcaggtatcggtgagacgggagtcatttctctgaactttcagtattctttctgaatctattttttaatcacaaaaagtaatgtactcagcttttatttattgaagatttttctcttgtacttataataaaggcccaaatgcatattgtaaatatataggataaaaataatactttttttttcattgtaccaagcagaagagtcctctccttcattcctccttgatccatggccccagcacaggcattgctgctgtgtggcgcctgcacggcccatccccgtttctacaaaatcagtgtgctttccagctttcattggtctttttctcattcacaatggtctcctcatgctgtattttaaagtggatttcaaatatttatttctttgttctgaagtggaattttattgggttaaaatcggcttattttaaaatattagaaaagctagcattgttgtagctttggagctgaggtttttctagctaggttgtttaggttatcaggttatatactccctgaactttggaaaagtttaatggagatggggatccatttcaagctttgttgtaaggattttcttctctgctttttgaggcattaagaaaggttcttaggaaatgtgtctaagataattttgagaaactgagtgaagctcgtgtctctccaggatctttgtgctttcctcacgtgccctttcttggtggtcttgacaggatgaagtggggcccacccatgagctggtccagagtctcatctctacccactccaccattgatgccaagatggcttcaagtcgagtgacgctgttttctgattccaagccacttgggtcagaggatatagataatcaagggtaagtctgctttttttctatttttaataaaaagatgtattacaaaagatcatatcacccataattcagccatcataacacatttcggtgggattcattctatgttgttttgtttttctttgtgtgtgcatgtgtctctgagggctcttcacttacctgacattacaagggagtcttttcttgaaataaattgcaggatgcatttttcaacagaccccaaatattcctcaaataccatgccatcttccataggttgccttttgttttttaagagacctgaagccacttggctttcttttggtggccaaaacactagagcaaagtcagggagtttgtggctgtccagaagccacatgccttgtctctgaaagttttatttagattgtgttgtattatctcctctgggtaggtttccgtggatgtatggctcatgtgaattattttccagtctgggttggggatttgtatacctttatatgcagtggatgtttgcaaaacattggttttgttgtattgatttatgactcccagtaaaatttatctgaaaattttgagattatctagtatgtaatttggtacaatgtgcataaactacctagcagaatgcctgacaggtacgaagtgttcgccgaaagatcactcctttataatgggattactagctattttcacttttgcatatccttctagtcatctttgtctacaagaatactctcctctaatatagttacagttaaaatacataattttatttctatattatcatttccttctttttttttttattatactttaagttttagggtacatgtgcacaatgtgcaggttagttacatatgtatacatgtgccatgctggtgcgctgcacccactaacttgtcatctagcattaggtatatctcccaatgctatccctccccgctctgcccaccccacaacagtccccagagtgtgatgttccccttcctgtgtccatgtgttctcattgttcaattcccacctatgagtgagaatatgcggtgtttggttttttgttcttgtgatagtttactgagaatgatgatttccaatttcatccatgtccctacaaaggacatgaactcatccttttttatggctgcatagtattccatggtgtatatgtgccacattttcttaatccagtctatcattgttggacatttgggttggttccaagtctttgctattgtgaatagtgcggcaataaacatacgtttgcatgtgtctttatagcagcatgatttatagtcctttgtcatttccttcttctatacagtctttatgtagtcatcattttgttattattggtgtattcttttttttttgtgacaagatcttgctttgtctcccaggctggagtgcagtggtatgatcttggctcacttcagccttgaactcccaggctcaagtggtcctcctgcttcagccccccaagtagctgggactacaggagtgcgccaccactcctagctaatttttttttttttttctagagattaggtctcaccatgttgcccaggctggtctcaaactcctgggctcaagcaatcctcctgccttggcctcccaaagttctgggattacagatgtgagccactacccctggcctattattgctgtattctaacttacccgtctcttatggtatgattttcagttttttcaaatttatgttttcttaattttatatatcttgctacattaaatagcttcatacagttttcttttatcctgtgattttagcttcctgatgattcttctgtatcagttatagcactggtgacttaaaatggatgttcttcctctgtcattcctcctacgtttgttagctggcatttttaacaaagagctttctcttctcccctttatttcggtatcactgctgactaatgcacttgtgttttgttccatgggttattttccatcactatcattattcttcctgatgcctatgctggcccagatttggctgcaggagccttcagcctgtctcctgtgtcctttcaactgtctctgttagtctttgagcatttctcactttctgacagaacaagaggatccaggctcattttgccttctttctgctttgggcctggacttacccatttctcttaaggatcatgtgtttttagcttagaaattaatcagctttccaaaagatctacaaaacagtaacttctcttttgagcaatttttttctaaaattagatttttgttttttaagggttattcctttattctctctataagttcttttgaagtgtggtgttagggaaccatgcccgagtttgcttcttaactcttccaatgtttatcaaatcatattttccctatgctatgtcatcttaaacaattccttgacattttctatttctttgtattttcattgactatattgccatttctagattagctgattaatgtacaaattgaattattttgtatttccttggtaatacaggctaatgatgccaaaggaggaaaaacaaatggacttgaacactggtcgaatgcgtcggaaagccattttcggagatgaagatgaatctggagatagtgatgatgaagaagatgatgaaatgtctgaagatgacgggttggaaaacggctctagtgatgaggaagcagaagaggaggaaaatgctgagatgactgatcagtatatggctgttaagggcatcaaacgacggaaacttgagttggaagaagacagtgaaatggatttgccagcatttgctgacagtgacgatgaccttgagaggagctcagcggaagaaggggaagcggaggaagctgatgaaagcagtgaagaagaggactgcactgcaggagagaagggcatttcaggatcaaaggctgctggagaaggtagtaaagcagggctgtcaccagctaattgccagagtgaccgtgtgaatctggagaagtctttgctgatgaagaaagcagctctccccactttcgattctgggcattgcacagctgaagaggtgtttgcatctgaagatgaatctgaagaaagctcctcactcagtgcagaggaagaagactcagaaaatgaagaggctattagaaaaaagctttcaaagccttctcaagtgagcagtggtcagaaactggggccacagaacttcattgatgagaccagtgatatagaaaatttactcaaagaggaagaagattacaaggaagaaaataatgattccaaagaaacgtcaggtaagcttaaatgtagttggttgctgctatgaacttggctctcgaaatggtaaccaaaggaatgtctacatttaggggtctgttgattctgtgattttgttaactgttgaaaagctgcattgtggatggatctcaagggaggggagacacatgaataagcctaactggaggttggcattggtcgtttcaggtgccctcaagtggaaggaagacctttccagaaaggcagctgaggcctttctgaggcagcagcaagcagctccaaacctccgaaagcttatttatgggacaggtaaagaattctggttcagaactagaaatgttttagtttctctgattatttagatgagggaattggttggaggattcggctggtattgttgacatccataattgctgtccatcacatttcatatttgacagatgtctctaatcatcagcttatgaggaccacacattggtcttataaagtagacttatgggtttgctgtaaaacttgatgcaaataccgtccattgcatcatgttatgtcccctatttaaaagtccttcatgagaatttttttgtagattagtgccagaaaaatattcctgcccataaaaatatttatttttttcctttctgagaatgagaaccctgtataacacattttgttctcccttttgcccttgtcctctgattttatgctttactaaacttaccaatatgttctttctggtagaattaatgcaaaaataaatatatagtggtgaactttacattgtgctccctggttactgcatggtgagatcaaggccacatggtgagacatttgggctcagcccactgaattgggaaggttgttgtatactgattttcattcaggttttgtctaggtactcttagtgatgagaggctcaacactctttagagctcttctttaataatctaaagctctgcctttaaattcccttccctcccttcaccgctaatattctcactcctcggcctcttagctgctcccgtgcaggagcacaggagccccacacatgtagagcaatagcttcctggctctcttcatctgtggctgccctgccctctcaatgcctaactcttatgtggccattgccatacccaccacagacagagtccctcagttcctgagttcaaagactcatggcctaactggttgaaaatgatgagtcctctagggctgtaatttttgttctcacttttctgccatggtgtgctctttagtgacagaagataatgaagaagaagatgatgatactctagaagagcttggagggttgtttcgtgtcaaccagcctgacagagagtgtaagcacaaggctgactctttggactgctccagatttcttgtggaggccccccatgactgggatttagaggaggtaagtctgggtagtacatttgatttattagagaattagcgaattgttctagaataagattatctgatgtcaatattgcttacctgttgttggcttcttatttttacaggattacaggtcattctcccagatattgtagtgggcgcttcatgcatcctaagcagtaacatgttctgagtttagttagaccatgtacatggcccacagaggacaggttcagctttcagtgtggacagtagtgtgcatctttattttgaaacatcacacataagtttttatacatcagatgtattttgtgtcttatcactaggatatatgtagcatccctgagttaacatttatagtttctgctatttgtaagcatagagaaatctgtgatacctgtatatgttcttcctgcagcttaccattttgtagtcacactggaattcattcagtactcaaactcaccacagcttaccctcctcttagacctcttctctttctctctctctctctttaagatatggtctttctctgcagcccaggctggagtgtagtggcacaagtgtatggctcaatgcagccacgacctcctgggctcaagggatcctcccacctcagcctccagagtagctgggactataggcacgagccaccaggcctggctaatttttgcattttttgtagagataatgtttcaccatgttgagctagtttcgaactctgggttcgaatgatcttcctgccttggaacttcccagagtgctgggattacaggagtgagccatcgcgccagcccctttctctctattctcttctggaatgttctgattttccaaaggctgctttctttttgtcaattcagtttggcttagatgtcacttctcacagaggcccaattgctatcatactgtctattgtaattcgccagataacacttaatgtactttatgagattttatttaaccatttttttatggtgaaatttaatacagatatataaaaccacgtaaaaacaattgttcagcctaatgggttgccagaaggtgaatatccctgtactcagcactcaggctgggaaatcaagctttgctgctcaattgtgacaccagccacagtccccttcctccctgtagaaggaggtgtagtccagcctcttaaggtgatgctttccttttcttcctggtttcctcctccatgcttccataagcatcatagtttacttttacttggtcttcattactgtttttcagtctatcttttaacatttttagtcaacagtctttccttcccatttctttctttggttacattttatttaataaaccaagtctttggtctgtagagtttcttgtattctggattttgtggattgctttgcatccctctggagtttcccaggccctcctgtatttcctgtgaatgggtatggagcaataccaatagaacttctgtaatgaaaggaatgtatatctgagctgtgggttgtggctacttgtggctactgagctctttaaatgtggctaatgagactggagaactaaattttaaatgttatttaatcttaattaagattaatttaaatagtcacatatttctagttaccctgtagacaaaacatctagcagttggatgggatttaaatttgatttttatttttcggcgaaactgcttcccaggtgatggtgttttctcattaggaggcgcataaagactggttgtgtccttttaatgctgttagatgttatcagttgttggtgctcaatgcctagaaccataccaatttcttaagaatgtagagtggtgatgttccattcaatcatttctctttatgtattagctgtaacacttctttaaagagaaacttttcctcttctattcggttatccactgccatatatatagggtaaatgcttgatttttttttttttttttttgagatggagtttcgctctgtcgcccaggctggagtgcagtggcacaatctcagctcactgcaagctctgcctcccgggttcatgccattctcctgcctcagcctcccgagtagctggtattacaggcgcccaccactaggcccagctaatttttttgcatttttagtagagatggggtttcaccacgttggtcaggctggtctcgaactcctgacctcctgagccacgtgcctcggcctcccaaagtgctgggattacaggtgtgagccactgcacccagcccatgcttgattttttaatcagtttgtggagtgattctccaaaggatacttgtttgtaagtttcactgtgatgtcatggatataaatgtagttgatgtgccttgtgctcctgcacctgttatcccttattgaagctcctctttatcccacctgtggcctgtaagagtctgtgcacaccagctcctgagtccttatgttacaatcatagtcattctttatcaattcttgctctatgatatgagagagcgcttggaatcacccataagaaatcctgatttcttttagtaggaaatggtatttcaacgtgacagcctaggcataggaatgctactgccatgagttggtcattacttctaggccttctcagtgacctgaaccaggagagctcatatagatatttccagttcacatacaggactacatcttactcattcttccactggagaattattccttggttgaatcagcagatgatgaaattagagaatcacataattactcatttgctttatcccatattacacacaaaatagtgtcagaataatatgactactgaaaacagttaaagatttttttcccttatatactgtctcatttctcttttcaaaagtgactgtgccattttacttacccactggcactgtaggtgggttccagtttcaccagttcttcaccagcacttgctattatctgtctttgtgattatagccatcctagagggggtgaagttgtatctcattgtagcattgacttgcattccctgatagataatgatgttgaacatcttttcatgtgcttattggctatttgtacatattcttcatattgtttgcccatttcaaaaattggattacttagttgtatgcgttgtttatatattctggatataagtcccttatcaggtacataatttgcagatatcttctcccatgttataggaattcagttttcaaacaggtttagattaacaaatagcaagaccaactttgtaaactactgtctcattgcattgccttagaaaccttaataaaattgaaaatcagttgaattagtaattatctgtttgtttacttatgaggtcagtagagtagtagtatttaatactttccctgtctgctgcttaatgtgttttatctctgtggttatactgtctccatcaaaggtaaagttattttctgggctcatttggaatgagaatatccatgaaagtgggaaatatttaaaggcaagttgtcacctactgccatttcttagagttgttttgctgagtgattggaacacctcacctaagtgctgacttttctgcgtaaggttatgaacagtatcagagattgcttcgtgactggaaagtgggaagatgataaagatgcagccaaggtcttagcagaagatggtaagtaaagagctgggttcttcaggaagactggcttctctaaactttattttcttcagtatcttagacaatagtcaaattgaaaataatagtcacttgtcaaatgctttgggaattcagacaggagtaatgaaccaggtaatattctgggttttccttttatgatgatcttattttctcagttggctgatttactgcgtatggactttaaaagtgagaaactttccataaattttaatcatgtgtttgttaaaaatagattttgtgtgatgtgaaaaatatatacaaataacatttatatttttttcataataaaggtagtatgcattgtggaaaatttcgaatgaaaagtacataacataccagaattctaccaacccataaaaaaacctttgttagcttcttcaactgtttccttctagtcatttaaaaattgtgtgtttaaacctttttagttgtactttatataatttttggcaggaggattgcttaagtgatgtactttttataaattttgtcattaaattttttcaaatatttcatttttattatttaaaattaaaaaatattttatttaaaataaataaaatattatttattattatcataccattattgaagtcacaattttttcaatatctaagtagttttatactttgttcattttataaagaactccacactgaacaactttgaaataattcttggctcacacttttttattttcataagacagattcataagtgttagaattgagtcatttttatggattgcaactgccacatggttttttggaaggtcattctttttgttttgtcttgagacaggatgtcgctctgttacccagactggagtgctatggtgtggtcatggcccactgcagcctcaacctcgcagactgaagcctcccgagtagctaggaccacaggcttgcatcactacacccagctaattttaaaatttttttgtacagacagtctttttatgtttcccaggctggtctcaaactcctaggcttaagagatactcctgcctcagcctcctgagtagcttgaaccacaaatgtataccaccatgcctggctaatttttaaatattttgtacagatgggggtcttgccatgttgcctagctggccttgaattcctgggcttaagcaatcttcccgccttagccttccaaagtgctgggattacaggcatgagccactgtgcctagtctgtagtatgtgaatgtattctttatatatatataatttttttttctgggccttctagttaatatcactgatctctgttggttcatttattattactataatttagtactctatgcagctttatcacgttactaagataccagttattaaaaccgtgtctcaacagtttccctttttgttctgctggggggcttcttttaggattctcctgactattctcaccttctcacttgcttattgttttttccataggaacttaagaatcggcttttctgttttcaaaagaaagtgtggtgggtttcttttttaatcacttcagtgaggtataattgatggtaaactacagtatttaaagtatacaatttgataagctttgatatgtgaatataccatcaccacaatcaaaataatgaacacatttgtcacccccacagttttcttacaccactttgtaactctccatcttgtcctcttccatcaccaggtacattcagctgccttgtgtcactattcagtaggttgtgccctttagaatttaattgaaatgggatcctacaatatgtactcttttctgtctaacttcttttactcagcatgattatttcaagattcatccatgctgttgcatcttcatttctttttgttggctagtgggtagtccattgtatgatgtatagcaatttatttatctgttaacctgttgataaacaattatttccaggttttggctattatgagtaaagctgctatgaatgttttttagaagtctttatgtgaaccaccgcttttatttcttttgggtaaataagtagttcagaatggactaaatgggtcatatgataggtacacatttaattttttaagaaattacccaactgttttccaaagtgtttataccattttccattgccaccataactttatgcaacttccggttgcttcactctacatctttcccagtacctgatagtatcagtctttttaaattgtaggccttcttttaggcatagagtggtatcttgtagttttagtgactaatggtatcgaacattttttcatgtgcttatttgccgtctgtgtcttctttgatgaaatatctgtccaaatcttttgtacattattttaattttgttgaattctaagaaattttgtgtatttttgatacaaattctgtatcacatgtgttatccaattatttttgcctagcgtgtgccttgtcttttctatttttaatagtgtttttcacagagcaaagtatttagttctggtgtaggtcaatttatcaaaaaaaaatttttttttttttgggatggagtcttgctctgtctcccagagtgcgatgtgatctcggctcactgcaacccctgccccctgggttcaagccattctcctgcctcagcctcctgagtaactgggattacaggcgcccgccaccacgcctgcctaatttttgtgtttttagtagagatggggtttcgccatgttggtcaggctggtcttgaactcctgacctcaggtgatccatccgcctcagcctcccaaagtgctgggattacaggcatgagccactgtgccctgcccaaaattttctcttatggactgtgcttttcatagtgcatgtaagaaatctttgcctcacccaatgtcacaaattgtctcatatattctgtaagtcttacagtttcaggttttacgtttaggtctataattctttttgagttaattttttatagagtgttgggtatggatttaggttccttttgacatattgatatctacttttccctgcaccatctgctgaaaatctatttttttccccgttgaattgccctgtattggttggccatatatgggtgaatatttctgggctctctgttctgttccattgatatatttgtttatttttgtaccaataccaacactgtctctgttacttacagctttataattagtcttggaattaagtagtttttaactttaggtagtttttcaaactttagtctccttttcaaagttgttttggttaatctaggttctttgcattttcatataaattttaagatgagcatgtcaattgctataaaaaagcccactgcaattttgattgggatttcatggaacttgtaaacaatttgggaaaattgccatcttaaccacattgagttttctgatctatgaacatagtaactctccatttatcttgttctttaatttctctcagcaaggttttcaggatacaggtcttatacaactctcaacagtttattttcatatcaacttgtatttatgtatggctaatatataagaaatgcagttgattttttttttaattgatcttatatcctgcaatcttgctaaattacttgttagttctgtttttgagacagagtctcgctctgtcacccaggctggagtgcagtggcttgatctcagctcactgcagcctctgccttccaggttcaagcaattctcatgccccagcctcgtgagtagctgagattacaggcagccattatcacgcctggctagtttttttatttttagtagaaatggggtttcaccaggttggccaggctagtctcaaactcctgacctcaagtgtgtgtttggaggggaggggtaaactttgactaaacagtattcatggttttctaagtaaatacttcttactatcccaaggattctttttcttttatgctgctttttctcctgttctgcacaataaagcctgggcttccaattctgctttgacctttcaccttggtccaatctcatatggttcccccagtttctgtgcaggatggttctgggagccaagcaggaaactatctacagaaaggctgagatagatcccagtggttttactttctttctttcctatctggatgacttaatttttcttgccttactgccctggtttaaacttccaggacagtgtggattagaagtcaaagtaaacaaccttgctttgtcctgattttgcttattttccaagtgaacttaagaatcacctttctggctgggcacagtggctgacgcctataatcctagcactttgggaggctgaggcgggcggatcacgaggtcaggagtttgagaccagcctggccaacatggtgaaaccccgtctctactaaaaatacaaaaattagccaagcgtggtggcacacgcccgtaatcctagctactcaggaggctgaggcaggagaattgcttgaacccggaaggcagaggttgcagtaagctgagatcgcgccactgtactccagcctgggcgacagcacgagactccgtctcaggaaaaaaaaaaaaaaaaaaaaaatcaccttttctatttccaaaagaaaagtttgtggtgtgttttttcctaattaaacttttaagtttgaggtaattgtagattgacatgcacgtgtaagaacaaatacagagaaaaaaaaagaacgaatacagagagatctcctgtatcttgtactatagcagtatctgtgtatatatgtactatgtatactatgtgtactgtaatacaaggtcacagcctggatgccaacattgatacaatctgttgatcctatgtagatttctccagtttcacttatgtgtgtgtgtgtgtgttttacgtgtgtgtgtgtctatacttctgtgctcttttatcacatgtgtaggtttgtgtgtctaccaacagttaagatacggagcagttccatcacaaggattgcttgtattgctgttttataaacacacccacgtccctgctgttccccagcccccagttccttcccttgtgaaccataatgtgttttctgtttctacaattttgtcatcttcaagaatgttaaataaacagaatcatacagtctataaacttttgtgaggggcttttttcactcagcataatttcctggagatccattcaagttggtgcatataccataggtcattcctttttattgctgagtagtgctccattgtatggatgtaccggtttgtttaaccattcatccaagatcaagctgggttgtttacagtttgttttgttttgttttgttttcagacagggtcttgctctgatgcccagtctggggtgcagtggtgtgatattggctcactgcagcctcgacctcctaggctcaagtgatcttcccacatcagcacccccaaggagctgggactacaggcatgcaccaccgtgcctggctaatatttttttatttgtttgtttgtttgttttgtagagacaggatcttgctgtgttgctcaggctgatcttgaactcctggcctgttttcaatttttgactattagaattgagctactatgaacacttgtatagaagtttttgtgtaaatatgcacttcccatttttctgggaaataaatgcccaataatgcaattgctgggtcatatggtaattgcacagtttcataggagactgccagagtagttgggccatttgatgtttctactagcaattatgtgagtgatccagtttctttacatccttgacaatgtgtggtgttctcactgttgtttattctagctattctaataggtatgtgatatttcattgtggttttaagatatacttccccagtggctaataatggtgagcattttttcatgtgtttatttgcatttttatatcttctatacagataaaaaatgtctggggatgtcttttttttgcacttttaaaaattgggttgggttgggtactgtgagttcattatatgtttaactccatcgtcggatgtgtgatttgcagatactttctcctaatctgtagttttcattttcttaacggggcctttcacagagcagaagtttttattttttatttatttatttatttatttattattattattatttgttttttgagacagagtctctctctgttgcccaggctggagtgcagtggcgcgatctccactcactgcaagctctgtcccccgggttcatgccattctcctgcctcagcctcccgagtagctgggactacaggcgcccaccaccacatccggctaatttttttgtatttttagtagagacggggtttcacagtgtttgccaggatggtctccatctcctgacctcgtgatccgccttacttggcctcccaaagtgctgggattacaggcgtgagccaccgtgtcgggccaaaagtttttatttttgatgaaatccgatttaccagttttttatagtattttttgttttctctttacacccatgatctattttgattttttcattttatgagatatgaggcttagctcaaggtttatattttcgcctgcaattgtataatttttctagcaccacttattttattgaattgcttttgacttttgtaaaacattagttgagcatctttctgtgaatctgtttctgggttctcttgtgttctattgacttcacatgtcaatcccttggccagtaccacccttgctgtctacgttcctgtagctttatagtgagtgttaatgttgagtagagtgactcctcttactttattcttgtttttcaagattggttaagctatcccaaggcttgtgactttccctataaattttagaataaacttgtttatgtctacaacaacttacctgggattttggtagggattgcattaaacctatagatcagtttggggggataatctttttctattttgagtattaaaatagatgaacacagtatatttatttattttagtttttatttctttcatcagtattatgattttcagcataccagttgggaatatgttttgataagtttagacctaagtatttgattttgattgattttcatttgtttctcttttgtcctgctaaactcacttattagttgtaggagggttttgttttgttttgtctttgtagattgcctgggattgtctacacagacagttgtgtagaaaacatagagacagtgttatttctttcttttcaacctgtatggcttttccttcttttttttttaattaaattttttaggggtagtgatggggtctcactatgttgctcaggctggtctcaaactcctgaatgccagtgatctgcctgcctcagcctcccagagtgctgggattataggcgtgagcgaccatgcctggccttctttctgttttaaaattttctgccttaattcagtgactagacttttagtacaatgtggagtaagagtgctgagagtggacttcctatgttgttcccaatcttgtcactgttatttatttactaacatgattggatgttgaattttgtctaatgccttttggtgtcagttgatatgatcatctggatatgggtttcattctttactcttttgatatagattacactgatccttttattttttgagacatggtcttcctctgtcacccaggctggagtgcagtggtgcgatcatggctcaccacagcatcgacctcctatgctccagtgatcctcctgcctccacctcccacgtagctgggactacaagtgtgtgctatcatgtctggctaattttttttttttttttttttttgtagagccaggtcttactgtgttgcccaggctggtcttggcttcaagggaactcttggcttcaagggatcctcccacttcagcctcccaagcgttaggtttacaggcaggagccaccgcacctggcctgattcattttttgaatgttgaagcagacttgcatacctggaataactctcacttgatcatgaatgaaaatgaaaatacaacatatggaaatgtgtgtgtttttttgttttgttttttcctttcatgtcagatggttaatgtgctaatgttgtaacaagggtcaagggtggcatatcccacatacatgcatgaatacccagtcatcacacttatgaactacgaaaagatcaccatgtgaaaatttttatacaaatctttttatgtgttgttggattccatttatagtactttgttgaggactttttgcattcatgagagatactggtctgtgagtttttttgttttgttttgttttttctttttgtggtggtactgtcttcatctggttttggcattgggataatactagcctcataaaatgagttgcaaagtgtcccctattctgttttctggaagagtttgtatagaattgggatgaattctttaaatatttggtgtaattctccagtgaaatcatctgggcctggagatttcttattccagaagctcttaattacaaattttatttctttaatggttataggacgattcagattatctatttcatcttgcctgaattttggtagtttatgattttcaaggtgtttcaagtcttgttagggaagtggaagttgcactgagtgccttcttgaagagaccagcttgggtagtctgagggtgatgtttagagtatttgcttaatactctttaacggctgcaggagcctttttgataacccctgttttattcgtgatgttgttggtttgtgtcttctctgtttttatctttgtcgtaaaatttattaattttgttgattctattcaaatgaccagctttttgtttcattgattttctctgtttttctgctttcaatgttattgatttctgccctttatttattattattattttttttttgagactgagtttcactcttcttgcccaggctggagtgcagtggcacgttcttggctccccgcaacctccacctccgggttcaagtgattctcctgcctcagcttcccaagtagctgggattacaggcatgcacccccacgcacagctaattttttgtatttttagtagagacagggtttctccctgttggtcaggctgttctcaagctcccaacctcagttgatccacctgccttggcctcccaaagtgctgggaatacaggcatgagccaccacatccggccaatttctgccccttattatttctattcttctgcttgtttggggtttattttgttctttttgaaatttcttaggttattggtttatcttttctcatttctaatgtgagcatttagtgtttaaatttccttctcagtactgctgagctgtaccccacaaatgttcacgtgttgtattttctttttcttttttttttttttttgagacggagtctcgctctgtcgcccaggctggagtgcagtggcgggatctcggctcactgcaagctccgcctcctgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctcacgtgttgtattttcattcatatttcctttgggacttctttttggcccatgcattatttataaatatgttgttttaattatcaagtatttagagagtttcctgtttttctgttatagatttctagcttgattatattatgttctgagaacatattcttatgagttgaattattttagatttgctgtgatttcttttattgccccaaatgtacttcatcttggtagatttctattgactttaaaaatgtgtgtattttgctgttggagagtagggtgttatacggatgtcagattttgctggctcactgttcagatcttttgtaaatccttgctccttttctgcctagtttcactctgtcacttacgctagagtgcggtggcatgaacatgactcactgcagccttgacctcctaggctcaagcagttatcctggcttaacctcctgaatagctggtactataggtgtgtgccgccacacttggctaaattcaaaattttttggagagacaaagccttgctatgttgcccaggctggaactcctggcctcaagctatcctttgtctttgcctcccagagtgctgggattacaggcatgagccactgtgcccggcctccgcctagttttaacagttgctgagaggagggtgttgaagtagatgtcttcttggtgggttaatccttttgtcattaagcagatgttacggtcacttccttttcaccccattggtgaaggaggggtccctgccctaaagtgtaggagatggctgaacacgacacctggcgtggatggatgagactgacagcagtgttttagtcacatatacccacagctcagaggaggacactgcatgccacgcagggtcagatgggcaccatactctgtagtggagtgagggctgggggctgaggaaggaggcaggcttggtagtaacaagagcacacaatgaccaatggttcctgagggggaatgcaattggcttgtttgaataaattcatgggctggcagacaggtgaagtgaaacttcttaggctgaggtgcaaccgttctggctgataaaagaactagccaggtggggagcctttgctgctgggtggcggggtagggggtgtctggtagaaacaggaaaacccacggctaggcctttggggccctgtgaggctcaaagatgtccaggcagcataggaaattttagatcttaaaattcagcgaagaccctctccagctctggtaaattattttgcttgaagtctacttcatgagatattaatatattcactcctgcttccttaaaaaattaatgattacataggatatctttctccattcttttactttcagcctacttaggtccttaagtgagtttgaagtttcttatgaacagtatttagttgggccatgtgtttattataggctctccatccatccgtcttttggtttatttagaccatttacatttaaggtgcttattgttacataattgcttatgtctgatgtttttattatttgcttttttgtttcctttttctttccctccatcttgatctatttctgtataatgttgttgcgtgtatctctttgtatagtcttgaagtgtttgctctggatgttacaatatgcatattgtaatatagtagtctactggtaccagtatttaccacttcaaagtgtggaaacctgccttgcatttatgtctctttaccttttccgcttgtatgaatcactggcttgagtattaggtggtggtatagtttttgtttcagttgtcaagtgtgattttaagaactgcggattgtctcgtgtatgtatccacatttctggtctttcctttgtccctcctcccatagtcccatattcatcccttctgcataagaactttctgtagccatttttttattttgatttttttgttttaattttttgtattgtggaaatgacagaacatatttctgtagccactttttagcatttctaaatttaccagagacaaattcctatattctcttcctctgataatgtctttatttctctcttcatttctgaagggtagtttcatgggatatagaatttgcaaccaacagtttttttgtttgttggtttggtttttttgtttgtttctttggttggttttttttaagcacttgaaaatgttgtgccacttccttctggcctccatggcatttgagttggcatgtccctacaggcattctgccatttttggtctttgtttttagttttgaaagtttaatcagtgttgctttcttttgttatactttgaggtttgctcagcttcttgaatctgtaagtttatatctttcactaaatgtgggaagcgtcaggaattagttatttgcatgcttttgcagctctggtctcctgtgggactcagataacataaatgcggggtcttttgttattgtcccacaggtccgtgcagctctgttcatttgttttcaggttattttctctctattgtttagactgggtgaattctgttgatacaggtttcagcttctctgattctctcctctgtcgtctccacttttactcaatagagcccatctagatagatttttttttaatttctgttactgtattttatatttctgtaatttccatttgattcttcttcagtttctttgctgacgttttcagttctttgtttgttgccataggatttgtagttgcttgttgaagcatatttatgctgactgttataagtgatgagtcagatggttccaacatctgcctatgtaatttttttatttttgcaggcagtcctcctatttgggtttagtctgtaggtcctggtctactttgtgggctgtgattccaatggcaatttaatttcagagccttcatggtgttattttggtctgtttggcttatatgtatcactgggattctcccaccagtccctgctgttgcccacctgagggaacaggggagctgccccaggctgggccacctgctgcagctaggtgggtggggagtggtggttgtcttggtgtgtggagctggttttcttgttatggggaagatttcctttgatctggggggactgagtctgcctgggttgccttctattgctacgttgggagttgggaaactctgggcctggtcaacttcctattggatgaggtccagggagacacctggccactatgcattccctagtcctagagtccctcagcagcctttttctttccacctttcagaattctcctttgatcatctcctgtctattatttcttaggagggtataatgtgttatcttctctagaccagaaatccttaatggtggtttcaggttgtaactgtgctaaagggagaattggcgtatttttgatgttgagtctttcttttcaaatgaggacatatcattattcagtagataatatttacaacacctacttccttgggttgaagaatgtggttaaggcaaggaaagtacttaacacagtgcctggtgtggagagcaccgatgagtgttggtggtgatgctattccttttgtcctttggtagcatattaaagcttttcttcttttttaaaaaaataaagttctggtgcatttcttgttaggtttattcctattttatccttttttgcttttattacaaataggagcttcctatctattataacttctacctggttctttggcccttatgtgaaaatgttttaatagccttctaaacattgctctcccaaatgagttttaacttgcctatttcttttattttcctttttttgagacagggtctcactctgtcacccaggctggagttcagtgatgcaattatggctcactgcaacgtctgcctcccgggcccccaaagtgctgggtttacaggcgtgagccactgcacccagccttacttgtctgtttcttttaagagtgggaactataattgagcccagagctccaaaaacaaatgaaggaatgaatgagtgaataagctcttcccatgggtttggtgtggtttggggctctactcttaatctaaatgctatgttttatataacctaaaatttcccctaggtgtgttacacgattgtgttgtgttgaacttacattgagactccttttcacatgtgctggtatcagcgtggagcttttctattcattccttgaactattcgtttgggggacacacatagacctctgtgtctttcataaagagtgtccattggccaggtgcagtggctcatggctgtaatcccagcactttgggaggctgaggagggcagatcacgaggtcaggagttcgagaccagcctggccaattggtgaaatcccatctttactaaaaatacaaaaattagccaggcttggtggcgggtgcctataatcccagctactcgggagactgaggcagtagaattgcttgaacccgggaggcggaggttgcagtgagctgagatcatgccactgcactccagcttgggtgacagagtgagactctgtctccaaaaataaaaaacaaaaacaaaagagtgtccattgtgtatactggaaaaattgagattgggattttgatgtgaagtgcggaaatgtggattgggtccatttagtttacctaaacagatgatgaaatactaactgttttacaaagcattccctagtgcaaagttttgcctgtgtgtgtagtgacaggaacagtgagaatgaggcttggaacgcagagcacactgtgggcctgtggtaggtggggccagcagcacatgcatacctggctcacagagcagcctttgggtgttcttttcccagaggagctctacggtgactttgaagacttggaaacaggggacgtgcacaagggaaaatcaggccccaatactcaggtatgactttgtcgtagctggctgttcttggtcattgtgttctgagagaggcccacattgagaaatgcaaatcttacttgtgatgtgtgaagattgcagactggatagatagattccttcctaaagggtggggatgtggggaccaaagagaagctttcttgtttacttgttaagttttggatgacagttactaccgtttcttgccatagtcatttgccaagtccactgtgatttttcactcacggaagtcttagcttcttggacttacattcaaccattggcatcattctcctttttttaaatttaagtgtcatttaaaagaatgaagtccctgttctccctagtatttctttagaacagggtctgggagcatctgggtgagggacacgtctgttatttttattctagtttgtgttcccagccagcttaaggattagcagctaattgtaatgcagatgtaaccatttcctgtagcagtaccatgttattcagagacaaaggttgtgttgtgttttcttttgttttattgataatgataacagatttttgctaagattcttgtttaaatagaactttaaaaaagctaatgtttaaagaaaagaccttcataaacatacacaaaattttttcttctggaaatttaagaatgaagatatagagaaagaagttaaggaagaaattgaccccgacgaagaagaaagtgccaagaaaaagcatttggataagaagagaaaattgaaggagatgtttgatgcagaatatgatgaaggagaaagcacatattttgatgatcttaaaggagaaatgcagaaacaagcacaggtgagaaacctcagttcctctcagccccttgtcaagactatcatatagcgcaggaatccctgactttgtttgggtccctacgtcctatcctgcttctgtgtatcctgcttctgtgcctttcattcggactcctgggtagagatgcatgtgagtgtgtttattcatgcagtgagctcattgtttctgcagtcagagggtcaccagaaaaagatccatacctattttgtaacaagaattaggaaacagaaatgactgagacatggtctctacttttgagacatggtcttacaatgtagtgatctgagacagtgtgttcatttcagtgcaagcattggcggcctattccaatcgctgctccctgatttgaatggcaggtgatcagtggcccctgtggcttatagacacaccagagctcccaggggaagtgctctgaaaactcatcctggtcagagttcagaaggacatgtggagtataaggtcagatgcagaaataaagggagatggtgtggccctcctgcctggggatgctgagcaggttgctggaggcggtgatctcactctgaaggagacagacacagaaacgtgtgtacagttgatggtgagcatctgagttgcgtcttgttagtgaggccaggagtgcctgtgtaagctggaacagattaggtatatgatttgtgaaacggagtttcatcctaggtcttcatctagtcaaaggactatttcctgattaggcattagcttagtggttgctagtctgtgttgacctttgaaaggcatgactaggctaactctgaagtttttgcttcacaccatttacaatttaaaattacctagagccttgtgggccattggaaaagactgaatgtttcactctgaaatgggagtccttggagggttttgagcagaggagaggtaatcagatcactctgccaagagatcagtcgggtggcacaaaccagaaggctggcagtggagatgagagaaagagtcaaacccggatagactttatttggaagctgggtcagtaggatttcctggtggactgaatgtggggtgtgtgagaggaaatgaggatgtcgactggaagttcctggaaggacgggttgttgtaagttagataggaaaccctctgcagatgcagttttgggaagatgatgtttggttcggctgggtatcatgcagacaagtgaaatgtcaggtctggagagaggtctggccagggacttagatgtagatgccctcagcatgtagatgccacttaacgctgtgaggtggccgggagtgagtgcagagtgagtgggaggagcaagactggcatgggcgagatggggcgattgtggccgtgagtcctgagcagtgcctaggagggagaagcagtgtgagcatgcaggcacacaggaggccagttgtacatggaggcgaagcattgttcagatcctgctgccatgttaactacggtgaaggcagagttcaccactggaggagtccttcagcgtggaggccttcagcaatcttggcaagcaccaattttcatggatgtaggagaatgggagcagaggaactggaggctgcaactgcagaaaacttttgtggggttttgctgcagagagaagcagagaaatgaagccgttgttggtggaagaagtggaatcaaaaggttttgagataagagagagaacagagggaagagctgttggaataaagtccaggaagagtggatggtgtctagtgagcaagtgatgtgtggccctgagtagaggcatggacaaatattctgtgcctgagctgcctgtagaactttctgtgatcatcgagatgcacgtcagtgcttcccaatattgtaacactggccgcaggttgatatggaccacttccagtgtgactagtgtgattgaggaactgcattttaaatattatgtaattgtaattaattttaatgtaaatagccactcatagctcccctatgggccaggtcagagctctgataaggctggatatgggaggaaaccctggtagagggctgaccgtggaggttcttttggttttggagtgaatcaggaaacagccatcagctgagtgaaggtgagggtggtggtgggtgtttgaagacaagggaaaagtgtgaaagaattgttcagaaaggaaagaaagaagatgtggactggggacgtttccagtgttcgggcatgcagggctccacagttatctacatttgctgtcccttggagcaggagagaagaaaacggttgggacatattctgagcagactgtagaggtaaaatatgtaggtctttttttttggttttttgttttttgagatggaatctcgctctattgcccaggctggagtgcagtggcacgatctcgactcactgcaacctccgtctcccgggttcaagcaattctctcacctctgcctcctgagtagctgggactacaggcacgcaccaccacgcccagctgattttggtatttttagtagagacggggtttcaccatgttggcgaggctggtttcaaactcctgacctcatgtgatctgcccacctcggcctcccaaagtgctgggattacaggcgtgagccactgtacctggccaaatgtgtagtatttttaatagggtaaagcctacataattctgtccacagttcctttacttagaaattgctcatttgttcatgttaatcttatgtttattacagataacagcatacaggtttttttattccccatcatgtacagctgaatcgcgcagaatttgaagatcaagatgatgaagccagagttcagtatgagggttttcgacctgggatgtacgtccgcattgagattgaaaatgttccctgtgaatttgtgcagaactttgacccccattaccccattatcctgggtggcttgggcaacagtgagggaaatgttggctacgtgcaggtgggtccctttgctacatatttggtgcctgaggctctgtggatttcccctccatcaatcatcttaccctctcgtcccctcagatgcgtctgaagaaacatcgctggtataagaaaatcctcaagtcccgagatccaatcatattttctgtagggtggaggaggtttcagaccatcccactgtattatatcgaagaccacaatggaagacaaaggcttctaaagtataccccacagcacatgcattgcggagcagccttttggggtaaaatatgattacaataacttgcctgttgccaagattaaaccttacaggctgcgttattatagctttgtgcttttctttcataaaattccactcctaagatttttctcttttctgggagcggggaggtggtttggagtatatatgtaaatctatatccaaatctaaatgtccatatccagtatgttaaactagaatctaaaatttgtggttcgctatatttctttttttccttttcctttaaggccctatcactccacagggaactggtttcttggcaatacagtctgtcagtggcataatggtaactatcttggatgatttcttttacagattggtttgagaaatatatcctgggtgtgggttattatgtacatgagactttaagttgaaaattactcatttttattaatacaaagtaaatttccctttgcttttaatcttcctacatcgttttcagtagggtgtgggattagaggaggggaggtggaagaattataatggtacatttcctatttttgtgcatcttttgcatttatttatctaagcaagtacttaagcagtgctcaccatgtgctaagcactatatgaggttgtgaggagccatcagagactccctgcagccgtgcagggagtccattttcatttgaccagtcaggcagggcagggtttattggtcccatttaacagagaagaaagcagaataatgagcagatggaatctgccctggagttccaaattttaatttcctaaacattgcaactgtatttttcttttccatttcattccaaataaatcattatagtgaaattacattcctctgaaatcactctcaggaaagtactcaaggcgccttttttttttttttttttttttttttttgagacagagtctcactctgtcatccaggctggagtgcagtggcacgatcttggctcactgcaacctctgcctcctgggtttaagcggttctcctgccttagcttcctgagtagctgggattacaggtgtgcaccatcatgctgagctaatttttgtatttttagtagagatgggattttgccatgttggccagactggtcttgaacttctgacctcaggtgatccacccgccttggcctcccaaagtgctgggattacaggtatgagccactgtgctcggcctcaagtcacccttgttagtttggcttaccaactttaaagttttggattgcttttgtcaaaccactgggttgcaagttcacatggtctctcttgtttttcttagctaattgtaagtaaaattcactttggtaatttattgtgtcacatagaattgaagtttttctcttgctgatattattcctattttcaaattttggggttcctgttagcctgattttcggatagctgctacaggagttgtccttgatctggataaatccataaaaattgtgaagaaattaaagctaactggttttccatataaaattttcaagaacacttcatttattaaggtctgtatatctatatattctcatatttataaatgtccatattgtttgagaaaaggaatgaaatacctttaaaatatgggcctcatatttttataaaagtgtttgaaatcttttataaacttcatattttgtttgctcctttatattctgtgttacttaaatatgctctaaaaagcagtggtaaaacagctatttaggaattgaggctgttattcataacttccatgtgagactgccacatattgaactcatattgaactcatattgaaaatatgtcattttatccactgggttttgtttcctactttttttatttgtgttaagaaagggaaaaaaatcacaagtttgtctaaccattcagtagaaaaatcgacaaagcatttgcagacaacttggcaaggttacagagaaacggatatactgtttttcagtatttggggaggttggtttgagcagcatttattgagaatttcattagtggggatgtttctattgaaaacacagagttagaaagtcataaaatgttcttgcaatataaggtaataataccaccagcgtttatcttactgttttcatgttctaagtgcatgcacctgagtaaaagcatctgggctgcagtccagtctgagagatgccaggaaaggctgcctaggccagttcagtccagtaaatccctcttcgatcttctcttccacacagacagcggtgatgagcatgcccatgaactgacatgattattttggggaaaatgaaagacttgtattctttttgagatagtaattccactttcaggggcgaatacattttgtttattttatcacccttcagtgagttgtttttgttctttaatcaaggatgtatgtttgaagtaagaagtaaagcataaagtatatgattttgtgtgtgtgtgtttttatcttgctatacctgtagggaatgtttaattctgccttggaagtggccaaatttgaaggtgctgtgattcgaacagtcagtgggataagggggcagatcaagaaagcactccgagctccagaaggagctttcagggccagctttgaggataagctgctgatgagcggtgagtgtcttgagtagtgttcagggcagggtgttaccattcatgcttgacttctagccagtgtgacgagaggctggagtcaggtctctagagagttgagcagctccagccttagatctcccagtcttatgggtgtgcccattcgctttgtgtctgcagtcccctggccacacccagtaacagttctgtgatctatgagaatagtttccttagcgagcttttccttcaaatactttgcagccaggtagagaagtttggagtgaaggttttattctttgtttcttcgcaatatggatatgaatcttcttttgaaaatgttaaagtaaattacctctcttttcagatattgtcttcatgcgaacttggtatcctgtttccatcccagcgttctataacccagtaacatctttgttgaaaccagtgggtgagaaagacacctggtcaggaatgcggaccacgggccaactcaggctcgcccatggcgtcagactaaaggcgaacaaggactctctgtataaggtactggtcgcgtgtgtgttagtggagatgaagcctgtgctctacagacagggagtcacacagacacttttctataatttcttacatgctttgaatgttcaagtataaagtctaacgttaaatttgattgaacagttgtatatttgtggaatattttggaatggaacaccaaaaaatgataatagtggttctttctggattgaagacaaacttttcttttttaaaataaattttattttatatatttgaggttgaccacatgatcttaaaggatacatatagatagtaaactggttactatcgtgaagcaaattaacatagctaccatttcacacagttagatttttttgtgtgtaacaggaacagctaaaatctacttacttaacaaaaatcccaaagacaatacatttttattaactatagccctcatgatatacactagatctctaacttgttcatcctacatgtctgctactttgtattgttttaatatacatctccccatttcctattggtcatttcctatttggcccatttttcaactgggttgtttttctgctattaagttgtaagagttctttactgatttttggatattaacactttatcagatatgtggtttgcaaatatttctcccagtctataggttcccttttcattttgttggttgttcctttgctgtgcaggagctttttagtttgatgcagtcctccttgtttatgtttacatttgtagcctggcttgtggtgcgatatccaaaaaattattgctaaggccaacgtcaagaggctttctccctatgttttcttctaggagttttatggtttcaggtcttatttgggtcttgggtcttgtatctattttgagttgatttttgtgtatggtgtatgatcagggtccaattttattcttttgcatgtgaaaatccagttttcccagcactattattgaagagactgtcttttttaccattgtgttgtcttgtttgcccttatcaaaaattagttgacagtatatgtttggatttatttcaaaggtctctgttctgttccattggtctatttttttgtttttatgccagcaccatactgttttgattactatagctttgtaatacaattttaaatcaagaggtgcgatgcctccaactttttctttcacagtaatctcttggctgtttggggttttttgtggttccatatgagtttcaggattgttttttcttttattttctttttttttgaggcaaagtctcactctgtcgcccaagctgtagtgcagtggcataatctcggctcactgaaacctctgcctcctggattcaagcaattctcctgcctcagcctcccaagtagctgggactacaggcacgtgccactatgcccagccaatttttgtggttttagtagagacagggtttcactatgtttgctgggctggtctccaactcctgaccttgtgatctgcccgctgtggtctctcaaagtgctggaattacaggcatgagccactgcgcctggccaggattgttttattctgttctgtgaagaatgccaacagaactttgatgaggattgtgttaaatctgtatatttgctttgggtagcgtgaacattttaacaatattaattcttctgatccataaacataggatgtctttccatttgttcatgtctaaatttctttcatcaatgttttatggttttcaagtgtacacatctctcaccttcttggttaagtttattcctaagtttttgtttttctttgctgctattgtaaattagattattttcttgatttgtcacctaggttatttgcatacagaaatgcaactgatttttatatattgagtttataccttgcagcttaactgaattgatttagtagttctcacacttttttgtggaatctttggagttttttatgtaaaggatcttgtcatctgcaaatagagataattttacttctttaatttagttgccttttttttctcatctgattgctcttgcaagtactctattgaataaaagtgatgaagctggccatccctatcttgtattcaatcttagtggaaaagcttttagttgttccccactaactattatgtagactgtgggtttttcataaatgggctttattacgttgaggaactttccttctatacataaactgttaagaggttttatcaagaaaggttgctaaactttgttaaatgctttttctgcatcaattgaggtgaacatgtcgttttatctttcattttgttaatgtgatatatcacattgattgatttacatatgttaaaccagccttgcatgccagggataaatcccacttaaacacgatgtataaagtttttgatgtgttgttgaattctatttgctaaaatttttttaggatgtttgcatcagtgcttaatttattggagaagttgacctgtagtttttgtttgttgtgtgtgtgtgtgtgtgtgtgtgtgtgtgtgtgtgtgtgtgttttggtttggcttaggtattaaggtgatactggcctggtaaaatgtgtttggaattatttcctcttgctctatttttgcgaagagtttaagaagtaaactcccaggggatgggagtgactctggacatgggagtgacataatagtgactctggaccctacagtggtgggacacagcagcatctcagtctctacgaggccaggcgcagcatcagcaaggaccccagaatgatggagcactactgtggcttgggccctcgggggcagggaccagtgcagcaactacttctctccctggggaggcaggtgcctgggcaactcagattctccagggctagtccagttccaaggaagcagggttctacagttgtttgtcctgaagggcaaggtaccccagttcaaccaatgccattttcctgggacgtgggggtgccatgttggctcatccctggcaggtgtggctgctcagctcagccaagacactgattccctgtgaagcaggacagtgcttcagctcttgtgcagtggggagtgtgactgctcagactggccaaggcactgattccctggaaagcagggcaccaagtcaactcaggctccaaggggcagggcgcaatggcagctgggaggggaggggcacggcagcgtggccccgcagggtggggtgcatgctgtgatgtggacatcgtttgttcccaccagcactcatgttgaaatttgattccaaatgtggtggtgtgggaggtggggcctagtgggaggtatttgggtcacagggcagatcctttatgaatagattaatgccttttcatgggactggattagttaccaggagtggattgttaccagagtgagttcagcttcctagactctcgtgtttcctctcttgccatgtgagccccttgcatacacctgtttccccttccactttccccatgaggtgaagcagcacaagaccctcgccagatgtgctgcctgatctcagacttttcagacacaagcagggtgagccaaataaaccttttttataaaataagttaccgagtctcaggtattctgttacagccacactaaatggcctgagacagtgtaacagcagctcagtgtaacagtggcccaccggccactaggtgggggtgatatagagcaacaaagcctgaggatggaagaagggtgtggtggctgctcaccctgggtgggacatgctcccgaagtgattccaggtccaggagggcacgttgcagcagcagctggtccatgggggtggggcacaacgtcagttccttctctgaggggagtgctggggctgctgggcccctcttgcttccttatccccacagggagacatcccctctgcttcaggctgatccctctgggggatgggtggtggggggcagatatttccttctctcctttatgtgaccatcctagttttctgtgctctactagatttctgctactccttgatgcactctggggctctcctttagtgactttcatcaaaatatagttgtttgctgctttggctgtctttgtcaggggatgagcgcaaggggctattgatcggccccttgctggcatcactccctcttaaacttttcactgggtactcttttgaactatttttttccccaccatatacatgtatttttaaaacattaatgtgctaatttctattaaagcaatgtggatttttctgaaagttttaatgttttaataagctttttattgaaatgttaatgtacatacagaagagtgcccaaatcataagtgtgcagctagatgaactgtagcacaccagctgccacgccctggaccaagcagtagcctcgccctgtggcctctcccaggcactgcctccccaacccacaaaatagctactttgccagttcctgacgtagatttgttctgcctggttttgacttttataaaatacagcacattctatttagcctggcttctttggttgagtattacagaacacatccatgttcttgtctatggcagacattgatttattgtcattgttgagttccagtatatgactgtgtcaccatttatccattgatgggtaaaatgatttcctatttttggccgttatcccacggcccttaacactaaggtctggatatgggacttgcaggtacggaggggcacacacacttctgctggaggatccctgggtagggtggagactccagggcacctgtgctctgcttcagtgtggaggcttctgtgtcgtgttctgggagcacagcggcttggcctccaccaccagcagcagcttaaagagttcctgctgttccacgtgcttgctgacaattggcctcttcagtttttttttttttattttaggttttcaatgcctgcctggacttgtgttttcatttagattttggtttcttagaactgttgttattctcttcacagcttaacaatgcatttgaaaagatttgttttcatgtggagtgttcagttttgtaataagagggttgttcaaggcatcagtctgccactctgctagaaacagaagtctcccaggcatttctttttatataaagtagttaatgaaattttgaaccgtcttacatgaatttttattaaaatacacttcaggatgtggtgcccattatccattctactcttttgtaacaagtagatttctctgaattcttgaattcaaaaacaatcggggttcctaaacaaagaatatggaatattattggggatgatgtctttaataatacatttcaagataggagaaacttgttctatatagttgactttaacaaaagcctagggcaaaactttcaatttattaacagtatttatgaggcagttaagaatttgggtcatcctccgtctccactaaaaatacaaaaaattagccaggcgtggtggcgggcgcctgtagtcccagctactcgggaggctgaggcaagagaatggcgtgaacccaggggcagaggttgcagtgagccgagatcatgccactgcactctagcctgggcgacagagcgagactccatctcaaaaaaaaaagaatttgggtcatctcaattaaatatagaatttaagattaccttgaaaattcagtgcagagtattttgccttcatctgttgtttgagtctcccttcttttagccatccttccatcagaaatagaataccaagttaaacttcttaattagaatcaggaatcaggactctttggctgctgattgaaggaagaactgtccttaaatccagagtgggccagttgtggtggctcatgcctgtaatcctagcactttgggaggccaaggcaggtggatcacctgaggtcaggagttcaagatttcaagaccagcatgaccaacatggtgaaaccccatctctactgaaaatacaaaaattagccgggcgtggtggtgtgtgcctgtagtcccagatacttgggaggctgagacaggagaattgcttgaacccaggaggtggaggttgcatgagccgagatcacggcactgctctctagcctgggcgtcaaggcaagactccatctcaaaaaaacaaaacaaaacaaaaaaaacatccagagtggttgatagtcaagacaaaaagctagattatttttgttagtctgggaaataagcacctcagtggcccaaagacaaggcctgaaatttccatgaaaagaaactgggatctattcatctgttctgttgagaccccatagttccataccatagaaatgggcacagtgggttttggggggagagttgtaagtgtaagctgtctgttcctctgtttactgagaattgtgggtgtccactgaggcagttcatatttggcagatgattgagtcctgatttctcagggccggcagactctggtgttactaatcttgtggaaaagtcaacccattgagaagattttatgcagaagttttaaatgcacattgatcataatttgaatatgtcacagtctttgtttttcttttcagccaatcctgaggcaaaagaaacattttaattcactgcacattccaaaagccttgcagaaggccctgccatttaagaacaagcccaagacccaagcaaaggcaggcaaggtgccaaaggacaggcggagaccggccgtcatacgcgagcctcatgaaagaaaggtactgttgcccatgctgtactgcacgctgcgtttagataggaaaagaacactctcaatagcacacttcctgtttctactgtagtctcagttattcagggcactggaactaaagtcagaggaagagccagagtccatttccctttctttgcctggtcctgctctgccctgtgcttttcatgggggataacaggtacatggctggggaacccttctgtctcggttagctgcacacagtgtccacagaatgatgaacagaggtggtaaaggtaaaatgggatcacacctgtgtctccatgccaacaatgacttcctagcacaggatgcattttcatgcagttaatattcatttggatcgtgggttgcctctagtcttagtgcttaggatgcgagtgtgtggtgtctgagagcattctgatactcaccggcttttgtccttgtcagatccttgcactgctggatgctctgagtacggtgcatagtcagaagatgaagaaggccaaggagcagcggcacctgcacaataaagagcacttcagagccaagcagaaggaggaggaggagaagctgaagcggcagaaggacctcaggaagaagctcttcagaattcaggggcagaaggaaagaagaaaccagaagtccagtttgaagggggctgagggccaattgcagtgagcctttggactggagggactgtccctggatctgcggaggtagacagtttcaaacatcacagtttgaatgcctgtgaatgacaagtcagtgggaaagagctcaagagatgtctctactcaaactgtgcctgcaggaggaggaacagagaagcctgggctgctgggactgggttcattctcatgacttggggctgtcgagatttaaagtgatgtaagctgtggttatgtggattctcttactttcctctgcctgcctcagtttaattattttgtcctacagaaatatcattaaaatatttttttgttacttttggcttagtagttttcattagggatgaatgcctgacaattctttgtggataattatttatactaccaccttcatgaggagtcttccagaagagaaagaaatattcacttgaactctgagctcccatggaagattttagagaatagtgtgtagtgtttttgttttgttttttgtttgagtgacacacaaacctagatggtacagcctactgtgcacccaggatctatgggctcctttgatcactggcccttgtggacattttctatcttatttcatatgttctgcacattagtatagtgacaaggtaacagtaagtacttttttaaagctttagacttaggagattattgtctcaggtgcagagaccaaggaaatcgtatgtatcagtgagataggcttcccgtattatgctcatgcgttatacctgcctagctacattgcctttttttaaattaaacattatgttgaagtaatcatactattacataggcgatgtatgtattttatgattgtatgttgatatagttatggggaatctattcctatacgatgtaatcatagattcacatatagttgtatattttgcccaatttctctcagtggtaatgtttcacacatataacaatcaggatgttgacatcaatacagcccgctgattttattcacatttccccagctttactttccccaacgtatactcctccatgtatgcatgggtgtgtagaaatatggaacgcagctgggcacagtgactcacgcctgtaatcccagcactttgggatgctaaggcaggaggatcacttgagcccaggaatttgagaccaacttgggcaacatggcaaaacctcatcgctacaaaaaataaaaaattcgccaggtgtggtgggtgcacacctgtagttccagctgcttgggaggctgaggtaggaggatcacttgagcttgggaggttgaggctgcagtgagccatgatagcaccactgcactccagcctgggcgacagggcaagaccctgtttcaaaaaaaaaaaattatacatatatgtatgtagaacacttcatgaatttgtgtgtcatctgtgcatggggcccatgctgacctctgtgttgtgccagttatagtatgtgtgctgctgatatgagtgccacattgcctttacaacatcataggggccaaagagggttggcaggattatgagcagttggcctagtctgagaggctctctaaaagcctaaagtctgtaggcaggtgctcagctttgtatctccataagaagggaagaggatgtgaggatcctgtcagggctaggtccacctgggaagtgacaattggaacactcccagacctctctgggcaactctgggtgtacattttcctctgttcctcaagagctattatgaatttcatcatccattatgctgataggcctggggactgacacatagtaagcccataacaattataatttaaaactaatttgttatatagcataattgatatattttaaaatgcaaaactataattcaactaaaatatacaaggcactcaagtcataccatgttttaagtagcttacaaggtgatcagcaagtgtcttatacaacaagcaaatttgttcaaagagaagcattgcaaataagtatttataattgtatagttttatattttagccagaagagtggaatcctttagcaatgggggaaataaaagaatgtttaattacagttgcagataattgccttttccaaagacaatgtatgtaggcagaactcatacctgttaatattaaaaatcttggtttatcatatttggagaacaagggaaataaaaagtttgcatattaagattatttaaactaaagttaaggaatctctaatgtctgaaagaaacaataaatagcatttttcatgtagaatttttattggtgaaggttccacctggccaggttagtaaaatacagtcacacatcagttaaggatggggatatattctgagaaatgtatcattaggcaattttgtcattgtgtaaacatcatagagtgacacacaaacctagatggtacagcctactgtgcacctgggctctatggtatggcctgttgctcctaggctacaaacctgggcagcatgtgactgtactgactactgtaggcagttgtaacacagtggtaaacatttgtgtatcgaaacatagaaaaggcgtagcaaaaatacagtattgtggaaccactgccatatacgtggtccatccttgactgaacatcatgcggcatgtggctgtatgtatacacatagtttttgctgtgagtttgcatccatctcataggaagacatatatcaaaataaggaccagactggagagtgtgtaaattacttttcaatactaatggcttattaatttgatattgtcagcaagtatgttgcaaaaacaaattccaccagaatgtgagttccatgagagcaggaactgggttgttcaccttgttggcacttggagtagagccactgagcttcgtgctgcataaaattgcttggaagaaagaagggagggcattccaggtaactgaagcattgctatgcaaagtaagcatttgccctctgaaatattttaacaatgtttatagaaacctttctcaattgtattaaactttgtaaattgtaaaaattattctgttataccttttctatttactaggcacaggcagccataggtgctaggtatgttttgaaaacatattgaacctacagtgtacatatcattccatgccattaaatattcttatttaatcatagatgtgttcaggtgtgtttggtttcctatttgtggatgtactagattgttttctttttttaacaaaacctgtgaacttgctttaagtattatcatttggtgacatgcccgccatttcagaaataaatgtttgagcaaagaggaaagccaccgggtctgattcagctctctggaggctccagagcttacctcgctgatgggaaaaagagcatcgatttaattgcccttggtaccgacttctagtatctagtattttgccagactcaggtatttcttaaagccattattcagagtcttcagcaaggacattgtattttacttgtgtctccttagttttacctagtttatttcatggttttaaagtattgtacatttttataatcctttaacaagacaaaaggttgagatgttggacatttaaatgccaaaggtgttttattatgagacttagcatttcatatttggggatggtaccttatcgaaaatcagataaactttggttggatgggtatttggaggaatcttttaagtcttttcttaagcaaagtttggacactctaaaataaggttgccaactggcatgtagagagaaaaggatgtgtcatacatttagaccaggtggcctgtcctgtaaatttttttgaggggaggggtgggcttgtttttttctgtgtttcggttttttccaatttttgttttgtgataaaatatgcataataaaacttattttatcaatttttaa

SEQ ID NO: 1557 - DNA, 45435 bp, Homo sapiens
cagtttccatggtgagatggtcaacaagcctgtaagttcctcagctacgactaccaggtacctcgggttcctccctcctccgagagaccgccgaggtgcgggctgtgagagggggagcgtggagcctccgaggccgaggtgaggggcggccggcgggcaggggccgggtctgaggtcgagggccgcacacccaggatcgagcggggactgggcccgctgggggtggggaccgtggggctgggatttgggatcagggcgagtcgtggcagagagaacccggaggatctttgaccccagtgcgggagcggccagcccaccctagagaagcgagacaagggcaaccagaaggaaccgagtctgaggaagcgcttcctctgggcagggatattgggagagtcctggacgagtgaccctggacctaggaggcatgagaggtctacacacacttgcaaggataccttcatgattgttgagttgtggtgagaaaagaggctctttttagtttattttttaaggcagtacattcacatccttaagagtcagaaacttgcacaaggccttattactcaaaactcccttttcccagttccttctgaggaaatagttgcaaatctttgaacttttttcctccggaaattttctttttttctcttacatcggcagctcttcactgtgttcttccttcattagctttactaagtttgtattctttggttggaaatatttatttatttatttatttataaatagaaacaggggtatcactatgttgctcaggctggtcttgaactcctgggctcaagtgattctcctgctttagctttccaaagtgcggggattacaggctgaaccaccgcctgccaccgaaatatttcttcattgagttcctttgcctcctagtgttacttttctgctgtgtgtgtaatagccatttgttttttctttctcctttctggtcatatccttaaatacattttgcactaattccttttgaaacctcatcatggagagaacttgaatttagcagattaggggtgagtgcaggcttttgtcttaggttccatatatatatatattttgaggtggagtctccctctgtcgcccaggctggagtgcagtggcgtgattttggctcactgaaacctccacctcctggcttcaagcaattctcctgcctcagcctcccaagtgacgagggttacaggcacgtgccaccacacccggctaatttttgtatttttagtagagacagggttttgccttgttggccaggctggtctcgaattattgacctcaggtgatccacctgcctcagccccccaaagtgctgggattacaggcgtgagccactgcacccagcccccatatattaagaaatatacccttgtgtattgttggtaagaatgtaaaatggtacagcagctatggaaaacagtatggcagttccctcaaaaaattaacaaatagaattgccatatgatccagcagtaccacttctgggtctgaatccaagagaaatgaaagcggggactcagttacttgtacagtcatgttcatagcagcattatttgcaatagtcaaaagggagaggtaaccccagtgtccattgatagatggataaacaaaatgtgtcatatacaatagaatatcattcagccttaggaagaaaatcttggctggatgcagcggctcatgctggtaatcccagcactttgggaggccaaggtgggaggattgcttgagtccaggagttccagaccagcctgagcaacatagcgagatcctgtttccacaaaaaataaaataaaataaagaatacaaaaattagctgggcaggccgggcgcggtgtctcacgcctgtagtcccagcactttgggaggtcgaggtgggtggatcagagggtcaggagtttgagaccagcctggccaatatggtgaaaccttgtctctactaaaagtacaaaaatattagccgggcatggtggcacatgcctgtaatcccagctacttgagaggctgaggcagaagaattgcttgaatccgggaggccgaggttgcagtgagccgagatcacgccactgcactccagcctgggtgacagaacgagattccgtctcaaaaaaaaatcagctgggcattgtggcatgtgcctgtagtcctagctactctggaagctgaagtcggaggattacatgtgcctaggaggttgaggcttcagtgagccatgattgcactgctgtactccaccctgagtgacagagcaagactccatctcttcaaaaaataaaaataagatggccgggtgcggtggctaacgcctgtaatcccagcacttggggaggccgaggagggcagatcacctaaggtcaggagttcaagaccagcctggccaacatggtgaaaccctgtctctactaaaaatacaaaaattagctgggcatggtggtgggcgcctgtaatcccaactactcaggaagctgaggcagggagaattgcttgaacctgggaggtggaggttgcagtgagccgagatggcaccactacactctagcctgggtgacagagtgagactccatctcaaaaataaataaataagtgaaaataaaaaagaaaatgtcatatgctgcaacatggatgaatgttgacgatattatgttaagtgaagtaaaccagtaatggacaaatattgtatgatccccacttatatgagaatctgaagtagtcaaattcatgtaaacagaaaagtagaatggtggttgctagaggctgcggtaaggaggaatgggaagttgtttaatgggtacagagtttcagatttgcaagatgaaaatgttctagagatctgtttcacaacaatgtgaatctacttaagactgaactgtacactttaaaaaggttaattggtaagttttgttttatatatatatatatttttttttttgaggcgaagtttcactcatgttgcccaggctggagtgcagtggagagatctcagctaactgcagcctctgcctgcccggctcaagcaattctcctgcctcagcctcccgagtagctaggattacaggtgcccgccaccatgcctggctaattttttatatttttagtagagacgggcttttggcatgttggccaggctgatctcaaactcctggcctcaggtaatacgcccgcctcggcctcccaaagtgctgggattacaggtgtgaaccactgtgccctgcctatatttttaatcaaaggagtttaaggacgggcacagtggctcacacctataatcccagcactttgggagtccgaagtggtaggatcacctgagatcagcagtttgagaccagcctgttcaacatggtaaaaccctatctgtaccaaaaaatacaaaaattagcccggcatggtaatgcttacctgtagtcccagctacttgggaggctgatgtgggagaatctcttgaatctgggaggcagaggcagcagtgagctgagattgcgccactgcactccagcctgggcaacagagtgagactctgtctcaaaaaaaaaaaagaaaaaaagaaacagaagactaccctcatatttgtggtcctttgtgtagttccgcctcatggctccctcctttgccctagggtaaccactgtcttcaactttatgcttgtcacttaacttgcttttctttataatttgactaaaattgtttgtatcccaaaaaaagacatattgagtagttttgcataaccttggactttttttttgttgtttgtttttgagagagtcactgtgttgcctaggctggagtgcagttgtgtgatcatagttcactgtagcctcgatcttcttggctccagaaatcctcccaccttagcctcccaagtagctaggaccacaggtaaatgctaccacacctggttaaattttttttttttttttttttttttttttttttttggtggagacagggtctccctgtattgcccaggctggtcttgaactcgtgggcttaagcaatccttccacctcagcctctcaaagtgcaggtattacaggcatgagccaggctgctttcaaactcctaacctcaagtgatccacttggcttggcctcccaaagtgctgggagtatagacatgagccactgcaccagaccgctttgcctttttttttgagacggagtctcactccttcgcccaggctggagtgcagtggcacgatctcggctcactgcaacttccgcctcccgggttccagcaattctcctgtctcagcctcccgactagctgggactacagacacctgccaccgggcccggctaattttttgtatttttagtagagacggggtttcaccttgttggtcaggttggtctcgaactcctgacctcaggtgatccacccacctcggcctcctaaagttctgggattacaggcatgagccaccgcgcctggccaatttttgtagagacagggttttgccatgttgccccagctagtcagggtctctctgtcacccaggcgggagttgcagtggtgcgatctcggctcactgcaacgtctgcctcctgggttcaagtgattctcctgcctcagcctcctgagtaccttggattataggtgcatgccactgtgcttggctgatttttgtatttctagttgagacggggtttcaccatgttggccaggcatgtcttgaactcctgacctcaagtgatccacccgcgttggcctcccaaagttctgggattacaggcgtgagccaccatgcccagccttcccctgtctttacatataaattttagaataaggttgtttataaaatatcttgctgtggttggccatgtaggcttatgcctgtaatctgagtgctttgggaggtagaggcgggaaaatcaaagtcaggagttcaagaccagtctggccaatgtagctaaccctgtctgtacgaaaaaaaattttaaatttagctggatgtgatggcacatgcctgtactgtagtcctagctacttgggacactgcggtgtaaggtttgcttgagctcagacgtttgaggttatagtgagctatagtaacaccactaacactgtaccctagcctggtctacagagggagaccctgtctctaaaacaacaacaacaacaacaacaacaacaacaaaaaaaaaacaaagaaaaaaactcttgctgtgaatttgataggaaaaatgttcaatttatatattgttttggaattttggagagcactgacgtctttattctattgagtcttttaatccattaacatagtacgtctcttcatttgcttagattttcctgaatttatttatttatttatttatttatttttttgagacggagtttcactctgtcacccaggctggagtgcagtggcacgatctcggctcactgcaacctccaccctccgggttgaaatgattctccttcctcagcctcctgagtagctgggactacaggcgcctgccactgcgcctggctaattttttgtatttttagtagagatggggtttcaccatcttggccaggctggtcttgaactcctgacctcgtgatccacccgccttagcctcccaaaatgctgggattacaggcgtgagacaccgcgcccagccctggaattattttataagcattttgtagtattcagggtacaagttgtgttcagcgtacaagtctgatatgtgtttgttagatttatagctaagtgtgcttgcttcgacagcacatatactaaaattggaatgatacagagattagcaatttaaagtattttttaaatttatagcttagtaattttttcaattattacaaatggtattttatttttaatttaatttaggtgtccatgttttattgctaatatatagaaatacagttgattttttagttgagcttatgttctatgacctttctaaacttactcgttctagcttttttttttttttttttgagacagagttttgctcttgtcgctcaggctggagtgcaatggcatgatctctgctcactgcaacctctgcctcctggattcaagcaattctcctgcctcagcctcccgagtagctgggattacaggcacccgccaccacgcctggctaatttttataatttttaggagagacgaggtttcaccatgttagccaggctggtctcgaactcctgacctcaggtgatccacccaccttggccttccaaagtgctgggatgacaggcctgagctatcctgctgggcctagtttttgtttttgtttttttttttttgagatggagtcttgctctgtcacccaggctggagtgcaatggagcaatcacggctcactgaaacctccccctaccgggttcaagagattctcctgcctcagcctcccaagtagctgggattacaggcacatgccaccgcacccagctaatttttgtatttttagtagagatgaggtgtcaccatgttggccaggctggtctcgaactcctgacctcaggtaatccacctgcctcagcctcccaaagtgctgggattacaggagtgagccaccatgcccggcccgttttttttgttttaatcaattttttttgtagagatggaggtctcactatgtcacctagggtggtctcaaactcctagcctcaagcaattccccccaactcagcctcccaaagtgttgggagtacagacacgaaccactgcacctagtggaggagttgtctttttgtatattgcttgaattttttttttttttttgtagacacagtctctctctgtcacccaggctggagtgcaatggcgtgatcttggctcactgcaacctctgcctcccgggttcaagcgattcctctgcctcagcctcctgagtaactgggactgcaggtgtgcaccaccacacctggctaattttttgtatttttagtagagatggggttttcaccatgttagccaggatggtctccatctcctgacctcgtgatccgcctgcctcggcctcccaaagtgctgagattacaggcgtgagccaccgcgcccggctcctaaaagttttctaacaaagctccttctctccttgtcctttggctagaaagcgacagattttcttaggcttttaaaatctgtacccattgatgttttcagattgctggcttctgtaacatctagtctgggatatatgaggcaaaaagaatacccagtgaacccagcactgtgtcgttctttgagttccaagatcccgtgctggtctgctattttctacctttcagtccatatcatgtttatttatatataatttcagggtattgagctttacttaatgggaggagtatgaagcagtaccctgaactggaagtgttgctttcatttttgaaagacatttttgttgccgggcgtggtggctttcctttgtttaggtttcattgagcttcttggaattataggtttacaggttgttcgttttttgtttgtttgtttgtttttgagattaggtttcactctgtcacccaggctggagtggcatgatctcagctcactgcaacctctgcctccgggctcaggtcagcctctcatctcagcatcccaagtggctgggaccacaggcgcacaccactccaggctaatttttttatgtttttggtagagatggggtttcaccatgttgcccaagctggtcttgaactccagagctgaagtgatcctcctgcctcggcctcccaggcagtgctgggattacaggtgtgagccactgcagctggccttagatttatgggtttttattgtaagggtagaaagatttaggccatcatctctttgaatattttttatgccaacaaccccccatcctccttccagttatgtatatcttaggctgctttaaatcatgacacagctcagtgatgttcttttcattgttttggatttttttttcagaaatgaacttagttgcctttaagttcagtaatcttttcttctgtaatgtctaatctgctgttcatttcattcagtgtatttttcatctcaaacgtggttttcattttcagaatttttttttttttctttagagacgagatcttactaggttgtgcaggctggtcttgaattcctgggctcaagcaattttctcacctcagccttccaaagtgctgggattataggtgtgaatcaccacaactggcccactttcagaattttgactggatgtttttatatctttcctatactgtaattctcattgtaggtcatgttttcttgcctgtttgcatgcctggtatcttattggatgttaggcattgtgaattttactttttggatgcaggatatttttgtattcctgtgaatcttcttgagctttattctgggatatagttaagttacctgaaaacagtttgttctctttggtttttgtcttttcaggattattaggcaggtccagggcattgttcattctggggcaaattattccccactgctaaggctagatcttcctgagtactttacccaatgggccatgaattatgacattttctttttttttttttgatcctcaaaaattttattttattttgttttaatttttttttagtatttattgatcattcttgggtgtttctccgaggggggatttggcagggtcataggacaatagaggagagaagttcagcagataaacatgtgaacaaaggtctctggttttcctaggcagaggaccctgcggccttccgcagtgtttgtgtccctgggtacttgagattagggagtggtgatgactcttaatgagcatgctgccttcaagcatctgtttaacaaagcacatcttgcaccgcccttaatccatttaaccctgagttgacacagcacatgtttcagagagcatggggttgggagtaaggttatagattaacagcatcccaaggcagaagaatttttcttagtacagaacaaaatggagtctcctatgtctacttctttctacacagacacagtaacaatctgatctctctttctttgccccacgtttcccccttttctattcgacaaaaccgccgtcgtcatcatggcccgttctcaatgagctgttgggtacacctcccagacggggtggtggccgggcagaggggctcctcacttcccagacgtggcggccaggcagaggcgccacccacctcccagacggggtggctgctgggcgggggcgccccccacctcccagacggggtggccgggcggagactctcctcacttcccagacggtgcggctgccaggcggagaggctcctcacttctcagacggggcggccgggcagaggcactcctcagttcccagacagggtcgccgccgggcagaggcgctcctcacctcccagatggggtggtggccgggcagaggcgctcctcacctcccagacggggtggcggccgggtagagatgctcctcacctcccagacggggcggccgggcagaggcgctcctcacatcccagacagggcggccgggcaggggcgctccccacatcctagacgatgggcgcccgggcagagacgctcctctcttcctagacgggatgacggccgggaagaggcgctcctcacttcccagactgggctgccgggcagaggggctcctcacatcccagatgatgggcggccaggcagagacgctcctcacttcctagaccgggtggcggctgggaagaggctgcaatctcagcactttgggaggccaaggcaggcggctgggaggtggtggttgtagtgagcggagatcacgccactgcactccagcctgggcaacattgagcactgagtgagcgagactctgtctgcaatcccggcacctcaggaggccgaggcaggcagatgactcgaggtcaggagctggagaccagcctggccaacacggcgaaaccccgtctccaccaaaaaaaaaaccagtcaggcgtggcagcgtgcccctacaatcccaggcactcggcaggctgaggcaggagaatcaggcagggaggttgcagtgagccgaaatcgaggcagtacagtccagcagagggagacggtggaaagcgggagacggagatgagggagagggggagaccgtggaaagcgggagacggagacgacggagaggggagagggagaacaacattttttttttgagacagagtctcgctctgttgcccaggctggagtgcagtggcacgatcttagctcactgtaacctccacctcacggattcaagtgattctcctgccttagcctcctgagagctgggattacaggcatgtgccaccatgcccagctaatttctgtatttttagtaaagacggggtttcactatgttggccaggctggtcttgaactcctgacctcaagtgatctgcctgcctcgggctcccaaagtgctgggattacaggcgtgagccaccacgcacagcctgaattatgacatttctaatctgcctggtgtaggaacaggcactattccatgccctgtgtgagcactgggcactattccctctgatctttttagatggttcttttgacagatgtgggtaatgcccttatactcatgtactgatcaatacactgctgagctctcaagtgggacgctgcaggtctctggggttttctctccatgcagctctttcttctctggtgctgtgttctgtgaattctagctgcctgtgtctccccagactatcaaatctatcttttcaactcaaggaatctgccaggctctgccttagttatttttccttgtagcacattctacaaactactcaagtcagttagctggggcacttgtaggactcatctcatttgtttcctatctcttagggattactctctgttttctgatgttcagggtcttggaaaccattttttttttttttttttttttgagacggagtctcactctgtcgcccaggctggagtgcagtggtgcgatctcggcttactgcaagttccacctcccgggttcacgctattctcctgcctcagcctccggagtagctgggactataggtgcctgccatcatgcccggctaattttttgtattttttgtagagacggggtttcaccgtgttggccaggatggtctcgatctcctgacctcgtgatccacctgcctcagcctcccaaagtgctgggattacaggcgtgagccaccatgcctggccaattggaaaccatttttgtccttacgttttgtcaaaaaatgttttttttttccaatataacctggtccctgttactcaattcgtcttgcgctgaagtggagaattgaagatggggcatcaagcattcatttcatctcttattgaattctaataataaaagtacagttgacccttaaacaaaatgggtttgacctgtgtgggtctatgtatatgtggatttttttcttttttaaggagatggggtcggctgggtgcggtggctcctgcctgtaatcccagcacattgggaggccgaggcaagtggatcacttgaggccaggagtttgagactgacctggccaagatggcgaaaccctgtctctaccaaaaatataaaaaattagctgggcgcggtggcgcacacctgtagtcccagctatcggggaggctgagacaggagaatcgcttgaaccttggagatggaggttgcagtgagccaagatcttgccactgtactccagcctaggtgacagaggaagactccgtttcaaaaaaataaatatataaaaataaaaaaaatgagctgggcattgtggcagatgcccatagtcccagctactggagaggatgaagcaggaggatcacttgagcaggagatagaggctgtggtgagctctgattgcatcactgcactccaggctgggtgacagagtaagaacctgtctccgaaaaaaaaaaaaaaaaaaaaaggctgggtgcagtggctcaggcctgtaatcccagcactttgggagggtgagccaggcagattgcctgagctcaggagtttgagaccagcctgggggacatggtgaaaccctgtctctactgaaatacaaaaaattagcagggcatggcggcgtgggcctgtaatcccagctactttggaggctgaggcaggagaatcgcttgaacctgggaggcgaaggttgcagtgagccaagattgtgccactgcactccagcctcagcgacagagcgagactctgtctccaaaaaaaaaaatcaactgtatatctaatggtactgaaaagagagaaaccacaagacactggtatatattgacatacacaagtcacagagaatagaaatggactggatgttgaagcacagtgatgcatatattattattcaagtcaactcactatttaaagctaatttcataggaaaattctacttaattcagtctaacattatgtaagtaaccaaggaagagttaacagctgtgttacagaagtgaactataagcttgtgaattcagtatttaaaaaaaaattccttttcagtattttgtaatgcttcaacatgcattttgagcttatttctgtttatattgttgtaatgttcctcagcagttaacatgtattgaagcattttttttttttttttaatgagactgagtctcactctgtcgcccagtctggagtgcagtggcactatttcagctcactgtaacctccgcctcctgtgttcaagtgattttcctgcctcagcctcccaagtagctcgaattacaggcacccaccaccactcctggctaatttttgtattattagtagagacggggtttccccatgttggccaggctggtctcgaactcctgacctcaggtgatccacctgccttggcccccaaagtgctgtgattacaggtgtgagccaccatgccaggcctgaatgtttacttttacttttaatgtaagttttaatttaaatactgatacttgattcagttattggaaaacttttttgttttgagacggagttttgctctttttgcccgggctggagtgcaatggcacgttcttggctcactgcaacctccgcctctcgggttcaagtgattctcctgcatcagcctcccgagtacctgggattattggcatgtgccaccacacccggctaggctaattttgtatttttagtagatacagggtttctccatgttggtcagtttggtctcgaactcccaacctcaggtgatccatccgacttggcctcccaaaatgctgggattacaggtgtgagccaccaagcccggcctcttttttgctttgtttttttttgagacggagtctcactctgttgcccaggctggagtgcaatggtgagatatcggctcaccacaacctctgcatcctgggttcaagtgattctgctgcctcagcctcctgagtatctgggattacaggaatgtgctaccacacctggctaattttttgtattttgagtagagacggggtttcaccatgttggccaggagttcgactcctgacctcaggtgatctgcccgcctcggcctcccaaagtgctgggattataggcgtgagccaccatgcccagccggaaagcttttaagtgcccagaataatttgggtgtgtgaatgcctttttatccatagtaaatttaataaaatctaattatagatcaagtatttctgatgtaaatttagcatctaaatttaagtggctgtgaagtataaaataacagtagataccaatgacttagaagaaaaaaaagccttgacatctctatttcctcgtctctaaaggtgataacacttgcactatggtgatcctactagtaatacatttggagccacgttgtaaacttcagagtttgcaccattattattatttttttattattattattttttgagatggagtttcgctcttgttgcccaggctggagtgcaatggcgcgatcttggctcactgcaacctccatctcccaggttcaaggattctcctgccccagcctccctaatagctgggattacaggcatgtgccaccacgcccagctaattttgtatttttagtagagacggggtttttccatgttggtcagactgcttgtgaactcccgacctcaggtgatacgcttgcctcggccttccaaagtgctgggattacaggcgtgaaccaccatggatggcctattattattattattagagatggagttttgctcttgttgcccagtctggagtgcaatggtgcgatctcagctcactgcaaactccacctcctggatccaagtgattctcctgcctcagcctcctgagtagctgggattacaggtgtgcgccaccaggcctggctaattttgtatttttagtagagacggggtttcaccatgttggtcaggctggtctcgaagtcctgatctcaggtgatccacccgccttggcctcccaaagtgctgggattatagacttgagccactgtgcctggccaaagtttgcaccattattattattattatttttcttttgagatggagttttgctcttgttgcccaggctggagtgcaatggcgtgatctcggctcactgcagcctccacctcccgggttcaagcagttctcctgcctcagcctcctgagtagctgggattacaggcatgggccaccacgcctggctaattttgtatttttagtagagacggggtttctccatgttggtcaggctagtctcgaactcccgacttcaggtgatcctcctacctcagcctcgcaaagtgctgggattacaggcgtgagccaccgcacctggccagtttgcaccattattatgggagcacttgcaaagcctgccagttgatggtagggtggaaaagaagaggacaactagaagagagttcctacaccgcaaagtaaactttgctggctctgcgaggagcaggaaacctgcatgatgagaacaaggactgggtggcactgcaggaaatgctcaattcgagtttcacttcctgtgttatcactttttctttgctgcaatttcatctttgttggtcaattctcttttaattttccatttttttacattctatgtaaatgtagtttttatgaactagagagtctgactccatattttatctttgactactgtcagctctcaagccccacctcttccctccccttctgtcccacacctggatggctgattcaaaagcccaggtgcttcctcttttggctctaaaggcaagttcaagccatgcaggccccagcatgtgcattggagccttcatttcccccccactccttaaccttaataacacccaaagccagtctctcttccctgctctcaagccatttttttttcttctttttctggagacagggtcttgtgtcacccaggctggcgtgcagggccctgatcacagctgccagtagctggaaccacgggggtgtgccaccacgcctggctaattttttaattttttttttgtagagatgaggagtgccactgtgttgcccaggctggtctcaaaactcctgagctcaagtgatcctctcttggcttggcctcccaaaatgctggggttacaggcatgagccattgcacccagccttaagctatttttgaacccatttgggattcatccctgttctccccagaaagcctcatgtgagtcataagcctttacatattctctctgtgcatgtggggctgtcaccagttttgaaaaaccaggttttgggtggggaatctatctcgtatctttgggtaatatcacagataaatacagcagacattaacattttattcagtaaccactgacagtaggggaaagagctgagctccattctgatttgtgcagtgatgatcgggctttttttctttttttggtggttggatattttatacctttttttccccaaatactctccactgaatgtagtcgactggtgattttaaagggggaatgagggagtatggaggggtatgagttggggctcagtagagttggggatgtgaaaaattacaagggaccagtgtaaatgtgatgaggccagcggtgtctgcctgctggcaatggtcaaagttagattccatcctcccacagagactgggagacagaggccttatctttcccaatcactacatttcaaagcaatggctccttgagaaagcaatgttccttgagaaagacacttcttagctgtaggagatacacacttgcatacacatacacaacatgtgtatcacataaacatctcaaagggacagaggacagattcataattgtaagtcctttttagtaaatgctcttaagagagggcggtcaggagcctatggtcagatattggcaagaatagtaagttatcctggcagcactgagatttctcaggcaggcattttaatggtggggacaggggtcatcctgggaacacaggctatgctactagaagccatgccaatttgtctctcagtgcagagtttcagatggagttatggggggagagttctgcagttctcagtaaccacaacagtatatatcactggaagatgaagcccacacaactacagatgttactgtttctgagtgagccgaataacaaacttacagtgagcagtcaccaacagacagaagtgatgtgattggttactgatcatgacatgcatttgttattaatgtgatgatgtgtagactgaagagctagcagcctgcactttatgcgaaaactcacagttaatatactgtgtacctgaaatttgagttgtgtcgttgggggactggtgttattaaatcatggtgactgaaattcgtgcatatcagaactgtaccaagcaagggctgcctgatgagtataatgctctcatgttttatgggaatttatataaatttaaaataatatgaataaatatttgaaagttgtatgttatgcacaaggtttgaaataatgcaattcttttaatattttaaaaaattgttaggactcagattttcttttatcttttcttttttttaaggtacggagtctcgctctgtcgcccaggctgaagtgtagagtgcagtggcatgatctcagctcattgcaacttccacctcctgggttgaagcaattcttctgcctcagcctccggagtagctgggaatacaggtgcaggctgccacgcccggctcatttttgtgttttagtagagatagggtttcaccatgttgcccaggctggtctcaactcctgagctcaggcaatcctcccgccttagcctcccaaagtggtaggattacaggcgtgagccactgcacctggccctcgactcacagattttcaaaatacttttgaacagtaagctgaggacagtgtttattatgactatactggtctcctttcactagctcacaaaatttaactacatcacttgtcagtctcctaaaaatgcagtgtatgtgctttgaaacttgtgaatgatctgctgatttgtgctattttatattcaatgttgttgaaagaatagtttttaaaccaagtaatgcaaaaatttagtgtaacatgaatgcttgtgctgtaaaacatactggaaaatcaatagctctggaataaactttggatttttaattaaaattgattttgatgtacttatgctgttaaattggtagagactagtctgaaaagctgagaaaagataaagcagaattaaaacaaaatctatcttattcgtagagccatgtcaagaatgcattctctctacacctattccaatgggcacattagtacttgattatgcagggagtgaatcatgccaagtcttcacgtacacattgctcctatcactgctgtgcagtgagccgtgactgcgccactacactccagcctgggcaacagagccagaccttgtctcaaaaaaaaaaaaaaaaaaaagtcctttaagggatacgaggctgtgtgtgatagtcgttttcttttagtttgcacttttttttttttttttggagacagtctcgctctgttgccccgtccggagtgcagtgggtccatctcggctcactgcaagctccgcctcccgggttcaaggccttctcctgcctcagcctcccgagtagctggaactataggcgcccgccaccacgcccggccaattttttttgtattttttagtagagacggggtttcaccgtgttagccaggatggtctcgatctcctgacctcctgatccgcccgcctcggcctcccaaagtgctgggtttacaggcgtgagccacggcgcacggcctagtttgcacttttattcacccccaaattctgtgtattgcaagtaagtctcaaattttgagaagcgagcaccatcccattggcatcgtgactaccaaccaccacatcactcagctgctttgctttccgggagaatccctgcgccgtgggttcgctcgcctttccatgcctgccgtgcaggcgtcctttgcggtcttttgtccacgtccgggtcaacgcctgacgcgccccttcccggctggacgacgcagctcagggcggggcgaggcgaggttgtgtcgcggaacctgacgggaaacggcccctctaggtccgtggcgcggcgcgcttgtggcagcgacgggcactgccgcgcatgcgcggcccatttccgagagtggcagggctgggcgcggtggggtcgcctctggggtcaaagagcacgccgagcccgccggagggcggggccgcggccttggccctttggcgcgtaggagacagcgcgccaggctggcagccggccttagcggcgtttgctgctcttgtgcggacgccactgcgcgccctagtggggactacggggacgcttcgcgctccaggaaggaggcgggcaccgcccgctctagcacagtccgggagctggacctcggggttcaccgctctgcttgcccactaaaagcccattcggcggaagtccagcgttgcatggttacagtactgagccccagacatcgttgccaagtataatgcaggctctgttttatcctggggcacttgtagtcagggttcgtgggcccgcacttcataatggagggctgcgggcctcgtctgaaccgtccagccagtgtgtcctcagtcgtcttggttgggtttttgaagaaccaacccgagattctggggcacagggagttacaagacttggggccctgatgtaagccccaaataaaatgattttggcccctagggccagatccgagtttctaaaaacagagcagcacttgtaaggtagaggaagcgtggcccacctgaatggggacttctcaccagagtttcacagcagcggaagacgaggctgaggaagagcacggcccatatttgcacggagaggcaatatgtaatgcctgtgctccacaagccaccccagctgactcaacaggagttttgctccagctgtcagagaggtgagctgggcctaaggctagggttaggcttgcccaggaaatgtctctccattttcagggttgagagaacctggttgggagggaaagaaatattactacctctaagaaaattatttttctttttcttttgagatggagtgtcgctctgtcgcccaggctggcgtgcagtggtgggatctcggctcactgtagcctctgcctcccgggttcaagcgattctcctgcctcagcctccagagtagctgagattacaggtgcgcgacaccatgcccggttaatttttgtatttttagtgaagatagattttcaccatgttggccaggctggtcttgaactcctgacctcaggtgatccgcgcgcctctgcctcccaaagtgttgggattacaggcgtgagccactgctcctggccaagaaaattatgtcttaaacaccccaacggcctttgaatttttctgaattatttactcattccagataccgagagcttcccatactatgccaattaccgcaggtggccttgagagatgtgggtgcttccaccatgcttactcagaaagtagttcaggaaacagtttcctggattaccaatttctgcctgacatgaaagatgaaaaccactgaactccagaggggtgaatgtccaggtcatcccattcattagctactccagaggctgaggcaggagaatcccttgagcccggaaggcggaggttgtagtgagccgagatagagccactgcactccagcctgggtgacagcgtgagactccatctccagaaaacaaaacaaaacaacaaaacaaaaaccctagcgcggtggctaacgcctgtaatcccgtcactttgggaggccgaggggggaggatcacaaggtcaggagttcgagaccagcctggccaacatagtgaaaccccgtctctactaaaaataaaaagatagctgggcatggtggcgcatgcctgtaatcccagctactccagaggctgaggcaggagaatcgcctaaaccctggaggtggaggttgcagtgagccgagattgcatcactgcactccagcctgggcgacaaagcaagactctgtcttggggaaaaaaaaaaaaaaaaaagaaaaagaaaagaattcctcatgagatcgcttgaacgcgcgagttggaggttgcagtgagccgagatcacaccactgcactccagcctgggcaacagagggagactccgcctcaattaaaaaaaaaaaaaaattcctcatgagacattaagagttacagctctttgccgggcagggtggctcatgcctgtaatcccagcactttgggaggccgaggcgggcggatcacgaggtcaggagatcgagaccatcttggctaacatggtgaaaccccgtctctactaaaaatacaaaaaattagctgggtgtggtggcgggcgcctgtagtcccagctactcgggaggctgaggcaggcgactggcctgaacccgggaggcggagcttgcagtgagctgagatcaggccactgcactccagcctgggtaacagagcgagactccgtctcaataaaaaaacaacaacaacaaaaacaaaacaaaacaaaaaaaaagagttacagctcttttagaatttgtctggcaggctttccagtttttgccagtgtgaacccaaaatatctgagataggcctcagttaatttagaaagtttattttgccaaagttgaggacacgcgcccatgacagcctcaggaggtgctgatgacatgcgccaatgtgggcagagcacactttggtttcgtacattttagggagacatgagacatcaatatatgtaagatgaacattggttcagtccggaaaggcaggacaactggaatcaaaggtgggacaacttgaagggcaggtggcttccggggtcttaggtacagaagagacaaatagttgcattcttttgagttgctaattagcctcttcaaaggaggcaatcagctttgcatttatcttagtgagcagaggggtaactttaaatagagtgagatgcaggtttgcccttagcagttcccagcttgacttttctctttagcttagtgattttggtgccccaagatttattttcctttcaccctggaaagccccttaaaaacaaaaaacaaaaaacaaaaaacagttcttggcattgaagtctaaaaaacattgtttttccggtcttcctgtagatgacttagtagagagtcttcagtctttcagtgagtaccagaaatcagtgcagtctgctgcttgtaattgagtacttcgtgtgggtcgagtactcagtcagtacatttctagggatggaggcaccttggtcccatagacctctttctgatggtcctgcttgatccaggcatagaagctgggatagctgcatgaaagaatggattatgtcaccttcagatacactccttaaatgtatgtgtagattgtacaacagcaaggttaaagctgtattttctggcaagtatctccacatttccctttcttattttgaacaacatgacttgctggatctgcctggtaggggtatccaaatgtcatggatactttagtgcttgccttaattgagcattctgtccagttgatgctcatgtttaatctccctaaaatgtcttctcagttggtttctgatctagtccttcctctgtaattatttcttttctgtcttgtccgtgaagtcttcttcctcttcctgcctctcattattgctgttcccaaggtatccagtctttttctttctttctttctttctttttttaggtgtagtctcactttgtctcccaggctagagtgcagtggcatggtcttggctcacttcatcctccgcctcccaggttcaagtgatcctcctgcctcagcctcccaagtagccgggactacaggtgtatgctaccacacctggctagtttttgtacttttagtagagacagggttttgccatgttggccaggctggtctcgaactcctgacctcaggtgatccacccaccttggactccccaaatgctgggattacaggcgtgagccactgcacctggcccttggtttgctgagactttttatcatccagtgggtattgaacttttaaaaaaaaatttttaagtcaggtctcactctgtcacgcagtctggagtgcagtgttgcgatcacagctcactgcaggtaactctgacttcagtctcccaggtagctggaactgcaggtgcacagcacaatgcctggctaatttgtttattttttgtacagacagggttttgccgtgttgctcaggctgtgagtttattattattattattattattattattattattattattattattttctgagatggagtctcgctctgtcgtccaggctggagtgcagtggctcaatctcagctcactgcaagctctgtctcctgggttcacgccattctcctgcctcagcctcccgagtagctgggactacaggcgcctgccaccacgcccagctaattttttgtatttttagttagagacagggtttcaccgtgtcagccaggatggtctcgatctcctgacctcatgatctgcccgccttggcctcccaaagtactgggattataggcatgagccaccgtgcccggccgttgaattattattatttttttagctaatagaccagaagaatgaatttaattattattgagatgattatattgttttattctttttcagtggattgattgatattaacctatggattgagttaattttattaatgttttgattttcaaatgttaaatcagcctattttccaggaacaaagtcatattgttgctttatccttttaaaatatattccatgacaaattgttagatatttttgtgtctttgttcctgaaagagtctgttgttttctttctttcttttttttttttttttttttgagaccaagttgtcgcccaggctggagtgcagtggcatgatctcagttcatggcaacctctgcctcccgggttcaagcgattctcatacctcagcctcctgagtagctgagattacaggtgtctgccaccatgcccagctaattttttgtatttttagtagatatggggtttcaccatcttgaccaggctggtcttgaactcctgacctcagatgccacccgcctcagcctcccaaagtgttgagactacaggtatgagccaccatgcctggctgttattttcctttcttaaaagtctttttttttttttgagaaagagtctcactctaatgcctagtctggagtgtagtggccctatctcagcttactgcaacctttgcctcccgagttcaagcgattcttgtgcctctgcctcccaagtatctgggattacaggcaggcaccaccaggactggctaatttttgtatttttagagagacagggtttcaccatattggcctggctggtcttgaactcctggcctcaagtgatctaacaccaccttggtctcccaaagtgctgggataacaggcgtgagctatcacacccggcctcttctaatatcttaattttttttttttttgagacagagtttcgctctcatcgcccaggctggagtgcaatggcgtgatctcggctcactgcaacctccacctccccagttcaagcgattcccctgccttagcctcctgagtagctaggattataggcgttagccaccacacccggctaatttttgtatttatagtagagatggggtttcatcatgtttgtcaggctggtctcaaacttctgacctcaggtgatctgcctgccttggcctcccaaagtgttgggattacaggcgtgagccaacatgcccggcccagtcttttgttttttttttttttttttgagacaaggtcttgctctgtcacccaggctggagcgcagtggtgtgatgatcataactcacctctcccttgaactcctgggctcaagcaatcttctgatctcagcctcctgagtagctgggactacaggcatgtaccataatgcctggttacttttttgtattttttttagagatggtgttttgctatgttgcccaggctggtcttgaactcctgggctcaagtgatcctcctgtcttggcctcccaaaacatcgggattacaggtatgagccactgcccccggcctttgttaggtttatatcaattttatgcctgtttcagaaaacatgtttagtgttttctctttattctccatgagtgcttgtgtaagattggtgctatttattccttaattgcttgtaaaattacagcagtgaatttttctagggtctggcttttctttatgaataattttaaaattatagatttaatttctttatattagggaaattatcctttagaacttgatacaagtcctagttgtttgtttctaccttgtcatttgtcatccccaggtgggtggcaggtgtgtttgttccagggcaaagctatgtctcacacacactagttcacataaccccattcagaccaaaaattgttcacagtttactttgctttttgtctctttatctccaaggttggtctgtagtgaactcaaagccttaattctatcccagtccttttagttaaggtcagcagtgacctctagtggtgaaatcttcagtcttcctcttaacatgactttcttttttaaaaattatctagtgaattactctttctgtttgtttgtttttgagatggagtcttgctctgttgcccaggctggagtgcagtggcacgaccccagattactgcaacctctgcctcccgaagtgctgggattgtagggttgaactactatgcctgaaccctcttacgtggctttctagccacgtaatcattgattacaggcacacctcgttttattgtcccttgctttaatgtactttgcagatattgtgcttttttttcttttttcttttttctttttttaacaattaaaagtttgtggaaacccggcattgagcaaatctgtagacaacatttttttttttttttttgagacagagtctccctctgtcaccaggctggagtgcagtggcgtgatctcagctcactgcaaccttggcctcctgggttcaagcgactcttctgcctcagcctcctgagtagctgggactacaggtgtgcaccaccatacccagctaatttttgtatttttagtagaggtggggtttcaccatgttggccaggatggtcacgatctcttgacctcgtgatccacctgcctcagcttcttgaagtgctgggattacaggcatgagccactgcatccggccttttttttttctttctttttttttttataaatagagataggggtctcatgttgtcacccaggctggagtgcagtggcatgatcttagctcattgtaaccttgaactcttcgactcaggggatcctcctgcctcagccccctgagtagctgggaccacagccatgcctggctatgcctggctaattaaaaaattttttttggccaggtgcggtggctcatgtctgtaatcccagcacttggggatgccaaggcgggtggatcaactgaggtcgggagtttgagaccagcctgaccaacatggagaaaccctgtctctactaaaaatacaaaattagctgggtgaggtggtacatgcctgtaatcccagctgctcgggaggctgtggcaggagaattgcttgaacccaggaggcagaggttgcggtgagccgagttcacgccattgcaatccagcctgggcaacaagagcaaaactccatctcaaaaaaaaaaattttctttttgggccaggcggatggctcatgcctgtaatcccagcactttgggaagccgaggcaggtggatcacctgaggtcattagtttgagaccagcctggccaacatggcgaaaccctgtctctactaaaaatataaaaattagccaggcgtggtggtgcacacttgtagtcccagctactcgggaggctgaggcaggaaaattgcttgaacccgggaggctaaggttgcagtgagccgagatcatgccactgcattgcagtctgggtttcagagtgaaacactgtctcgaaaaaaaaaaaaaattttttttttttggtggaaacttggtctcactatgttgcccaggttggtcttgaactcctggcatcaagtgatcttcccatcccaccttggtcccccagagctctgggactgtaggcacgagccacctcacctagcctcacaactgtttttctttctttcttttttttttttttttagcatgtgctcatgttgtgtctctgggtcacattttggtaattcttgccctatttcagacttttttttattatctattatggcaatctgtgatctgtgatttctgttattattattgtaattgttttgaccgtatataagatggttaaaattaacaaatgttgcctgtgttctgactgcttcactgactggctgttcccctttctctctccctttcctctggcctccctattccttgagacacaacaatattgaaattagggtaggtaactaccctgcagtggcctctcagtgttccagtgagaggaagagtcatacatctctcactttaaatcagaagctagaaatacttaagcttaatgaggaaggcatatatcaaaagccaagacaggcctaaattaggcctcttgtgccgaacagcccaaatgtaaatgcaaaggaaaactttttttttcttttttttttttttgttttgagacaacgtctcactgtgtcacccaggctggagtgcagtggcatgatcttggctcactgaaacctctgcctcctggttcaagtgattcttctgtctcagcctcctgggtagctgggattacaggtgtgtgccaccatgcccggctaattgtttgtatttttattttatttattattattatttttttttattgatcattcttgggtgtttctcgcagagggggatttggcagggtcataggacaatagtggagggaaggtcagcagataaacaagtgaacaaaggtctctggttttcctaggcagaggaccctgcggccttccgcagtgtttgtgtccctgggtacttgagattagggagtggtgatgactcttgatgagcatgctgccttcaagcatctgtttaacaaagcacatcttgcaccgcccttaatccatttaaccctgagttgacacagcacatgtttcagagagcacagggttgggggtaaggtcatagatcaacaggatcccaaggcagaattcttcttagtacagaacaaaatgaaaagtctgccatgtctacttctttctacacagacacagcaaccatccaatttctcaatcttttccccacctttcccccttttctattccacaaaaccgccatcgtcatcatggcccgttcttaatgagctgttgggtacacctcccagacggggtggtggccgggcagaggggctcctcacttcccagtaggggcggccgggcagaggcgcccctcacctcccggatggggcggctggctgggcgggggctgacccccccacctccctcccggacggggcggctggccgggcggggggctgaccccccccacctccctcccggggcggctggccgggcggggggctgacccccccacctccctcccggatggggcggctggccgggcggggggctgacccgcccacctccctcccggaaggggcggctggccgggcggggggctgacccccccacctccctcctggacggggcggctggctgggtggggggctgatcccctcacctccctcccggacggggcggctggcctggcgggggctgatccccacctccctcccggaccgggtggctgccgggcggagacgctcctcacttcccagacggggtggctgccgggcggaggggctcctcacttctcagacggggcggctgccgggcggaggggctcctcacttctcagatggggcagctgccgggcagagggtctcctcgcttctcagacggggcggccgggcagagacgctcctcacctcccagacggggtcgtggccgggcagaggcgctcctcacatccctgacggggcggcggggcagaggtgctccccacaactcagatgatgggcggccgggcagagacgctcctcacttcctagatgggatggcagccgggaagaggcgctcctcacttcctagatgggatggcgggcgggcagagacgctcctcactttccagactgggcagccaggcagaggggctcctcacatcccagacgatgggcggccaggcagagacgctcctcacttcccagatggggtggccgccgagcagaggctgcaatctcggcactttgggaggccaaggcaggcggctgggatgtggaggttgtagcgagccgagatcacgccactgcactccagcctgggcaccattgagcactgagtgaacgagactctgtctgcaatcccggcacctcgggaggccgaggctgggggatcactcgcagttaggagctggagaccagcccggccaacccagcgaaaccccgtctccaccaaaaaaatacgaaaaccagtcaggcgtggcggtgcgcgcctgcaatcacaggcactcggcaggctgaagcaggagaatcaggcagggaggttgcagtgagccgagatggcagcagtacagtccagcttcggctcggcatcagagggagaccgtggaaagagagggagagggagagggagctggagcttgtttgtatttttagtagagacagggtttcaccatgttggccaggctggtctccaactcctgatctcaggtgatctacccgtctcagcctcccaaagtactaggattacaggcatgagccactgtgcctggctggcatatttgtttatagcatggtttactgaatttttgttttcttttctttttttctttctttcttttttttttttttgagatggagtcttgctttgtcacccaggctggagtacagtggtgtgatctcagctcactgcaacctccgcctcctgggttcaattgattctcctgcctcagcctcctgagtagctgggattacaggtgcgcaccaccacacccagctaatttttgtattattagtagagacggggtttcaccatgtttgtcaggctggtctccaactcctgaccttgtgatccacccgcctcggcatcccatagtgctgggattacaggcgtgagccaccatgcccagctggtttactgattattttaaacaaattattgagtcctaatgttcagaaaaaatatttctttcaaaatgttactgctcattgacaagctagtcacataagagctatgaggtatgaaattaatgttgttttcatgcttactagcatgcatccattctacagcccatggatcaaggagtaattttttttttgagacagtttagctcttgttgtccaggctggattgcaatggcgtgatcttggctcactgcaacctccacctcctaggtttggcgattctcctgccgcagcctcctcagtagctgagattacaggtgcctgctgccacacccagctaattgttttgtattttttttttagtagagatggggtttcatcatgttgaccaggctggtcttgaactcttgtcctcaagtgatctgcctgcctcagcctcccatagtgctaggattataagcatgagccgccgcacccggccaaggagtaattttgactttcaagttttattttttatttttctttttttgagacggagtcttgctgtgtcgcccaggctggagtgcagtggcacaatcttggctcactgcaacctctgcctcgcgggttcaagtgattcttctgcctcagcctcccgactagctgggactacaggtgcacgccaccacgcctggctaatttttgtatttttagtagagacagggtttcaccatattggccaggctggtctcaaactcctgacctcgtgatctgcctgcctcggccttccaaagtgctgttattgcaggtgtgagccactgcgcccgaccttcaacttttattgtttaagaaataaatttgtagccaggcgttgtgactcatgcctgtaatcccagcactttgggaggccgaggctggtggatcacctcaggtcaggagtttgataccagcctggcaaacatggtgaaaccttgtctctactaaaaatacaaaaattagctgggtgtggtggtgcatacctgtaatcccagctactcgggaggctggggcaagagaatcgcttgaacctgggaggcagaggttgcagtgagccgagattgtgccactgcactccagcgtgggcaacagaatgagactctatctcagaaaaaaaaaaaaaagaaaagaaaaatttgtaaggctatagctggcatggatagtgatccctctgatggatctgggcaaagtaaattgaaaaccttctggaatggattcactgctcaagatgccactaagaccatttacgattcatgggaataggtccaattaacaacattaataggaatttggaagaacttgaatccaacccttatggatgactttgaggggttcaagtcttcagtggaggaagtcactgcagatgtggaaatagcataactagaattagaagtggagcctgcagatgtgagtgaattgctgcaatcttatgttagaacttgaacagatgaggagttgcttcttatgcgtgagataagaaaattgtttcttgtgatgtaatctattcctggtgaagatgctgtgaacattgttaagatgacaacaaaggatttagacttacataaacttagttaataaggcagcagcagggttttagaggattgaatccaattttgaaagaagttctactataggtaaaattaaacagcatctcatgctacagagaaatctttcgtgaaaggaagagccggccgggtgcagtggctcattcctgtaaccccagcacttttggaggctgaggcaggtggatcacctgaggtcgggagtttgagaccagcctgaccaacatggagaaaccccgtctctactaaaaatacaaaattagccggccatggtggcacatgcctgtgatgccaactactcgggaggttgaggcaggataattgcttgaacctgggaggcagaggttgtggcgagctgcgatcgcgccattgcactccagcctgggcaccaagagtgaaactctgtctcaaaaaaaaaaaaaaaaaaaaaaaaaggccgggcgcagtggctcacgcctgtaatcccagcaccactttgggaggccgaggcaggcggatcacgaggtcaggagatcgagaccatcttggctaacgcggtgaaaccccgtctctactaaaaatacaaaaaattagctgggtgtagtggtgggcgcctgtagtcccagctactcgggaggctgaggcaggagaatggtgtgaacccaggaggcagcgcttgcagtgagccaagattgtgccactgcattccagcctgggctacagagtgagactctatctcaaaaaaaaaaaaaaaaaaaaaaaaaagaaaaagaaaggaagagtcaatcagtgtggcagacttaattgtccttttattttaagaaattgcacagccatcccagccttcagcaaaccaccactagcagtcatcaacattgaggcaagaccatctaccagcaaaaagattatgattcactataggctcagatgattgttagcatttcttttattttactttattttttgagacatagtctggctctttcacccaggctggagtgcagtggtgcgaccttggctcactgtgacctctgcctcccgggttcaagcgattctcctgcctcagcctcctgagcacctgggactacaggcgtgcaccacacccggctaatttttgtatttttatagagacgggctttcagcatgtcgaccaggctggtctcgaacccctgacctcaggtgatccaccagccttggcctcctaaagtgctgggattacaggcgtgagccaccgcgcctggccatcatttatttatttatttttttaaataaataagagacagggtcccttatgttgcccaggctgatcttgggctccttggttcaaatgatcctcccacttcaaccttccaaagtgctgggattacaggcatgaaccaatgtacttggcctgcatttttaggccatgaagtattttaaaattaggatatgtctgtacacggtggctcatgcactttgggaggccaaagtgggtggatcacttgaggccaagggtttgagaccagcccggccaacatggtgaaaccctgtctctaccaaaaaatagaaaaattaggtgggcgtggtggtgtactcctgtaatcctaggtactcaggagactgaggcatgagaatttcttgaacccaggaggcagaggttgcagtgagctgagatcacaccactgctctccaacctgggcaacagagcgagactctgtcttccaaaaaaaaaaaaattaggatatgtacattggtttactagacataatgctattgcacacttaatagactatagtatagtgaaaacataactttcacatgcatgggaaaccaacatactcgcatgactcaagtgacatttgctttattgcagtggtccggaactgaatgcacattatctttgaggtatgcctgtgtttttcccttctggttgactttcttcacttggcttacaggacaccacactcttttaactttcccttttaatttttttttggttgcgggaacagtgttttactctgttgcccaggctggagtgcagtggtgccatcacggctcactttagccttgagctccctgggcttcggtgatactcccaccttagcctcctgagtagctgggactacaggtgcatgccactatgcccagctaatttttctatttatttatttagagacagagtttcacttttgttgcccaggctggagtgcaatggcgtgatctcacctcaccgcaacctccacctcccaggttcaagcgattctcctgcctcagcctcccaagtacctgggattacaggcatgcgtcaccacacctggctaatttttttgtatttttagtagagatggggttctccatgttggtcaggctggtcttgaactcccgacctcaggtgatccacctgcctcggccttccaaagtgctgggattacaggcgtgagccagcacacccgggcaatttttctatttattgtagagatgggatttgccatgttgcccaggctggtgtggaagtcctgggctcaagcaattttcctaccttgacctcccaaagtgttgggattacaggtgagagccactgcactttgccttaactttttccttttttttttgaacagagtctcactgtcacacagcctagagtacagtggcacgatcatagctcactgcagcctcgacatcctgggctcaggtgttcaagtgatcctcccacctcagcctcttgagtagttgggactacaggcatgcaccaccacactaatttttgtatttttttgtagagacggggtttcaccatgttgccgaccttaacttttaactttccttctctcatcgtttgctggttcctccttttcttcctgtctctgaatgtttatgtgtagtccttggtcattgtgatgcaggatttttcttggcccctttgttggactcgtgacagggctgtcccatttactcggcccattgcgctcaaccccttgcaggatggagcacgtgagtgagtgcgggatctggctggctgctccgggcactggcaggagcaagctccgtgtccagaatggccagccagatcccacacttgctcgcacacttggatggcggtgccaaggcgagggtgcccactaccccaaaaccctagagggagtgttacggtgctctgttagttttgctgtctgcagacagctgtgtgtttgcagctcagttggccccttgtctcgttgcatggggtggctgccctcctctggtgaggacaaagggccagcgtgacagtctttctaggtacccgcactcagtggatcctgagcttttgtctggtgtccaagaagaatgtcacatgggcaaactgaaggatggtgaagtcagagaattttattgagcaatgaaaatggctctcagcagagaggggaactggaaaggggacgggaagggcaggttgccttccctgaggtcaggttgccccttccctgaagtcaagccatctctctgaagtcaaattgtctctctctgaagtcaaactgtctccccctctactgactgagtctggggtctttctttatagcactcagaatggacagtgtgtgctcattggtttgtgagtatgcaaaaaatgttaaagtgaagacaccactcaatggtgggcataacagtgtagaaaaccaattaggaaagggtagctatatataaaataggtgaagagtggggattagaggaaagcatgccaaagaggaagataagtcctcagtctggtccaaggatttaacttgtatcttggctttcaggctttaaactgtctttggcttggaggtttcactggggacctgcccctatttaccttggcatttggctgcctccatttgttatcacttgtactttgtctggctgaggcctctcccttggcaatgttttgtcagcagtactctctggggcctgatccctcctggtaatctctccagctcagatttccttcttacactttggatgcatatgttaactgtccactctgcatctctgcttgagtattttatagacccaagctcaacatgattaaaactggcctcttggattttctctcccaaacccacaacctctggagcattccttccccttcttgtttgatagcagaccccttggaattatttttgaactgtttttttcttgtcttacacatcttatttgtcagaaaaacctctggggcatacatccagaatatatccacagagtctgacctcttgcaatcctctctatgacatcttttgcctggattacagcaaccgttgcagagcagtcttgctgctgctcagaccttggcctctggcatagcatttagagtacctgtgtaggaagagtcaggttgctaagcgccaatcctctgcccaacatctacatttttcactgagtaaaagccaaagttccaccagtgggttatgtgatccattacatctgtgacttcacttccttctcagcctcttgatcactatgctccagctcgacttgccttcttgctggatgtaccaggcataacaccacctttgtctttgtaccaaatgtgcccttttcctggagtatgtttcctagggagccttccaacttattctgttataatttataaaggatttataatttataagcatttataattatgtcaaccatatttaataagttgatcattggctgggtgggtgcagtggctcatgcctgtaatccaagcactttgggaggctgaggcgggaggatcacttgagcctgggaggtagaggttgcagtgagccatgtttgtgccactgcactccagtctgtgtgacaaagcgagactctgtctcaaaaaaaaaaaaaaaaaggttgatcatcctttgtatatggtgactttaccatatattaggacacttttttttttttttgagatagagtttccctcttgtgcccccagactggagtgcagtggcatgatctcggctcactgcaacctctgcctcccgggttcaagcaattcttctgcctcagcctcccgagtagccatgcctgtctaatttttttgtattattagtagatatggggtttcaccatgttggccagggaactcctgacctcaggtgatctgcccatttcggcctcccaaagtgctgagactagaggtgtgagccaccgcgcctggcgtaggacactatttaactctgttttgggactttttcttttcactggggtatttttctttttattagaggagttcataataaacagtaatatctagcaagataagcccatttataatttttgtttttgacataccttttttcccttttttcttttttttgagatggagtcttgctttgttgcccaggctggagtgcagtggcgcgatctcagctcactgcaagctccgcctcccgggttcacgccattctcctgcctcagcctcctgagtagctgggattacaggcccccttttttttttccccagacccaaacatcaacttaccttcgccaccttttataaaagcaacttaagtacaacagccaggctgggcaaggtggcttatgcctgtaatcacaacactttgggaggcttgaggtgggaggatcacttgagcccaggagtttgagaccaacctgggtaacatagtgagaccccatttctccaaaaatttaaaaatctgcccgatgcagtgacttattcctgtaattgcagtattttgggaggctgaggcaagcagattgctagagcccaggagttagagactaacctgggcaacatggtgaaaccttgtctctgtgaaaaggcaaaaaaattaactggggatggtggtatgcatctgtagtcctagctactcaggaggctgaggtaagaagattgcttgagcccaggaggtcaaagctgcagtgagctgtgtttgtgccactgcattccagcctgggtgacagaacaagaccgtgtttcaaaaaaaaaaaagcaggggctgggtgcggtgtggctcaagcctgtaatcctagcactttgggaggctgaggtgggccgaggtcaggagtttgagatgagcctgaccaacatgatgaaaccctgtctctactaaaaatacaaaaatgagccaggcgtggtggtgcgcccctgtaaccccagctactcaggaggctgaagcaggagaattgcttgaacctgggaggtggaggttgcggtgagctgagatcgtgccattgcactacagcctgggtgacatgcctggagccccatgtacttgggaggctgaggcaggagtattgcttgaacccaggaatttgaggctgtagtgtgcaatgatcatgcctgtgaatgtactccagcatgggcaaaacagcaagacctggcctctaaaaggaaaaatgatttattatttattttttgagacagagtctagctctgtcacccaggctggagtgaagtggcgtgatcttggctcactgcaacctccacctcccaggttcaagtgattctcctgtctcagcctccccagtagccggaattacaggtgcgcaccaccaagcttgactaatttttgtatttttaatagagacagggtttcaccacattggccaggctggtcttgaacttctgacctcaagtgatctgcctgccttggccacccaaagtgctgggattataggcatgagccaccacactcagcctaggttttttttttaatcaattttttaaaaaatatcaattctactaaaagactgccacctcacagattgaataccaggccaccacacagtatcttaagaggccaggctcctcccccctgtacaaggcgcaaacttcccctgcctccacctcattctcccagtgtgcaggtgggtccccagtctgttgcaggcatgtgcagacaagaccctgggcagattcccttatctgcagaaaagcatctgatgtaaacacttgtggggttggttggagattctccggggaccctcccttatctgcctcctgcgtctatcactagcaggacctcgtataatttttgtatgaattaagaaagtaggccgggcctagtggttcacatctgtaatcccagcactttgggaggccagggcaggaggatcgcttgagcctggagttcaagaccagcctgggcaacatggtgagaccttgtctctacaaataaacaattagctgggtgtggtggtgcgtgcctgttgtcccagctacttgggaggctgaggtggcagaatcgcttgtgccccagtggtcaaggttgcagtgagttgtgatcatgccacagcactctagcctgagtgatagcgcaagaccccgtctgaaaaaaaaaaaaaattaatataccggcagagtcctcataccaggatttctcattttcctacaatgtataatatcaatagtaggcatcctatgtagcattttctcttcaactatcaacagtgaacatgacaaggtgttagatctcacacatgttgtatgctctccacttctgatcactgtagaatgaaaacaaatgtactgttctagggatcagtgtccttcagtgatgtggctgtgggcttcacccaggaggagtggcagcatctggactctgctcagaggaccccgtacagagacatgatgctggagaactacagcctcctcctctcagtgggtaaggattatgtaatttgcagcttcaaataacatttatttcctttttagctgctgattacagatggtttctttgtatgaatatgagttaaaggcttgagactcaggagttgaagcttgattgatcccttctgggcactgtaaagaatatctgtggtgttttctgtaatgaaatgctcaagtggacctatttttgtgcaggcacacctttgtcctccgcaggctatctggcccacgtcctgtgtcattttcattcacaggatattgcattaccaaaccagaggtggtttgcaagttggagcatggacaggtgctgtggatattagaggaagagtccccaagtcagagccacctaggtgagttaataaatatataggaagctataatcccagggagaaatttgatcctagggagatacttcacatattgacatctttgaaatttttcagagatatgtttttagagttaccagaactttggaagtgactaagaagagttggcctgcttgcctcagatgtatatgttattacacactagcagataacagctaaatggtctttgtttttttccaaaacttaatccttgcctctctcagtttagtcaaatgaatgtcatttgactcttccttctatatcaatttcagttatcttcttttcatcatatattatgtatttattcaatatgtattaatttggcagctacgatgttggcatttccatctgtgttagagatatagctctaacaccatggctgtgttatgttggtagaagagaatgagatgtagtgtgtgctttatgcaagggcctttttgaagtcagtagtttaataaacacagatttgaattgtgtgtcagtggaatattctggccagatggtataccctgtgctgtgaaccttaggccacagtgtcacgtgtgcaggacagcagtgagccaggctgcgtggaagtcaaggggtgatggggagcatgtgagagatgctgtcagagagactgctcgctgaggtgccgatatattcggaagttgtagccaaaacagaatttgctgctaaattggattatgggtataagaaaaagataataagcatgatctcaaaggttttatgctgaggcactggctgtgtgatgataccattaactggatgggagaaaatggggagaaacagttttgggaagaaataagagatagacacataaatttaaacaaatattctttgtataaaatagtaatgatgcccagttggatataaaacaataaaaataaaatactgaaaaatgacccaacatgtgaatcagttaccagttgatctgaattgtgttctaaaatcctttcttttttttttctttttctttctttatttctttttttttttgagacagtctctctcagtctcacaggctagagtgcagtggtgcaatcttggctcaatgcaacctctgcctcccagctcagagattctcatacctcagcctccctagtagttgggaccataggtgtgtatcaccacgcctgactaatttttgtatttttagtagagatggggttttgccatgttggccaagctggtctcaaactcctggcctcaagtgatctgccccccttggcctcccaaagtgctgggattacaggtgtgagccactgcgcctggcttctaaattcctttcattgttaagacgaaataatgttgcattaaatataaatggtaacatgtaatgagtaaatgctaaaagaaagtaatacttgtaacttctaaacttttaaaaagaagaaaatggaaaagaaaaaaattaaatgtgttggattagactgaaaaaaaaaaaaatgaggtcgggcttggtggctcaggcctgtaatcccagcactttgggaggccgaggcgggttggtcacctgaggtcaggagttcgagaccagcctgaccaatatggtgaaacgccgtctctactaaaagtacaaaaattagccgggtgtggtggcggatgcctgtaatcccagctattcaggaagctgaggcaggagaagcttgaactggggcagcagacgttggagtgagcagagatcgcactattgtacttcagcctgggtgacaagagcgagactccatctcgaaaagaaaaaaaaaaaatgaaaaagtggggaaaggcaggtaaaaattagaaaaactggaaactcttaagtgaaaaagagaaaaccaatccagatattttagaaatcataatacagttaaaggggctaaaccatcttattaaaagatggatattgtcaaattggattttcaaaaaccaagttatataggctcagtgcagtggctcactgctgtaatcccagcacttcgggagaccaacccaagaggattgcttgaggtcaagagtttgagaccagcccaggcagcacaatgaggacccatctgtacaaaaaataaaaaattaggccaggcgcggtggctcatgcctagaatcccagcactttggaaggccaaggcgtgtggatcacctgaggttgagagttcgagaccagcctgaccaacatggaaaaaccccttctctactaaaaatacaaaattagccgggcgtggtggcacatgcctgtaatcccgctactcgggaggctgaggcaggagaatcacttgaacccaggagggggaggttgtggtaagctgagattgcgccattgcactccagcttgggcaacgagagcgaaactctgtctcaaaaataaataaaaaaaaaattagccaggcatggtcatacaccagtagtctcagttttgggaggctgaagtgggaggatcgcttgagcccaggagtttgaagctgcagtgagctatgatcatgccactgcattccagtctggatgacagagtaagagcctgtctgtaaaaacaaaacaaaaatcaagctatatggagtttgagaatcatatatgaaatgtgaacatgaaaccttagaatataaaaggaatataaatgatatatggtccaaataataaacaaaatagaatgttacctctcagtggacccaaatttagcttttgagtttatttttgatgcagttcttttttcttttttctttttttttttaatgagatggagtctcgctttgtcttccaggctggagtgcagtagccgatctcttttgatcctatctcaaaaaaattttttttctaacttagataaacaaagagaaaatttatatatatatatatttgtgtgtgtgtgtgaatatatgtatgtatgtatgtgtgtatatatatatacacacatatatacacatatatatgtgtgtatatatatatataaatttgtactgatgaggtcttgctgtgttgctcagactggtcttgaactcctgaccttaagcaattcttccacctctgcctcccagagtgctggtttagaggcttgatccactgtacctggcctacttttattttttaattgaatgaaactcattctgtttttgctgttatcatttgagtgaattggtcccatttataatctaagaagcatgatactattttagtgatctatttttcttaagtttgaaacattttggtatgttatttcttagcaattatttcaacattactcatcaattatgtccaactgtggtaaaataaactaaaatagaaaagaatgatggaattgcttgtaaggataatagaatagtaaagaacactgtcactattacatcatccttcaattttcttattgagctgcttgaagcattacttgtgacaaaaatataaaagaagcctggagaaaccttatttgtagtttctttcttttttttgttgtttttattttatttattcatttcattttgagatggagtctcactctgttgcccaggctggactggagtggtgtgatctcatctcactgcaacctccgcctctcgggttcaagtgactctactgcctcagccacccgagtagctgggactacaggcacccaccactgtgtcctggctattttttatttttttgtattgttactagagacggggtttgccgtgttggcaaggctggtttcaaactcctgacctcaggtgatcctcctgcctcggcctcccaaagtgctgggattacaggtgtgaaccactgcacctgactctctttctttctttcttttctttctttccttctttctttctttctttctttctttctttctttctttctttctttctttctttctttctttttctttctttcttccttgcttccttccttccttccttctttcttttcttttcttttcttttctttcttttcttttttttgagatggagtcttgctctcttgcccaggctggagtgcagtggcacaatctaggctcactgcaagctccacctcccaggttcaagccattctcctgctgcagcctcctgagtagctgggattacaggtgcgcaccaccacacccagctcatttttgtattttgagtagagacagggtttcaccatgttggccaggctggtctcgagctcctgacctcgtgatccacccccatcagcctcccaaagtgctgggattacaagcgtgagccaccgcacctggccactttttattattatttttttattttttgaaatggagtcttactctgtcacccaggctggaatgcagtggcatgatctcggctcactgcaacctctgcctcacgggttcaagcgattctcctgcctcagcctcccgagtagctgggattacagatgcacaccaccacacctggctaatttttgtatttttagtagagatggggttttgccatgttggccaggctggtctggaacgcttgacttcaggtgatccaccttccttggccttccaaagtgctgggattacaggcgtgagccactgcgcccacctctctctctctctcttttttttttttaataattcaatgggcacagttgagagttcagagcttttattttcttccattaattgcaaagagtagaaaattgacaagaggaagactcttcacaattattaggcaaatcagaagatgaagcagaaccactgtagactctaataattacagtataattgatcgcataagtgaaatctcagactatgagttagatgatgatattctagatgaataaaggtatgcatatgatcctgttataagaacagcctgggccgggtgcagtgtctcatgcctgtaatctcagcactttgggagccgaggcaggtggatttcttgagcccaggaggtcaaggctgcagtgagctgtgatgctgccactgcattacagcctgggcaacaggagtttgacaccagcctgagtaacaaggcaaaaaactccatctctacaaaaaatacaaaaaattagccaggcatggtggtacatacttgtaatcccatttactcgagaagctgaggtgggagcatcacctgagcctgggaggttgaggctgcagtgagccatgatcacaccactgcacaatccagcctgggtgacagagccagacactgtgccaaaaaaaaaaagaaaaaaaaagcatgtgaatatgtctctttttcatgaaaaatatgttaacatttataatctgtgataacttattattatttctagactgctgcatagatgatgacctgatggagaagagacaggaaaatcaagaccagcatttgcagaaagttgattttgtcaacaataaaacactgactatggacagaaatggtgtattaggaaaaacattttctcttgacacaaaccccattctatcaagaaaaatacgtggcaactgtgactcatctggaatgaatttgaataatatttcagaattaattattagtaatagaagctcctttgtaaggaaccctgctgagtgtaatgtacgtgggaaatttctcctctgtatgaagcgtgagaatccttatgccagagggaaacctttggaatatgatggaaatgggaaagccgtctctcagaatgaggacttatttaggcatcagtatattcaaactcttaagcagtgttttgaatacaatcagtgtgggaaggcttttcatgaagaggcagcctgcagtacccataagagagtgtgctcatgggagaccctgtgaatataatgaacatgtgagagccttttccgatagaccaatattcattgttcatcagagaactcacataaggaagagtcaccatgaattcaatgaatgtgagaggaggtctggtgagaggccacctgtaaataaacaccacagggttatggagatgaaatactatgagtgtaatgcgagtgagaatagttttggcaagaaatcactcctcattctacaaagttacagaggagagaaaacttgactgtagtagacatttggaagtattctgcaagaagccaaatttcactcaacatcaagaaacacatataggaaagaatgcctataaaattaatcagtatgctagtacattttgctgtaagccaaagcattctgtatatcagaaaacagatacagaagaaaaactctatgaatgtagtgaatgtgggaaaaccttcagccataaatcctcttttatcctacagcagaggatacacagaggagagaaaccctatgaatgcactgaatgtgggaaaacttttggatataggtcatgccttgcagtacatcaaagaacacacacgggacaaaacctatgaatgtaatgaatgtggaaaaaacttctgtgagaagtcaaatcttcatgtacatcagagaacac

SEQ ID NO: 1558 - DNA, 120 bp, Homo sapiens
gccatgaggagctggcagtgggatggcctgggggtaggagcgtggcttctggagctagaccacatgggttcagatcccagcggtgcctctaactggccacaggaccttgggcagtcagct

SEQ ID NO: 1559 - DNA, 50437 bp, Homo sapiens
cagtcccgcgaccgaagcagggcgcgcagcagcgctgagtgccccggaacgtgcgtcgcgcccccagtgtccgtcgcgtccgccgcgccccgggcggggatggggcggccagactgagcgccgcacccgccatccagacccgccggccctagccgcagtccctccagccgtggccccagcgcgcacgggcgatggcgaaggcgacgtccggtgccgcggggctgcgtctgctgttgctgctgctgctgccgctgctaggcaaaggtgagttctgccggccgccggctcccgcaggggccagggcgaagttggcgccgagcagcggagcgggcgcgttcagaagcgcctttctgtttgccgtgggcagcgggctgtgcggtcgccggccacccggcctcggctgggagcgcagtggctgcggcgggcggcgggcgaagggcaggacgcctcgggccgggcgcctcgggccggggctgggcgggtctcgggcgggagcggagcgcgggccgggccgcgggggtcggtgctcagaaccctagccatagccgcaggtctcaatctggccgcgccctgcgccaaagccgcgtcctggagcaaacgggacagccgtttcggggccgacctggcggacgggtcagggagccccgaaagcccgcgattcgtgcggagagttctgtttcggcaggagacggctccgtcctggtttccttttcccgctcagcgtccgtgcgttcctcccccagctctgccgtcctggccagccgagggattcggaggctcttttgaaaagattgcttttccctcgtgcgtttttgccgccctgtctttaaacacctaaaaaccgtggtttctggggtggctccccccgaggggccgccgtgataggcgtcccacccggcagccctggagtcgtgtggcgctgcctggcagagatgctgaagatgcggccataggaggcccagggcttggggtggggcaggggtttgcgccgccagccagcgttggtgctgggcctggtgaaacctcaggtgccttaggatcccagcattaggtgtggccttgcaaagatggtcatcgaccccacccaaactctggcagagtgagccgcaaggctgtggaatctttgaccccttggcacgcgtttaagtgtccctcaaactggccctgacttgatcccctccaagcgcttgtgtatgaaccaagtttccctctaagagggaaggagccctggccatcctccctcactccttacaaagggctttctctccccacagcctttgggaacagaagaagccatggtcagtcaccctgtctctggccccaggccctgcacaaactgagtttccaggcctgcctgagacttcatttgtgtgacctgcgcctcagctcagcatatgctgaggccagagcgggtccccagtccacctagcgagggacaggggagaagcccttgcctttctatcttttctgagtgttaggactttggggtcccagtgctgcagggggaagacacggggcagaagcaaacaaggcgctctgacgctgtcttgggattctgggctgtggctttggctttgaggttgtgggcagggggccaggtgtgaactgctgctggtgtgctgggcagaggacttccccacacccttccacagccttgcgttcagttggggtggccagtgaggctgtgggggccaggctctgggggccggcttgtggcactcagcaggcatgcaggtagctttccgtgcccagacccctggcccacagacagcttcccgaatccagagatggtgagcccctagcccctgggataacccggacaccacagttggaggcactgggagtgaagaggcagccccactccctggagtagacagctggggcctttgaagaggctgcagagctctttcccaggagccacagctccggaggttcgagccgcactcttggagctgccaaggaccgccccagtgagcccctcggtgctccccaaccaccccaaggggacagctcggcctcaagcgccctcttgcggacgctgcactttagtggctgggcctgatgacaggcacagactgggtctctagaggatgagggttcttccacagctcacacatgcacactcacactggatcaccaagacacactcctgccccttctcacagcacttgctgccaaggctgtggacatgcacagcgtggttccttcacaccctgcctcacccacgtccacacagggaccccagcccctctcatcactcatacacacagggacgccacgtgtgtatatagggacacacactcctcatacctgcagggcatagcctgtcagccccaggtatgctggaaccagagtgagagaacctccatctaaaagttacattcatttaaaagttgctcttaaaggtttctggcatttcattgctcaacacagatacagctgtccccgttgcttggatgaggaaactgagtctcagcttctggggttccccccaggtcccaggctgaccctgcacctcaacctcccacagctcctcagcaagcctcttgtctcttgtcttcctggcctgacttcttgggtcctgttttgcagcaaggaaggacattccctctctgcccctgggccccggggccttctgttcccagcatggaagagctgggcactgtgacttggcagggcccggatccaagctgccagaccaccctctgcagagggcctaggcagcccacccctgcctgaagcaccaggtatcagcgcgggcagctcaggccaggggtacagctccccctgcttcatccttttccttctcccctttctctggccagaggcttcaccaggttcacctgggcctggcttgcttcctcctccactccagctcactaaccctgtctggcctccagaagctgcctgcagccctcactggtgggctgtgcctgctgggggcctgcaagcagagagcaaatggggaagtgcattgagctgattcactaaattgcctttcttctgcagaatcactttagggacaggctgaggaaatcactgtttccttggtggtgtgaagaaaatgggatgcgatcacctagcggggagctaatagccttttagccagtggaggagaaaaccaattaaaaattatgatatctgttaaaatggaacctggggtgccaaggggaagggaaggcccggaagctgccatctcccctgagaccttccccctctgcagcctggccgaagaccctctaggtcccctcgtcttaactggataaggctaataccagcagtagcaccccatgggggctcacagtgcactgcccctgtgctgtgcctactcacttcatcttttccaacaagtctgcaagggtcatggtcttggcccatttcacaggtgaggaaacaggttctcatagcctatggactcgaaccggtagagaggatgcgggagctccccagccctggccctctggcttgctccagcccgttctctgggccagtggtgtgggtccagggtggggctaaggagggcttccagggaggttgccctgagcctgcccacccactggtgagtccccccacctcgggctccaggtgccctcaggacatcccagcccagatcccagagtaatgtgtggcaccatgcacagacgctgagatactctctgggtctcgtcagctttagttgatgtctgggagtcctatgggtctggggaggagcaccaggcatggctgtgccagcagaagggccgactgtgtgtgctctgtggatggcaggaaggcatcttgctgccagtggcggtgcagatgttcggctgggacaccaggctgtggcccttgcagccaacatatgcctgaggccctggcatcggatggaagctactgctctgaagacaagggtgcagggatggggtttgggcatcagggatgggggtacagctgtgtttcctcatgcaggacagggccttcctcctcatttttcccatcctccaggacagcctgggagaagaaagccagggaataggggcaaagcagggtgcagccccccatgctccctgctgccctcctcccctcctgcagaggcacttcctttccacttcaggagcccctcccccagaagtgggccccccccatccccccttccttctttggaggctgcttcctggtgccaggttatgctccctccccgttctctgctgtgccctctatctccccactcctctgcaattatttttcagcagagtgacttaatagtaacaataacagtaacaataatagtaacaacagcaggctgggagcactcctgagggagcctcggctcctgccctgctgctctagggctggggactctccagagctgtctcatggcagggagagaccgtagtcaaggagaccctgtgtagggacttccgcatgcgtgtgtggcaaggggcggggactgggcagtgaccaccaggcagggagcacacctcagtcatggtcacagagaaggtgatgatggcaccagggctgtctctccgtgcccgtctgcacctgggcctgccagagccgtcttctgtgccccatggggtaggggagcaccccatggcccctgggaggctgccagtcagtgggactatgaggtcaaatggggaggtcccttggggtccatgacccaggcactgcaccccttggggctggaaggggagaaggccccaggcccaccagagcccctctggctcccccactagaacagcagccagggccggctcagggattgaggcgaagccttggtgcttgattctttgtcccctgaggcaggctgtacctctcataggagaactttggaggacgggccttctcctgaccaaggctctgggacacttggcagcccctgaggtcctgctttacctctctgctttctccccccttctctgagctctggggccaggcctgggcacttggattggcgctgagacaatgaggcctgaacctccatggagctctggtcccgcagctgtgtgatcatgggggcctcagggaccccgctcccctccattccccaagcctagaggccatgaagcctgtgggtccctgaactgtccaccctgagactgcaggcagggcagggctgggcaagagcaggcagcaagctgtccttgttcccacagctcctcctggctgggctcttggcccctgaaaagcctggggcagggagatggtgccagcaggaccttaaggacagcagttcaggtcgcacctggccctggagggagcaggtggccagctccaagcaaacacctctgtttgcttttgcctcaaggagtggctccacaaagtgtagcagcccaggcaccaccacagaaaggtcaccgctgcacctggacaggtgtgcgcctacctggtggaccagcgggcataggctttcctccctgatatcagggatacctggagggcctggtgctggggctctgtgctcaggggagaacctgtggccctacagccccaggttctagaccccctcccagattcgggtgctgcagctgcgcttccactcctggcccttgctcctctgtgctgctgctctccatgccctgcaggagccagggttccaaggaagcacctgaggggcagtgtggccccagggcaggagcaggacagtggccaccaagctgtttccagttcccttgtgtgcctgtgactccagaggattctcgcccttgtgttcctgagagggaaaaaggaaacatgtatttcctagaatttaagtaatgactggggagatgtgtgctctgggtgccgggacgagggtgggtgagctggaggtgcagcatgagctggtgcagttctggagggagggagagggctcattgggtttcttcctcatactacttggcagtgcaactggcacagacccggcagctgttgctgggctaggggccaggggcttcctcttgctctgttccccttcctgctccaccaccattgcctgtagggcgtctgccagccccaggaagcctaacacttagcccaagtggggctctgggcctggccctcctcacccagggaaacaacggggctcatgggcgcttggtgacatgggcacattgctctgccatcgtaaggggccagcctggctatgggacccagcaccggtgggcagcccacaggttgtctctgcaggagactcctctggcaggtcacatacaggatgccccacagcaccttgaaaactcgtgacccgggaaagcctcaaattgtctttgctcccctagcctccccaccacctgtatatgcaggggcatgtgagactgtacttggtgacaggaatgccccccagtctcaggggcttaacgccatctactatgtccttcttgtggcatagcctggcatggcccttacccactgggtggccacacctcccagcccttgtgcctggctatgtgcacaggagggcacagagcttcaagaagcctgaggcttaaggagctttgaggcctgggagggggccaccgtcactttccctgtgttccgtgggatcctgtcacatggtcgttctcaccccaggaggcttcaagtacagaggacgcggggatgggggcacgcaggggtgtacctgcacacacttctgcctaccagctctccatcccttgtcctggtccacatagcaggggctcctggcgggcccagcagctgagggggacagagggggaaacagggtagcaaataattatggtttactcttttttaattgtgaaatttgtgtaacataagtttaaccatttataagtgaaccatttggtggcatttagcacatttacagcattgaacaggcattgccttagttccaaaaaatttgcatcaccccaaaaggaaaccccatacccattaaacagctgcttcctgtccccgggcaacccccagcctgcgttctgtctctgcggcttggcctgtcctggaacatttcatctgcatggactgttgtctggcttcactcagcataaggtcttcagggttcctctaggctgtggcacacatcagccccttcctgtgaggggtaaatagtgtgccgtcacccattcatctggggatggacacgtgggtgctttccaccttttggcagttatgaaaaatgctgccagggacattcctgttataaatacctgagttcgtgctttcagttcttttgggtacatacctggacatgaaatcgctaggtaattctgttttatattttgtggagccgccaaactgttttccacagtggttgaattgtgttacattcccaagggttacaatctatccacattctcaccaccacgcattattctctgttattctctggttcatgtctcactctggccgtgcagccagtgcacagtgctagctcgttgtggctttggtttgcctttccccggtgatggcgtgctgggcatcttttcctgtgcatgctggccagttgcatgtctctttggagaagcatctcttcgagccctctgcctgttgtctaactagatggctgtcttgccatacagctgactttgctgttgcatctgcatcaagagctgcagagaagcagctttatccagggccgtcactgtcagtgattgagccccaggtcccttgtgaggagagtgtggattcgtctgattcctcacatgggcattgaatcaccactgccctcgaggaccttgaggacattctcggaagacctggactctgaggccacgttgagcaccaacatctggaaaccatggtgtcactgcttgtgcataagaaggggcctctcaggaaccgccctgtgaaggatggaggaaggggaaggtgcaaggagccagcagacccccaccccactgacaagacgagactcagcagcaggggaaccagggccgccctctctcgctcatcctgaaccctgactctaaaaataaccaggctgataatcggatccgctgtaagttgattatcatcattgccgtggtgtgatgtcatgctgccaggccctggggcagttttctcaggacagcggtggatgcacctaggcagctctggaggccagcatggagctggggggccctgaaccgagggtggcaggcagcctctgtgggctcctgcaaatctgcttggtgggggtggaacactggcatccataggcaggcactctgtgctcccaaggaggagttcctgtccccattcgcagctagggacagagccagggaagccaagtgcccagccctggcaaacagcggggaagcacaggggcatgggctgggccgctctgccctgcgtttctgctccttcctgctgctgaactctctcctttctgctgctgaactctctcctttggactaggcctttgtcttcttgcctcatcgtcagtggcctgggaggacacttgcagtcttaatcctgttttggccccatgtccctcaccccccaggggccacctaggccagagcctgtcctgatttccatctcggccaccgtctgcccctcggcccctggtcaggagctcattctgtggatactcctgcatagacatcacgtggactcaaagggcatgaggacctcggctgagaggagcttacacatcagtgcaaacctctcattttacacagggagaaatcgaggccctgagggaggcgtgagttgtcacacatgggggtagtgtcagatgaagacttggcaccacttccctgggcatccccttccctgcatggcatccccagccttgggtttggattcttcttcacccttgatgttgaggtctttgctcccaggacctggataacagcatccagatgcaggtggtgcccccgcatcgggctgcctggctgtgacctggggcatcaggattgtcagcttgtctggccccaggtctgtgctgggctgaaacctactgtctcagaggctcctggctctctccctctgctctccactgctcttaagagcagaccctcaagccttttttgtgtcctctctccagggagagcccagcttctactctgcagcccaatgcagaaggggtggtagctcacggtgcctcggcttctctgcatgcctgtcactgaacagagaagcccaggccagactgcagcttaattcctagcctctgtgtggcctccagcagggtacctaagctagtgctgcctcattttcctcctgtgtgagatgggaatcctcatggtccctacctctgacagttgttttgatgcagtgggtgatgcagatgaagcgcccggagcagacctgctcatgaggagcacaccgtggattcctactggttaatgttgaacagggatgagaaggggctggggtagggcgaaaatgggcaagaccatctcagcttgaggaacatgagctgacagattgacttaaatttgcacatggacatgatctgagtcactgccttgctgagtgcatggggacagttgcccaggccagaggcaccagggtcaaagccagtggtgatgccctggccccgttgccccaggccagggccagtgaacaatgtaatcagctggggcagactctacagccctgcagccaagggggccagtgacccttacatggtcatccacaggccacttgggtggccagtcctgttcagccaggccttgccctaggaaagaaattaattataacctaattggcagtttcctttgcatagaagccggaagcaactgccagtgaggctggtgattaactctgcagcagctgggaaattgcagttgggcaggagcgcccatcatcctggccaggccgctgcagctggtctgggtatggaagtgtgggtggtggccatcgtgcagcttagggcctgggcccctcagagcagaaggctgggtctgtgtgcagaaggtagccttgggctgccaggtcccccagtgcccagttgcggacctccttctcccaaacctcagccatgcctggaccccttccccactcacggcagaaggctgcatggcttttaggggtgtcaggaggctcatgtcctggttgcagttctaccatgggtgtgcagcgggaattctgggcttctgttttctggcatgggatggggtgaatgatatctctgttctacagcaggggctcagactggatgtgtgagaagagcctcagttaaggagggccatgttcgtgcgtgcagggatcgtggtgcctcccaggccagggccgggccccatctctcctcctcctcagctgctcttccagctactggccaccctgcctggctggaggtccaagaggagaggtatctgaggagatcctgcactccacaccgggtctcctgcccagcattttggaagaaccaattcttaagtctggtactgaggccgcactgccatgatgataactggtgtcaccaggacaccagggaaggagctgcccttggtgtttactgagcgcccggtatatgcactgagctgtccatcatctgcagagaccagtgttttcttgatggttttacagagagatgcttaaacccagtgaactaagaatgggacaggctgtcagatttttctcaaaggaggtattgacttgttagcgggtacaattaggccgaggaaccaggggctgatgcagtgtgctcccgaagaggggcttctatggactccagttaccagagcctgccccaggattttccttcacacctgctctttatgccagggatcaagcagggttataaatacaacagcgggcaggatgagccagtggtggccctgtgggtcttcacagcccaaatttccttccatggttagtgtaggttaaacctggcaaaaagctgctttcatttggaagtctcaggatgccagcaaagtgatgagagtggtagggatagaggtgagatgggggtggtgctggtgatagtgatggtcatggtgttggtgttggtgttggtagtggtggtattggtgatggtgatagtggaggtcgtgatgatggttgtggtggaggtgatggtaatgttgatggtggaagtcatgatagtgagtggtggttgtggtggtggtggtggtgatggtgaagacggtggtggtggacgtgatagggatattgatggtggagctcataatggtgaaggtggtgatggtggtggaggcagttgtggtggtgatggtgctggtggaggcaacggtgatggtggtggtgatggtgaagacggtggtgggaatggtggtggtggaggcaatggtggtggtgatggtggtggtggaggccatggtattagtgaaggtgatggtgaaggtggtggtggaggtcatgatggtgaaggtggggatggtggtggtagaggcagtggttgtgatggtggtgatggaggcggtggtgttagtggaggtgatggtgatggtggtggtggaagtcatgatggtgaaggtggggatggtggtggtggaggcagtggtagtagtggaggtgatggtgctggtggtagtggtgaggcagtggcggggaaggtggaggtaatggtagtggtagaggtgacggtgatgttgatggtcgtgatgcagccatcttctgtgagcatttgcttggtgccagccactgatctgtgaacttcatgtgcattaattccttctagctcccaacactcctgtgtggtgggagctctgagtctcagtgggtacagaggagaaactgagatacaaatatatgtcccttgctccaggctcattaccactgcaacacacactttctctccatcacccagatggagtccacagccttgcctggaatccacaagcttgcccaaccttcttcttcttcctaagttcatgccctcatggcccgaggagctggcctcctgtctccaaccagcattcacctccggccctgtgctgttgctgctcatctgaactgcctctacctcctgctgcttttcccctcctttcactctggctctgcccccagccctcccgtcctgccgggcactggctcctgcttgtggctgcagcccagagcagtcccttccctttagcctccacttgcctgtctgtggctgtctcttggtcaggcattttttcagaacgggcagcgtggggcagcccccttggcccctcagcctgggctaggcactctcctccatccagtgctgggccctttaaacaggtcaggcagcgtccgctcagcagaagcgtgtgatgacttccccagccggctgacctcagggagggtgcacatgggtgcccccagtcagctctcctgacgtccctgccggggtcaggtgtcccagggtctccagccttagggtctaacacattcatctctccaaaagtaaggattccttgccagggaaagggctaacaagctgcctgttttcttggccagcaggcatcctccccatgagcccagggctatgggtgaccagcaagccattagcatatgcgtgtccatctgtcctgcctggctggtgggctgccaggatagccgttccttttgctgcccaaggaagtactcaggacccagttactgtcacctctcccaaggcgtgcaggtggcgtaggaagtgcatgtccgttctttctgtaggacacacctcaggaccccaggggacattgtcaagaggcagaaccagggtgctcctgctgtgtaccagggccgacagcattgtgtcggggagcccgcccccacatgcaaggacacaccacacacagggaggcgtggagcacatgtggcctgtcccacctgctaacaggccggccatcggggccctcctctggctcataggcagggcatctggaggaagccgtccctgccaagagcaggttgagtgtatgggcactgtctgtcagcctcatactcttgttatcatcagacaagaaccctgagagttaagggaggcaaaggccagcaaggtcaggacttggggcagagatcggggctgggacaggagcttgttcaggacagtgggcaggactcccacaggtggagaggacagggatggccatgcacctgggagccctgggccaggctgagcgagcgagcaccagggcccggagtgaggggctgatggcaggggcatgcaggcagctgcacataccaggctctgtgtatgaaagggaaactggacatgtgtgagtaggcccaggcctggcaaatggctcagagagacacctgtgaacagctgtgtttggtggctgccctgggcaggggtgaggctgagagcccactgaacctcctgagtcagaggtgatgagagccacccccaggtgcagggaagacacagggaatttaggaagagagcaggacgccaggcagggtgcacttaatcgtcacttggaaaccagtgtccagtagtggctgcccgggagcctcttgggttggcactgggctcgtgtgaggaggaggcgtggcaaagggaagggctctgtgacagaaggcagttgagactgggccgcttctgggcgctgcctcctctgctgaggcctcagatgggtccctgccttgctcagggctgtgtgctccatgctaagccttgtcctcctgggggctcaggcacaaccaggtgactctcaagccagggccacatgcgtgcaccatgggcccctcccacatccaaaagcaaaattatattctgcaactgtgttggtataagacaaacacaatccaggccactttattattatttatttcttattatatttatttcatccttttgattttaaaatgaattaaaacaaaaaccttttttgcgcacccaggcgcatgcagcagtggtgccggtcaggagcagaggttcctcctctgcaggctcctggccccctgggaccctggcaccgagggctggccctagcggcccagcccttgtgagccctcacacctgcctagagatggcgcgctccctagccagtcagggcgctctcgtgcctggatgctgtggtctcatgagtggacagcagctgaagtgggaactgcagcagatactggccgtgcccaggtgtgtacctgccccaggcaggtgaccagggcagcagggtgatgccagatggggccaaaaatttcatgcttctgtttgaccttggttctagctgaagatttagctgtgtacacatctttaaaactgggatccccctataaaaaccagatgcacaggcagccgaagaaagaatggatgaattgggctacatcaaaatgtaaaacttctgtgaaccaaggccacaatcagaagagtgaaaacacagcccatggaatgggagaaaaacttgtaattcatagatctgatcagtgttaatccagaatctgtagagaactcctcacactcaacaacagcaacaaaaaaacctgattccaaaatgagcacagggggccaggtgcggtggctcactcctgtaatcctagcacttggggaggctcacgcaggcagatcacttgaggtcaggagttcgaaagcagcctagccaacatggtgaaaccttgtctctactaaaaatacaaaaaaattagccaggcgtggtggcaggtggctgtaatcccagctacttgggaggctgaggcaggagaatcgcttgaactcaggagacagaggttgcagttagccgagatcgtgccactgcactccagcctgggtgacagagtgagactccatacaaaaaaaaaaaaaaacccaacaacaacaacaaaaaaaatgagcacagggcctggatggacatttctccgaataagatttacagatggccccaagaagcacatgaaaagattctcagcattgccactcattagagaaatacaaatcaaaatcaccatgtgataccatctcacacccatttggatgtctactatcaaaaaaaaaaaaaaaaaaaaagaaccagtgttggtaaggatgtgaagaaactgaacccttgcgcactgctggaaggtaaatagtgtagctgctgtggagaacagcaggaaggctcctcaaaggttaaacctagagctgacttcggctccagcacctccactctggatacatacaggaaaggaagcaggaagcagtcaggatatatttgtatgtccccattttcagcagcattattcatagtaaccacaaagaggaagttacccaagtgtccattgaccaatgaatggataagcaaaatataatacagacatacaatggaatattacttggctttaaaaaggaaaaaaaatttgccacatcctatgccatggttgaacctcgagggcattatgtcacagaaggacaagcactgtatgattccacttacatgaggtccctgcagtcgtcaaattcgtggagacagtagaatggaggattccaggaactgggagaggagaggagggggagtaattgtctcatgggtacagaatttcagttttacaggataaaaagagtgctgtggaaggatggtttgcatggcagtgtgaatgcacttaatgccactgaattgtacacttaaaaattttaagatgataaagttcatgtgtattttaccacaatttaaaataactttttaaaactagaatctctctttatatacacctccaaatttgttatttacagtagagcctcccttgatccgtgttttttccctaaatgcaaagttagattatagtcccaggcaaaagcagcctccagctgggacagagccgaggacccaggtttgtgcagcatgctgcaggtggtcctacccgagtgagtctggctggcagctccggtgcccagggctcctcaggcactgatagatcatttcctgagctgaaaaggagtggttttgtcctcagcctcaggcttgtttgctcagcacagtggctggccccacaaggttgctggtgcactagtgggcactgcacgtgtgcacagggcgcatccacacagctctatcctgccactgacagcctgcccgtggctccagtgcccgtgagaccatgtcacagtatctccccgtcctcttactcccttccccttcccaaattctgaccatttcccaaatgtgcccagccctttcacactcctgtttatgaaaccattgtactggctcgttgattcattgattcattcattggttcataaatttattcattcagctcacagaaagtgagttggcagatgtggcaggaaggtaggcaccctgtaagagtgaggaggaagtgagttggagggcagagggggccctgggagccctgatgaggagctatgttttattctgcaagcagcggacagttaacacagggctccacagagggtgccatgattcagtggaccctggctcctctgtgcgagattgcctgtcctgcccagcatgtggtccagggttggacaggggtggcagaggggacttgggaggtggggtgaggggtgaaagagaaagggatctggggactgaggtgtgtgacctgagcagtgaggtggggccataccgtgatgagatggggaagagttggggacaatttggggtgaggaggggccaaactgaggcaaaggagtagagagagcaaggcatggagatgcccaggctgctgatcagcatgctgcacaccagcatagagacaggattaacagcccagggcctggatatggctggtgagtgagccactgccaccatctggaggacagggtgcagaggaggaaaccagccgagggggtgagcagcctcggtagcatcccagcgacgctggacagcaccaaagacagaggaggtcctgggagcagctgggagaaagtgggttacccaggaggggccggcctgagcatgggccctcagcagcagcagtgaggctgaaagacgggagccagaccttatgtagagtggaggaaaatagctgtccacatggaattctccacccagcaaaaatgggccttccatgaatgacgtcaaaaaatgaggcaagaagaaggccaggcgcaggctcctgctggtgggggtgggacacagtggcaggtggggaggcgggaggagcagcagtgtggccaagcatccagttcagcagggccacgggctccagggtgtttgttcagcataaatgttctgtgaaatgtattcgttgtacatgtcaaatatttgactatagtaagagaaaacgtgagtgggaagtgggagggaagcggtgggggggtgggggtggggtaacaggtcacatcctgagaggataacagtgctcagcatggggctggagggacccccatagggacagctggcctggggaggcggggaccgcctctttccacccccagcccccagggaggagccctggggcctgtttcccattcccaggaagatgattgcattaggaaatcgtctcttaaggagattctgctgggccataataaagctgtcatctgcatcgtctgccacccatcaagggcaggcgtggggctggtgtcgcatgaggggttctgcaggaagggcctgctctacacacatgccctacgctgcttctaattcatgcagtttttggatcatatcgttgttattgttttcttttttggaagtcccaaatttcggcccttgtgctgccatcctagggaagtttttcatggtctggagctccatttgtgtttctgtggcagggtcaccatgccatggcaagggtgacctcacagtgccccatcagagctgccgggtggtcggcagtgggggagtgagagaccaagggccacagccaggagccagtggagagctggtgagcccctgcctccacagacagggccaggccacgcttagtatgtgtgcaccgagggtgcaggaaaatgtgtgtgcttgtgtgtgaaagcgggtatataccagtatgagcaaatacatgtgcttgttagagccctattggcagtgtgagaatgtgtgagcatatgggagaacaagtgtataacagtgtgtgcccccgtggtgtgtaatggtatgcgtctgagagaatgagtgtgtgtgagagaaggaatgcatgtgtgcaatgtgtccgcctgagtctgaccaggagacagccccacgtggtccctgagacaggagcagtaacatcagaggcactaagctgtgatgaaagagggatgaatgggggtggggagagctctgtggggcaccctcagctgcaggtgggcaccagggaaggaaccccttcccagctggggtcagagcctgagggaggagctggatgctaggctggggctgctgtgcaggctcaggtctggcaggaactatccttagggcacgggagctgaggctgggggctgcaggaagctgatggctaggctcaggtatgggctgcatcagtgccgagggattgcatgctttgggtatgtgctagggtggagcacatagcacaccctgtctcgtggactgcccgggcagcaggacctagaaaaggcaggtgtaacaaccggagacaggagcaacccctggcctgtcccagcatctctccaaagccctccaccgatgaagcttggccttgtgctgcctgcaaagtaacctgctccaggcccgcctgggcatgagaacatgcacacctggacggagtgtgtggattgacaaggtgtgtgcacgcgcacatgtgggacgagggggctcaggactggtcccctctgcatccaaagatgaataatttaaacagcccagccacgtgtggaacattggaaacagtctagcacttcactctgtcaaacactagggcagactctttcctgctgagctgggcagggtgggagcagatggggtcttaggtgggcatgcctccatctctttttctgtctcctgcatgccctgtgcgtgcatacatatacacacactcatgacacacactacataggccttgaaggtttctgaggtctctctgaatgtgagcagcaacttgggtctttggcaagtgtgctgtgagcaagcaggaccttcccccaccccatcctgcatggtgcctgggcacagccagcctgaggaaccagaaccacggtggcgggggtcattgagggttgatgtgggaatcctcttagtttctcagacaagcgacactgccatttgcaccgtcggtgggtgtggtgtgtgccaggccaccgctgtgctgcagaagtacagggtgggcccagccctggcaaccaaagctgtccaggcagacacctgtgtgctaggtttgagggaggattctgtcaccacgtggcatttgggctttgaaggcatggggtgggaaaagctttgtaagtcctgctggtgaccttcccatggtgccaggagtgggagtgtctgtcaccagacgtgggtctcgacccacgggcctggccttggtccacaggccaggcggcccttctaggcagaaaggcggcagcaggatgggaagccaaccagcagggcactgggcctcctggcaggctcagcacctgctggcgcctggcttccaccatcactttcttagctgttatcctaacccccgagacacaaagcctcacagcatgtccagctatttcacttggtcaggcttctcgccacccagccttgctgttcttatatgtgaaatgggcagtgaagggatctgcacccagtggctgagtctgcagtgagagcctcatgatgatacacccctgtgcagaggtgcacgcctggctgcacctgcactggccgttcctcctctccttagcatgcctcccccacttcgaagctggggaaactgaggcccagaggaggccagtgttctgcagagtctgcacagtccggtggttcctgatgccagcagctgttccccagctctcccctgtggctgacccaccacgattggctgcatcatttgtgggccccttgatctagaattatgaagaatttcaagactgtagcaaagagcattaaaccaagcgtgagacctctgagcagggcccactgggactgcccaggctgcagtccgctgaggcaggtcctgcacccacctccttcattctcccaccttggaccatgtgtttttccatctagaagtgtctgtgacaagcgggaaccttaagacagctgtgcccagctgcagagaccacctgggaggcattttaagtgcatttaagtctgtttctgctcgcaatcattgcctgacccacaaatcccttttggcagcagggagaccaattgggattgggccccccacgatcctgtaggggtgggctctgccagatgggagcaggaaggcccgttctcccctgcacatgtgggctttgtggtgggggctttgggaagcccaggcctgtcctacctctagtccctggaccactaaaggtgcttgcacatcatggaggccccagaggagcacctgtgggattcccagactggatctgctcctgcgacagatggggtgccagggccctacccactcttctgcagcctgggcatcaccagagccaccccacggccacccaagggcaaatggttcttattgggaagaccagggccagaggtgtgtgtcccagagaaaactagacccagctgagctgcattgcctctccccacctgagctcagccaacccctagcatcctctctggggtaagaacatggaccccactgcctgcatggatagcccagacataggatgccacatgggattgggagggggctcatcggggccagggcatctggaccctcctcgccctgtgaggccactatgagttacaatctctcaccctctgtcgccagaaatgcagcaccccctcccaccccgagggcactgtcatgggagcagtgttcctgatgtacagtgagcacttcaagagaagctttctcctgttctattttcccactgtgggactccagacgtctcacctgttctcttccaggctccccttggcacttgattgtttcccccaggtgtgtcctggaggagcccagcggccctgggggcgttctcaactgctgctgcaggccccgccctccagacccctcagcgacctcaagcagcaaccgtctgggtgggagcaaactgatcaaaaagagagatcgattacatacaagtgcagtattcctaatgtgtcctttggatgttggtattgtttgggcattctagagtctatttgcaggttcttaatggattttaagcattttttgcctatttatccatctttttaaaaattcatacgattttttattgtggaaaaatatacacaaaaatgatttacaatgtaactatttttaagtatacatttcagggacattaagtacattcacattgttgtacagccatcaccacctccgtccctgaacttttcatcttcccaaacttaaactctgtccctatcaaacactaactccccatcctgtctcccccaagccctagcaatcaccatcctatgttgtgtctgtgaatttgactactctagggatctcacataagtggaatcgtgcagtgttcatccttttgcaatgggcttatttcacttagcataatgtgctcaagggttatcagtgttatagcctgtgtcaggattttcctcctttttttttttttttttttgagacaggtcttgttctgttgtccaggctggagtgcaatggcacaatctcggctcactacaacctccgcctcgtgggttcaagccattctcctggcttagcctctcaagtagctgagattataggcgcccgccttcatgcccagctaatttttgtatttttagtagagacggggtttcaccatgttggctaggctgatcttaaactcccgaccttaagtgatctgcccacctaggcctccgaaagtattaggattacaggcgtgagccactgcgcccggccagatttccctcctttctaagactgaatattccattgtatgtatagaccatgttttgttcatccattcatccattgatggccactgaggttgcttccaccttttgtctatcgtgaatagtgctgttgtgaacatgggtgtgtaaatatctatttgagacttggctttcaattcttttgcgtatgtacccagaagtgggattggtagatcatatggtaattcaatttttaagtttttgggaactaccttcttgtttttcatgataactgtatattattttccattttcaccgacaatgtacatgagttccaaaaactattttaaaagctttccactgtgggaaatgttggccacacacagtcagcagcatagtgcaccgtgcccctgcttgggctcactcagccacagccgaggctagcatcctgccttcttcaaggaagctacgcctctgtccacagcgccttcagtgattcatttttcagttatttaggtaaaaattacatagataggccgggcacggtggctcatacctgtaatcccagcactttgggaggcagaggcgggcggatcgccggaggttgagagttcgagaccagcctgaccaacatggagaaaccccatctctactaagaaaatacaaaattagctgggcatggtggtgcatgcctgtaatcccagctactggggaggctgaggcaggagaatcgcttgaacccgggaggtggaagttgtggtgagccaagattgcaccattgcattccagcctaggcaacaagagcaaaactccatctcaaaaataaataaataaataaataaataaataaataaataaataaataaaaattacatagataagatgcacggaccttagctgcacaatactgacaaacgaatatgcccacgtgatctgcacccttctcaggatatgggaccttcacattccccagaaagtgccctgtggcccttcccaatctgtccacctcccccacacccccgcctgccacaggcagccagtctgatccattgcctaacatccgtccagaatcatgccatgtgcgctcttctctgcctggcttcctcaccttggcatggtttgtgtgtgtgacccatccaggtgtttgcgtgtatccatagttcatccttttccattgctgggcaggattctgtggcatggctggaccacggtgtgcctgtccatccacctgctgaagggcctctaggctcttgacttctgtgaatcatccttccatttccaactatggcatttgatagacgtatgttttcacttttcttggatgaatggagtggaattgcagggtcatatggtaggcgtatgtttagataaagatttatgactttcctgtaaagtgctttcttcattttttggcaactgttgcctgccccacatgggtggcagtgtctcctgcccttgaacactctggctctgggtgacctgttgagaagtctgtatggttcaggtgcccttccggcttggatgattgagaataggcttgtcactgaggatactgcttcccctgtttccttttctttttctgttttaaagcagttcttttctagcccgtgtgtaactatacaaataattgagtgttcatgttctcaggaacagagatgaaaaactcctgctaagatcggaattttaaattaatgattttttttttttttgtccttgaagaagccttattctcaccatccctcactcacttccctacttcccacagtggcattgggcctctacttctcgagggatgcttactgggagaagctgtatgtggaccaggcagccggcacgcccttgctgtacgtccatgccctgcgggacgcccctgaggaggtgcccagcttccgcctgggccagcatctctacggcacgtaccgcacacggctgcatgagaacaactggatctgcatccaggaggacaccggcctcctctaccttaaccggagcctggaccatagctcctgggagaagctcagtgtccgcagtaagggagccgccccaacacccaccccgtgccccaccccaccccttcctcaagccgcccttatcacagccgctgacactgaagcttggcatggcttcccccccaccgctggtgtggaaggcgtcaggggttaagtgaggctggcctgcctctgtgtccagcctggagagaagccaggacaagcttcagggctgcgtgaggctgtaggagtttggagacacacgggaatcatccgggtacactcttctgccagacccgaatccctcttccagtggggctaaaaaggattaggaggtttcgagagagggagtaagtggggctggaaaaatcccaaggttttgatttagcaaatgacctgcaactctctggagaagcggcagttcccaaggaaagcctgacttcttatcagcagctggctgcccttgtacctggcagggacttgggcctgtcccaggtgtccagggaggaaagaggagcagtcagagccagagtcacggccacatgtgacattggtaatgggaggggtgggggggaagcagagcccctgtgacaggaaacggtgatgctgcacctggtagctcccatccctagcacccctccagggccacagcttgcacagccctcacaaccaccctgagccctgtctgctggtgagaggcaagcctcaggctatgaatgcagagcaggcatccctgccctacccaggcctatctgccagggacagccagggtgcaggggagggaggagacttgggtgggcaactccctccggcgcagcccaggcagttcctggaggaggcagcatctgaggttggtcgtggttctacgcacttagttgctgccctcttcatcctgagcctccagggtggagcttgaggaatgggagtccctgggtgggggccagtgtggaatttgccctgggcctgcatttcgtaggaggcctaagccctccaaggtggggagaggcttcatgcacagccagttcctgtggaggaagaaaccacagggtaatttaacagggagagtttgtgtaaagaattaattacaacaggggattggagcaatgagggacaggctagcaaaaagcaaagagaatgccagagaatatgggaagagcagctctgaggagcagccgcccacctagggctgagatggaggctgggaaagccctcgcagcccagctgaaatggctatggcgcttcggtgatggaacttgccggaaatgccccctctaggcattggggaagtatgtctgcggccactccaaacctcctgaggagggtgtggcagggggggtgctggtcaccccttactggagaagttgccaccatcagagttggggagccttagacccagtgctcaacacacctccctgaggaaggggcctctaagccaagaactgaatgatgagagctaggcctgtggggcattggtgctgggcagcagggctgtgcagcagaggtaaggaggtggcaggcagagctggaacaccagtctgagccttgtggaccttggtggggaccagggtttacaccagccctggagctcctgcctcctccccattcccgactgcctggcagatgtggccgatgcccccacagacctgacttctctctgcagaccgcggctttcccctgctcaccgtctacctcaaggtcttcctgtcacccacatcccttcgtgagggcgagtgccagtggccaggctgtgcccgcgtatacttctccttcttcaacacctcctttccagcctgcagctccctcaagccccgggagctctgcttcccagagacaaggccctccttccgcattcgggagaaccgacccccaggcaccttccaccagttccgcctgctgcctgtgcagttcttgtgccccaacatcagcgtggcctacaggctcctggagggtgagtgccgaccttgtggggccgccccacagtgcctgctactgctggtcttgctctgcgagcccttgacacaagccatctggtttattcttcaccttcatgccatcagttcattcaatattccagaagtacctcttgcatgcctgccaggggccaggtactgttctaggagctaaggatataacaatgaacacaacgggttggaatcttgcctgcctgcagctttcattcttgtggggcagacagagcgtctgagcatgccaaggaaatcaggtggcttctggaaggagctagctggggaggaaactgggaagagggaaacgctgaagaggaggggaacagacgaggagacctccattcctctatcgtaaattgggtggtcagggtgggggctagcagagcaaaggtgggagggtgccgggtaggcaggcctagccccttggagggcaccacagtgtgaccctcgtgtgcctggagtgcactgagcgacagggaagagctgaggctgatggggcagaatagttcctggggcagggggcaggtctgggagtggcttgcagggctttctccggaggaacatggggagctatggaagactttggagggagggagtgctggcaggacctgacttagttttaaaaggattagtcagactactgtgttaggaatggtttggggtgggaaggttcaggggcgaagctgggagacaatcagaaggctacaggagaaacctctgaacaggaggatgtggggtgtgatgccgggatacgggtggaagccgaggcatggcgagaagcaggcagctgcagccagtcagagggtgggatgagctggatcccagtggagaggggagaaggcagctgactaggtgcagggaggccccatttgaccatcagaaagtcaggaagtggggctcaaccaggtcacagaggctgcaccgctggcaagtgtgtcctaaattcacactaactttatcacacaaacatggcaagaatattaaaatctcagtaaaggaagacaagccatcacttatgcttccccagattcctttcattctctggggcagggttgatggagcacttggttttttgcatgctgccctttttcactaaaaattatgtgattaaatttagtttagtggggggttttttgtaatcacactcaacagaggaaagcattatatgataagcatttcccacatacgtaattcatgcgcaaggcatggttctgcctgggaggcttgtggagttgcccccgcctccttggggtgggttgtggggtcttcagcggtgaccttccgccttcagcatgcccccttttctggattatttctggaggacaaatccgaggtcaggctcgttgaagactgtgttgtggttcctggccctgcttcaggggcgatgtagtctagcgcgagctgccatgcagggcacggagcattcgcttttgtctcgacatccggccttcagaggatgaccagcctggcgacgcactggacaaggaggtgtagagtggggatgcacactaggcggtcggaaatcattatgcgttaatgtcacatcataccccagatgtccactgtgtttgttttcaagtggtagaatcgtggctttctcacgttctctaaaatgaacacatattgcttccataattgaaaaaaaaaaaaacctaacagtttttaaaaagcagccaaggtcaccaatatggtgaaaggccgtccctactaaaaatacaaaaattagccgggcatggtggcgggcgcctgtagtcccagctactcgggaggctgaggcaggagaatcgcctgaacccgggagttggaggttgcagtgagccaagatcgcgccactgcactccagcctgggcaacacagcgagactccatcaaaaacaaaaaaaaagcagccaaggccagtagctggctctctagggctgcagtgcagcttgggctgaggcaaagccacccttccccacacaaggccactcctgatcaaggccaggtgggcggaggggtgtcccagtccctactggttgatcagggtgcctggtcctggctcttcccaaccagcacgagtgaggacgcagctgcagcaggacgtaagcacagtcatcgctgcaaactgcaaactcgtaagcacagtcatcgctgcaaactgcaaactcgtgctccgagcgctgccctcccctgtggagcggaggaggggaggcctggggccgcggcggtgtgcgccccgctctgaccgcagagcccccttcccgaggaaagcggctggcccggtcccggctggtgatcacgcggggcccctgtctgcttggtgcgcaggtgagggtctgcccttccgctgcgccccggacagcctggaggtgagcacgcgctgggccctggaccgcgagcagcgggagaagtacgagctggtggccgtgtgcaccgtgcacgccggcgcgcgcgaggaggtggtgatggtgcccttcccggtgaccgtgtacgacgaggacgactcggcgcccaccttccccgcgggcgtcgacaccgccagcgccgtggtggagttcaagcggaaggaggtgcttgtccgcgcgtgctgtggtctacccagtgtctgtctccggccacagttcgtttctcggtcggtttagtgtccgtgtagccacccaaccgtgtggccgaccattcgcgctttcatttgtccttcgcctccgtctgcgccgtctgtcctagggggaggggaagggggagtcctgccagcacccagctgggccttgcctcgggaggcaaggaccaggacgaggcccgagggctcgcgtctggggcatacttgtgccgctgcaggcgggcgcggcgcgctgcccgggcggggagcatctgccgggagggcactccctcccaccagcagttagcccccaacgggagggcccttgagtgaccacgagcagagccggggattggagaaggacgggaaggcggatcacctccggcgccgcccgccccgcccttctccggctcgcgctggtggagcgcgaccgccacctgctgggcctcggccttcctgcagccggcccacccagcaggggccgtgggagagtgggcgtggggactgaggtaggtagtacgttgccttgttccgcttctctgggcacaccacgtgcaggtttggcagggaaagggggtctggtcgaaagcacaatttgtgagtaaaggctatgtgggcctccctggggtgacagcagaggcctggtgggcagagccatccaggtgcccagcggctttcctcacaaccccctccagcctggggtaggaggatgcttggaacagagcgctctgatgtacacctggcctcggagctcggctctgccggctgttcctgtgtgaccttgacctgaccttcaccctgtggggcccagcttcctcaggggagagtggaggtgctcatcctgctctctggggacctggatgggacctgccagcagggtgcctgggcatcggctgtaattctccttataagaggtctgcattgtacctgttacacaggcgaggctcagtggctcagggaaggtgacggccaggctggccagtgaccccgtgggaacttgaacccaggtcagactgtccccagacctggctctgacaacacacatctggtccacctatgggctgtgtgggacgtgcagcattctaaggtctctggttttggggggtctgaggggcccatctcgcctgcactgaccaacgccctctgcatcctgcaggacaccgtggtggccacgctgcgtgtcttcgatgcagacgtggtacctgcatcaggggagctggtgaggcggtacacaagcacgctgctccccggggacacctgggcccagcagaccttccgggtggaacactggcccaacgagacctcggtccaggccaacggcagcttcgtgcgggcgaccgtacatgactatagtaagaggggctggtggcacggcctggctaggcccccaggaaatgaggtgctcgctcttcatgggcaagcagcaccctacacacatgcacacctggcatggccctctgtggcccaagccacttcccctccaccctctgcccagcacttcctgtgtctctgccaggcctgccctccagccaccagcagggctttcaccatgggacctctctccctgagctgatccatggccgaccctggcagggccccaccacacccccctgctgacctcaccagggctcaccaccgactgcaaacacacatgtcacctgaggctttcctccagcccctggcactccatcgttgcccctaaggcgtcccaagtgcttacggattattgctccagcctcagcagctctctgctaaacaggctggtgtacagaagcagccccgagccaggtcagggcttctgagcccattatcctgcctgactgctgacatgccaccatgctcacctgcttgcagggcacctttcagcagcggccttgcttcctgcctccctccgccacctcctgcagatttctcctgggatcgccttccaaataaaccacctgcatttggggtctgtgtctggtggaaccccaggccatgagtccttcacccctttctgcctggcctggtcctgttcattcctcagtcctccccacctcaccaagcctatggaggccccacttgtcagaggggagacagcctccttgccctggcactgaacaccctgtgtgccagagtgcccctcccatcattgtttccaccacatgagatccacagtggcagcacgcggcaggtacaccgatggcatgacttccagggcttggcctgcggggtcattgggtctgctggaggttcctgcagtggagggtagttctgccatgctctgggggagctgtctggagggctctagtgtgtccttcccagggccttggtaatgtagacctttaaccccccatgcctcacacacacacacacacacacacacacacacacacacacacaccctgttacccaaaaaacgaaactctgtaaaacattttaaagaggtttattctgagccaggatgagtgaccacagcctggagaaaacacaaacccaagaagccttgagtaagtggtccccaggtccaaggtggtggagttacagtttgcttttatacattttagggagacaggagttacaagcaaggacataaatcaacacacagaaggtatacattggtttggccccaaaatgcagggtatcttaaaacaggggcttacaggttagaggtagatgcagagattctttaatttacagttggttgaaagagttaagctttgcctaaagacttcaggtcagtacaaaggaatgttaaggaggcctgctatgtgtcgcctgatgctatacagggtcaggagggaaagtaaaccacgttatacctgggtaacttaaaaaaaaaaggtttttaacaagattttatggaccaggcatagtggctcacgcctgtaatcccagcactttagggagaccgaggcgggtggattgtttgagtccaggagttcgagaccagcctaggcaacatggtgaaaccctgtctctacaaaaaaaaaaaaaatacaaaaaattagccaggcgtggtggcacatgcctggattccaggaacctgggaggctgaggtgggaggatggctggagcctgggaggtcaaggctgcaatgagatgcaacagagcaagactctgtctcaaaaaagaaaaccaatgttatggtttgtagggtgtttcttaacccttgcctggcatggccttaggtcctgtttataatttggtatcttactgccacaaagagtccgatctgtcagtcttatgatctctgttttaatgttaatgccggtcagttgtgtccaaactccagcaggaagagggcctaataaggcaagtccaccctgccttcctgtcatggcccagaattctgtttttaaggtttttctggtgtcccttggccaagaggggatctattcagttggtccggggactcaagattttagtttcagtttacaactctatacacaaacaccccatacacacaggcaccaataccctatgcacagacaccacacaaatgcatactacacacttacacataccacacacacgcataccatgcaagcatatcatacacacagacaccccatacaatgcgtacacatgcacacacacacaggctgcctcaaattgagaagggttccttggactttcagttcagtaaatcccaacgtttgaacattggtgctaacttaggaccagccccaggcctgttgcatggcactgtatgtgtgaaagtgcgtgtttgcaccagtgtgagtgcagggctgtgtctgggaagaggtgtgctacacatgaggaagcagccagagcagcttggtggtcattgttgtgcccctacctgcagggctggttctcaaccggaacctctccatctcggagaaccgcaccatgcagctggcggtgctggtcaatgactcagacttccagggcccaggagcgggcgtcctcttgctccacttcaacgtgtcggtgctgccggtcagcctgcacctgcccagtacctactccctctccgtgagcaggagggctcgccgatttgcccaggtgagcccatacctattgcctgtctggggaagattgaaaggccaagggacatgggggcacagggaggcaggtgacactgcctcttggcccaaccagcacagagtagactgggtggagtcctgagcccagggccaggaggtacagctgtgtgcacagaagaggcctgggagagctcacagtgggcagggctgggggctccttgggcctctctttttttcccctttccattcttggtatctttaaaatgtattttcaaaaatgcaagagcaatactgggtaaatctgcatatggtgactcggaagaatcttcctggtggattggtgagagtggcttgcagagatgttggtcccacgtgactccctttgtgcaaaagcagatcttccctgacagggatctgcaagtgtgcagagatcacagtgctgtccacagtggtgccctcagggggaggcaggaaacgcttccactttttactttttgtaactaggtttgctagaaagcgtatatttatatttgtctttggaaaataatgattagaaatagaaggcataaaagtaataaatattcattaaagaagatgaggcatgaggcatgaggcgtgatcccttctacccataggcgccagtgttgcacatcgtggtgttctttctgggatgtttctcgtaagcacttattaagttgacttgaaactgcagcacgcatgttctcgcatgccgctctcccttgcagagcagcccgtggcgcctcctcttcaggggccatctgccagttctttcgggtggttctgtgcccgcatcagctcctggcagccacccgtgtccagcccacgagggagcccacccttggacatatctaagctccccgaccacctccttggcctttaatgggagtgggatcagagacagaggggcgacaagacagagggccccggggggtctcatggggggcggggcaagagcaggcattgctgaagttgggtcacctgccctctgtcaggagcaacgggggcctgaatcccagtccagcctcagcctcactgtggtctcacctttctccccagtttgtaaagctgtgaattagggacaggaaccctgaacaattttgagagtcacatgagcatttggaagtgggctttgtaggggaaagtgaggaggcccaggaggctggtttttgctgtggtcacttgtgggcctgggagagcccagccctgctctggcccgcccccatctcgccatctgtggaacttttggtttcaagcagctgcaagagttgccaagaggttgaaagaattcagctgcctgactccaggtcctggcatccccaggagaggcccctctttcccaggggctctggtcaaagtcccagagcctggcatccccaggagaagaggctcctctttcccagaggctctgctcaaagtcccagggaggccccctggtcctgcatgggctggggcaaccatgctcccgagtcttgtggctggggttcagtgctctgaccaggggacaccagggcagggtggacctctaaaccctgtgcactgagggaggagtgaggggtccccagagcactgctggggcagctgggagcagccagggaggagcctgggagacattccggcggctttgttgtctgagtgagggaggaaaggggagtaaagggttgagtcagggcctgcctggggcttttcctgccaccaaactgaacctcgaggccctgggttgccttgacctccagctcccaggaacaggggcagctggtaacatgtggcctgagtggaacggggcagggcagggctggggcaggtgggtgggtatgaaggctctgaggggtggaggacagggtgctcgggggggctgctgtctccaggcccagttgggggctgttccaggacttaggctgtgtgggaatctctaccctcaggccattacaggccggtccagctgcctggctaaggtgttcccctgtgcccccctagatcgggaaagtctgtgtggaaaactgccaggcattcagtggcatcaacgtccagtacaagctgcattcctctggtgccaactgcagcacgctaggggtggtcacctcagccgaggacacctcggggatcctgtttgtgaatgacaccaaggccctgcggcggcccaagtgtgccgaacttcactacatggtggtggccaccgaccagcagacctctaggcaggcccaggcccagctgcttgtaacagtggaggggtcatgtgagtgcctgctccagggagggagggtcggggtcctgggggcttctggagcctgggcctcctgccctttgagaaaagcagtacagctgcaaggcttagctggggagtggggaaggcatggaccagcttcaccctgagtgacccagcagtaaatggttgctccttccagataacatacaggaccttgggtaaatttgaattttgggtaaacaacaagcagttttttggtataggtgtgttccatgcaacttttgcagcttctcgaaagacacacctctaggtccatccatgccctcttaggaacatgctgacacagctgccattcatgccattcattgtgtatctgaaatgtaggtcccacagggcgtcgttggctgaatctggctgcactcacatccttcctcctgtacttaccccagcccaggtgacccctgctttgtgaccatgatgtcctgtaccctgccctgcgccctgtgctcctggcactgtctttgctgccctgggtctgtcactccggtccccttgggctccatccgtgggcagctcagctggtgctgttccctgtccttgggcactagctggacgctgggcccaggccagccccctgtgaccctgcttgtctgccacctgcagatgtggccgaggaggcgggctgccccctgtcctgtgcagtcagcaagagacggctggagtgtgaggagtgtggcggcctgggctccccaacaggcaggtgtgagtggaggcaaggagatggcaaaggtaagccctggaaacgcccaagggaggcctgcaggggcgatggcaccggtggaaacggggtcctggggccctgccagcctggggtggctctccctgctccaggtctgcttctggcacctcatcccccatgtggctctcgatgccagcatagcgggcagcagtgcagggcttgggagagggcttgtgagtacagtgaatggtccccaggccggattcactctggacttgggaaggtctgaaccaaagttgggatgtgctggggacagaatggcgtttttctgggaggtcctcggccaggggatgtggtgtgggcaggggactcattgtctgcatcagccagaggccagcctgggtgtgcccaccaccatgaggggccctcaccatgcagccctgagagggtcccggcctctttgctgtaagggccacctgtgtgaggaaccccccatacctcctctcccataagccatggctccccaggatgcttccgctggcaaggctctgtatatggtgtttccctactcaggcctccagttgctcctccctagaggggcaggatctgcctaggaggtggtgggggcgtgtggcggggctcccacatgggtgacagcctgctgtgtgtcctgtgcagggatcaccaggaacttctccacctgctctcccagcaccaagacctgccccgacggccactgcgatgttgtggagacccaagacatcaacatttgccctcaggactgcctccgtaagcagggtttaatcagggcatgggaacaggtaggagatagtaggggaaacctggatcccacaggcacttcagccagagttgccagggctgtcagttctatgcatcaagctgagcctcctgtgcatttcagcatcaccctagccatggggagggagcaggcagggtcagggacagggggaaggcagggacccacagactgtccaggcccctgctgaggtcccagaagtcggcacacacagatttcagaagcagagaatggtcagtagggacactgacagggaaagtgcggccctgagccagacgagggacactgcaatgtgcgggtcaggccaccaggctccagttttggaggcagagtcctttgttcagatgaaatgttaggagggggcctggcttcacccatggcttcagaaaggcactgtgaccaagccctgcccggctaagccaagctgctgggcccctggcctcactgggcctatgcttgcgacaccagttggggagggggctccttgggacactgccctggaaatatgggcgcctggggtggtcaggcgccccaggaggctgagtgggctacgtctgccctcagggggcagcattgttgggggacacgagcctggggagccccgggggattaaagctggctatggcacctgcaactgcttccctgaggaggagaagtgcttctgcgagcccgaagacatccagggtgagtgggtggcggccgggaccaccaccacctcccagccccacagaggtctcaacagcacatctgaggtcccaacaagggaggaaattgctgggaggcgagtgggccccatgaaacttccctccctccctctgggcctctgttactccacccaggagaggggccagggcccctgtaaagtgtcttctggccataagttctatgatggacaggccagaaaagcagttcttccaccaaacaacttgtcagcctgacaagtcactgtccctgtgaccatgcagctgggacccacccaggaacacatttcaaggtcagcaggtatggtgggttgcacagccacactgactacactcaggggtgctgttctgcctgagcatagggacacgtttctgtcattgagttttctggtattatatagccctacgtccctagccacttagcattttcataaagaaaatgccaaagacatttggaacagaggaaaattttgacctcccctgccagccctccagtgccagctggtgtaatgagcacagcctctgctgtgtgaccttggcaggctgctcagcctctctgagcctctgtctccatctgtaagagggcaatagtggtctaggagggggcagtaaatggcagtacccatgctcgatggggtgttctcaggccttcccacacctccatggccacttcccagctggcgcggacacggcaggctggagagccatgaggcagagcatacgcagcctgtacccagtggtgccgagcctctggcggtgccaagcctcacaccacccccacccacagatccactgtgcgacgagctgtgccgcacggtgatcgcagccgctgtcctcttctccttcatcgtctcggtgctgctgtctgccttctgcatccactgctaccacaagtttgcccacaagccacccatctcctcagctgagatgaccttccggaggcccgcccaggccttcccggtcagctactcctcttccggtgcccgccggccctcgctggactccatggagaaccaggtctccgtggatgccttcaagatcctggtgagggtccctgcggggcagggaagatcccctgccctccccagctgccttccagggagggaggccagctggggagacagaggccatcctgtgaggggctgccaacgctgggcagacgaggcctgtgttctgcccccatttccatagggcgctgtgtggggacagtctgtggggtgggactgtgatgaggtgccgttcccatctaggtgagaggcagtggtcagggtcacagcatcgggcaggggagcagcagtgtggatggaggggcactgaagtcagaagggggtgcctttctggggagcctggcctgcaggtctgcatgtgctactcagagcctccaggctgtgccgagtatcctggagcctccttgtcccggccaggcaggcctctgccctctcctggtggtggcctgccccttcagtgttcctactagcactgtccagggcgctggaagccaagcccagttctggaagtaacagaggctcagagccaagggtgtgagtgaacggtgagccacgcagcttatggtggcgtgaatagctcctcggcaggagcctccagggaggaagctgagcacccagtggccacagggccctggcagttcccatctcaggctgggaggtggcctgggattcctgggaggggccatatcccacagtgcagctcagcctgaggcctcggccctggagcctccgttcaggcaacacccagccctcggtaagggtgtgagccaaggaggccttcccagatgtggccactgccgcttccccaccagctttcctaattggtggtccccatcctggcctggctgcagcttagcctcatggcagggctctaggatgagccaccagagtccttcataaacccagtgggtttgtgtgaggctgcccaggaaggccgcactggtctgggctgctgctggcagagaccaccaccctaaccccagtcagctccagagtcacactcatcagcaccaggtcttggacccatgactcaacctcagtatttgagaggatcaggttgatgtcgccctcatgtgcttattgcagtctctagagtgtggtaaacaggtttccagtgccagctgtggaggtgacagcggcagggaagccatggcagtgtcgacactgaccttgactgtgggttcccagggaatgtggggccagaccaggacagcccaggagcaggagacctggggtgacggatgcccagagctggcacatcaagggagggttcctggatcatggcaggctttggcctccctggtcagagttcaagtactgggggccagggtgggggtctgggaaggcatccggagcagtcccaagtgggcccaatgtgtggatagaactttggtgggagggcagggtggtagtgccagcaggcagggtgagcgggtgcgtgagggccagtggcagcccttgaggagcagtgcttccacactctgaggcggaacatggtggcgcctttctttgcaggggtggctatgtagagaagttgtcctggacacttccactgtagtcagaggtcctgggctgggcctggtgctcatttagtcctggggcaggggtcaggggagacagtagaccaggaaccagagagggtcgaagtactgagtccaagccatgctgtgaccacacctgtcatgtagcagctttcaggggcctggctgtggggtcctgcccagggcagagacaggcagcgttgccgctggctcagatgacagccggttctctgcacattggaacttgtccatggggcctcctttaagggtcttgccttcttcctcccctgtcatcctcacacttttcccccctcttctcccccttccctcatttccaacataggaggatccaaagtgggaattccctcggaagaacttggttcttggaaaaactctaggagaaggcgaatttggaaaagtggtcaaggcaacggccttccatctgaaaggcagagcagggtacaccacggtggccgtgaagatgctgaaaggtacctgccaggcacaggcacagtgcccctgggggagtctccggggcggggggcgggtgaggcccctcctgcccagcatgggaccctgaagagcccccaatgctgttctagagcggctgcagttgggggacccctaccatgggccacttgggcctagagaagcagagcgaggactttgctctccctggaaggctctagaggtgttgctgtgccagtgccactgaagatctaagctttaaacatttaaaaagccctttgattttgagctgacagctgtcttcactccagtctgccccattcattcctctcagcccagtgtctcctggggtcttggtgaagagaccaccagtaaggactggccctcaatctcaagagacccccatgggcctgtctggcctgcatgcccagtcatgccacaagtttggctctcgatgggcacatgcacctacccacacaggcatgcgactgcactgagtagccccctcttctgtggccaggccccagccctgtgaacagccaggctgaatggcggtgagggagagtggttggtgtacataacaattatctgcagtagtcgggggctgcacagcacagggtgcttccagatgcctacccagccccagactgggttcacctccaagccagtaaaaccccggactctccaggggcacagggagacccttggatttccattgcagccatgcacagccccaggctgcccacacctggtccaaggggtcctggggccccaactcccaactgtcctctcccttccagacaacctttcaggacagaggaggtggcacggcacagctgggcagtgggacagctgacctgggagggatggcttagccatgtgttctgactcttggaataccttcaggcccaggcacctgctgggcattccagcacagctctggccaccatcgggacgcatgtgctgggcaggtgatccctgtggtgcctcgtcctgtttccatcatgcctctacagttagactctctggggaatcatgctattcattaagaataagccagaatgtcaggtgtgcagtgcactggtaacactgctttatctcaggtgctaatgtgggtcttcttggtaactaacggagtgtgagctgctgacgtgtgtgtgacggatacatcagcagcacaggagatgcctgggctccaggctggccatctcagacaggagcgggaaatggggagcctggtcgcggtgtgtggacctcctttatggctctccaccttctccagggcctctcccgacaagtgggtgtgtgggtacccctcacctttccagaatgattaatgcggggaatttctgtggacgactgtcttctaaagacaatgactacaggaacataatgccacatacacaggtggcccagccctgggacactctggggaaagatccggcatgtgtggttgctggctcctcagggtgcttcttcctcagggtggatgaggcccctgtccactgatcccaaaggctgggagaagcctcaagcagcatcgtctttgcaggcctctctgtctgaacttgggcaaggcgatgcaggtccatcctgacctggtatggtcatggaaggggcttccaggagcgatcgtttgcaacctgctctgtgctgcatttcagagaacgcctccccgagtgagctgcgagacctgctgtcagagttcaacgtcctgaagcaggtcaaccacccacatgtcatcaaattgtatggggcctgcagccaggatggtaaggccagctgcagggtgaggtgggcagccactgcacccaggctgggggctccatacagccctgttctccctctttctccctttccctactgctcctgccctgtttcctgttctccctctttctggaagcctggctcaggccccagcctggagcttgtgtctagctgagtccacgggctgagtggtcactttccatcagaggggccccgcgctagcggcactccctgggcccacagggctactcagaggtctctggtgtgacactgccatgtgtcctcacccagttcggggctgggcccgtggggcagggagctctaggaatggacagtgcatcctgggtactagggtaccctgggtaccacagggcaccaggtgtgctgtgacctcaggtgaccccagccccgccctgcatggcaggaacattgtcaccatttctcagataaagacccaggagaccagcctggtttgttggttttccaaaccaccatgctgctcaggggcttcccagcatgcgtgtgtgggtgtgtgcgagagggatagggaacccaaacaccgggagtgcgcagcaggcactgtggtcggcaccagtagagttggaggctgggcctgggacaggacaggtgggaacagggagcaggctgtgtgcagagcccagcgccaggcaggaacccttgcatctgcgcaggcctctgcctccatcagcatccccagcctgcactggggcaggacccaggaggcaaaaaggcttggcgtcctagcatcagggaggggtgcctcccagggcagtgtcgcctgcctcaggcacctcgagaaggaggcacccacacgagcagcaggaggcagagagcaagtggttcaagagaaagctgaggcttcaaggtctgcgctctccacagagctgcagcagtgctgcctgaggcagggctgtgtccacccccttactcattgggtggccgggcctggggaccctgcggcctcccacccctggctcctggaagacccaagctgcctgacccgcacgcccagggccccctctctccgcccccaggcccgctcctcctcatcgtggagtacgccaaatacggctccctgcggggcttcctccgcgagagccgcaaagtggggcctggctacctgggcagtggaggcagccgcaactccagctccctggaccacccggatgagcgggccctcaccatgggcgacctcatctcatttgcctggcagatctcacaggggatgcagtatctggccgagatgaaggtgcgtgcatatggctctgcacccagccagccccggccaggccacaccctgacccaccacgcccctgccacccacaccctggcctgccactcccccaccatgccacactctagcccaccatgcccctgccatggcatgccatgctatggctcaccacgcccctgccatgtcacaccctgactccaccacgcccctgccatgccacacccccggcccaggtctcaccaggccgctacccgggccacacaccacccctctgctggtcacaccaggctgagccagtgaccgctgctgcctggccatggcctgacgactcgtgctatttttcctcacagctcgttcatcgggacttggcagccagaaacatcctggtagctgaggggcggaagatgaagatttcggatttcggcttgtcccgagatgtttatgaagaggattcctacgtgaagaggagccaggtgcccagtcccggggatgaggcggggctcccagggatcccaggtgcaccatggggcaggcagtgcccttgggaagcctaggaaagataccgaagattagtggagctctaagctttttatagccctcaccccaaatctttctgaccctgggtccccaaggacccaattagaactccgctcagcctctgccatgtccttctcctccagggcctccagggcacccctccctggcagcatactgacccgaggcccttgccgcacttttcagaggccacctcatgctgcggaactaacagtcctcttctgcagaataaaggtcaccgttctgatatgaccttagctcttttctcaaagaagggtgggatgaaattagcaggatcgtcattctttgcaaaaaggaatgaactgctttacaagtgaggcttctcccgcacaggggccttggacactgggctgggtgagtttagaggcataggaaccccctggacaggatccagaaacgcagcccagctttgtccaagtctatgaaacaggcagtgggcacccttggggacacctggttccctaccatggtcctagtcccgggacaactgccttggccctcttagtttttctgcccatgtcagcccctctcctgcagcctcccagtggcagcccaggcagggcaagttcaaggggctgctcaaaggccatgccgcccagacgttcagagcagaccctgctcaaaaaagaagaagaagaaaaaaaaaaaccacaaaaggcgacttcctatgattcagctttgctctgaggggtctggagaagccatttgtgttgccaggggttgtgagctgttccgtttcttctggggtttcccttgtgacagcagatctcagaactgctgtggggggaagtggtaggggctggcccctgccctgtggagggtgtggacagagccttcctgttgatgcactggtcctccagggagagaagctgaaggcattcttatacaagacgtgcaggctacactgtcacacactgctgccaagacagccacactgcactaaggacataaatccctcatgtgtttaagtaaaagaagtgacagtaagattgtgttccaacccaaggcacacattttaaaaatggacttgcaccttcaggcttgtctgtggagaagctgtttctcaagtcaccctggaaaggatttgttaggtcagaccccagcactgatgagggatgtagggggctgggggcactcattcagagatgctaaaagcaccctgcaatacaataagagagaaaaaacagcctcccccaaggcacacagacaaatcccttccctcaaggctccttcagtgtggtagctgctggcaaagtgcccaacatggaaatgctagatgttggtttcccaaacacattggccctcagaaccccaggggagatcttgcagggggagttccaggcccatgcatagggaagcactgctctgcactaccagcaggcctgtggcatgtgacaagctggccctgtgtgcctgtgggtgggcagctgactcccgccagcatctcagcaatccacaggaggttcaggctggagctccagccccttcaaagatgtgtgtggccagttctgtgcccaggagtgtctacagcactcctctggttactgaaagctcagggatagggcctggccttctcctttacccctccttcctagagagttagagtaacttcaatgtctttattccatcttctctttagggtcggattccagttaaatggatggcaattgaatccctttttgatcatatctacaccacgcaaagtgatgtgtaagtgtgggtgttgctctcttggggtggaggttacagaaacacccttatacatgtagtggggccacgacgcccgtctgtgcagcttggccagggaattgcactggccctgagcacctgtctgcagtgctagccctctgcaatgaccccctcactgaggggccttcatgatgtgttcgtgaggcaaatggctgggccaggccgggctgcagttctgaaagctccggtagagcatgagagccgagcaggtggccagtaacccagcctcccccacccttgctagtcccatgcctccctctgggtcccttggtgactcaggcccagcccagcagttaccctcctgtggtcctgagtagggctttgggctcaggcagagcacccagtgacttgcccccacccacaagtggagcttggggactccacctgaagatggccttgtgtgagtttatagattggtgtgccccaaactgctcaaaggtggaagccaaaatctcattcttccaggtccaatgacaagagctgatcacttttaaaacacaggattcttgcctctaaagtgttctacagtcagcagaggtgtgatgtgcctctctttttttgtggggggaggggatagggtctcactctgtcacccaggttggagtgcagtggcgcaatcctggctcactgcaacctccacctcctgggttcaagcgattcctgtgcctcagcctcctgagtagctgggattacaggcacgtgctacttcgcctggctcatttttttgtattttttggtagggacagggtttcaccatgttggtcacactggtcttgaatcctgacctcaaatgatccacccacctcagcctcccaaagtgctgggattacaggcgagagccaccacgcctggccaacatgtgcatcttaaatactgtgggctgtgaataagcaattggacaacagctttccgattatataagctgactgtaggctagttggaaaaggcagagaaaagcataaagaagagactgaatgtcattggaccacaccgcccagtgacctctggctgccctctggtgtgctccgtggtgtgcacatgtatgctttttattgccctaaatgggctcatgcgatgctgttttgtgatatgattttgttcccattgcaaagcgagttttccttcacagttaaaatgtttttctatagctttttttccttctaagattttatgaaattttccaagcacatagaaatggcaaaagaactatacaaggcactctgagtctggtggcctgcattctcaccgctttaagtgtgagaatcttaagaattattaagattaattcatgatattaattaatgtatcattaattcattaatcatgaattcatcttaagcctcatgtgtcccttgtgcgtgtggctgctctgatgggagtggcttgggcaaggacttcagcttcatggagtaggggccaggcaggcaggcagcccttccccaccttcatgctacatccatctgagcagccagacccaggctgacatctgtgagcatctgtgcttgaagccgacagggtcagcaggtgcttggtggtgggggtggatatctgggccccccggagggctctgtgagggccaggtggagccactcactggtcctttcactctctgcagatggtcttttggtgtcctgctgtgggagatcgtgaccctagggggaaacccctatcctgggattcctcctgagcggctcttcaaccttctgaagaccggccaccggatggagaggccagacaactgcagcgaggagatgtgagcggggactggctttggcccagcctcacttgggaagggaggggacatctgtgtgcattccctccccatccagagcagccccaggagaaaccaggagaagtggggggtggggagtgggcagggcagaggttagagagccatccttgggtgtggcagtagatgctgggggtcctaccccactgagggctggtgggcttcctagggggtcttataaaaatgagtgagagcagagactggtgcaatgcaagctcaagggctgagagctgtcccagcaggacacttagggaggagaaggtaattccagatggcccagggggcacgtgttaaggggtgcctgagtggaggtgcagagccaggcaggggcagcctgggctgcaacctgagaggttgaaacctttacactctcaggggagatggtcttagaaaccaggctgagaacagatgagaaagggctgcccagaggcagagatgcatggtacatgcattccacagagtgtgcacactgctggggcgtggagggggcatgctgggccgagaagccaggtaccacctccctgggcccccagctggtggccagctggagcgctgtggtctgcctgggcacccaggcaagcaaggacggtgcaggacagacgtgtgattgccaaaggttcttgtttgtctgtctccacacctaaaagccctcaatcaattcattcttcttgagagttttaaggactggcacttctcacttagctgccagagcaagcatagtatccagtgagctgtttaccagtgtctttgcaagggaagtaaaaatgaatctcccttggagggaagggaagcttgtaggattctggaccacagctctgagagacctgagcacagtggcccacgggctgggatcctgcaacaggccatgccccagtcccacgaggctcagagatgtcagcgatgcagaaatagctttggagttggagacagagcacactgggcccagggtacagggcagggtgcgatggctgtggtgggctgtccttctgagacctggccctgcttggatcatattggcctgtctgctcttcccaccaggtaccgcctgatgctgcaatgctggaagcaggagccggacaaaaggccggtgtttgcggacatcagcaaagacctggagaagatgatggttaagaggagagtgagtgcctgggtccaattcccacaagctgaaagtggcttggggagactccagcctcaccccagggcagtagttttagccctcagagttcccagtgtggggccacagtgggattgtgcagagagagagagtcatgctctcccctgcatgcagacagcagattgaacccttctcaggccaggccgcttgggcttcttttcaagtcatgaagaaaccaagattcttgacatttaggaaaagctctctacagacaggcatgggaggaaaatattccaaagccaaaaagaaatagttttccataatggaaaatgagaaagttgagttaaagcaagtgcccaaaattcagatgcccagaggggggtccggctggaggagggcagtgagtaaggagcagtggagactgtggcaaacagccagccccctccaaagggttccttgctggagtacctgtggcctgcagaaaaaggagccaggaatgggctgggtcttctgaattttatgaggtttatgttgtctcccagtttttattgttaacaattcatttaaatttcccagagccgaacgcaggccaaacaaagcatatcggggggtggccagagtcagcctgtgtgcctggaagtacagtttgtgaggtctacacattttcaaccaatattcatcaggcagctgctaggacccatactatgtctcagaggctgggaatgcagataaacaagaccagcacagccctgccctcacggggtttacacacaggccttgtcttaacattggcacatttactgagttgtcacttcttccgacttggatagcgggatgcaggacctaggaccccataggaaaacttcacatcactgtctcgcttggatgaaaacttcaagtcctgagaatgcagcgttgttcaaaacagaagcgatcactggtgctggccttcctagaacagtgctgagaaacagccgggaaaacgctgggcccctctgtgcacattcaagctgggcattgaaaggagcagacgccagtggcccctcgtgctggggagcccgtgcctgtagcagggtcctgtgcaccctgacagcgctgtcagatttcagaactcagccctgacgtgacgttctagatggcaggggtccttggggaaagctggaaaacatcctgcaggctggggctgcgtcctggcatgtggctgcagtgggctcccccagagcccaagggtttgtcagcgggctggttccgtgctgcccatctccgggttgggccaggggcagctagatgaggcgtcccccaaggctgccctccaggccctggagataagacgctgagggagcacatttctttccccagggaggtgactttccaggggaagagacagaatagacaacacccaggggagtgatggggacctcagagcaggaccaggccagccaggagtcctgggagctctatgcagcctggccctggtctcttggagaggtcaggagattggtgcgaggtggagacacagccagagcctctgccctgaggatggcttgttgtatactgagttgtatctagttgtggcacatggcttggagtgaccggccatctctgtcttccaggactacttggaccttgcggcgtccactccatctgactccctgatttatgacgacggcctctcagaggaggagacaccgctggtggactgtaataatgcccccctccctcgagccctcccttccacatggattgaaaacaaactctatggtagaatttcccatgcatttactagattctagcaccgctgtcccctttgcactatccttcctctctgtgatgctttttaaaaatgtttctggtctgaacaaaaccaaagtctgctctgaacctttttatttgtaaatgtctgactttgcatccagtttacatttaggcattattgcaactatgtttttctaaaaggatgtgaaaataagtgtaattaccacattgcccagcaacttaggatggtagaggaaaaaacagatcagggcggaactctcaggggagaccaagaacaggttgaataaggcgcttctggggtgggaatcaagtcatagtacttctactttaactaagtggataaatatacaaatctggggaggtattcagttgagaaaggagccaccagcaccactcagcctgcactgggagcacagccaggttcccccagacccctcctgggcaggcaggtgcctctcagaggccacccggcactggcgagcagccactggccaagcctcagccccagtcccagccacatgtcctccatcaggggtagcgaggttgcaggagctggctggccctgggaggacgcacccccactgctgttttcacatcctttcccttacccaccttcaggacggttgtcacttatgaagtcagtgctaaagctggagcagttgctttttgaaagaacatggtctgtggtgctgtggtcttacaatggacagtaaatatggttcttgccaaaactccttcttttgtctttgattaaatactagaaattt

SEQ ID NO: 1560 - DNA, 53282 bp, Homo sapiens
cagtcccgcgaccgaagcagggcgcgcagcagcgctgagtgccccggaacgtgcgtcgcgcccccagtgtccgtcgcgtccgccgcgccccgggcggggatggggcggccagactgagcgccgcacccgccatccagacccgccggccctagccgcagtccctccagccgtggccccagcgcgcacgggcgatggcgaaggcgacgtccggtgccgcggggctgcgtctgctgttgctgctgctgctgccgctgctaggcaaaggtgagttctgccggccgccggctcccgcaggggccagggcgaagttggcgccgagcagcggagcgggcgcgttcagaagcgcctttctgtttgccgtgggcagcgggctgtgcggtcgccggccacccggcctcggctgggagcgcagtggctgcggcgggcggcgggcgaagggcaggacgcctcgggccgggcgcctcgggccggggctgggcgggtctcgggcgggagcggagcgcgggccgggccgcgggggtcggtgctcagaaccctagccatagccgcaggtctcaatctggccgcgccctgcgccaaagccgcgtcctggagcaaacgggacagccgtttcggggccgacctggcggacgggtcagggagccccgaaagcccgcgattcgtgcggagagttctgtttcggcaggagacggctccgtcctggtttccttttcccgctcagcgtccgtgcgttcctcccccagctctgccgtcctggccagccgagggattcggaggctcttttgaaaagattgcttttccctcgtgcgtttttgccgccctgtctttaaacacctaaaaaccgtggtttctggggtggctccccccgaggggccgccgtgataggcgtcccacccggcagccctggagtcgtgtggcgctgcctggcagagatgctgaagatgcggccataggaggcccagggcttggggtggggcaggggtttgcgccgccagccagcgttggtgctgggcctggtgaaacctcaggtgccttaggatcccagcattaggtgtggccttgcaaagatggtcatcgaccccacccaaactctggcagagtgagccgcaaggctgtggaatctttgaccccttggcacgcgtttaagtgtccctcaaactggccctgacttgatcccctccaagcgcttgtgtatgaaccaagtttccctctaagagggaaggagccctggccatcctccctcactccttacaaagggctttctctccccacagcctttgggaacagaagaagccatggtcagtcaccctgtctctggccccaggccctgcacaaactgagtttccaggcctgcctgagacttcatttgtgtgacctgcgcctcagctcagcatatgctgaggccagagcgggtccccagtccacctagcgagggacaggggagaagcccttgcctttctatcttttctgagtgttaggactttggggtcccagtgctgcagggggaagacacggggcagaagcaaacaaggcgctctgacgctgtcttgggattctgggctgtggctttggctttgaggttgtgggcagggggccaggtgtgaactgctgctggtgtgctgggcagaggacttccccacacccttccacagccttgcgttcagttggggtggccagtgaggctgtgggggccaggctctgggggccggcttgtggcactcagcaggcatgcaggtagctttccgtgcccagacccctggcccacagacagcttcccgaatccagagatggtgagcccctagcccctgggataacccggacaccacagttggaggcactgggagtgaagaggcagccccactccctggagtagacagctggggcctttgaagaggctgcagagctctttcccaggagccacagctccggaggttcgagccgcactcttggagctgccaaggaccgccccagtgagcccctcggtgctccccaaccaccccaaggggacagctcggcctcaagcgccctcttgcggacgctgcactttagtggctgggcctgatgacaggcacagactgggtctctagaggatgagggttcttccacagctcacacatgcacactcacactggatcaccaagacacactcctgccccttctcacagcacttgctgccaaggctgtggacatgcacagcgtggttccttcacaccctgcctcacccacgtccacacagggaccccagcccctctcatcactcatacacacagggacgccacgtgtgtatatagggacacacactcctcatacctgcagggcatagcctgtcagccccaggtatgctggaaccagagtgagagaacctccatctaaaagttacattcatttaaaagttgctcttaaaggtttctggcatttcattgctcaacacagatacagctgtccccgttgcttggatgaggaaactgagtctcagcttctggggttccccccaggtcccaggctgaccctgcacctcaacctcccacagctcctcagcaagcctcttgtctcttgtcttcctggcctgacttcttgggtcctgttttgcagcaaggaaggacattccctctctgcccctgggccccggggccttctgttcccagcatggaagagctgggcactgtgacttggcagggcccggatccaagctgccagaccaccctctgcagagggcctaggcagcccacccctgcctgaagcaccaggtatcagcgcgggcagctcaggccaggggtacagctccccctgcttcatccttttccttctcccctttctctggccagaggcttcaccaggttcacctgggcctggcttgcttcctcctccactccagctcactaaccctgtctggcctccagaagctgcctgcagccctcactggtgggctgtgcctgctgggggcctgcaagcagagagcaaatggggaagtgcattgagctgattcactaaattgcctttcttctgcagaatcactttagggacaggctgaggaaatcactgtttccttggtggtgtgaagaaaatgggatgcgatcacctagcggggagctaatagccttttagccagtggaggagaaaaccaattaaaaattatgatatctgttaaaatggaacctggggtgccaaggggaagggaaggcccggaagctgccatctcccctgagaccttccccctctgcagcctggccgaagaccctctaggtcccctcgtcttaactggataaggctaataccagcagtagcaccccatgggggctcacagtgcactgcccctgtgctgtgcctactcacttcatcttttccaacaagtctgcaagggtcatggtcttggcccatttcacaggtgaggaaacaggttctcatagcctatggactcgaaccggtagagaggatgcgggagctccccagccctggccctctggcttgctccagcccgttctctgggccagtggtgtgggtccagggtggggctaaggagggcttccagggaggttgccctgagcctgcccacccactggtgagtccccccacctcgggctccaggtgccctcaggacatcccagcccagatcccagagtaatgtgtggcaccatgcacagacgctgagatactctctgggtctcgtcagctttagttgatgtctgggagtcctatgggtctggggaggagcaccaggcatggctgtgccagcagaagggccgactgtgtgtgctctgtggatggcaggaaggcatcttgctgccagtggcggtgcagatgttcggctgggacaccaggctgtggcccttgcagccaacatatgcctgaggccctggcatcggatggaagctactgctctgaagacaagggtgcagggatggggtttgggcatcagggatgggggtacagctgtgtttcctcatgcaggacagggccttcctcctcatttttcccatcctccaggacagcctgggagaagaaagccagggaataggggcaaagcagggtgcagccccccatgctccctgctgccctcctcccctcctgcagaggcacttcctttccacttcaggagcccctcccccagaagtgggccccccccatccccccttccttctttggaggctgcttcctggtgccaggttatgctccctccccgttctctgctgtgccctctatctccccactcctctgcaattatttttcagcagagtgacttaatagtaacaataacagtaacaataatagtaacaacagcaggctgggagcactcctgagggagcctcggctcctgccctgctgctctagggctggggactctccagagctgtctcatggcagggagagaccgtagtcaaggagaccctgtgtagggacttccgcatgcgtgtgtggcaaggggcggggactgggcagtgaccaccaggcagggagcacacctcagtcatggtcacagagaaggtgatgatggcaccagggctgtctctccgtgcccgtctgcacctgggcctgccagagccgtcttctgtgccccatggggtaggggagcaccccatggcccctgggaggctgccagtcagtgggactatgaggtcaaatggggaggtcccttggggtccatgacccaggcactgcaccccttggggctggaaggggagaaggccccaggcccaccagagcccctctggctcccccactagaacagcagccagggccggctcagggattgaggcgaagccttggtgcttgattctttgtcccctgaggcaggctgtacctctcataggagaactttggaggacgggccttctcctgaccaaggctctgggacacttggcagcccctgaggtcctgctttacctctctgctttctccccccttctctgagctctggggccaggcctgggcacttggattggcgctgagacaatgaggcctgaacctccatggagctctggtcccgcagctgtgtgatcatgggggcctcagggaccccgctcccctccattccccaagcctagaggccatgaagcctgtgggtccctgaactgtccaccctgagactgcaggcagggcagggctgggcaagagcaggcagcaagctgtccttgttcccacagctcctcctggctgggctcttggcccctgaaaagcctggggcagggagatggtgccagcaggaccttaaggacagcagttcaggtcgcacctggccctggagggagcaggtggccagctccaagcaaacacctctgtttgcttttgcctcaaggagtggctccacaaagtgtagcagcccaggcaccaccacagaaaggtcaccgctgcacctggacaggtgtgcgcctacctggtggaccagcgggcataggctttcctccctgatatcagggatacctggagggcctggtgctggggctctgtgctcaggggagaacctgtggccctacagccccaggttctagaccccctcccagattcgggtgctgcagctgcgcttccactcctggcccttgctcctctgtgctgctgctctccatgccctgcaggagccagggttccaaggaagcacctgaggggcagtgtggccccagggcaggagcaggacagtggccaccaagctgtttccagttcccttgtgtgcctgtgactccagaggattctcgcccttgtgttcctgagagggaaaaaggaaacatgtatttcctagaatttaagtaatgactggggagatgtgtgctctgggtgccgggacgagggtgggtgagctggaggtgcagcatgagctggtgcagttctggagggagggagagggctcattgggtttcttcctcatactacttggcagtgcaactggcacagacccggcagctgttgctgggctaggggccaggggcttcctcttgctctgttccccttcctgctccaccaccattgcctgtagggcgtctgccagccccaggaagcctaacacttagcccaagtggggctctgggcctggccctcctcacccagggaaacaacggggctcatgggcgcttggtgacatgggcacattgctctgccatcgtaaggggccagcctggctatgggacccagcaccggtgggcagcccacaggttgtctctgcaggagactcctctggcaggtcacatacaggatgccccacagcaccttgaaaactcgtgacccgggaaagcctcaaattgtctttgctcccctagcctccccaccacctgtatatgcaggggcatgtgagactgtacttggtgacaggaatgccccccagtctcaggggcttaacgccatctactatgtccttcttgtggcatagcctggcatggcccttacccactgggtggccacacctcccagcccttgtgcctggctatgtgcacaggagggcacagagcttcaagaagcctgaggcttaaggagctttgaggcctgggagggggccaccgtcactttccctgtgttccgtgggatcctgtcacatggtcgttctcaccccaggaggcttcaagtacagaggacgcggggatgggggcacgcaggggtgtacctgcacacacttctgcctaccagctctccatcccttgtcctggtccacatagcaggggctcctggcgggcccagcagctgagggggacagagggggaaacagggtagcaaataattatggtttactcttttttaattgtgaaatttgtgtaacataagtttaaccatttataagtgaaccatttggtggcatttagcacatttacagcattgaacaggcattgccttagttccaaaaaatttgcatcaccccaaaaggaaaccccatacccattaaacagctgcttcctgtccccgggcaacccccagcctgcgttctgtctctgcggcttggcctgtcctggaacatttcatctgcatggactgttgtctggcttcactcagcataaggtcttcagggttcctctaggctgtggcacacatcagccccttcctgtgaggggtaaatagtgtgccgtcacccattcatctggggatggacacgtgggtgctttccaccttttggcagttatgaaaaatgctgccagggacattcctgttataaatacctgagttcgtgctttcagttcttttgggtacatacctggacatgaaatcgctaggtaattctgttttatattttgtggagccgccaaactgttttccacagtggttgaattgtgttacattcccaagggttacaatctatccacattctcaccaccacgcattattctctgttattctctggttcatgtctcactctggccgtgcagccagtgcacagtgctagctcgttgtggctttggtttgcctttccccggtgatggcgtgctgggcatcttttcctgtgcatgctggccagttgcatgtctctttggagaagcatctcttcgagccctctgcctgttgtctaactagatggctgtcttgccatacagctgactttgctgttgcatctgcatcaagagctgcagagaagcagctttatccagggccgtcactgtcagtgattgagccccaggtcccttgtgaggagagtgtggattcgtctgattcctcacatgggcattgaatcaccactgccctcgaggaccttgaggacattctcggaagacctggactctgaggccacgttgagcaccaacatctggaaaccatggtgtcactgcttgtgcataagaaggggcctctcaggaaccgccctgtgaaggatggaggaaggggaaggtgcaaggagccagcagacccccaccccactgacaagacgagactcagcagcaggggaaccagggccgccctctctcgctcatcctgaaccctgactctaaaaataaccaggctgataatcggatccgctgtaagttgattatcatcattgccgtggtgtgatgtcatgctgccaggccctggggcagttttctcaggacagcggtggatgcacctaggcagctctggaggccagcatggagctggggggccctgaaccgagggtggcaggcagcctctgtgggctcctgcaaatctgcttggtgggggtggaacactggcatccataggcaggcactctgtgctcccaaggaggagttcctgtccccattcgcagctagggacagagccagggaagccaagtgcccagccctggcaaacagcggggaagcacaggggcatgggctgggccgctctgccctgcgtttctgctccttcctgctgctgaactctctcctttctgctgctgaactctctcctttggactaggcctttgtcttcttgcctcatcgtcagtggcctgggaggacacttgcagtcttaatcctgttttggccccatgtccctcaccccccaggggccacctaggccagagcctgtcctgatttccatctcggccaccgtctgcccctcggcccctggtcaggagctcattctgtggatactcctgcatagacatcacgtggactcaaagggcatgaggacctcggctgagaggagcttacacatcagtgcaaacctctcattttacacagggagaaatcgaggccctgagggaggcgtgagttgtcacacatgggggtagtgtcagatgaagacttggcaccacttccctgggcatccccttccctgcatggcatccccagccttgggtttggattcttcttcacccttgatgttgaggtctttgctcccaggacctggataacagcatccagatgcaggtggtgcccccgcatcgggctgcctggctgtgacctggggcatcaggattgtcagcttgtctggccccaggtctgtgctgggctgaaacctactgtctcagaggctcctggctctctccctctgctctccactgctcttaagagcagaccctcaagccttttttgtgtcctctctccagggagagcccagcttctactctgcagcccaatgcagaaggggtggtagctcacggtgcctcggcttctctgcatgcctgtcactgaacagagaagcccaggccagactgcagcttaattcctagcctctgtgtggcctccagcagggtacctaagctagtgctgcctcattttcctcctgtgtgagatgggaatcctcatggtccctacctctgacagttgttttgatgcagtgggtgatgcagatgaagcgcccggagcagacctgctcatgaggagcacaccgtggattcctactggttaatgttgaacagggatgagaaggggctggggtagggcgaaaatgggcaagaccatctcagcttgaggaacatgagctgacagattgacttaaatttgcacatggacatgatctgagtcactgccttgctgagtgcatggggacagttgcccaggccagaggcaccagggtcaaagccagtggtgatgccctggccccgttgccccaggccagggccagtgaacaatgtaatcagctggggcagactctacagccctgcagccaagggggccagtgacccttacatggtcatccacaggccacttgggtggccagtcctgttcagccaggccttgccctaggaaagaaattaattataacctaattggcagtttcctttgcatagaagccggaagcaactgccagtgaggctggtgattaactctgcagcagctgggaaattgcagttgggcaggagcgcccatcatcctggccaggccgctgcagctggtctgggtatggaagtgtgggtggtggccatcgtgcagcttagggcctgggcccctcagagcagaaggctgggtctgtgtgcagaaggtagccttgggctgccaggtcccccagtgcccagttgcggacctccttctcccaaacctcagccatgcctggaccccttccccactcacggcagaaggctgcatggcttttaggggtgtcaggaggctcatgtcctggttgcagttctaccatgggtgtgcagcgggaattctgggcttctgttttctggcatgggatggggtgaatgatatctctgttctacagcaggggctcagactggatgtgtgagaagagcctcagttaaggagggccatgttcgtgcgtgcagggatcgtggtgcctcccaggccagggccgggccccatctctcctcctcctcagctgctcttccagctactggccaccctgcctggctggaggtccaagaggagaggtatctgaggagatcctgcactccacaccgggtctcctgcccagcattttggaagaaccaattcttaagtctggtactgaggccgcactgccatgatgataactggtgtcaccaggacaccagggaaggagctgcccttggtgtttactgagcgcccggtatatgcactgagctgtccatcatctgcagagaccagtgttttcttgatggttttacagagagatgcttaaacccagtgaactaagaatgggacaggctgtcagatttttctcaaaggaggtattgacttgttagcgggtacaattaggccgaggaaccaggggctgatgcagtgtgctcccgaagaggggcttctatggactccagttaccagagcctgccccaggattttccttcacacctgctctttatgccagggatcaagcagggttataaatacaacagcgggcaggatgagccagtggtggccctgtgggtcttcacagcccaaatttccttccatggttagtgtaggttaaacctggcaaaaagctgctttcatttggaagtctcaggatgccagcaaagtgatgagagtggtagggatagaggtgagatgggggtggtgctggtgatagtgatggtcatggtgttggtgttggtgttggtagtggtggtattggtgatggtgatagtggaggtcgtgatgatggttgtggtggaggtgatggtaatgttgatggtggaagtcatgatagtgagtggtggttgtggtggtggtggtggtgatggtgaagacggtggtggtggacgtgatagggatattgatggtggagctcataatggtgaaggtggtgatggtggtggaggcagttgtggtggtgatggtgctggtggaggcaacggtgatggtggtggtgatggtgaagacggtggtgggaatggtggtggtggaggcaatggtggtggtgatggtggtggtggaggccatggtattagtgaaggtgatggtgaaggtggtggtggaggtcatgatggtgaaggtggggatggtggtggtagaggcagtggttgtgatggtggtgatggaggcggtggtgttagtggaggtgatggtgatggtggtggtggaagtcatgatggtgaaggtggggatggtggtggtggaggcagtggtagtagtggaggtgatggtgctggtggtagtggtgaggcagtggcggggaaggtggaggtaatggtagtggtagaggtgacggtgatgttgatggtcgtgatgcagccatcttctgtgagcatttgcttggtgccagccactgatctgtgaacttcatgtgcattaattccttctagctcccaacactcctgtgtggtgggagctctgagtctcagtgggtacagaggagaaactgagatacaaatatatgtcccttgctccaggctcattaccactgcaacacacactttctctccatcacccagatggagtccacagccttgcctggaatccacaagcttgcccaaccttcttcttcttcctaagttcatgccctcatggcccgaggagctggcctcctgtctccaaccagcattcacctccggccctgtgctgttgctgctcatctgaactgcctctacctcctgctgcttttcccctcctttcactctggctctgcccccagccctcccgtcctgccgggcactggctcctgcttgtggctgcagcccagagcagtcccttccctttagcctccacttgcctgtctgtggctgtctcttggtcaggcattttttcagaacgggcagcgtggggcagcccccttggcccctcagcctgggctaggcactctcctccatccagtgctgggccctttaaacaggtcaggcagcgtccgctcagcagaagcgtgtgatgacttccccagccggctgacctcagggagggtgcacatgggtgcccccagtcagctctcctgacgtccctgccggggtcaggtgtcccagggtctccagccttagggtctaacacattcatctctccaaaagtaaggattccttgccagggaaagggctaacaagctgcctgttttcttggccagcaggcatcctccccatgagcccagggctatgggtgaccagcaagccattagcatatgcgtgtccatctgtcctgcctggctggtgggctgccaggatagccgttccttttgctgcccaaggaagtactcaggacccagttactgtcacctctcccaaggcgtgcaggtggcgtaggaagtgcatgtccgttctttctgtaggacacacctcaggaccccaggggacattgtcaagaggcagaaccagggtgctcctgctgtgtaccagggccgacagcattgtgtcggggagcccgcccccacatgcaaggacacaccacacacagggaggcgtggagcacatgtggcctgtcccacctgctaacaggccggccatcggggccctcctctggctcataggcagggcatctggaggaagccgtccctgccaagagcaggttgagtgtatgggcactgtctgtcagcctcatactcttgttatcatcagacaagaaccctgagagttaagggaggcaaaggccagcaaggtcaggacttggggcagagatcggggctgggacaggagcttgttcaggacagtgggcaggactcccacaggtggagaggacagggatggccatgcacctgggagccctgggccaggctgagcgagcgagcaccagggcccggagtgaggggctgatggcaggggcatgcaggcagctgcacataccaggctctgtgtatgaaagggaaactggacatgtgtgagtaggcccaggcctggcaaatggctcagagagacacctgtgaacagctgtgtttggtggctgccctgggcaggggtgaggctgagagcccactgaacctcctgagtcagaggtgatgagagccacccccaggtgcagggaagacacagggaatttaggaagagagcaggacgccaggcagggtgcacttaatcgtcacttggaaaccagtgtccagtagtggctgcccgggagcctcttgggttggcactgggctcgtgtgaggaggaggcgtggcaaagggaagggctctgtgacagaaggcagttgagactgggccgcttctgggcgctgcctcctctgctgaggcctcagatgggtccctgccttgctcagggctgtgtgctccatgctaagccttgtcctcctgggggctcaggcacaaccaggtgactctcaagccagggccacatgcgtgcaccatgggcccctcccacatccaaaagcaaaattatattctgcaactgtgttggtataagacaaacacaatccaggccactttattattatttatttcttattatatttatttcatccttttgattttaaaatgaattaaaacaaaaaccttttttgcgcacccaggcgcatgcagcagtggtgccggtcaggagcagaggttcctcctctgcaggctcctggccccctgggaccctggcaccgagggctggccctagcggcccagcccttgtgagccctcacacctgcctagagatggcgcgctccctagccagtcagggcgctctcgtgcctggatgctgtggtctcatgagtggacagcagctgaagtgggaactgcagcagatactggccgtgcccaggtgtgtacctgccccaggcaggtgaccagggcagcagggtgatgccagatggggccaaaaatttcatgcttctgtttgaccttggttctagctgaagatttagctgtgtacacatctttaaaactgggatccccctataaaaaccagatgcacaggcagccgaagaaagaatggatgaattgggctacatcaaaatgtaaaacttctgtgaaccaaggccacaatcagaagagtgaaaacacagcccatggaatgggagaaaaacttgtaattcatagatctgatcagtgttaatccagaatctgtagagaactcctcacactcaacaacagcaacaaaaaaacctgattccaaaatgagcacagggggccaggtgcggtggctcactcctgtaatcctagcacttggggaggctcacgcaggcagatcacttgaggtcaggagttcgaaagcagcctagccaacatggtgaaaccttgtctctactaaaaatacaaaaaaattagccaggcgtggtggcaggtggctgtaatcccagctacttgggaggctgaggcaggagaatcgcttgaactcaggagacagaggttgcagttagccgagatcgtgccactgcactccagcctgggtgacagagtgagactccatacaaaaaaaaaaaaaaacccaacaacaacaacaaaaaaaatgagcacagggcctggatggacatttctccgaataagatttacagatggccccaagaagcacatgaaaagattctcagcattgccactcattagagaaatacaaatcaaaatcaccatgtgataccatctcacacccatttggatgtctactatcaaaaaaaaaaaaaaaaaaaaagaaccagtgttggtaaggatgtgaagaaactgaacccttgcgcactgctggaaggtaaatagtgtagctgctgtggagaacagcaggaaggctcctcaaaggttaaacctagagctgacttcggctccagcacctccactctggatacatacaggaaaggaagcaggaagcagtcaggatatatttgtatgtccccattttcagcagcattattcatagtaaccacaaagaggaagttacccaagtgtccattgaccaatgaatggataagcaaaatataatacagacatacaatggaatattacttggctttaaaaaggaaaaaaaatttgccacatcctatgccatggttgaacctcgagggcattatgtcacagaaggacaagcactgtatgattccacttacatgaggtccctgcagtcgtcaaattcgtggagacagtagaatggaggattccaggaactgggagaggagaggagggggagtaattgtctcatgggtacagaatttcagttttacaggataaaaagagtgctgtggaaggatggtttgcatggcagtgtgaatgcacttaatgccactgaattgtacacttaaaaattttaagatgataaagttcatgtgtattttaccacaatttaaaataactttttaaaactagaatctctctttatatacacctccaaatttgttatttacagtagagcctcccttgatccgtgttttttccctaaatgcaaagttagattatagtcccaggcaaaagcagcctccagctgggacagagccgaggacccaggtttgtgcagcatgctgcaggtggtcctacccgagtgagtctggctggcagctccggtgcccagggctcctcaggcactgatagatcatttcctgagctgaaaaggagtggttttgtcctcagcctcaggcttgtttgctcagcacagtggctggccccacaaggttgctggtgcactagtgggcactgcacgtgtgcacagggcgcatccacacagctctatcctgccactgacagcctgcccgtggctccagtgcccgtgagaccatgtcacagtatctccccgtcctcttactcccttccccttcccaaattctgaccatttcccaaatgtgcccagccctttcacactcctgtttatgaaaccattgtactggctcgttgattcattgattcattcattggttcataaatttattcattcagctcacagaaagtgagttggcagatgtggcaggaaggtaggcaccctgtaagagtgaggaggaagtgagttggagggcagagggggccctgggagccctgatgaggagctatgttttattctgcaagcagcggacagttaacacagggctccacagagggtgccatgattcagtggaccctggctcctctgtgcgagattgcctgtcctgcccagcatgtggtccagggttggacaggggtggcagaggggacttgggaggtggggtgaggggtgaaagagaaagggatctggggactgaggtgtgtgacctgagcagtgaggtggggccataccgtgatgagatggggaagagttggggacaatttggggtgaggaggggccaaactgaggcaaaggagtagagagagcaaggcatggagatgcccaggctgctgatcagcatgctgcacaccagcatagagacaggattaacagcccagggcctggatatggctggtgagtgagccactgccaccatctggaggacagggtgcagaggaggaaaccagccgagggggtgagcagcctcggtagcatcccagcgacgctggacagcaccaaagacagaggaggtcctgggagcagctgggagaaagtgggttacccaggaggggccggcctgagcatgggccctcagcagcagcagtgaggctgaaagacgggagccagaccttatgtagagtggaggaaaatagctgtccacatggaattctccacccagcaaaaatgggccttccatgaatgacgtcaaaaaatgaggcaagaagaaggccaggcgcaggctcctgctggtgggggtgggacacagtggcaggtggggaggcgggaggagcagcagtgtggccaagcatccagttcagcagggccacgggctccagggtgtttgttcagcataaatgttctgtgaaatgtattcgttgtacatgtcaaatatttgactatagtaagagaaaacgtgagtgggaagtgggagggaagcggtgggggggtgggggtggggtaacaggtcacatcctgagaggataacagtgctcagcatggggctggagggacccccatagggacagctggcctggggaggcggggaccgcctctttccacccccagcccccagggaggagccctggggcctgtttcccattcccaggaagatgattgcattaggaaatcgtctcttaaggagattctgctgggccataataaagctgtcatctgcatcgtctgccacccatcaagggcaggcgtggggctggtgtcgcatgaggggttctgcaggaagggcctgctctacacacatgccctacgctgcttctaattcatgcagtttttggatcatatcgttgttattgttttcttttttggaagtcccaaatttcggcccttgtgctgccatcctagggaagtttttcatggtctggagctccatttgtgtttctgtggcagggtcaccatgccatggcaagggtgacctcacagtgccccatcagagctgccgggtggtcggcagtgggggagtgagagaccaagggccacagccaggagccagtggagagctggtgagcccctgcctccacagacagggccaggccacgcttagtatgtgtgcaccgagggtgcaggaaaatgtgtgtgcttgtgtgtgaaagcgggtatataccagtatgagcaaatacatgtgcttgttagagccctattggcagtgtgagaatgtgtgagcatatgggagaacaagtgtataacagtgtgtgcccccgtggtgtgtaatggtatgcgtctgagagaatgagtgtgtgtgagagaaggaatgcatgtgtgcaatgtgtccgcctgagtctgaccaggagacagccccacgtggtccctgagacaggagcagtaacatcagaggcactaagctgtgatgaaagagggatgaatgggggtggggagagctctgtggggcaccctcagctgcaggtgggcaccagggaaggaaccccttcccagctggggtcagagcctgagggaggagctggatgctaggctggggctgctgtgcaggctcaggtctggcaggaactatccttagggcacgggagctgaggctgggggctgcaggaagctgatggctaggctcaggtatgggctgcatcagtgccgagggattgcatgctttgggtatgtgctagggtggagcacatagcacaccctgtctcgtggactgcccgggcagcaggacctagaaaaggcaggtgtaacaaccggagacaggagcaacccctggcctgtcccagcatctctccaaagccctccaccgatgaagcttggccttgtgctgcctgcaaagtaacctgctccaggcccgcctgggcatgagaacatgcacacctggacggagtgtgtggattgacaaggtgtgtgcacgcgcacatgtgggacgagggggctcaggactggtcccctctgcatccaaagatgaataatttaaacagcccagccacgtgtggaacattggaaacagtctagcacttcactctgtcaaacactagggcagactctttcctgctgagctgggcagggtgggagcagatggggtcttaggtgggcatgcctccatctctttttctgtctcctgcatgccctgtgcgtgcatacatatacacacactcatgacacacactacataggccttgaaggtttctgaggtctctctgaatgtgagcagcaacttgggtctttggcaagtgtgctgtgagcaagcaggaccttcccccaccccatcctgcatggtgcctgggcacagccagcctgaggaaccagaaccacggtggcgggggtcattgagggttgatgtgggaatcctcttagtttctcagacaagcgacactgccatttgcaccgtcggtgggtgtggtgtgtgccaggccaccgctgtgctgcagaagtacagggtgggcccagccctggcaaccaaagctgtccaggcagacacctgtgtgctaggtttgagggaggattctgtcaccacgtggcatttgggctttgaaggcatggggtgggaaaagctttgtaagtcctgctggtgaccttcccatggtgccaggagtgggagtgtctgtcaccagacgtgggtctcgacccacgggcctggccttggtccacaggccaggcggcccttctaggcagaaaggcggcagcaggatgggaagccaaccagcagggcactgggcctcctggcaggctcagcacctgctggcgcctggcttccaccatcactttcttagctgttatcctaacccccgagacacaaagcctcacagcatgtccagctatttcacttggtcaggcttctcgccacccagccttgctgttcttatatgtgaaatgggcagtgaagggatctgcacccagtggctgagtctgcagtgagagcctcatgatgatacacccctgtgcagaggtgcacgcctggctgcacctgcactggccgttcctcctctccttagcatgcctcccccacttcgaagctggggaaactgaggcccagaggaggccagtgttctgcagagtctgcacagtccggtggttcctgatgccagcagctgttccccagctctcccctgtggctgacccaccacgattggctgcatcatttgtgggccccttgatctagaattatgaagaatttcaagactgtagcaaagagcattaaaccaagcgtgagacctctgagcagggcccactgggactgcccaggctgcagtccgctgaggcaggtcctgcacccacctccttcattctcccaccttggaccatgtgtttttccatctagaagtgtctgtgacaagcgggaaccttaagacagctgtgcccagctgcagagaccacctgggaggcattttaagtgcatttaagtctgtttctgctcgcaatcattgcctgacccacaaatcccttttggcagcagggagaccaattgggattgggccccccacgatcctgtaggggtgggctctgccagatgggagcaggaaggcccgttctcccctgcacatgtgggctttgtggtgggggctttgggaagcccaggcctgtcctacctctagtccctggaccactaaaggtgcttgcacatcatggaggccccagaggagcacctgtgggattcccagactggatctgctcctgcgacagatggggtgccagggccctacccactcttctgcagcctgggcatcaccagagccaccccacggccacccaagggcaaatggttcttattgggaagaccagggccagaggtgtgtgtcccagagaaaactagacccagctgagctgcattgcctctccccacctgagctcagccaacccctagcatcctctctggggtaagaacatggaccccactgcctgcatggatagcccagacataggatgccacatgggattgggagggggctcatcggggccagggcatctggaccctcctcgccctgtgaggccactatgagttacaatctctcaccctctgtcgccagaaatgcagcaccccctcccaccccgagggcactgtcatgggagcagtgttcctgatgtacagtgagcacttcaagagaagctttctcctgttctattttcccactgtgggactccagacgtctcacctgttctcttccaggctccccttggcacttgattgtttcccccaggtgtgtcctggaggagcccagcggccctgggggcgttctcaactgctgctgcaggccccgccctccagacccctcagcgacctcaagcagcaaccgtctgggtgggagcaaactgatcaaaaagagagatcgattacatacaagtgcagtattcctaatgtgtcctttggatgttggtattgtttgggcattctagagtctatttgcaggttcttaatggattttaagcattttttgcctatttatccatctttttaaaaattcatacgattttttattgtggaaaaatatacacaaaaatgatttacaatgtaactatttttaagtatacatttcagggacattaagtacattcacattgttgtacagccatcaccacctccgtccctgaacttttcatcttcccaaacttaaactctgtccctatcaaacactaactccccatcctgtctcccccaagccctagcaatcaccatcctatgttgtgtctgtgaatttgactactctagggatctcacataagtggaatcgtgcagtgttcatccttttgcaatgggcttatttcacttagcataatgtgctcaagggttatcagtgttatagcctgtgtcaggattttcctcctttttttttttttttttttgagacaggtcttgttctgttgtccaggctggagtgcaatggcacaatctcggctcactacaacctccgcctcgtgggttcaagccattctcctggcttagcctctcaagtagctgagattataggcgcccgccttcatgcccagctaatttttgtatttttagtagagacggggtttcaccatgttggctaggctgatcttaaactcccgaccttaagtgatctgcccacctaggcctccgaaagtattaggattacaggcgtgagccactgcgcccggccagatttccctcctttctaagactgaatattccattgtatgtatagaccatgttttgttcatccattcatccattgatggccactgaggttgcttccaccttttgtctatcgtgaatagtgctgttgtgaacatgggtgtgtaaatatctatttgagacttggctttcaattcttttgcgtatgtacccagaagtgggattggtagatcatatggtaattcaatttttaagtttttgggaactaccttcttgtttttcatgataactgtatattattttccattttcaccgacaatgtacatgagttccaaaaactattttaaaagctttccactgtgggaaatgttggccacacacagtcagcagcatagtgcaccgtgcccctgcttgggctcactcagccacagccgaggctagcatcctgccttcttcaaggaagctacgcctctgtccacagcgccttcagtgattcatttttcagttatttaggtaaaaattacatagataggccgggcacggtggctcatacctgtaatcccagcactttgggaggcagaggcgggcggatcgccggaggttgagagttcgagaccagcctgaccaacatggagaaaccccatctctactaagaaaatacaaaattagctgggcatggtggtgcatgcctgtaatcccagctactggggaggctgaggcaggagaatcgcttgaacccgggaggtggaagttgtggtgagccaagattgcaccattgcattccagcctaggcaacaagagcaaaactccatctcaaaaataaataaataaataaataaataaataaataaataaataaataaaaattacatagataagatgcacggaccttagctgcacaatactgacaaacgaatatgcccacgtgatctgcacccttctcaggatatgggaccttcacattccccagaaagtgccctgtggcccttcccaatctgtccacctcccccacacccccgcctgccacaggcagccagtctgatccattgcctaacatccgtccagaatcatgccatgtgcgctcttctctgcctggcttcctcaccttggcatggtttgtgtgtgtgacccatccaggtgtttgcgtgtatccatagttcatccttttccattgctgggcaggattctgtggcatggctggaccacggtgtgcctgtccatccacctgctgaagggcctctaggctcttgacttctgtgaatcatccttccatttccaactatggcatttgatagacgtatgttttcacttttcttggatgaatggagtggaattgcagggtcatatggtaggcgtatgtttagataaagatttatgactttcctgtaaagtgctttcttcattttttggcaactgttgcctgccccacatgggtggcagtgtctcctgcccttgaacactctggctctgggtgacctgttgagaagtctgtatggttcaggtgcccttccggcttggatgattgagaataggcttgtcactgaggatactgcttcccctgtttccttttctttttctgttttaaagcagttcttttctagcccgtgtgtaactatacaaataattgagtgttcatgttctcaggaacagagatgaaaaactcctgctaagatcggaattttaaattaatgattttttttttttttgtccttgaagaagccttattctcaccatccctcactcacttccctacttcccacagtggcattgggcctctacttctcgagggatgcttactgggagaagctgtatgtggaccaggcagccggcacgcccttgctgtacgtccatgccctgcgggacgcccctgaggaggtgcccagcttccgcctgggccagcatctctacggcacgtaccgcacacggctgcatgagaacaactggatctgcatccaggaggacaccggcctcctctaccttaaccggagcctggaccatagctcctgggagaagctcagtgtccgcagtaagggagccgccccaacacccaccccgtgccccaccccaccccttcctcaagccgcccttatcacagccgctgacactgaagcttggcatggcttcccccccaccgctggtgtggaaggcgtcaggggttaagtgaggctggcctgcctctgtgtccagcctggagagaagccaggacaagcttcagggctgcgtgaggctgtaggagtttggagacacacgggaatcatccgggtacactcttctgccagacccgaatccctcttccagtggggctaaaaaggattaggaggtttcgagagagggagtaagtggggctggaaaaatcccaaggttttgatttagcaaatgacctgcaactctctggagaagcggcagttcccaaggaaagcctgacttcttatcagcagctggctgcccttgtacctggcagggacttgggcctgtcccaggtgtccagggaggaaagaggagcagtcagagccagagtcacggccacatgtgacattggtaatgggaggggtgggggggaagcagagcccctgtgacaggaaacggtgatgctgcacctggtagctcccatccctagcacccctccagggccacagcttgcacagccctcacaaccaccctgagccctgtctgctggtgagaggcaagcctcaggctatgaatgcagagcaggcatccctgccctacccaggcctatctgccagggacagccagggtgcaggggagggaggagacttgggtgggcaactccctccggcgcagcccaggcagttcctggaggaggcagcatctgaggttggtcgtggttctacgcacttagttgctgccctcttcatcctgagcctccagggtggagcttgaggaatgggagtccctgggtgggggccagtgtggaatttgccctgggcctgcatttcgtaggaggcctaagccctccaaggtggggagaggcttcatgcacagccagttcctgtggaggaagaaaccacagggtaatttaacagggagagtttgtgtaaagaattaattacaacaggggattggagcaatgagggacaggctagcaaaaagcaaagagaatgccagagaatatgggaagagcagctctgaggagcagccgcccacctagggctgagatggaggctgggaaagccctcgcagcccagctgaaatggctatggcgcttcggtgatggaacttgccggaaatgccccctctaggcattggggaagtatgtctgcggccactccaaacctcctgaggagggtgtggcagggggggtgctggtcaccccttactggagaagttgccaccatcagagttggggagccttagacccagtgctcaacacacctccctgaggaaggggcctctaagccaagaactgaatgatgagagctaggcctgtggggcattggtgctgggcagcagggctgtgcagcagaggtaaggaggtggcaggcagagctggaacaccagtctgagccttgtggaccttggtggggaccagggtttacaccagccctggagctcctgcctcctccccattcccgactgcctggcagatgtggccgatgcccccacagacctgacttctctctgcagaccgcggctttcccctgctcaccgtctacctcaaggtcttcctgtcacccacatcccttcgtgagggcgagtgccagtggccaggctgtgcccgcgtatacttctccttcttcaacacctcctttccagcctgcagctccctcaagccccgggagctctgcttcccagagacaaggccctccttccgcattcgggagaaccgacccccaggcaccttccaccagttccgcctgctgcctgtgcagttcttgtgccccaacatcagcgtggcctacaggctcctggagggtgagtgccgaccttgtggggccgccccacagtgcctgctactgctggtcttgctctgcgagcccttgacacaagccatctggtttattcttcaccttcatgccatcagttcattcaatattccagaagtacctcttgcatgcctgccaggggccaggtactgttctaggagctaaggatataacaatgaacacaacgggttggaatcttgcctgcctgcagctttcattcttgtggggcagacagagcgtctgagcatgccaaggaaatcaggtggcttctggaaggagctagctggggaggaaactgggaagagggaaacgctgaagaggaggggaacagacgaggagacctccattcctctatcgtaaattgggtggtcagggtgggggctagcagagcaaaggtgggagggtgccgggtaggcaggcctagccccttggagggcaccacagtgtgaccctcgtgtgcctggagtgcactgagcgacagggaagagctgaggctgatggggcagaatagttcctggggcagggggcaggtctgggagtggcttgcagggctttctccggaggaacatggggagctatggaagactttggagggagggagtgctggcaggacctgacttagttttaaaaggattagtcagactactgtgttaggaatggtttggggtgggaaggttcaggggcgaagctgggagacaatcagaaggctacaggagaaacctctgaacaggaggatgtggggtgtgatgccgggatacgggtggaagccgaggcatggcgagaagcaggcagctgcagccagtcagagggtgggatgagctggatcccagtggagaggggagaaggcagctgactaggtgcagggaggccccatttgaccatcagaaagtcaggaagtggggctcaaccaggtcacagaggctgcaccgctggcaagtgtgtcctaaattcacactaactttatcacacaaacatggcaagaatattaaaatctcagtaaaggaagacaagccatcacttatgcttccccagattcctttcattctctggggcagggttgatggagcacttggttttttgcatgctgccctttttcactaaaaattatgtgattaaatttagtttagtggggggttttttgtaatcacactcaacagaggaaagcattatatgataagcatttcccacatacgtaattcatgcgcaaggcatggttctgcctgggaggcttgtggagttgcccccgcctccttggggtgggttgtggggtcttcagcggtgaccttccgccttcagcatgcccccttttctggattatttctggaggacaaatccgaggtcaggctcgttgaagactgtgttgtggttcctggccctgcttcaggggcgatgtagtctagcgcgagctgccatgcagggcacggagcattcgcttttgtctcgacatccggccttcagaggatgaccagcctggcgacgcactggacaaggaggtgtagagtggggatgcacactaggcggtcggaaatcattatgcgttaatgtcacatcataccccagatgtccactgtgtttgttttcaagtggtagaatcgtggctttctcacgttctctaaaatgaacacatattgcttccataattgaaaaaaaaaaaaacctaacagtttttaaaaagcagccaaggtcaccaatatggtgaaaggccgtccctactaaaaatacaaaaattagccgggcatggtggcgggcgcctgtagtcccagctactcgggaggctgaggcaggagaatcgcctgaacccgggagttggaggttgcagtgagccaagatcgcgccactgcactccagcctgggcaacacagcgagactccatcaaaaacaaaaaaaaagcagccaaggccagtagctggctctctagggctgcagtgcagcttgggctgaggcaaagccacccttccccacacaaggccactcctgatcaaggccaggtgggcggaggggtgtcccagtccctactggttgatcagggtgcctggtcctggctcttcccaaccagcacgagtgaggacgcagctgcagcaggacgtaagcacagtcatcgctgcaaactgcaaactcgtaagcacagtcatcgctgcaaactgcaaactcgtgctccgagcgctgccctcccctgtggagcggaggaggggaggcctggggccgcggcggtgtgcgccccgctctgaccgcagagcccccttcccgaggaaagcggctggcccggtcccggctggtgatcacgcggggcccctgtctgcttggtgcgcaggtgagggtctgcccttccgctgcgccccggacagcctggaggtgagcacgcgctgggccctggaccgcgagcagcgggagaagtacgagctggtggccgtgtgcaccgtgcacgccggcgcgcgcgaggaggtggtgatggtgcccttcccggtgaccgtgtacgacgaggacgactcggcgcccaccttccccgcgggcgtcgacaccgccagcgccgtggtggagttcaagcggaaggaggtgcttgtccgcgcgtgctgtggtctacccagtgtctgtctccggccacagttcgtttctcggtcggtttagtgtccgtgtagccacccaaccgtgtggccgaccattcgcgctttcatttgtccttcgcctccgtctgcgccgtctgtcctagggggaggggaagggggagtcctgccagcacccagctgggccttgcctcgggaggcaaggaccaggacgaggcccgagggctcgcgtctggggcatacttgtgccgctgcaggcgggcgcggcgcgctgcccgggcggggagcatctgccgggagggcactccctcccaccagcagttagcccccaacgggagggcccttgagtgaccacgagcagagccggggattggagaaggacgggaaggcggatcacctccggcgccgcccgccccgcccttctccggctcgcgctggtggagcgcgaccgccacctgctgggcctcggccttcctgcagccggcccacccagcaggggccgtgggagagtgggcgtggggactgaggtaggtagtacgttgccttgttccgcttctctgggcacaccacgtgcaggtttggcagggaaagggggtctggtcgaaagcacaatttgtgagtaaaggctatgtgggcctccctggggtgacagcagaggcctggtgggcagagccatccaggtgcccagcggctttcctcacaaccccctccagcctggggtaggaggatgcttggaacagagcgctctgatgtacacctggcctcggagctcggctctgccggctgttcctgtgtgaccttgacctgaccttcaccctgtggggcccagcttcctcaggggagagtggaggtgctcatcctgctctctggggacctggatgggacctgccagcagggtgcctgggcatcggctgtaattctccttataagaggtctgcattgtacctgttacacaggcgaggctcagtggctcagggaaggtgacggccaggctggccagtgaccccgtgggaacttgaacccaggtcagactgtccccagacctggctctgacaacacacatctggtccacctatgggctgtgtgggacgtgcagcattctaaggtctctggttttggggggtctgaggggcccatctcgcctgcactgaccaacgccctctgcatcctgcaggacaccgtggtggccacgctgcgtgtcttcgatgcagacgtggtacctgcatcaggggagctggtgaggcggtacacaagcacgctgctccccggggacacctgggcccagcagaccttccgggtggaacactggcccaacgagacctcggtccaggccaacggcagcttcgtgcgggcgaccgtacatgactatagtaagaggggctggtggcacggcctggctaggcccccaggaaatgaggtgctcgctcttcatgggcaagcagcaccctacacacatgcacacctggcatggccctctgtggcccaagccacttcccctccaccctctgcccagcacttcctgtgtctctgccaggcctgccctccagccaccagcagggctttcaccatgggacctctctccctgagctgatccatggccgaccctggcagggccccaccacacccccctgctgacctcaccagggctcaccaccgactgcaaacacacatgtcacctgaggctttcctccagcccctggcactccatcgttgcccctaaggcgtcccaagtgcttacggattattgctccagcctcagcagctctctgctaaacaggctggtgtacagaagcagccccgagccaggtcagggcttctgagcccattatcctgcctgactgctgacatgccaccatgctcacctgcttgcagggcacctttcagcagcggccttgcttcctgcctccctccgccacctcctgcagatttctcctgggatcgccttccaaataaaccacctgcatttggggtctgtgtctggtggaaccccaggccatgagtccttcacccctttctgcctggcctggtcctgttcattcctcagtcctccccacctcaccaagcctatggaggccccacttgtcagaggggagacagcctccttgccctggcactgaacaccctgtgtgccagagtgcccctcccatcattgtttccaccacatgagatccacagtggcagcacgcggcaggtacaccgatggcatgacttccagggcttggcctgcggggtcattgggtctgctggaggttcctgcagtggagggtagttctgccatgctctgggggagctgtctggagggctctagtgtgtccttcccagggccttggtaatgtagacctttaaccccccatgcctcacacacacacacacacacacacacacacacacacacacacaccctgttacccaaaaaacgaaactctgtaaaacattttaaagaggtttattctgagccaggatgagtgaccacagcctggagaaaacacaaacccaagaagccttgagtaagtggtccccaggtccaaggtggtggagttacagtttgcttttatacattttagggagacaggagttacaagcaaggacataaatcaacacacagaaggtatacattggtttggccccaaaatgcagggtatcttaaaacaggggcttacaggttagaggtagatgcagagattctttaatttacagttggttgaaagagttaagctttgcctaaagacttcaggtcagtacaaaggaatgttaaggaggcctgctatgtgtcgcctgatgctatacagggtcaggagggaaagtaaaccacgttatacctgggtaacttaaaaaaaaaaggtttttaacaagattttatggaccaggcatagtggctcacgcctgtaatcccagcactttagggagaccgaggcgggtggattgtttgagtccaggagttcgagaccagcctaggcaacatggtgaaaccctgtctctacaaaaaaaaaaaaaatacaaaaaattagccaggcgtggtggcacatgcctggattccaggaacctgggaggctgaggtgggaggatggctggagcctgggaggtcaaggctgcaatgagatgcaacagagcaagactctgtctcaaaaaagaaaaccaatgttatggtttgtagggtgtttcttaacccttgcctggcatggccttaggtcctgtttataatttggtatcttactgccacaaagagtccgatctgtcagtcttatgatctctgttttaatgttaatgccggtcagttgtgtccaaactccagcaggaagagggcctaataaggcaagtccaccctgccttcctgtcatggcccagaattctgtttttaaggtttttctggtgtcccttggccaagaggggatctattcagttggtccggggactcaagattttagtttcagtttacaactctatacacaaacaccccatacacacaggcaccaataccctatgcacagacaccacacaaatgcatactacacacttacacataccacacacacgcataccatgcaagcatatcatacacacagacaccccatacaatgcgtacacatgcacacacacacaggctgcctcaaattgagaagggttccttggactttcagttcagtaaatcccaacgtttgaacattggtgctaacttaggaccagccccaggcctgttgcatggcactgtatgtgtgaaagtgcgtgtttgcaccagtgtgagtgcagggctgtgtctgggaagaggtgtgctacacatgaggaagcagccagagcagcttggtggtcattgttgtgcccctacctgcagggctggttctcaaccggaacctctccatctcggagaaccgcaccatgcagctggcggtgctggtcaatgactcagacttccagggcccaggagcgggcgtcctcttgctccacttcaacgtgtcggtgctgccggtcagcctgcacctgcccagtacctactccctctccgtgagcaggagggctcgccgatttgcccaggtgagcccatacctattgcctgtctggggaagattgaaaggccaagggacatgggggcacagggaggcaggtgacactgcctcttggcccaaccagcacagagtagactgggtggagtcctgagcccagggccaggaggtacagctgtgtgcacagaagaggcctgggagagctcacagtgggcagggctgggggctccttgggcctctctttttttcccctttccattcttggtatctttaaaatgtattttcaaaaatgcaagagcaatactgggtaaatctgcatatggtgactcggaagaatcttcctggtggattggtgagagtggcttgcagagatgttggtcccacgtgactccctttgtgcaaaagcagatcttccctgacagggatctgcaagtgtgcagagatcacagtgctgtccacagtggtgccctcagggggaggcaggaaacgcttccactttttactttttgtaactaggtttgctagaaagcgtatatttatatttgtctttggaaaataatgattagaaatagaaggcataaaagtaataaatattcattaaagaagatgaggcatgaggcatgaggcgtgatcccttctacccataggcgccagtgttgcacatcgtggtgttctttctgggatgtttctcgtaagcacttattaagttgacttgaaactgcagcacgcatgttctcgcatgccgctctcccttgcagagcagcccgtggcgcctcctcttcaggggccatctgccagttctttcgggtggttctgtgcccgcatcagctcctggcagccacccgtgtccagcccacgagggagcccacccttggacatatctaagctccccgaccacctccttggcctttaatgggagtgggatcagagacagaggggcgacaagacagagggccccggggggtctcatggggggcggggcaagagcaggcattgctgaagttgggtcacctgccctctgtcaggagcaacgggggcctgaatcccagtccagcctcagcctcactgtggtctcacctttctccccagtttgtaaagctgtgaattagggacaggaaccctgaacaattttgagagtcacatgagcatttggaagtgggctttgtaggggaaagtgaggaggcccaggaggctggtttttgctgtggtcacttgtgggcctgggagagcccagccctgctctggcccgcccccatctcgccatctgtggaacttttggtttcaagcagctgcaagagttgccaagaggttgaaagaattcagctgcctgactccaggtcctggcatccccaggagaggcccctctttcccaggggctctggtcaaagtcccagagcctggcatccccaggagaagaggctcctctttcccagaggctctgctcaaagtcccagggaggccccctggtcctgcatgggctggggcaaccatgctcccgagtcttgtggctggggttcagtgctctgaccaggggacaccagggcagggtggacctctaaaccctgtgcactgagggaggagtgaggggtccccagagcactgctggggcagctgggagcagccagggaggagcctgggagacattccggcggctttgttgtctgagtgagggaggaaaggggagtaaagggttgagtcagggcctgcctggggcttttcctgccaccaaactgaacctcgaggccctgggttgccttgacctccagctcccaggaacaggggcagctggtaacatgtggcctgagtggaacggggcagggcagggctggggcaggtgggtgggtatgaaggctctgaggggtggaggacagggtgctcgggggggctgctgtctccaggcccagttgggggctgttccaggacttaggctgtgtgggaatctctaccctcaggccattacaggccggtccagctgcctggctaaggtgttcccctgtgcccccctagatcgggaaagtctgtgtggaaaactgccaggcattcagtggcatcaacgtccagtacaagctgcattcctctggtgccaactgcagcacgctaggggtggtcacctcagccgaggacacctcggggatcctgtttgtgaatgacaccaaggccctgcggcggcccaagtgtgccgaacttcactacatggtggtggccaccgaccagcagacctctaggcaggcccaggcccagctgcttgtaacagtggaggggtcatgtgagtgcctgctccagggagggagggtcggggtcctgggggcttctggagcctgggcctcctgccctttgagaaaagcagtacagctgcaaggcttagctggggagtggggaaggcatggaccagcttcaccctgagtgacccagcagtaaatggttgctccttccagataacatacaggaccttgggtaaatttgaattttgggtaaacaacaagcagttttttggtataggtgtgttccatgcaacttttgcagcttctcgaaagacacacctctaggtccatccatgccctcttaggaacatgctgacacagctgccattcatgccattcattgtgtatctgaaatgtaggtcccacagggcgtcgttggctgaatctggctgcactcacatccttcctcctgtacttaccccagcccaggtgacccctgctttgtgaccatgatgtcctgtaccctgccctgcgccctgtgctcctggcactgtctttgctgccctgggtctgtcactccggtccccttgggctccatccgtgggcagctcagctggtgctgttccctgtccttgggcactagctggacgctgggcccaggccagccccctgtgaccctgcttgtctgccacctgcagatgtggccgaggaggcgggctgccccctgtcctgtgcagtcagcaagagacggctggagtgtgaggagtgtggcggcctgggctccccaacaggcaggtgtgagtggaggcaaggagatggcaaaggtaagccctggaaacgcccaagggaggcctgcaggggcgatggcaccggtggaaacggggtcctggggccctgccagcctggggtggctctccctgctccaggtctgcttctggcacctcatcccccatgtggctctcgatgccagcatagcgggcagcagtgcagggcttgggagagggcttgtgagtacagtgaatggtccccaggccggattcactctggacttgggaaggtctgaaccaaagttgggatgtgctggggacagaatggcgtttttctgggaggtcctcggccaggggatgtggtgtgggcaggggactcattgtctgcatcagccagaggccagcctgggtgtgcccaccaccatgaggggccctcaccatgcagccctgagagggtcccggcctctttgctgtaagggccacctgtgtgaggaaccccccatacctcctctcccataagccatggctccccaggatgcttccgctggcaaggctctgtatatggtgtttccctactcaggcctccagttgctcctccctagaggggcaggatctgcctaggaggtggtgggggcgtgtggcggggctcccacatgggtgacagcctgctgtgtgtcctgtgcagggatcaccaggaacttctccacctgctctcccagcaccaagacctgccccgacggccactgcgatgttgtggagacccaagacatcaacatttgccctcaggactgcctccgtaagcagggtttaatcagggcatgggaacaggtaggagatagtaggggaaacctggatcccacaggcacttcagccagagttgccagggctgtcagttctatgcatcaagctgagcctcctgtgcatttcagcatcaccctagccatggggagggagcaggcagggtcagggacagggggaaggcagggacccacagactgtccaggcccctgctgaggtcccagaagtcggcacacacagatttcagaagcagagaatggtcagtagggacactgacagggaaagtgcggccctgagccagacgagggacactgcaatgtgcgggtcaggccaccaggctccagttttggaggcagagtcctttgttcagatgaaatgttaggagggggcctggcttcacccatggcttcagaaaggcactgtgaccaagccctgcccggctaagccaagctgctgggcccctggcctcactgggcctatgcttgcgacaccagttggggagggggctccttgggacactgccctggaaatatgggcgcctggggtggtcaggcgccccaggaggctgagtgggctacgtctgccctcagggggcagcattgttgggggacacgagcctggggagccccgggggattaaagctggctatggcacctgcaactgcttccctgaggaggagaagtgcttctgcgagcccgaagacatccagggtgagtgggtggcggccgggaccaccaccacctcccagccccacagaggtctcaacagcacatctgaggtcccaacaagggaggaaattgctgggaggcgagtgggccccatgaaacttccctccctccctctgggcctctgttactccacccaggagaggggccagggcccctgtaaagtgtcttctggccataagttctatgatggacaggccagaaaagcagttcttccaccaaacaacttgtcagcctgacaagtcactgtccctgtgaccatgcagctgggacccacccaggaacacatttcaaggtcagcaggtatggtgggttgcacagccacactgactacactcaggggtgctgttctgcctgagcatagggacacgtttctgtcattgagttttctggtattatatagccctacgtccctagccacttagcattttcataaagaaaatgccaaagacatttggaacagaggaaaattttgacctcccctgccagccctccagtgccagctggtgtaatgagcacagcctctgctgtgtgaccttggcaggctgctcagcctctctgagcctctgtctccatctgtaagagggcaatagtggtctaggagggggcagtaaatggcagtacccatgctcgatggggtgttctcaggccttcccacacctccatggccacttcccagctggcgcggacacggcaggctggagagccatgaggcagagcatacgcagcctgtacccagtggtgccgagcctctggcggtgccaagcctcacaccacccccacccacagatccactgtgcgacgagctgtgccgcacggtgatcgcagccgctgtcctcttctccttcatcgtctcggtgctgctgtctgccttctgcatccactgctaccacaagtttgcccacaagccacccatctcctcagctgagatgaccttccggaggcccgcccaggccttcccggtcagctactcctcttccggtgcccgccggccctcgctggactccatggagaaccaggtctccgtggatgccttcaagatcctggtgagggtccctgcggggcagggaagatcccctgccctccccagctgccttccagggagggaggccagctggggagacagaggccatcctgtgaggggctgccaacgctgggcagacgaggcctgtgttctgcccccatttccatagggcgctgtgtggggacagtctgtggggtgggactgtgatgaggtgccgttcccatctaggtgagaggcagtggtcagggtcacagcatcgggcaggggagcagcagtgtggatggaggggcactgaagtcagaagggggtgcctttctggggagcctggcctgcaggtctgcatgtgctactcagagcctccaggctgtgccgagtatcctggagcctccttgtcccggccaggcaggcctctgccctctcctggtggtggcctgccccttcagtgttcctactagcactgtccagggcgctggaagccaagcccagttctggaagtaacagaggctcagagccaagggtgtgagtgaacggtgagccacgcagcttatggtggcgtgaatagctcctcggcaggagcctccagggaggaagctgagcacccagtggccacagggccctggcagttcccatctcaggctgggaggtggcctgggattcctgggaggggccatatcccacagtgcagctcagcctgaggcctcggccctggagcctccgttcaggcaacacccagccctcggtaagggtgtgagccaaggaggccttcccagatgtggccactgccgcttccccaccagctttcctaattggtggtccccatcctggcctggctgcagcttagcctcatggcagggctctaggatgagccaccagagtccttcataaacccagtgggtttgtgtgaggctgcccaggaaggccgcactggtctgggctgctgctggcagagaccaccaccctaaccccagtcagctccagagtcacactcatcagcaccaggtcttggacccatgactcaacctcagtatttgagaggatcaggttgatgtcgccctcatgtgcttattgcagtctctagagtgtggtaaacaggtttccagtgccagctgtggaggtgacagcggcagggaagccatggcagtgtcgacactgaccttgactgtgggttcccagggaatgtggggccagaccaggacagcccaggagcaggagacctggggtgacggatgcccagagctggcacatcaagggagggttcctggatcatggcaggctttggcctccctggtcagagttcaagtactgggggccagggtgggggtctgggaaggcatccggagcagtcccaagtgggcccaatgtgtggatagaactttggtgggagggcagggtggtagtgccagcaggcagggtgagcgggtgcgtgagggccagtggcagcccttgaggagcagtgcttccacactctgaggcggaacatggtggcgcctttctttgcaggggtggctatgtagagaagttgtcctggacacttccactgtagtcagaggtcctgggctgggcctggtgctcatttagtcctggggcaggggtcaggggagacagtagaccaggaaccagagagggtcgaagtactgagtccaagccatgctgtgaccacacctgtcatgtagcagctttcaggggcctggctgtggggtcctgcccagggcagagacaggcagcgttgccgctggctcagatgacagccggttctctgcacattggaacttgtccatggggcctcctttaagggtcttgccttcttcctcccctgtcatcctcacacttttcccccctcttctcccccttccctcatttccaacataggaggatccaaagtgggaattccctcggaagaacttggttcttggaaaaactctaggagaaggcgaatttggaaaagtggtcaaggcaacggccttccatctgaaaggcagagcagggtacaccacggtggccgtgaagatgctgaaaggtacctgccaggcacaggcacagtgcccctgggggagtctccggggcggggggcgggtgaggcccctcctgcccagcatgggaccctgaagagcccccaatgctgttctagagcggctgcagttgggggacccctaccatgggccacttgggcctagagaagcagagcgaggactttgctctccctggaaggctctagaggtgttgctgtgccagtgccactgaagatctaagctttaaacatttaaaaagccctttgattttgagctgacagctgtcttcactccagtctgccccattcattcctctcagcccagtgtctcctggggtcttggtgaagagaccaccagtaaggactggccctcaatctcaagagacccccatgggcctgtctggcctgcatgcccagtcatgccacaagtttggctctcgatgggcacatgcacctacccacacaggcatgcgactgcactgagtagccccctcttctgtggccaggccccagccctgtgaacagccaggctgaatggcggtgagggagagtggttggtgtacataacaattatctgcagtagtcgggggctgcacagcacagggtgcttccagatgcctacccagccccagactgggttcacctccaagccagtaaaaccccggactctccaggggcacagggagacccttggatttccattgcagccatgcacagccccaggctgcccacacctggtccaaggggtcctggggccccaactcccaactgtcctctcccttccagacaacctttcaggacagaggaggtggcacggcacagctgggcagtgggacagctgacctgggagggatggcttagccatgtgttctgactcttggaataccttcaggcccaggcacctgctgggcattccagcacagctctggccaccatcgggacgcatgtgctgggcaggtgatccctgtggtgcctcgtcctgtttccatcatgcctctacagttagactctctggggaatcatgctattcattaagaataagccagaatgtcaggtgtgcagtgcactggtaacactgctttatctcaggtgctaatgtgggtcttcttggtaactaacggagtgtgagctgctgacgtgtgtgtgacggatacatcagcagcacaggagatgcctgggctccaggctggccatctcagacaggagcgggaaatggggagcctggtcgcggtgtgtggacctcctttatggctctccaccttctccagggcctctcccgacaagtgggtgtgtgggtacccctcacctttccagaatgattaatgcggggaatttctgtggacgactgtcttctaaagacaatgactacaggaacataatgccacatacacaggtggcccagccctgggacactctggggaaagatccggcatgtgtggttgctggctcctcagggtgcttcttcctcagggtggatgaggcccctgtccactgatcccaaaggctgggagaagcctcaagcagcatcgtctttgcaggcctctctgtctgaacttgggcaaggcgatgcaggtccatcctgacctggtatggtcatggaaggggcttccaggagcgatcgtttgcaacctgctctgtgctgcatttcagagaacgcctccccgagtgagctgcgagacctgctgtcagagttcaacgtcctgaagcaggtcaaccacccacatgtcatcaaattgtatggggcctgcagccaggatggtaaggccagctgcagggtgaggtgggcagccactgcacccaggctgggggctccatacagccctgttctccctctttctccctttccctactgctcctgccctgtttcctgttctccctctttctggaagcctggctcaggccccagcctggagcttgtgtctagctgagtccacgggctgagtggtcactttccatcagaggggccccgcgctagcggcactccctgggcccacagggctactcagaggtctctggtgtgacactgccatgtgtcctcacccagttcggggctgggcccgtggggcagggagctctaggaatggacagtgcatcctgggtactagggtaccctgggtaccacagggcaccaggtgtgctgtgacctcaggtgaccccagccccgccctgcatggcaggaacattgtcaccatttctcagataaagacccaggagaccagcctggtttgttggttttccaaaccaccatgctgctcaggggcttcccagcatgcgtgtgtgggtgtgtgcgagagggatagggaacccaaacaccgggagtgcgcagcaggcactgtggtcggcaccagtagagttggaggctgggcctgggacaggacaggtgggaacagggagcaggctgtgtgcagagcccagcgccaggcaggaacccttgcatctgcgcaggcctctgcctccatcagcatccccagcctgcactggggcaggacccaggaggcaaaaaggcttggcgtcctagcatcagggaggggtgcctcccagggcagtgtcgcctgcctcaggcacctcgagaaggaggcacccacacgagcagcaggaggcagagagcaagtggttcaagagaaagctgaggcttcaaggtctgcgctctccacagagctgcagcagtgctgcctgaggcagggctgtgtccacccccttactcattgggtggccgggcctggggaccctgcggcctcccacccctggctcctggaagacccaagctgcctgacccgcacgcccagggccccctctctccgcccccaggcccgctcctcctcatcgtggagtacgccaaatacggctccctgcggggcttcctccgcgagagccgcaaagtggggcctggctacctgggcagtggaggcagccgcaactccagctccctggaccacccggatgagcgggccctcaccatgggcgacctcatctcatttgcctggcagatctcacaggggatgcagtatctggccgagatgaaggtgcgtgcatatggctctgcacccagccagccccggccaggccacaccctgacccaccacgcccctgccacccacaccctggcctgccactcccccaccatgccacactctagcccaccatgcccctgccatggcatgccatgctatggctcaccacgcccctgccatgtcacaccctgactccaccacgcccctgccatgccacacccccggcccaggtctcaccaggccgctacccgggccacacaccacccctctgctggtcacaccaggctgagccagtgaccgctgctgcctggccatggcctgacgactcgtgctatttttcctcacagctcgttcatcgggacttggcagccagaaacatcctggtagctgaggggcggaagatgaagatttcggatttcggcttgtcccgagatgtttatgaagaggattcctacgtgaagaggagccaggtgcccagtcccggggatgaggcggggctcccagggatcccaggtgcaccatggggcaggcagtgcccttgggaagcctaggaaagataccgaagattagtggagctctaagctttttatagccctcaccccaaatctttctgaccctgggtccccaaggacccaattagaactccgctcagcctctgccatgtccttctcctccagggcctccagggcacccctccctggcagcatactgacccgaggcccttgccgcacttttcagaggccacctcatgctgcggaactaacagtcctcttctgcagaataaaggtcaccgttctgatatgaccttagctcttttctcaaagaagggtgggatgaaattagcaggatcgtcattctttgcaaaaaggaatgaactgctttacaagtgaggcttctcccgcacaggggccttggacactgggctgggtgagtttagaggcataggaaccccctggacaggatccagaaacgcagcccagctttgtccaagtctatgaaacaggcagtgggcacccttggggacacctggttccctaccatggtcctagtcccgggacaactgccttggccctcttagtttttctgcccatgtcagcccctctcctgcagcctcccagtggcagcccaggcagggcaagttcaaggggctgctcaaaggccatgccgcccagacgttcagagcagaccctgctcaaaaaagaagaagaagaaaaaaaaaaaccacaaaaggcgacttcctatgattcagctttgctctgaggggtctggagaagccatttgtgttgccaggggttgtgagctgttccgtttcttctggggtttcccttgtgacagcagatctcagaactgctgtggggggaagtggtaggggctggcccctgccctgtggagggtgtggacagagccttcctgttgatgcactggtcctccagggagagaagctgaaggcattcttatacaagacgtgcaggctacactgtcacacactgctgccaagacagccacactgcactaaggacataaatccctcatgtgtttaagtaaaagaagtgacagtaagattgtgttccaacccaaggcacacattttaaaaatggacttgcaccttcaggcttgtctgtggagaagctgtttctcaagtcaccctggaaaggatttgttaggtcagaccccagcactgatgagggatgtagggggctgggggcactcattcagagatgctaaaagcaccctgcaatacaataagagagaaaaaacagcctcccccaaggcacacagacaaatcccttccctcaaggctccttcagtgtggtagctgctggcaaagtgcccaacatggaaatgctagatgttggtttcccaaacacattggccctcagaaccccaggggagatcttgcagggggagttccaggcccatgcatagggaagcactgctctgcactaccagcaggcctgtggcatgtgacaagctggccctgtgtgcctgtgggtgggcagctgactcccgccagcatctcagcaatccacaggaggttcaggctggagctccagccccttcaaagatgtgtgtggccagttctgtgcccaggagtgtctacagcactcctctggttactgaaagctcagggatagggcctggccttctcctttacccctccttcctagagagttagagtaacttcaatgtctttattccatcttctctttagggtcggattccagttaaatggatggcaattgaatccctttttgatcatatctacaccacgcaaagtgatgtgtaagtgtgggtgttgctctcttggggtggaggttacagaaacacccttatacatgtagtggggccacgacgcccgtctgtgcagcttggccagggaattgcactggccctgagcacctgtctgcagtgctagccctctgcaatgaccccctcactgaggggccttcatgatgtgttcgtgaggcaaatggctgggccaggccgggctgcagttctgaaagctccggtagagcatgagagccgagcaggtggccagtaacccagcctcccccacccttgctagtcccatgcctccctctgggtcccttggtgactcaggcccagcccagcagttaccctcctgtggtcctgagtagggctttgggctcaggcagagcacccagtgacttgcccccacccacaagtggagcttggggactccacctgaagatggccttgtgtgagtttatagattggtgtgccccaaactgctcaaaggtggaagccaaaatctcattcttccaggtccaatgacaagagctgatcacttttaaaacacaggattcttgcctctaaagtgttctacagtcagcagaggtgtgatgtgcctctctttttttgtggggggaggggatagggtctcactctgtcacccaggttggagtgcagtggcgcaatcctggctcactgcaacctccacctcctgggttcaagcgattcctgtgcctcagcctcctgagtagctgggattacaggcacgtgctacttcgcctggctcatttttttgtattttttggtagggacagggtttcaccatgttggtcacactggtcttgaatcctgacctcaaatgatccacccacctcagcctcccaaagtgctgggattacaggcgagagccaccacgcctggccaacatgtgcatcttaaatactgtgggctgtgaataagcaattggacaacagctttccgattatataagctgactgtaggctagttggaaaaggcagagaaaagcataaagaagagactgaatgtcattggaccacaccgcccagtgacctctggctgccctctggtgtgctccgtggtgtgcacatgtatgctttttattgccctaaatgggctcatgcgatgctgttttgtgatatgattttgttcccattgcaaagcgagttttccttcacagttaaaatgtttttctatagctttttttccttctaagattttatgaaattttccaagcacatagaaatggcaaaagaactatacaaggcactctgagtctggtggcctgcattctcaccgctttaagtgtgagaatcttaagaattattaagattaattcatgatattaattaatgtatcattaattcattaatcatgaattcatcttaagcctcatgtgtcccttgtgcgtgtggctgctctgatgggagtggcttgggcaaggacttcagcttcatggagtaggggccaggcaggcaggcagcccttccccaccttcatgctacatccatctgagcagccagacccaggctgacatctgtgagcatctgtgcttgaagccgacagggtcagcaggtgcttggtggtgggggtggatatctgggccccccggagggctctgtgagggccaggtggagccactcactggtcctttcactctctgcagatggtcttttggtgtcctgctgtgggagatcgtgaccctagggggaaacccctatcctgggattcctcctgagcggctcttcaaccttctgaagaccggccaccggatggagaggccagacaactgcagcgaggagatgtgagcggggactggctttggcccagcctcacttgggaagggaggggacatctgtgtgcattccctccccatccagagcagccccaggagaaaccaggagaagtggggggtggggagtgggcagggcagaggttagagagccatccttgggtgtggcagtagatgctgggggtcctaccccactgagggctggtgggcttcctagggggtcttataaaaatgagtgagagcagagactggtgcaatgcaagctcaagggctgagagctgtcccagcaggacacttagggaggagaaggtaattccagatggcccagggggcacgtgttaaggggtgcctgagtggaggtgcagagccaggcaggggcagcctgggctgcaacctgagaggttgaaacctttacactctcaggggagatggtcttagaaaccaggctgagaacagatgagaaagggctgcccagaggcagagatgcatggtacatgcattccacagagtgtgcacactgctggggcgtggagggggcatgctgggccgagaagccaggtaccacctccctgggcccccagctggtggccagctggagcgctgtggtctgcctgggcacccaggcaagcaaggacggtgcaggacagacgtgtgattgccaaaggttcttgtttgtctgtctccacacctaaaagccctcaatcaattcattcttcttgagagttttaaggactggcacttctcacttagctgccagagcaagcatagtatccagtgagctgtttaccagtgtctttgcaagggaagtaaaaatgaatctcccttggagggaagggaagcttgtaggattctggaccacagctctgagagacctgagcacagtggcccacgggctgggatcctgcaacaggccatgccccagtcccacgaggctcagagatgtcagcgatgcagaaatagctttggagttggagacagagcacactgggcccagggtacagggcagggtgcgatggctgtggtgggctgtccttctgagacctggccctgcttggatcatattggcctgtctgctcttcccaccaggtaccgcctgatgctgcaatgctggaagcaggagccggacaaaaggccggtgtttgcggacatcagcaaagacctggagaagatgatggttaagaggagagtgagtgcctgggtccaattcccacaagctgaaagtggcttggggagactccagcctcaccccagggcagtagttttagccctcagagttcccagtgtggggccacagtgggattgtgcagagagagagagtcatgctctcccctgcatgcagacagcagattgaacccttctcaggccaggccgcttgggcttcttttcaagtcatgaagaaaccaagattcttgacatttaggaaaagctctctacagacaggcatgggaggaaaatattccaaagccaaaaagaaatagttttccataatggaaaatgagaaagttgagttaaagcaagtgcccaaaattcagatgcccagaggggggtccggctggaggagggcagtgagtaaggagcagtggagactgtggcaaacagccagccccctccaaagggttccttgctggagtacctgtggcctgcagaaaaaggagccaggaatgggctgggtcttctgaattttatgaggtttatgttgtctcccagtttttattgttaacaattcatttaaatttcccagagccgaacgcaggccaaacaaagcatatcggggggtggccagagtcagcctgtgtgcctggaagtacagtttgtgaggtctacacattttcaaccaatattcatcaggcagctgctaggacccatactatgtctcagaggctgggaatgcagataaacaagaccagcacagccctgccctcacggggtttacacacaggccttgtcttaacattggcacatttactgagttgtcacttcttccgacttggatagcgggatgcaggacctaggaccccataggaaaacttcacatcactgtctcgcttggatgaaaacttcaagtcctgagaatgcagcgttgttcaaaacagaagcgatcactggtgctggccttcctagaacagtgctgagaaacagccgggaaaacgctgggcccctctgtgcacattcaagctgggcattgaaaggagcagacgccagtggcccctcgtgctggggagcccgtgcctgtagcagggtcctgtgcaccctgacagcgctgtcagatttcagaactcagccctgacgtgacgttctagatggcaggggtccttggggaaagctggaaaacatcctgcaggctggggctgcgtcctggcatgtggctgcagtgggctcccccagagcccaagggtttgtcagcgggctggttccgtgctgcccatctccgggttgggccaggggcagctagatgaggcgtcccccaaggctgccctccaggccctggagataagacgctgagggagcacatttctttccccagggaggtgactttccaggggaagagacagaatagacaacacccaggggagtgatggggacctcagagcaggaccaggccagccaggagtcctgggagctctatgcagcctggccctggtctcttggagaggtcaggagattggtgcgaggtggagacacagccagagcctctgccctgaggatggcttgttgtatactgagttgtatctagttgtggcacatggcttggagtgaccggccatctctgtcttccaggactacttggaccttgcggcgtccactccatctgactccctgatttatgacgacggcctctcagaggaggagacaccgctggtggactgtaataatgcccccctccctcgagccctcccttccacatggattgaaaacaaactctatggtagaatttcccatgcatttactagattctagcaccgctgtcccctttgcactatccttcctctctgtgatgctttttaaaaatgtttctggtctgaacaaaaccaaagtctgctctgaacctttttatttgtaaatgtctgactttgcatccagtttacatttaggcattattgcaactatgtttttctaaaaggatgtgaaaataagtgtaattaccacattgcccagcaacttaggatggtagaggaaaaaacagatcagggcggaactctcaggggagaccaagaacaggttgaataaggcgcttctggggtgggaatcaagtcatagtacttctactttaactaagtggataaatatacaaatctggggaggtattcagttgagaaaggagccaccagcaccactcagcctgcactgggagcacagccaggttcccccagacccctcctgggcaggcaggtgcctctcagaggccacccggcactggcgagcagccactggccaagcctcagccccagtcccagccacatgtcctccatcaggggtagcgaggttgcaggagctggctggccctgggaggacgcacccccactgctgttttcacatcctttcccttacccaccttcaggacggttgtcacttatgaagtcagtgctaaagctggagcagttgctttttgaaagaacatggtctgtggtgctgtggtcttacaatggacagtaaatatggttcttgccaaaactccttcttttgtctttgattaaatactagaaattttttctgtttcctaacttcatcattgattgtttgaaatcttggagtttcaagcatttttttcaagctgagacggttccttttgcatgcctcctgactcactgactcctcactggctttgtgtctagtgccacactccatttgtgctgacgatgctatgaggctggcccgtgtgcaccctcgatttggaaggtcctcttctccgttgtaggctcagacaacagacgagtgcctcctttacgttagagaatgttttatagaacgtttccgctgcagtaagccattgagtgcagcagtgtgctgttgccctacactgccttagaaaaagagttaagcagttcgacaaatatacatcagattagagagtctcaagttcataaaagtcaaaattggtagtgtctgttaagttacatttaccaagagagcacatgatatttcccctaactataacagtgtttttggaaacctggaacacaaaaccattaatataattggcacagaaaccacgagtttggtttgaacatcaaagggagttttgccaaggccttactgtctgcacttgaagttttggttcttcagtgcagaacaaatgatctgttttcatttttaggcatgtcagacccgaactggcctggagagagtcctgtaccactcacgagagctgatggcactaacactgggtttccaagatatccaaatgatagtgtatatgctaactggatgctttcaccctcagcggcaaaattaatggacacgtttgatagttaacatttctttgtgaaaggtaatggactcacaaggggaagaaacatgctgagaatggaaagtctaccggccctttctttgtgaacgtcacattggccgagccgtgttcagttcccaggtggcagactcgtttttggtagtttgttttaacttccaaggtggttttacttctgatagccggtgattttccctcctagcagacatgccacaccgggtaagagctctgagtcttagtggttaagcattcctttctcttcagtgcccagcagcacccagtgttggtctgtgtccatcagtgaccaccaacattctgtgttcacatgtgtgggtccaacacttactacctggtgtatgaaattggacctgaactgttggatttttctagttgccgccaaacaaggcaaaaaaatttaaacatgaagcacacacacaaaaaaggcagtaggaaaaatgctggccctgatgacctgtccttattcagaatgagagactgcggggggggcctgggggtagtgtcaatgcccctccagggctggaggggaagaggggccccgaggatgggcctgggctcagcattcgagatcttgagaatgattttttttaaatcatgcaacctttccttaggaagacatttggttttcatcatgattaagatgattcctagatttagcacaatggagagattccatgccatctttactatgtggatggtggtatcagggaagagggctcacaagacacatttgtcccccgggcccaccacatcatcctcacgtgttcggtactgagcagccactacccctgatgagaacagtatgaagaaagggggctgttggagtcccagaattgctgacagcagaggctttgctgctgtgaatcccacctgccaccagcctgcagcacaccccacagccaagtagaggcgaaagcagtggctcatcctacctgttaggagcaggtagggcttgtactcactttaatttgaatcttatcaacttactcataaagggacaggctagctagctgtgttagaagtagcaatgacaatgaccaaggactgctacacctctgattacaattctgatgtgaaaaagatggtgtttggctcttatagagcctgtgtgaaaggcccatggatcagctcttcctgtgtttgtaatttaatgctgctacaagatgtttctgtttcttagattctgaccatgactcataagcttcttgtcattcttcattgcttgtttgtggtcacagatgcacaacactcctccagtcttgtgggggcagcttttgggaagtctcagcagctcttctggctgtgttgtcagcactgtaacttcgcagaaaagagtcggattaccaaaacactgcctgctcttcagacttaaagcactgataggacttaaaatagtctcattcaaatactgtattttatataggcatttcacaaaaacagcaaaattgtggcattttgtgaggccaaggcttggatgcgtgtgtaatagagccttgtggtgtgtgcgcacacacccagagggagagtttgaaaaatgcttattggacacgtaacctggctctaatttgggctgtttttcagatacactgtgataagttcttttacaaatatctatagacatggtaaacttttggttttcagatatgcttaatgatagtcttactaaatgcagaaataagaataaactttctcaaattattaaaaatgcctacacagtaagtgtgaattgctgcaacaggtttgttctcaggagggtaagaactccaggtctaaacagctgacccagtgatggggaatttatccttgaccaatttatccttgaccaataacctaattgtctattcctgagttataaaagtccccatccttattagctctactggaattttcatacacgtaaatgcagaagttactaagtattaagtattactgagtattaagtagtaatctgtcagttattaaaatttgtaaaatctatttatgaaaggtcattaaaccagatcatgttcctttttttgtaatcaaggtgactaagaaaatcagttgtgtaaataaaatcatgtatcataa

SEQ ID NO: 1561 - DNA, 72385 bp, Homo sapiens
ggggagtgatgtattcttttattgaagcaagtatgtccagtcacaccaaaactgacgtcctgcattatggtacagcttcatactcagagttcatctcaaataccaaaacatcaaatcagggtatgtatcaaattgggaaaataaagtagcagacagacactgtttcaagtaggtactagaactgatcacccgtgaagtgcacgtgggtgtgtacagaaaccgttctaaggctgtattccaaatatatattctcaagttttaagcctttctcatctcaaagacataaacaaagcaatatgtactatcaatatacaatctgtactagctagaacctcagaaagtgcaaacacactgtgacaatacagtggaactattcctgctccacccaggaccagaggcatgggcagcgggcccagggctgcctcctccccaggcccagcctttcccaatgtcttcaggctcttccaggagctttgggaattgggacctggcccatcctcacccaggcttccccattgatcaaggctcctgcggaaactgggaatgcagagggacaaggatgcggagttcctgcgagggagacggtccacgtggattgaccgtgtgctttctgaaggacagctgtcctgcgccatggtcagtagggcccagggctcacaccacgaagtcagacatgggaaaatggagtgtgctcctctagctgggtgtagaaaacacctctcagtattgggcagttttatctgaatgggctccagcagtatggcctggcgaattttctgtttccaattccaattagggcgctgcctacccaggtgggaagagggctgttggctgccctcccctctgtagatgataggtttcaagactagctctaaatgtcaccaccctggagtcggccatgtatttttcttcatcacagctcagtgtgtctttcagtcacagcccagaaaactgacaactccatgcttccctcccttaccttattttagatttcctcctttctaaaatgtagttgaagaatgatttgctggacacattgtcacagaaaatatgctgccaggtgccccctgcccctccctgaccccacaaatccctgaaaggaaaatgaaaatgtaaactttggacagcccgtactcaaaggctcacttccagaagtgtgcggacgcgacctcccagccaccagccctcctatggagcctcgcagcccaggctcctgagggcaggcgcccaggtggagtgggactcaccgcagcccaaaccacagagcaggaagaccagaccccagtaccctctaaggcactaaccccgacgtcagagacactggctggaaaggcgtccgagcaggcagggctcacgttggttttggctgggttttttaaaatatttttttcataagatgttaataatcaaaagtagaaaataaaaatctacatttcattagaataagatgttatcatggataccatctcccatgatactctcccctccccctccccaaagcagggccctgccctgttatttaaaataaacaaaaaaaactttgtaagtgccaaaggttgatgcgtgaaataattaccatttttttctcataaaagttatatacaaaatggaccccaaccagtgaggcctcctcatctcaacccacatcagtcaaaatttaaacccagttagtgcacgtgcttcctctggcgtcgcgggctgcatccgcctcaggctctgttcagaagggtggtcctagagggggacaggacaagcagtgctcaggcccgagcagggcggcttgggtccaagccatcctcagcctcccaccaaacatgcaccagggaccctggaccagggacgcggcagtgcccaggctccctttccaggagggtaaccctcgtgcccaccctgagtcctccctcttccttacagactcccatgttcctgacgccctcctacctgagggtcttccagctgtctttttccatgtggttctcgggaccctcactttcaaaggaggcgacgaagagagctgagagatgggaaagtccctcagagcctgtgtccccatgcagtgtctgcctgaacccagctgtcccttcaggagtacagcccagcacaaggggacagtgacctctggctgggctgaacacagttctctgctgtgcggggctctcaggctgcctgttggggactctaggaaggttcctcgtgttgcagcacctgacctaagcccatgtgaccctctccagtggctgctggaaactgagtctcttgtccttctcttccatccatcccatgacccaccctcatgcacactcgcccctgcgagcagagccagccctgtgtggcatggagcagccagcaggccatctcccagggcaaccccaaagagcaccgggcctggacaaggagtcaggtggggtgggaggcatgctgcgttgggaggcagccctcaccttcctcgctgtagatgggcgccgtgagcaggtaactctgaatcttcttgtccttctcgaaaggacactctacctgtgtccatgtcatgaactcatggatctgtctggagatctcccagaatttctgaagggagcaaaaccaactgatgttcatctgtcaccttaagcaccaaaccctcggtcagggcaggggacgtaggttttggcctcagcctcctgctcacttcactggtcccagcaagatgggacagtggccctgcacgctgaccccgtggccatggtggcacgccatgcagcctcagagccagcaggtgtcccccaaggccactctgtctggccctccacctgggccatcaggccggcagcagggtctctgcctgtctgtgcagggacccaaagaaggccccactgataactccagcctgaggcaggcaccccatccaaacccagcccagcggcgccaaccagaacgtgtcatgatgtcccttctctgggaccttcggaaggatcccagctcctgcccacacctcacctgtgtgaggtaggcatccggcagcccacagccacctacacctgccctgccacctatgtcccaccctcccatcctcaccaggtgccctcaggcccacgaggcaggctcttcacttccatctagaattctctgccgcctcctccctgctcaagtcccttcctatctaaacccctcctgacctccaatcccacaggggtggacagggctctctccctggtagggccaggctggaaccacggtcctggataaatacaattccctgtgactccaagctctgcaactaggccatccacccagaagtaccggcaggcgcacctcataccttgcagtcaaacagcaccccgtgacccactatgaggctttcagtcttgaaggcccttgtgaacctcaggcagggctcaggaaacccacagatcccgacccagggctaatgcctggcggctccagtagctcagacagtttccgcctggcctgccctgtgctgggatgagctcaccttaaagttaatgtgcccgttgggcaggtggttggtatggattttgtgcaggaagtagatgtccttaacgaagaggttgaacacagggatgacgatcttttcacggctgctgttggccatctgggacctctgcgtggccccctgcagggctgtacggtagttgcagaagttgctggacgggtccatgtgatgctgtgggcacagggaggacctggtgagcatcacagccccatgcccctccgacctgctccagatgcccctctgcagagcaggaggcagcagacagagaaggcacctggcccctgggcagcctgggagttagcacgggggaggggacgcccaagggtgcctggctgagccctggggccagggcttctgagttcaggtcctggcatcctctggaaagccacagaagtgtcactgccctgcctgccaggcctgaccctcgccctccttccttcaagacttccctttgctcctctacttagatcaacacctcccagacctgaccagctccacaagacacatgctttgcaaaaatggactctgtggtcaaacacatctgaggaaggctgcaggtgaccctgtctgccagcctctgggccatctagaccagccaggacctggagacactgaccaaggaaaaggcagtgtcttccaacacaaccccactcttgtcaaactcttgcttaaccgcattccactctggaactcgccttaggtgatgccgggtctgcctgaagtaaccgaggacaacttaagtccccactgctggaggacgaacatgccaggccagctcagccagcactgtaggtgctagccccagggagaggagggcagccccccacccccactgtcagggcccccttcgggccattgcgggacgaaatgggtgcagctcgcagctgtgacggggctcaggtgcctacctccaagacatcaaacttggctgtcttgaccttggaccaagttttcttcagccttgccacaggactgaggttcatgccagctgcagaggacagcaggtagggtcagggccgggggggtgggccatgcagcagccccaccctgggtgcccagtcactcacagatgatggccatcatggagttgaagttcccgatgttgaagcactcccgggccacatcaatgaagaactccaacatgcgggtccggtgtttcttcttcaccacctggaaggtggcaggtgacctcagcatggcgctgccgggggacagcaggagctggggccgccgggcagaggaacagaggggcagggaggacctcgggacttagcttctggccacagcgggctgatccaggtccatggctgcgtctgggaggtccagacatgtgcacggcctatgctcaggctcctcagtcatcaaagggaaggcaccatctgccccagagggctgtgagggctggcaaagcctcacacaggcaagaaaaatggtgctgggcacaaggggagcactccacggatggggtgtctgttgtcattgaaggaatcgctgtatgtcggggttgggggaccaccaaggccctgacaatgcaacagggactttgtgcattcactcttaaagttccatcatctaattcctggggcaagatcagggtctcactgggtgtgggcatggcagccaccccaccatgtctgccatgggcacttacccggcacacctcagtggccaccagcatgctcaggcagttgaaccagttgtcataggcctccaggctgtaggtcttggtcaggtcccctcggcactggaaaggacacagcaggtcatagggggcctggaggaccatggctggacaacttagtccccacagctggccctggtccccagctatggctcagcctgcaccgcagcagcctcaatcatgcctgcgtgctccttgctgcccagtgcagggctggcaggccaggctggctccctggcccaaatctgtgacctctcccagcattcatcatccatgaccagcacagccatcttggagcaggtgctgcctcttgaagcaggtgctaggaggtccagtgccacatccatcggggctcatggcccagcactccggagacgctcggggcgtgctgagtgaggcccacacccaccctgcatggagcgcaagtgctgggcagacagggctggcaggggtgccacaggccttggcccacttaccctgtggttgtccaaggagtccatgtggctgacgatctgcatcaagtcctcagggtaaatgctgctgaccctgtcctggggtggaagatagcaaagggaaggtgacaagcttcccctggagaagggacagcactgcataggcatgcggacagggagaggaggagctgcccagggcacaggaccttcacctcctcccaggccagtcctccatcctagggccactgcagtccccactgcaggacgacactgctccagctcctcccactgacacagcactgctgtgttcctgaggacgtgagtgccaggcacagaggtgcccgccactcagacggacacacatctggcatgaagtgtggcagtcagggctggcaagcgcacttccctgatggctcagtgtgactagcaggggcctgaagtgctgtgctgaaagaggcactgtggtcccacagcccccacccccagtcagggcataaggcagcactgaccagctcaatgtgagtcagctgctgggccagcaccagggggtcgcagcacacgcccaggatgtccttctgggcggctggtggcttggtcttgaggatgggccccttgtctacagccggtggccggagcttctctcgcagttcctggagctggctccgggcagccaaggacagcaacaggctctgtgtcatctgggcaatggccttcttcactgtgccattctcctgtggggtcaagggcaataagggtgccagcatgggctggcagcaaggccaccaccactgtgggtaggatccatctcacctccagggatgtgcctaaccaacgtgagcccacagcccctatctaaaccgcagccttcaggccttcaaggacaaagtggggcacagcatgggctcctctgaggactgctgaggaggggtctcagtgggctgtcctgctgcaggacgaggctaagggcagagacaggctcaagactgagcttctgggtctgaaaagcatggctttttcagaggcggcccactgagctgcttcctgaagcaggagcagcccatagaacagtttaaggcatgggaaaggcttctgccaaagccaggagtctctgccccctagttgggagcagcctggggtccctggctcctcctggagtactcggggtgaacaggagctgctaagcacagggaatgcttccactgtggaggcccagttggcccaggcatctccagttctctctccaccaaaggcaaaggtgaagacatttgaaaaatgggagaccggtttaaagccttacccccacctcctctcactaatccaagacaggcagagccttacaaactctcaataggctcccactccagggacaaggacagcaagggccaggagagggttgagacaatgattgccaggcccgcaaccgggctgcaaggtccctgcttgcagtatcatgggtgaccctggcccactgctggccagctgagctgtcatctgggggaagggaggttgaatggggccagccagcaaccctcctgggggagtaacatggaaggggaccacatacagagttgtccccgaagcccccaccctcccgagggcagaccctggcacacacccaaagaccctggccagagcccagggagcactcacctcatcacactgggtgacacggtgtgtgatggctttcagctcggccatggccttctcatcctggaagtcataggggaaggcctcggtccactccttcaggagctgcacgatcttggctgagaaagacttcagcttggcctggggcagcaggggatacagagtaaggccccacagggcagagtagggtactagatggcaaatggtgcaagcttcccacatccccaagccacaccccaggccctgtgctgggcacagcccccaactgcgtgccacctgcggtttggccaaacctgaaccgccacatgactcctgtttggttccttcttccttccccttaagttgactttctttttcacttaaataaacttatattaaaaaaacccaccccatctctaaggtgacaaaaaactaattccatttgctataattagaagttacccataaaagcaatacagtaaaataacccaagccaagccatccagttagaggagagctcccgtctgccccctgtggttgaaagggcgacagcgctgaaaggggtgtgaccccgaggggaggcgacgcgctcccgcgccctagtccacaggcatgcacgaccccacccagcacagggcctagggcatggggactggccctcttggctgaaacgactccgaccctctcggaagatgcccgcgcggcctctgcccccggggagaggggactgtgcccgatgctcaggcgccgcgcccccatcctccaatcccccagaacgcaccacaggccaagcccctcctgcgccagccaagactccgcgccagcccacaccagccccactcagaccgctggaccccgcccccggcccccgcaccacccagcccgcaactctgcagctttcttcgcccacgccgcacagcctccaaaccagcggattccgcccacgttgccagcctaggccccccaccacccgctcccaccacgcccctaacccggacccaacccacagctccagcccagacctcaccccagcctggtgtggcgtcacgccccaactcagacccgccccacagccccagccaggccacgccccaaccctagccctgaccccgcccccaggccccaccagcccagccaggccatgcctaaccctagcactgaccctgccccgagaccccacagccccagccaggccacgccccaaccctagccatgaccccgccccctggtcccaccctggaccccaccctgcagccccagctaggccacgcccaaccctagccttgaccccgaccctgccccagccaggccacgcctcaaccctagccctgaccccaccccctggccccaccctggaccccatcccacagtcccagccaggccaagccccaactctagccctgaccccatcccccagctctaccgtgaaccccgccccatgcctccagcccctagccttgacctcgcctcctgccccctgcccccgcccgtgccccagccaggccccgcctcaccttttcaggcccggcttccagctgctgcttctgctccacgcagatctgccccacgcgggccagcaggtcatgagggggcataaagacccgggagctcaggagaaaggtgaagatgtacgtcctctgaaggcaggagacggagagagggcggagggagggtgaggcaggcccccgggggctcaccgcgctgcttcacctggcccggctgcctcccaggcccagcaccgccggtcccgaggccatgccttcacctgcccggttcccttcgccttgcaggcccttcctcctcttactgctaccccggccctgcctacctaggaggcacggctcgagccccgcctcccagcagctctcccaggcctcctagcagtcttcctccgctgggattctccccctctctgccccacgccaccatagggctaaccccagcctgggacgttggtagggctccatggtgctcgctgcgccaggatgcaagccagctgctgtttcagatcctcgtgggccgagctggaggtcagcggtggggagggtgggggatgcagggaggttggcacaggagcggggcctgtcgggagcagggctgatccatggggcggggcctcatcagcaggggcggggccccatcagcaggggcggggccccatcagcaggggcggggcctcaggggcaatgctggtgggggcccctgcactctctgaccagctctgggcctagaccctgactgccagagcagggcccctccataccacatccacgtgccttccatcgagatcctcgtgggctgggttcttgggccttttgtctaatgagggtcaatgtctgtgggaacttcactctagctcctgcttgtggacagggtagacttgcaggttgaggagactgcctagggcttcctagagggactctgccccacgtggctgctgcaggctgggctgcccagaagcctctgcctccactcccagcccatataacccggtttttcttgccccagccagaagcaagccaggttgtgcttgctgggagtacaggcctcctggagcaggactcaggggcctgggctgacactgcccaccgcagccctccctggagcatcagggactcctctaacatcctgcaaacttcccacaccctgccccaggctatgcagcatggcgaattgaggggtcagaaccagcacatctctcagggtcccccttctaaggagacaactaagacgtggaggaaaggcccaccatggagctcttggccaagggcagggcacccaaggggagagcctgtgcatctccaaggaggagcatggagaccatgtgtgcatgtttgtgtgcatgtgtgagtgtgttcagctaccggtgcacatggggaagggtggggtggcgggggaggggtaggtgctcggcagaggagccaatgcccaactggagtctcgtgggaagctggtcagatctcagggcacagggaccacactgggtgaccgccaaggtggctcctctggggtaggcctctgagaagggtggcttctccagctgtggcatgaggcctctgccccacagacggccctgccctggactacctcagggccttgggcccctcccctggctctgccctgtgggcactcaccagcctgtctgcactgccatctccagccccagccaaaccctgacagggcttacgggacagacagaaggacagatggaggaggaggaggagtgggcaacagaaaggcaaggccccctcacccaaagcccaggaaggcagtggaggtctggcaggtggtgaagccaggctgactgcagccccgttcagtggaagctagagggcagcatccctcccgcccacctccctgcaagctgtctgactcccaggctgacaagcagggcagggagggagaggggatagcatgatgcgggcaggactggccctcccagagggtagatgctcagctcacaagagggagctggcaggcccagtgccactgctgctaagagacatcaccctccagggggagggaaggcacacttgacaagggaacactttctctgttccaagactgtatcatgccaccttgaggtgaaaagggaggattagggttgttgcctaagaacagtccccgagtcagcctgaacagtgctctgctgacagggcagggcaggccgggccatctcctcttcattctggaccaccagggtttatgtacaaaccagcttcccagctcagccctgggctccaggacctcggctgggcgtgccctcgccaggaccccaagtgctggctttgccctttaaaactcctcttcctccttggaggccctgctcagaactcagggccctgctcggcccttgtgtgtttctgcttcccgtgtccctaggatcatctcctcctacctggggcagcagcagggaagtcacagcaggttcccccaggccacctgctagctggtggtgtatgcagagcagaaggcagagaaggccctagaggtgggcctgggccccccactgccctgcccctcctgcagccctgtccagctctaccactctgtgggggcctccctcccacacccgacatctcctggagcccaggtcaccccattagtctcactccacaaggccccacgtactcacatcggggtaatagtccaccgtgggaacaaggtgctccatcagggcctccagggacccagagatgaggtgtccatcttggaagatgaggtccccggagccgccaccggccccgcctccacgctcccccatgccaggctgcacctgtccgctacagctgggcccaaggatgctggagaagacaacggacgtctggggcatagtttcctgggagaaaagagcaaggacatgaggcatcaaaggcgcctccacagctccacagaccctcctcccaggcagcctgcagcgtgcatgcatgtgtgcaggggtgcgtggcaggggcgcagcggcactggcagagggcacccccattccagggcagggcaggcgggctccttggtggtcccccagccgctgcacatctgatcactgtgtcttcagctccctgtgggccagacctcattccagggccctggacactcaaagccggcagagaagagaaactctgggaaaaatgtccaagaagggacagggagcctgcggtgggcagtcagggctgcctggggtgagagggctgtgaacaactgatggggctggccgcgcagctcccaggataagaaaggaacaccctaggcatgaggtacagtgagtgccaaggtcctgacccagagatgtgtgcagcggggagctgggaggacagtctgaggactcagggccggacacacaggctgcatgtgctgcttcactgaggtgggagcctggggctctgagcacagtggtctgacttacggtggctgccacgtggatggtgggtcttgccacagcccaaggagagcttgctcaggcaggcggtagcaggagtggcgagcagggccactccacatggtgaaggtcttgggccaagtggctgaccagtatgaggcagggctgtgggcagggctagagagagatctggaactggctttggggcctgtgagtctgagtgcccctgagctgcagatgtctgagcagctgggcctcctggaggcctcggtgcccacactgggactgtcctccacagcatggcccgctgtgatggggctcagggtctcaccacaccctgcagctgggagttcttgtgaagcctaggggagtctgaagccctctgggcctgtttccccagtgccccagacagccagccatgcctgggaggagccaagtggggactggacgatgcagcaactgccagcctgagggccagaggtggcctgcctgtggccttgcctgcacacagagccagcctcaacctcctggccctcaagggaaggcagcacaggtgccagcggctgaggtcaggtggagaagcgagaccctcctgccattttggccttagtttccccactgcacagagcaaattgttgccatgattacttcagtgccatgacaggaccgtgggcctctgccctgtaggggccttacaaggagagagcggaccacctgcccacaccccccacgtcaacacacacacacacacacacacacacacacacacacacacacacacacacacagcacgtccctgtccctcccaccagggaaaaaagagcatctggcccagacgtcactggttttcccaccaaacacctaaaggtttccttggaattcttagaaagtctttggcaaggagagcaagaacgcaaccaaaggccccacgatgacgctgggtggaatgtccaggcccccaggctcagtgctgcccccactccaggacagggaggtcatggctcagactcatacaatgctcccttcaaactcaggccagcagcggtgcctcacacaagttagaatgcacattctcaggcctagccccagacctgctggtcagaaactctggggtggactgcttctgtaccccaacgcgctctccactccagcccaggaaccactgatgtgagccaatccttcatttttcagatggtgaaactgaggcccagtgggaaggaactcaactaaggaaaccccaggagttccaagtccagcctaggtgtcaccacctccaggaagcctccctgggtttaacctagactgttgacccacaaagccagaagtggctgtatcattcacctgtgtatcctatcgctggcccagggtggcactcagtgaccatttgtgcaatgaagtcacgaaggcgggctcacaaaccccttgttgcccacagctgctcagcactgtctcaggcatctgaggccaatgcactgtgggacaacctccccaagatcacacagttctgggttcaaaaggcgaccagcaggtggtaaccttggtcagttgggcctcctcaccccaagctcttggggtcatcagagagggcatttgccgagccactggcctctcccactgcaggctgctctggtcaggaggtagtatgtgggggatgcactctgacaccccacaaactcagccccagccgatcccccacagggcaaggccactccatgtccagcctgcagagagacctgcctcagtgctaggaggcctgcctaggagttgaggagccatcctggggacccagcccactggtcagcagccagagaggggctgggaaggccacgccttcgagggtgggggcctggaggaggagcatgcaggggtgtcccaggcaagcagaggttctgcacatgctcagaatccctttggggagtcagcagagcctgagggggaccgtgtggagccgcactgacctgagaggtggggtgctctgggttccttctgtcctgcctacctggagacccacctggggacacggcccagggctaggtctcctgcatccaacaaaccaagaccctgcaggtctgggggatgccccatgagcccctacccccgaaagctcaaacctagcagggcccaccctgcccagccacggagcacttcgaggagggtctccagggctcagtgccaagtggagaggcaggttccctacatggcttttcccgggcaggaatgccggccctgcagcaggcccactccttgttcctgggtgcatctggccagccctccaccttcccagctgtgaaatggtgatgatgacagcacttccactgcggggtcccctgccggccacccccacccagccctgaggtcgcttgttcttgcacctgcttcctccttgccccaacagcaggggcaggcacttcgacaggcagctgcaaacctgtgtatctgaacagctgtgtccaccaccaggcagccccttcccaaggaagaattgcacactgggctcttggctccagtcacagcaatagccatcatgatacaccgatggccagggtgctgaacactgaaaaccgcaaggctacagttgaagaatcccagttactcttcccagtcaccccctatgctcccagagaacccgttattcccttacgcagacgaggggtgagtacctgccccaggtcacagccagagggcaacagtgccaggattcatgccgagcaagcagcaggggtaggcagggagcccaagtccgagcctggctccaccacctgtcttggctatgtcaagatcctcaaacccttggagccttaacttctttgtctgtaaaatgggcacagggagcactacttcagaggtttgcagggaagatcagaggagcccctgtgtaaggtgctgggcaccaggtgcctcctcacccccaggagctgattcccaccagcatgattgctcagcacccctacagaccacacaggaggcactgcttattctagacacactggccctttgtgtttgggcactgtggagagctcaggaagcccccccaccagggctaggcagagatagggctgtggcgggccagcttgctcaaccagcatttgtgggaaccatcacctccaccccaagtccagctggggctggcctggacagagcaggccaccctgaccccagagagccagaccctgcatggatgctctaaggccaggtgtggtccccagagcaggagcagtaccttctcctgagccagaaactggtgggagtgggcccagtgctcccctttcaggtagctcagctgcacactggcgttctagacccttcccctacagcctctcagttccaagtgtggccgctggacctgcagctaaagcatgacctgtcgattgtcaaagagcagatctcaagttccaggccaggcctgctgggtcacatctgctgctgagcaagacaccaggtgaatcatgtgcaggtgaatggaaggcccgggaagcccacctgtgtgagaacctcagcctccaggtaagctgcaccggctaactcagagcaggggcctggtacggaggctcatgcctgtaatcccagcactttgagaggccgaggtggatggatcgcttgaactcaggagttggagacaagcctgggtaacatagagacccctgtctctactaacattcaaaaaaaaattagccaggtgtggtggcacaggcctgtggttccagctacttggggagctgaggcaggaggatcacttgagcccaggaggttgaggctgcagtgagccctgatcacaccactgcactccagcctgggcaatggagccagaccctgcctcaatcaatcaataaacaaaccagggcaggccctcagctgtagtatgtgcacaccagcaccatgtggggatttttcaaagacaccgtgcctgacccctgcctggacaactgatttaactggtctcaggggcaggagaggcactggcatcttccacagacttccaggaagcacggggagcctctctcctgcctcagctgctcctggctgcaccagacccatctcgaggcagcagaccctgtgaagggctcaggaagcaccctcctcccacccaggatgtaggcacagacggggccggggccagccagtgtgccagaccagtctctgtgggaaccctcacctccaccccaggtccagctggggctggcctggaagagcagcagccccttgcagggagtgggggacaggcttgcacccagtagcccctctgactccttggagcagcagccccttgcagggagttggggacaggcttgcacgcagtagcccctctgactccttggagcagcagctccttgcagggagtgggggacaggcttgcacgcagcagcccctctggttccttgcagcccctcctctgttcaggcaggaaggaaagcacctcctaattatagagctaatcaatgcagaagaaacgtgcttatagcaaagcagagaagagtgactcactgtctcctggaggacgcgcctcactcccttctcacctcccacgcagggccggtggacacaagggcagtcccaggggcccagcctgctggtgagaggggtgccctcttccatcttggaagagagcagatttccatacctggctttacttggctctctgggggcaccattcgagaagggggtcctccctgtatctgagcctaagtcttcctggctgggcctccagggtcacacccctgacctgcacagcctcagcagcactgtaggaggcctggagtggaggctgcctgggagaggctgaacctagaggccccttgccacctgcctgccaggatgcgctgcagcaggacagagggcaggcggcagacaaccaggcacagggctctccccaggcctccactactctgcctcattgtggctatcccagccttttcaggcttggcccaaggtgccccacctggcacatatgctgctgtcccccagaggatgaagtgactcgtggggtcctgctgctgtccctccttggtctgccacaggtgataccatcctgagaggccccccacagctgcacccccagtctctcatgcccttgtccacacccccgcacacctgagtcctttcctgcagttgcagatcctgggcctgggactgcatgccagagaacaggctctgtccccacacccacgggaagcctctgggtggccctaagcctgcttcctcggctggacactgggtgtggaatgtcttgtcccacctccctgcagggttgcagtgaggttgaagggagagacggaagctagtgcggttgtgtgcctggagcagaaccaggtatgtggttctgtgccacccacatctaggccttgcctcaatggtgcccagtggcccagtgctgggtgccactgcttctgacctgtggcctctgacctaggcccttagggccatgggcacacaccacaccgccagccctgggagaggttggggctggggcaggttaacaccctgtaggaatcctcaccccagaggcactgttttgagacacagaagtttcacagagcctccccagagatgcctgggatgccagctgttgttggaacacatcccggcatctctccactcgctcccagcctcctgctgcccgggactgtgcttcccaataaagcgagcacagccaacatttccgtgagctctgatctcaggtttaagatgggctctgagaccttgcaccccgccccatggagtgagtagggtagaggaggggctgtcatctggtttctcaaccccctctgactctagaacagccacgtgctgatggcgccaaagtgccaggaggggagaggccaggagcctgcatccacatgtgggccaggcctcccattggtggtcggcctggggcagttcctctgtctgtgtgagccttagtggcactggcacctgaacctcatggtggctgtggggagtgcggggtggcagggagacacatggagtgtggcttccagcccagcacaagtgctcacacgcagggcgtgcttcagtgcaagtgaacactgctcctggggctctgctcagcctgggtgagggactgtgggaacacagccctggatctccaggaccttttccagtgggtacgttctggagctcagcctcaatacacctcaggggagaggcacttttaggggacacagcctaaaactttagcttctgaatattcacagctccccccacaacactcacacacacaggttcacacaggtgcacacatgcacacacaggtgcacagaccccttcgcaccaaggaatacactgtgccaatcacacagcactgagagtggaggtcactatgttaagtggagcaagccaggcacagcaagaccaacgctgcatgttcccactcaggtgggagctgaaaaccttgctctcatggaggtagacagtagaataatggctaccagagggcaggagcgggaaacaaagatagcttgggcaaccggtacagactcacatttagatagaagaaataacttctaatgttccataacagactcaggtggctatagtttgcagcaatgtattgtatacttcaaaagagatagaagaaatgtttccgacacatagaaattacaaatgctcaagatgatggataccccaaataccctgccttgatcagcacataacccatgcatgtaaaaaatacatgtaccccataaatatgtaaaatactacatatgaataaaagaaaagaatagcttgaggagaggaaaaaagcatagagagcaagaatggaagtggctagactgagggtccagggtgagaagaggggagggggcagccaggatctgagaaactttccagccttttaagaaagtaagaggagggaccctatgtagccccagtgctatgagagatcctgggagagagaggaaaagggaagtttttgtgaaagagtacgaatgacattcctttttgcagcctcttcaaggacgttggagagttttttattgttttttgttttgagacagagtcttgctctgtggcccaggctggagtgcagtggcacgatcttggctcactgcaacctctgcctcacaggttcaagcgattctcctgcctcaggctcccgagtagctgggattgcaggtgtacaccaccatgcccagctaatgtttgtattttttagtagagacggagtttcatgatgttggccaggctggtctcgaactcctggccagcctcaagtgatctgcccgcctcaacctcccaaagtgctgggattacagggtttagccactgcacccacctgctacccagctatctaatgtgacccatgcccgtcccccaggcagcacacagagagaggccatctgcctctggcctcatgtgtgcaaaagctggatgcgctcctcgggaggggcagccacacagtgtgtacacctttcctgagctggtgcacagtccttccctccattcaaactgcagccatggactctgagaccttgcaccctgccctatcacccatgagctcctgagagctgcagctacgatggaggcccagcagctctgagcccaagcctgtggcctcactgcagccagagcctgctgtgcgtgtcgtcttcccgtgcacccactcatgtgtccaggcctgggcagcagctgggtcactttccactcccgaatgttctttctgtgtcctgcactgaggatgcccagtgatgaggagacccaacagagccacaggaggcttgacaccaccgtggcctcataaaagatccccagggaagggggacgcaggggtcagtgagcattcacccaccccgccccccttcgtaggtgtgtgcacagagcacaactgtccagctccccaaaaggggctatgggaggagcatcagaaggtggccctatggggtaactggccatcctccaacaccaccagccccaccacagcagagagtaggaacaacaggccaggaggggacagagtctcctgcacagctggtcaggaacagggtcaggcctccgttcaactccaaagggaagagcagtataaggcaggctcctagcacactgtcggaattctaggaccccttctggatcctggagtctgcagttctggaaacttccaaagcagggattaaccttcacttgactaaccttgctttgctttaagtgtgcatcgttaggagttagagtgagctgtgtgctggccattccatgactcatctcaatgcaattctccctcacccagggagacagcccggagaggcccgtttctcagatggggacactgaggctcagctcacaggacccaagaggccgtaatgtgcaggactgcccaggtctgccctgctgttcctcggacctcagcattgcccctgagagcacctggcaggggcatggccccctgagcatcaagtgcaggctgaagccctggcctggacatgtggacaagcacacattcccacgacctgcagatgattcgggggaccgatgagctcccagaagctcatctgtggacttcaaattaagaaacccagcttcctggaaaactgggacaaaaacagccctcagggcccatcatgcatgagtcccagggatctgccaggaggtggaggaggggttcgagccagccccctgcctctgccagccttggcagggggcttctttctgaggcagcacgtgggcttctattttttaacctactcaacaaaaacggagactatttttagctcagcaagctgcagggcatcacaattagcaactgaaaattacacatctcgcctgtctcccctctcttggctggcagggagagcgtgctcctggagggagctgggggcagccctgtgccatgatcctggtgggcctcaggaggggagagacctgcgcacctacctgtgctgggctggatgcatgccacggacccgacagaatgggctcttcgcccttcaagggataaccggccagttctctgaaattaccggcactggggtggggaaggaggtgggtgttcccggagccctattctttgcccattcattcattcacaagtggtaatgatccctgcctagatactggagatacaccaggggaaaaaaacagggttctctggccccagagagcaccccacagagcctgtgtggtgccacgcacaacggccacagatggcgacatgatattctgggttaggagagaatcagtgctccgacagaggagatggaaggtcaggaatgtgagtgggaaagcggtaacctctgcctgggcggtgaggttggcctccctgtggaggtgaggcctcagccgactggaaggagcttctgggaaaggacgagcagagtgagtggacagaagcgctggcgccaaagcctgggagcttttggcccattagatctctggcaaaccctccctggggcacctcctggctgcctcacttactccaaaacatgcactgactgatgatgtgtgtgtcggccttgctaaacctggacctgtgatgtgccaggatcagggtccccagcagtgccaggctgccccccaacctggcctggtccccaccctgccaggagcgggggcgctggagccaccagcaccccgggcacatcccaccaccaccgccattgccatcggtactcagggtctatgcctacagtgggtgggccgcctgccccactctgtgagggtctgggctcctcccaccaggacatcgggaatgaggctcccctccccaggaggctcccccaggatgcagcaggtgattcctggtttccttgggggaccatcttgtgggggtcctcaccttaccctgcggggagggctcagcagggagtcaggcgcaatttgtaagtgaagtgcttgtttgagtgtatgggaggcaggcaccatgattacaagattccccatgcaaatgcacatcttttgctaaaccttcagtgggccctttgccttagtgaggattttgcccccctcctggatagtagacagtgctaggtagcccgcccaggggctgccccacccagagaaggccgttgggatgtggcagtgggccacgtcacagggaagaaactgcccgccttggggagggtagagggctgagtgtgcccacttggcttgaagactcagccaccctcagggaggaaagaaggaggggcactgctcctgatgggataagaacctgcatggggtggcagaggagggggaaggaggttaggggcctcctcccttccacccagcatgcagcaaggacagacttcaccccatctccctcctgagctccatcaggaccggtcagatagtggaggcagctgcgcctcctttgccgctcacccttcccatcttacacacccttccccatcttctgaccctgccagtccagagctgcattctcagaccagtaaaaagagccctccgggatcccacctgcactgagaggcatcgtggagggggagaaatgaggtaggggccacccccacctactggatgtcactcactggcaggggagcacaagcgaggggagccgatggcctgcagaagacaatggggccactgcaccctcagctggtggagcgtgctgggacccgaccctgagggcaccaccccagcatggggctgggggacctgtatggagctgagaggaggagtgcctgccccaggcagcccccagtccttccatccccctttggctcccatttctctaacacccctgtcctggtgacatgtgtccctcgctcatgctccctcttcccacgccagggctacagtgctctctccaagctggtgctgcagtcccaggcgctggacgacccgcctcagcgcctccatccccactgcacctaggccctcccagctctgtggaagaaggctgggtgaccagccactgcccagcccctctaccacacctaggtcctcccagctctgtggaagaaggccgggtgaccggccattgcccaacccctctggacgtcatctatccacaatgtgcaggcaagtgacacctgcctgggagagtctggggcttagtctccaccatttctgagattctagtgcctgctagagggactagagccaggactctgactctgcccaggttggccccaggcctgccctcaacagcaggtgcgccacatcagagccccttcccacaaccgggctgcatccacctcctactccctgacccagggcaggaagggttctcccccaaccacccagccaacactcagatgtcctccccatccccaaatcccagctctcagactgtcctgactgagctgaaacgtgtctcccttaactccagggagcccttgtcccatctgctgaggccatgcacagcagatgggcagggggcagctgcaggcccaggctggatctaggcatgggctgggcgtccaatgggaagggagtgggccccaccccagctgggagccggcaccctcctctgtgagatgccacctccagcacctgcttcccaggcgaccgtgagcactaagtgaagccacaaagctcaggacaggctcaatgcctggtgggttctgatggcatcggcactgcagagcactagcggtcctataggtttcccagctgcctccctagacacacagctcttgggagctggtgctgccccctccctcatcccacttctgggtccttctcacctcccatgcaagggacagccagtgcacctgctgcagacagcaacaagtgaggagaagctgcctcctgcttctaggcaggtggacccgttgacctggttgcactgtcctgtcccaggcatgggggactcagagctggctctggtctagggatggggggcgttgggggtgacactcccctgcaggtcaggctctccagtcctcaccctcctctctctcaacccttgttccctctgcagcagcacagtccttgggagcacatgctggccccattcctgcagcagggcagggaactccctgcagcccctgcctctccatcctccaggccaggcaggcatcagagggcaggggccacgctgtttcacataagccaaacttcaagtactgcgaagaagggccggatttacctttgtgaaccttccgggctggccagggcagtctcagggcctggccaagggcctcaggccggactccaacaaggaggcggctgccatgggaaccagcacgacagcgcctcacagggcgcccgctccagaggcctggccacaggcgcgacgcggataattaaagctttgttacagacacatgattcattttttccttctgaattcccttctattacccaatacaatttgaattgactgaaggaatctggtcgtctcctcttcacgctcctcagattctgcccagtctgggtttctgcctctcccttttccctttctgtccagtcagcttcttctgggcctgctcagggcatagaacatcattgtccaccaagaaccattccattcttgagactcaagaggcccaaggatgcagcaggtgggacttcagagaatccctgccctttcccggcaggcgctggcagcctggcctcccactccagccgcctggggagccctgctcccccctccccttggcctcgctccctcttcggccaacgccatcagattctgcaggggtaacgagagcctcctgtagatgggtgggcagccctgtgcctcccagggacagagctgggcacaggcttggatggggtcatgtgcaaactcacgcaaccttggtagccagttctgtcctttccagggagacccctagggtgccacggaggagggggctgggaagcagtgtgcagattccaccccaagtgaaatcacccctctggggtccctgtcctagatgggttgtccactgatgatgacaggacagagcagggtgtcctgctgctcatcagttctgggcagtggccagggcgcctgctggctccagtaggaaggcaccagcaatctgtcctgcccaggcccacccgggcacactgcccacatccagccagccctggagtcagccccgaagcagcagcccatgaccaagagagagggacagtgagcgggcagggtcagggctgagggcctccagaggcaggaagggatggccagccgcgtaggccacacacagacctgtcccgggtgagctgcacctccgccctctacagccacctagggtgctgggatatggaataaaagacatatggttcttttacttttaaatgataactaattacgctgagcaaagatttttcctttgtgttccaaaacaaataaaaatccatttccctcacttgaattgtcctcctggcagatggctgtgggagcagggagctctctctgggccagtcatgggggtaggggaagggggcacccagccccctgctgggtcacagagccatgggcatgctcagtctggcagcctctgggaaacagcacccagacacacgtcctgactgccacccccatgccgtggacacaggcagctcttctgtcacatgctgtgcgtctgtcccctggccctgggggctggtaaccggtggttagacactgaccagccccaagagtaccagtgcacaggaatgtgtaataatgtgttgtggtccttagggtctcaaaataaacggccaggcacaatggctcacacctgtaatcctggcactttaggaagccgaggtggaggatcgcttgagcccaggagttcaagaccagcctgggcaacatagggagatccctgtctctacagaaaaattagccaggggcagtggcatacacctgtaatcccagctactcaggaggctgaggtagggggattgcttgagcccaggaggtaaaggatgcagtgtgccaagatcataccactgcatccctgggtgacagagcctgggcaacagagcaagaccctatctcaccgggtgtggtggctcactcctgtaatctcaacacgatgggaggccaaggcaggcagatcacttgaggtcaggagttcaagaccagcccgaccaacatggtgaaaccccatctctattaaaagtacaaaaaattagccaggcacggtggtgcacacctgtaatctcagctactccagaggctgaggcatgagaattgcttgaacctgggaggtggacgttgcagtgagctgagatcacgccactgcactccagcctgtgtgacagaacaagactctgtcttaaaaaaaaaaaaggggggggagtacttatgacaagtaactcagcttagagtgaagttgctgagccctcagagtgattagcataggtgtggtggactgcaatgatcagatgatatctgctgtggccaggcatccctgagacccaacaagaaagtgatgtcaaaaggcacctgaagatgatggccagggacactcctgcggagggccataaatacaaagaagctgctcatgaccaagacacctgcagaagcactgccctcgagaactccgaagcctcttttccattggaggccaccagacgccctgctgggagaagaggagtgatcccatccctccacccgggggtctgcggtccctctgctctgaaggaacttggaccctgggcaatcagcagctggtctccccatcccccgacactgtggttcgctcccgcctctcttatgactgcctgggtgtgtggaatatatttgcatgattgttggggtgtgaaaacgtcccaataaaccatgaatttgtaagcatttaattggctgctgagtcatcctgaaacctccccacatcagttagtgccaccaggctgattcgaacctaagccagacacagccgtctccatgcctccccagggtggccctcctgctgctccccccttctccagatgaaggaacagaggcccaaagggcctcagtcaccagcgccagtctgggaaactggtggagctgggattggaaccctgtctgatgtgctacccagggcaaccagcacagggctccggagaaggagaatggtgtgaggtgacagcagggggagccagccaggcctgtgggatggacagggcctgacccaggaggagctgcccctgctgcatttgcaggttaggctgcaagcgcagggcagcgaggtggggtgggggaaatcaggccagggtccaaggggcccgtgctgcattctagcccctgcaaaactgcccacaagcctcaccaccaatgagtggcgtaggcagagggcctcccacctgctgggccctgtgacaccatctgggggcctctgaggccctgctctccacttcccagatgagatacaggtgtggggctgaggacagggcacagctggaagccgcccaggcctcctgcctgcaagttggcccttcctgtccgtgtggcccgggcacatacagtcatgcgtccattcgcgacggggatacctcctgagaaatgcatcttaggcgatttcgtcgttgtgcaaaccccagagtgacttacacagaccaggatggcacagcccactacacacccaggctccgtggtacagcctattgctcccgggatcccaacctgcacagtgtgtgactgcactgaatatactggaggcaactgtaacacaacggtaaggatttctacagctaaacatagaaaaagcacagtgacaatatcatattatgaatctcaggggaccactatgtggtgcatgacgctgtcttttttcccagcacaccctcctaacactctcagaatctccaaagtggtaagtgtcttctgtgtgctgatggacttctggacagcctggctgggggctggttgtcaggggaaccaaccatgtgatgaaagggtggggactttcactcccacccccagctctagggacaagagagaggctgaaggttgggtccatcaccaatggccaatgattcagtcagtcacacccacataatgaagcctccacaaaatcccaaaaggagcggcttcagagcttctgcgtaggcaagcaggtggagggccctggagtgcagtgcctgggaggacagggaagctccacgccccttctcacatgccttgccctgagcatcccttcctcttactgttcatctgtgaccactgtaaaaacctgcatagtaagtgggtaaatggaagcaagtgcttccctgaattatgtgagctgctctagcaaattaattgaatctgagaaaggagtcccaggagtggtgatttgctgggtgggtcagaagcacaggccacaacctgagacttgcaaatggcatctgaagtcgagggagggggacagccttgtgggaccaagctctcaacctgtgagatctgacttcgcctccaatattgtccaaattgaattacagggcacccagctgctgtcttaatgttagagaatctggtattagaatgttgtgctaaatggctgagagtggagagtaagaaaaacactttattggttttttttttataaccctattagaggtaaactcccaagaacacaaagctatgcccaggaaacacagtgagcacctcttcatgctagattcacaaccagaaattgcccagcaagtggtagatgcccaagggatgaaaatattgcagtgcatgctctctggacaggggaccaagatatgtgaaaaactgtgtctagaaacagaaaggcacattctactgtccagagtctctgccacatggtcgtatgttataccaccaatgaaacccagtaaagtccccaaatagaagtgtgcaggtgagagaatgacataagcacaatgtactatagttggatattaatatataactgataaacaaaatacccacttcataaaaaaaatccctaaatcacacctgtgttaaagattcaaattccaattacagatgtcagaaaaataacctttataggaaaactctgtatcgaatttgatatggccaaagctgtactcacagaaaagttcatagacttcaataatgtattgaagtaaacactaagcacttgattcaaaaagcttaaaaaagagcttctcaacaaaacagtgaaacaaactggaagaagaaactactaaaaagcaaattagatgacttaatcaaagaatagagtagaactccttataaacttcaagagctgattctttgaaaacacagatttcaaggataaccctcttgcaattctaatcaacaaaaggaaagaagaaagggagggagggccaggcaccctggatcatgcctgtaatcccagcactttggggggctctagtgagaacctgtctctatttctttaaaaaaattataaaaatttattttaaaaaagaaagggagggagagaagaaggaagaaaggaaggacatgaaaaatacattgggcatgaaaaaagggaatctaactccagatatgtagaagaaagtttaaaacaaacaactacctaaatctgtggtaaatgatctgcaagaacttttaatggttacttatattatctagaaaatataagtaaccaaaaatagagtaaaactgtttagaacccaaaaagaccaataaccatagtacaaattaagttgagagccaactaagcctctggaaaaaataaaagaaagccctggctgaaatagtttctaaaatgaattatttcaagcctttgaggataagataattttatatgatatataaactatttcaactacacaattcatattgaaaagccttcctattcattttataaagctaaaatagcatgatttataaatgtgacaaatatgtctcctagtagaaaagtatgcataaattcttacctctgaaaatagtgaaaaataccctcagcaacatagcaacacatcagtaaaatgaactcagcagcatttttaagcacaatagagcctgacccagtgggctttattccaggaacaagaggatgatttagctcagaagagttaataagtcaacacattaataggtccaaggaggaaaggcatttgatgattttgctagatataggaaagcctttgatgaaactgaatatccattcctggtgtgcactcttggcaattaatgtaggattccagcacactgtccttgatgacgaatacctattggaaatatgggccagtttcagacttagtaaaacatgaaaagcctcctcattaaaatgaagatcaagccaaagacaactgctattatttaatgttactttgcaccttttagaaaacataataagataagaaaactaaagatacattagaaataaagaagttggctgttccttatgtgtaagtaatataattaatttcttggattttccaggaagccaaactaaaaatctgttcaaactagtaaggtatcaataatcaattacctaacataaacttttaaaaaatcaatagcttacttatctacctcccctgggcatatgtgtctgcccataagtctgtgtggagctgttacagagatgctcacaccagtggcagtaggggaggtgtgtctgtgtgtctctgtatgtgtctgtgtgtctctgcatatgtctgtgtgtctgtgtttctctgtgttagtgtgtctctgtttctgcgtgtgtgtgcctgcatgtgtctatgtgtgtctgtgtctctgtatgtgtctgtgtgtgtgtctttgtgtctctgtgtctgtgtgtgtctctgtgtctgtgtgtgtgcatgtgcctgcatgtgtctgtgtgtgtgtgcatgtctgtgtgtgggggtctgtggggggggggtctctgtgtctgtgtgtttctgtgtgtctgtgtctttgtgtgtgtctgtgtgtctgtgtctctgtgtctgtgtctctgcatgtgtctgtgtgtctctctacgtctgtgtctctgcatgtgtctgtgtctgtgtgtgtgcctgcatgtgtctctgtgtctgtgtctctgtatgtgtctgtgtttgtgtgtctctgtgtctgtgtgcctgcgtgtctctgtgtctgtgtctctgcatgtctctgtgtgtctgtgtgtctctgtgtctgtgtgcacctatgtgtgtctctgtgtgtgggtgtctgtgtatgggtgtgtgtgtgtgtgtgtgtgtgtgtccacggatctctcagctctctaagctccactaccatcccccaggaacacgatgtccacagtgggcctgctctgccaaccagctcagctaccctgaagccacttttcctggtcacccacccaaaacaccacaccactgccccctcaggctgggcactctaggaacatgccagtccctgttttaaggacatctgttgtatgtggccccagggaggtccccagagaagtcatactcaggttggggccagagttgaaggctgagcctcctcacccacggggagggggagagagaggagggcggcgctctgacgcatacttaccggcccaaggctgggcaggggtggctggcggcagtcacagtgacatttgggaaatgccaggggctgggtcccagcccggaaggcgggtgtgggcggtgacaggggtgggggctgggttattccccgaggctgagaccacaagacaccagctttgccaacaaaactccacttggccagtggtgccaggggccgcagggccagggcccagccagcagcaggggccagaagaagaaacagagggccaggttcagtggctaatgcctgtaatcccagcactttgggaagccaaagcgggcagatcatctgaggtcaggagttcgaaaccagcctgaccaacatagagaaaccccgtctctactaaaaatacaaaattagccaggcatggtggcacatgcctgtaatcccagctactcaggaggctgaggcaggagaattgcttgaaccccagaggtggaggttgcagtgagatcatgccattgcactccagtctgggcaacaggagcaaaactctgtctcaaaaaaagaaaagaaaagaaaaaaagaaacagagaagctgaggggatcttggctgccatcctcctccgagatccacgccatccatgggctcccacctgactgtccccgggttccctcaggagcccccacgcctcgtgtcccatctgcctctgaactcccattgtcctggaacccacagggacccaggcagcccagaacccacacagtggagccctcatgacccaggaaccagctctgacccctgacctcctggctgacctcaggcaagacacagcccctctggacctcaatttccccagatgtaaaacaagaagtagagagcctgtacaggccacttcccgccctcatctttgttccttcctttcttccttcctccttccttccagaacttgttcagtcaagtcagcatcccttgaggcctttgtggcctatgccacacactcagaacggaacagcccatggaccttagtgtctgtgggaagacagacacaactccatggcatggcatgatctcttcaggattgggggtctgtgccgggtgtcgtggaggcacggaggtggggaactaactctgtagggagtagtcagggagggcttcatgaaggaggtgattctgagatcagcttccaaggataaccaggggttttccagtgggttaagggggaaaagggaggttgacatgacagtttggtctccttcctctggtcactcaccagcagttccctggagggcgaggtccaagagcccaaaggtgtgggagatgcaggcagcttcccctgcactaagtcaatcctcatgcatcccaccaatgccagtgtgagactctctcccccaggcagcccttcctgactgcctgcccccccgacagatggcactgctgcagcccatgtgtctgtgagtatgtgaccctgggttgtgctgtccccagtgccccctgcatcctggccaggcctggacccccaatgcacagaggtggtgggctaacatgagaggccatggctctgctctccttcccctggcctgtgccccgctgagggctagagtcctcatcccacctctcctggggaagctgaaagaaggtggctcaagctagcaggcccagcaagatgggctttgggcctgggaaggctggggcccagggctgtactgtcctgagccagcaggtgcaggtgtgggtagggtggccaggaggcagggcagcaaggagcctgcagggtggagcaagccaggctctgcatgagcacatgcagcctagacctctccctggactctagactgcccacaccactgccaggcaacacctctggggtgggaagtgttgaactgtccctgctcccacctgctgtgcctgccatcttgcccacctctaagggcaacaccctccttcctgcgccagcctgaccttccccatctcaatgaaaacagcctacccaccagcacggcctccaggtgttgccttcagaatacccccagaatcagtccttccctcctcctccttctctgccatctcccaaggctgggattctcatctgtccccggaccactggggtggcactctgctagcttcacccctcccagcagcagccagcaatgccatggcagccccacggggagcacatcctgctccaccacctcccactgcagccccgtcacccccactggctcccccagccacgccacctcgctggcctcactgtcccacctcctcttgggctctgctcctgatgccccagtctccaatctggccccaacatgcaggcagcttccacttcaaagctctgccctggccttttcctggtatgccccccgcatagctccctccctcccctccttcagcaggtcctgtgcacacgtctcctctggccaccatacctaaggcacagacagccccctccttcactggtggtcagcacgctgggcaccaagtgtgtcagacccctggttgctgggggagcaggactgtcattggaggtccgaatgaaacggggtggggccgtggggtccacctgtctcacagcagtgactggagtactgggctggggcatttaaatgccagtgcagggccctccccactcccctactatgtgaccccgtcagcctgggtccctgaatgagggtggcctggaccagggctgacaccagtgagtggaaactgcaccatgttgtgagctgagggacttgggggctgctctatcgctgcagaatgacctgaactaccctcaccgatgaactcctcacaggccctgctagctctcctacattgcttcttctctagccctcagcaccaggtagcactccacccattttacctacacattgtgcttgttcctctgctgtgtgggcaccgtgaggacaacactctccgtgctgtggtgtttggttccctgctgaaccgcagtgcctgcacacagcaggggcccgataaatgcatgctgagtaagtgaaagaaggaagggacagatgagtcctgcatctttcacgtggccagggctggccggggctcagctccacgctgtgggcactcagaacccagggggctgccgcacccgaatcacaccgccttacgcctctggggatgggtctccataaacagcgtgggaaatgccagtgctccatgctcaggtcctctccaggaccagttctccgcctgcaccctacagcgccctcgccctggagcgcacactcctcgaagccccacggtgggctccactctccctaaacgcacaggcgcgcgtggggctcacaaggcacaggcacggctgcgctccctcccatgtgccgtgaataagcgcgcccgcgcttccgcagccctcccccgcctgcacctcacacagaccacacaccgcggaccacccctcgcccggcacatcctcctcagagcaacaggtggttctgcgcccctcaagtcgtccgggctcctacacgcccgtccccaccccttccaggctcgcaggagccactgtgctctcggcgtccgcgggccgcgccgcgaagggcagggcaggagcagaggcaggctgggcgccgcccaccgggcagtaggtgctccagcggggacgcacagagggcggcgcgcgggtcctcagggcgggcaccctcccgcacgggtcgggatgcaggggaccgtcgcacccctcccgagcccgacagcgcaagaaccctgccccgcggccttgcgcctgggcccgccgcagccctacctggggctccaggaacattctggccgccggctccccgcgccgtcctgcccggtccggcgtccagcgagcggcggctcctctgcccgcgagccaagcaagcacccactcctgcgccggcccctgccgctggacgcctccgctggaggggtgggaccccggaagcagggaaccgaggggctgggctggggaccgcggggtccgggcggggcagaggggccgcgaggccggccaggaacgcggggcggggccgaggctaggagcatggcgcggaggtggggcagggacccggggcggcctggagcgctgtcaggaggagctgcctgggccgggcgcgcgcctggcgctaggtgtgggggcgccgtaggtgccggggtgtgaggctggacggggcgtccgggatcggccgtgccgggggtcggtgctggcgcgcggggccggcgagggggcgcagcgtgggtcggggctcggcgcgggaaggggatgcctcttacccggccccggcctcacctgatcgtagacgtccactacggaactacagcaggtgttctgccagcattcgacttgaatgccttccctgacagggcgctcactccacacagctctggcctgagacaggcgtcgcacagaactccctgtccttccatttcattggaactcgggggacacggcagctgcttttgtgggagggctgatccgagccgcagcgaggggtgggctgggcacatggcacagtgaggctcctcccgcccccagagccccagcctcagaaggaatctgccaggtgatggggctacccctctgcgcattcctgtggtggaccccactccctcagatgatgcggacgggaaagatgcgcggagccgaagagcgccctctctgggggtctggattggagcacccagcacctgagctgggtgagagaccccttgggctctgggggagtccgagttggccggcggggcggccgctagggaggagcagggtatgctcagcttgaacctcacagagaggctctgacaactctggagagctctcaagccacgggctgatggacaatcgtgaccctgacaacatctggccgccccaggatgcccataccctcaccccacctccacccccacggctcttgcccaggccttgccagaggccctctgcctcccagcttgtttgcctgctcacttactagcagcaagagtacctactaggctggctcgatgggcagttgtctctgtcttgggaaagtaggggctgtgctgggttcattcactggcctccctcaagccagctcaagggcctggagacaggagtccttctcctggagtgctgccctctcaccagctcttctctaccagtgagtgttggcctggcctggaaccgcttcccactgctcagagcatgcactatacattactgcgtggtatgcagcgcctgtgggtgggcagtgcggggagtacgaggcaaccaggcagaaatggcacagtggccctccagctttcacaatgtcctcccccacttttgcttctgcatcttgtttcaggccagccagaagatgcgaagctcatggtgaccttggcaggcagacaggtggcatcaggatggtctgggcctgcagggccaccctgtcccttcaggtggcttcatggagagcaccaagaaggtgaaacctggtgtcttgcccctggggaagccttcgaggcacctgcccctgccttcctcagccctgtaccgtagccctgcagaacatctgggccctggggtggccccagtgttgtctcaggaagtccatgtgagcagttggccctgctgcctcctgaccccagagcaagcatcccctctgcctccctgaatgtgacactctagaggaggtggtggatgggtgggcagccccacaagccttcttatgcagtcacagggtcacttcctatcacgctcatcccagattgcaccagtgtcacccaaggaccttgataaggcagacgcttccccgggaggaatggggcccttgcccccatctctggctgacacagatggtgctgtctcctttacccaccagtgtgatctcagcattcatgtgtgacctgacccacatccttcctggtgcctgaggatgcgaggaggctgctatgctggggctgagccctgccaggcgtcctgcttgcatccctgcagctggggctgaggctgtcctgcagggagggctggtgggccctgaggcagaatcccactgccacttcagaaagtagagaagaagccaggtgtggtggggccagtggccatctgccgggacttcagggagaccagacacacaggaagaggcactttctccagacacctcctttaggggcagggcacaaggcctggaacaaggctgcctctgaccagagcaacagagcctgctctgaggatggcagagcctagagcaggcaagctgtcaagattctgggttgagggtcacaggacaggaggctggactcccgctgatatgatttgggtttgtgtccccacccaaatctcatgttcaattgtaatccccagtgttggaggttggaggcgattggatcatgggggcggagttctcatgaatgggttagcaccatcccctcggtgctattctcctgttagtgagtgagtgagttctggagggatctgactgtttgaaagtgtggggcacctcccccttctctctcttgctcctgccatgtgagacacctgctccaactctgccttccactatgagtgaaagctccctgaggccttcccagaagcaaatgctgccatgattcctgtaaagtttgcagagccatgatctaattaaacctcttttctttataaattacccagtctccggcttttttttttttttttttggagatggagtctccctctatcacccaggctggagtgcagtgacatgatctcagctcactgcaacctccaccttctgggtttaagcgattctcttgcctcagcctctcaagtagctgggattacaggtgcacgccaccatgcccagctaatttttgtatttttagtagagacagggtttcaccgtgttggccaggctgatctcaaacttcctgacccaagtgatctgcccacttcagcttcccaaagtgctgggattacaggcatgagccaccgtgcccggccaaggcccttctttatagcagtgtgagaacagactactacactcgcaaaggctccctctcagagtccacccttgctgtctccacacagcagccgggggggatctcttagaacctgagtcagaagctccgtgactcccacctcaatctcgatgaaggcagagtcctaacgaatagccccatcagggacctcaatgctccctgctcagcctcgacaggccctgcccaccctccccctgcgtgcaatgtgctctgcagtgtctgtggccccccaccccgacaggccaccttctcactaacacagctgcaatgccatcctctgccccagcattgtcctgccatggaatggttttccttaaggttactgggtccagcagagcctttccaccttctggttcattcgtctgctctcctgagaatgtgagctccatgagggcaggatctttgttttgttgactgctacatcccaatgactgtaacatgtctatgcacagaggcactcagaacctatgtgtgtgcacgtgtgtgtgtgcgtgtgtgtgtgtgtgtagacagatacagagacacaagtgtgaataaggatatggttgtatatatccagcacaggactcatatccaaaatatataaagaactcatgtaaataaaaaagtcagaagactcaattttttacaaatgggcaaaagacttgaagacatatttcactgaaagaaggctatccaaggggtgataggcctaagagagcacccagctccatgactcatctgggaaaggcactaaactgcggtgtggcaccctgcacacccagcagcaaggctaccatcaaaaggcagaaaatgccacgtgctgacgagatagcacaacccaaattctcagctgctggcggcgcggcagggtcagctggtgcagccaggcgggaaaacagcccgatcatgcctatgaacaccgaccacaccaggcccagaaattccatcctggatggaggctgtgcagaaacactagagactcacaccaaaggacacacgcaggagtgtctgcagcagccctactcacaagggcttcgaactgaaaatgaaccaagcatcccccacaggggactgggtttccaccgagctgtggcatgtgtcactcaatggaacgctccaggccgaggataacccacccagacaaccacaggcaagggcagggagtcaaggacaccaggcacaaagagcatctaaggttggccccacgtggagccagctcagggccggggagggcaccctcacccccagaggtctggggtgctgccctggggaaggggctggaaggggctggatctgggtgtccctgcggagtcaccccatgaaaaatcaccaagtgtacactgtggctctggctcaggcatgtttctgtgtgtgttacacttcaatcacatgaagaaaactgaaggagagaaaaataagagagaacatctgggccaggacaggtagaagctgtcggcacctcagggcctatctaggtctgctgtggccacgcctgagggaagaagggatgtggaggaagggacctgagcctccctccgctcatccccccaagaacaaaggcagagttggggcaaaccctgctccctcttctaaaaggcacagcctacagggtcaagcaatggcaagtgagaggcatccactggttttggaggatggaaggtggcctgaggcaggtgacagaccttgcagaacagagaagcaggagcccagtgccccacagggggctgatgaggaccacgccggtgctacagaggccctgatgaggctcagcccacaaggccttgggttccaggaggagggtcaagggacagaaaggccctggccccccaccctgccctgctgatgccacctcattactgggccacaccacacagtccaagagtttcgggtccaaaccctgaaggtgatggcgcatacctctctatcctctccagggcatgaagtggggcccgagatgccaattcacaagggtgctggcaaaacacgaagcaaaatgaaccaagccctcagtgagctccagaggctcctcagacagcccctgcctcctcaggggtccgagggctcacgctgtctgccagactcaagcctcctgcacacacagccacggtctgcagagaggcccctccaggctcctccaaggctggtcagtacccctgggcagaggccactgatggccctaatcaaaaccacacctaaacacacccacaggctccagggaaggttgtctggcagccaaccctgtcccttgggtcagtggggaacccctaagccttccagaatttccctcaggccataccattagtgctcccttttggagaataatattccatgcactgaatcactcatggctttaggcataaagcgtgaaggagggggtgaatgggagtcagctgagctttctgatgcgcaaggcaacatccttccaggcaccagcatacctgggcaggagcccaccggccacagcgtcaggcacacctctccccagtcgtctgagtcagagcctccacatctttgagaagctcatcaagataccatggtgtatttagcccttccacatcctattctgcctcctggggtccatgagtctttcctgaggctcttcctggggtcctgtgtccatgcgccttggccacccctcctcagccacactcagagaatccagggtttcaacaatgcagcagtgtggggaaggcaggaatgccaggctgggaggcttcctccagatggggctctcaaacctgaccacactgcccaggagcttgctaaaaaggcagtgccaaggcgccatcctcagagatccttcctgcccccattggtgtgtgggactcagtgctcagggaggcggcaccagttaaaactcggcttgggatgcagggcctctggtccaggggaagagagcccaccacactgagtgccagcctgccacatgcacaggggacagtggagaacgcatccagggatcggggggacacaaggcatgggatggggacacagcatcatgcccagcacaatgggacccaacaagggaggaggctgcagccacacaggcaggacgggttgagggccaagacagggcccgggaagtcacttccccgagatgaagcagatgatgaccaacagggacccctcccatcacaaggctctggatacccaccccatcacctgagcagagacctgcacaaagtgagacacagataatacccctgacaccccaatgagaaagagagaagagggacagcacatggaaatagggcagacccagccagaagcaaactacttcatggtgacaaaaagcttgcaagttaaagccttgagtcatcacttggcacctgtgaaatctgcaaaaataatgttaaaggtaatatagagtgtgagcttaagcgtcagggaaaagccagggtcactggcaggaaaaggagagaaatggacagcaggtatccccaagcacctccctggagcaaagacatggcagcaggcatcgtctagggcaccgcgcatccatgtgtgtttgtgtgaccttgtgtgcgcatgtatacatgtgcttgagtgtacatgtgtgcctgagcaggtgtgcgtatgcacatgtgtgctttctgcatgtgtgcataggcatgggtgtgtgtacatagttgcatgcatgcattacgagtatgcaggcctatgcatgtgtgcatgtctgcacctgcgcctataaaacagacaagcatccacataccaaaagtctaatcagggtgccttcctccactggccagcatacaccttctctccgtctctcgcgccctccctcctcctcttctctccatttagccttatcaagtgcttcccaagttctctccaattactatgaatggcttcatcacagcataacacagtacgtgctcatcttctaaaaccaggacatgaggcatccctgctcccactaagactgtgcaaagttaaggctggagcagcagtggcccactcagggctcgcccctccctcggagcccttcacaggctcctggagaagagagactcagaggagaccctgcctgagagctcacacctgagatcacctggtgtgtaggggacaagggggggatgcttaggaccataggggggtctcagggccagcctggccttgtgggagggtctcagggccagcctaaccttgtgagggtcttaagaccaggctggccttgtagggggtcttaggaccagcgtggccttgtggggagtctcaggaccagtctaacattgtagggtatctcaggaccagcctggccttatagagggtcttgggaccaggctaaccttgcagggaatcttgtgacaagcctagccttgttgggggtctcataaccagcctagccttatagaggatctcagggccagtgtggccttgtgagggggtcttggggccagcctgctctatggaaattggaggcaccagtcaaggagagaggcttctgtctccctgggtccttggtttccacccatccttggccagtaccttcactcctccccgaccccggaggctcctagtctgttctcctgcttcacctgccctccaatggagcccctggccatcatgggcccaggccccggagctgatccctgaccccactgttgtgcccctaactcccactctccccctcctcccctcccctcccccccacctccatttcccctcagcctctgccctctccagaccacagacacagtcctcctgaccccggctcctcctgagctgcctcccaacctctcttttcttcttacctacatttctagaaagagcagctgcatctgctattttgcagccaattctgcctcctccctccagtccctgctgtgctcatcagaggcaccaggctaacgcacggcgtgggttccaaccaagcccaggcctgaacgcactcatgccaggatgcctagctggctccgctctccccaaactcagctgctactcctcagggatcccacgacacccagccccatagaagtcccagggaccatcccagcatggccccagcacatagaccacagagcttctctgcctgaatgtcccaggaccgccatgtgatgtctcctctcccacagggaatagagccctgtcctgcagacactcaggcacaggcaaacagagacccagccattgtacctgtgggcggggatctgggctcagcacagcccacctgcccatcaggggagtgggccacacaggccaaggcggccaggcctgacgcaggtgtgcctgagacccgccttcaggaggattagccatcatagattgagacccgcctttggggggcggagggagggggggtgctgcagattgagacctgccttcaggagggtttgccatcacagagtaacacctgcccctcaggagggttagccatgtcgacttaaaggggtcttcaggggagttagccgtggctagtttatgtgtgcctacaggagggttagccgccgcagattgagacctgccttcgggggtgttgtatcgcagattgagacctgtcttcaggagggttagccatcgcagagtcagacctgccttcagcagggttagccatcgcagattgtctggtttcctacccttgagctgctcagtgtacttcaccgaactgcagtactttagatagctctactactaccgtttttgacagtttacttatatttcatttaagtttagtgggggaaagcctgggttccccagcctccttgttcactgccccagccccatgtccacatacactcctgcaactctgcaaagacaccagggtgctgtgagggtcccgtgggtttccccaggtcctcttttggcaggtccctataacatgttgcagggcaggggagaggctgtctgtgatgggcagggcccctgactgccattcgggcaagtggggatactgagggaccctgaaagatatcagggtcaggctggtagggcatgtgggcagcaatgcatctcagggagtcctgccccctcttccatgggaagggcccacagctgccatccccatgagccagagaggatgacactctaggctggtggaaagggacctgatatcaaatggaaatgaggcaacccacgaatacacaagtctgcacgtgcttctgtgcatgtgtctgttcctagagcagacacaaatgttccagaagtttctttcttagtcattcacagaatcacaggctctcgaagaaggggtattattcattctaatcagtggtgcctggaatgatgccctgtagtttctttacttgccccagacacctgcagctccctggagagagcccctcagctcctggcaactccatacgttctgtggcagctgcagggtattccactgggtaggtgggctgccacacatgtaagaggtcctctagcaaaagacaccaaggtgctttacagtctttggcaacgaaaaacactcctgcaatgggcattattgatgaaaagtttttattcaaatgtgtgaccacatataaaagatgaactcctaatacttgatgtgctgggtcaaaggttatgatcattgtaagtttaaagagacatcccagaagtgctttcaatagagtatagccaggtagtgaaaatggtggagtaaggacctccaaaaaccctctcttccataaacgcaacaagaaaaccagcaaaaaacaaaaaggtcagaatccacatttttagaacttccaaaattaactaaacgcttgcagaaatcttaggaggatttattcaaaaaacataactgaatctcagtaagaattgcaaattttatagcacttgaacttgccctagtcccatccctgactctctatcccaagtgccttgaaaagtaggaccccacattcatcatgaaaaccactggcgtagcagcccctggagggaaaacagcaatggaactctttcaaagcttcattctcagaaaactgtcattatttgacctgtccagtagttcccatggagaccccacttacaaggatgtctgtatttgacctgactcagaggtctcaagtacaaaaatcatattccccaaggttcattgtcaaaaacaattactggtatttaatttcacaaatgcctgaagcagtagataacagtgaagcaagcaatagactaaccagaaagcttaaaaggaaagtttcagtaatgacatgatcataggggttttgaaaaactgcagtgcattcctgagaatctagaaggtcaagtgcatgctcagggctgtgcacatgctcagaaaagtacttgggaaaccctaagcactcacttctggctgactttgagtctctgtgcaagcaggaagagaagactaaggcagagttatcagctgcttagctgagagctgaaagcatacccaaagacacagagccccttagcgaagactgagaactttattgactccaggcacttatgaaaatttctttccaatcattatttgaccgctaagataactgagcagagatttcagtgccacacacaaaagaatacagactttgcagaagtaatccagaaatgtcacaaaacaaacaaccattactacaataaacagcagcaacaacaaaccccaaagagtggggagaatctgatttccagaattgacttactaaacaaaaactttcaatcagctactttaagtatattttttaaagactgaaggaattgatgtttaaagaactaaaggaaagtatggaagcaatatatcaaacagagaatatcaataaaggaatacaaattataaaaaagaaccaagcagaaattctggtgttgaaaactaagtaaatgaaatgaaacatagcaagaggggctcaacaacaggtttgaacagagagaagaaagaatcagtgacttgaaaaaacgtccattgagattatccagtctgaggcacagaaagaaaaaagaaaggaacaaataaatagagccacagacaccataatggacactatcatatgtataagaagagtctcagaaaaagaggagagtgagaaataaggcagaaaaaaaatattagaagcaataatggctaaaattttctaagttagatgaaaatattcatctccatatcctaaaagttcaacaaactccaggtagatttcttatcaggaaccatgaagggcaggaagcagttgagctgacacgttcaaaatactgaaagaaaagaggtgtcaaccatgaattctttatgcagcaaaattgtcattcaaatatgaaagggaaattacctgacaaataaaatagagaactcgtcagaagaagacctgccttataagaactactaaagagagtccttcaggctgaaatagtaggacaataagcagcaacttgaaatcatgtgaaaaaataaagaggaccattaaaggtaactttactggttttatatttattgctatatattagtaaatataaaagatagtataaacacattttatgcacttaactctatttttctcctatttgaattaaaagacaactggtctatgaccatactaccctgaatgtgcctgaattaaaagacaactgcatgaaacaataattataagtatagattgatgagcacacaaggtataaaaatgtaaattttatggcagtaacagcacaaaggagaggagaggcaacagaactacagaggagcaaagtttttgaatactgttgcaattgagtttgtattaatctgaacattgacatgtacatataacatatacatagttatttgttaagatattaattataaccctacaggcaacaggtaagaaaataactcaaaaatatacaataaaggaaaagacagaaattaaaatggtacactagataatatctaaatatctatttaacacaaaagaagaaaataatgaaggaataaaggaacaaaaatggcataagacataaaaaacaaatagcaaatcctaccttatcagtatttacattaaatgtaaatgaattaaacactccagttaagagtcagagattatcagagttaaaaaaaaaaacatgatccaactacatggctttctaaaatagacccactttagagagaagaacacaaataagttgaaagtgaaaatatggccggatgcagaggctcacgcctgtaatcccagcactttgggaggctaaggtgggtggatcacgaggtcaggagattgagaccatgctggctaacacagtgaaaccccatctctactaaaaatacaaaaaaattagccaggcatggtggtgggcacctgtagtcccagctactcaggaggctgaggcaggagaatggcgtgaacccaggaggtggagcttgcagtgagccaagactgcgccactgcactccagcctagacgacagaacgagactccatctcaaaaaaataaataaataagaaagtgaaaatatgaaaaaagacattccaagcaaaaagtaatcaaaagagagccagaatggctatattaatattagagaaaatagactttaggacaaaaattgttactagagacaaagaaggatattttataatgattaaagggctaatcaacaagatataacaattacaaacaaatatatacctaacaacagagtcccaaaattcaagaagcaaaaactgatagaattgaaggaagaaataagacaattcaacaaaaatagttggggaattcaatagccccactttcaataatgaacaaaaactctagacagtaggtcagttaaaaaaaaatcgctccctctccctctccctctccctctctctccctctcgctctcgctctccgtctccctctttctaccgtctccctctcttgcagagcctggactgtactgccatgatctcggctcgctgcaacctccctgccttgggctccggtgattctcctgcctcggcctgccaagtgcctgggattccaggcacgcgccgccactcttgactggtttttgtatttttggtgcagacagggtttcgctgtgttgaccgggctggtttccagctcctggcctcgggtgatctgcccacctcggtctcccgaggtgctgggattgcagatggagtctcgctcactcattgctcaatgttgcccaggctggagtgcagtggcgtgatctcggctcactacaacctccacctcccagccgcctgccttggcctcccaaagtgctaagattacagcctctgcccgcccgccaccccgtctaggaagtgagcagcgtctctgcctggccgcccatcgtctgggatgtgaggagcccctctgcccgcccgacccatctgggaagtgagaagtgcctctgcccggccgccaccccatctagaaagtgaggagcgtctctgcctggccgcccatcgtctgggatgtgaggagcgcctcggcctggccgccccgtctgggaggaagtgaggagcgcctctgcctggccgcccccgtctgggaagtgaggagtgcttctgcccggccgccaccctgtctaggaagtgagaagtgtctctgcctggctgcccatcgtctgggatgtgaggagcccctcttcctggccgccccgtctgggaagtgaggagcgcctctgcccggccgccccatctgggaagtgggcgcctctgcccagctgccccgtccgggaggtgaggggagtctctgcctggccaccccgcctgggaagtgaggggcgtctctgcccggccaccccgcctgggaagtgaggggcgtctttacccggccgccaccccatctgggaagtgaggagcgcctctgcccggccgccccgcctgggaagtgggtgcctctgcccggccgccccgtctgggaggtgaggggcgcctctgcctggccgctgccccatctgggaggtgaggggcgtctctgcctggctgccccgcctgggaagtgaggagcgcctctgcccggccgctcttcgtctgggaggtggggagcacctctgcccagccgccccatctgggaagtgggcgcctctgcccggccgccccatctgggaggtgaggggcgtctctgcctggccgccctgtctgggaggtgaggagcacctctgcccggccacccagcctgggaagtgaggagcgcctctgccaggccgccccgtctgggaagtgtacccaacagctccgaagagacagcgaccatcgagaatgggccatgatgacgatggtggttttgttgaaaagaaaagggggaaatgtggggaaaagaaagagagatcagattgttactgtgtctgtgtagaaagaagtagacataggagactccattttgttctgtactaagaaaagttcttctgccttgggatgctgttaatctataaccttacccccaaccccctgctctctgaaacatgtgctgtgtcaactcagggttaaatggattaagggtggtgcaagatgtgctttgttaaacagatgcttgaagacagcatgctcgttaagagtcatcaccgttccctaatctcaagtacccagggacacaaacagggccgaaggccgcagggacctctgcctaggaaaaccagagacctttgttctcgtgtttatctgctgaccttctctccactattatcctatgaccctgccacatccccctctctgagaaacacctaagaatgatcaataaatactaaaaataaaaaaattaaaaaaaaaaatcagaagacttgaacaacactttaagccaactagacctaacagacatcgacagaacactccacttaacaacaacagaacacatactcttctcaagtgcacaggaaatattctccagaatagaccttatgttaggccataaagcaaatctcaataaatttaaaaggactgaaattatacaaagtatgttctgtgaccacaataaaataacagaagtcaacggcaaaaacaatctgggaaatttacaaatatgtggaaattacacaacatattcttaaataaccaatggaaaaagaagaaaccacaagggaattctcaaatttacttaagtaaaaatactatgaaataaatggacatgaaaacataacatgccaaacttacggaatacagcaaaagcagtgctgagtttaaaaatatatatataaaactataaatgtccacattaaaaaacagaaagttctcaaatcaacaacctaacattccaccttgagaaactaggaaaagagaagcaaattaaattaacaaataacagaagaagaaaatactagagtgaaagtaaatgaaatagagagtaaaaaaaaattgagaaagttaatgaaaaaccaaaaatgggttctttgaaaaataaaactgacaaacttctaactacactgaacaagaaaaaaatagagagaagactcaaattagtaaaatcagagaggatattaccaccagctttacagaaataaaaagcactataagggaatactatgaacagctgtttgccaagaaattagataaactagatgaaatgggaaaattcctagagaaacacaaactctcagactgaaacttaggtcagaataaacctataacaagatattgaattagtaatcaaaaaacttcttgcccacaaagaaaagcccagggccaaagtcactggtgaattctgccaaacacttaaagaattaacaccaatcccttacaatgtccttcaaaaaatagaatacaaagcactaaccaattcattccatgaggtcactattgccttaatactcaaactaggaaacaaaatcacaaggaaaaaaactataaaccaatataaaccatccataaatgtagatgcaaaactcctcaacaaaatattagcaaatcagatccagcagcatattttgtaagtattcatcatgactaagccatacgtattcaaggaatgtaaggttagatcaacatacaaagatcaatgtaatataccatatccatagaccacataatcatcacaatagatgcagaaaaatcatttaataaaatccaacatcctttgaagatttaaaaaaatgctcaacaaacaagcaactgaagggaacttcatcaatccaataaaggatatctgtgaaaaatccagaacatcacagttaattgtagaagaccaaaagctttcctcctaagatcaaaaacaaaacaaatatgtctgctcttgcctcttctatttaacattgctctggaggttctggcctcggcaattggataagaaaaagatataaaagacacccatattgaaaagaagaagtaaaactatctctatttgcagatgatctcatatataggaagtcctaagaaatacacatacacacacagacacacacactattagaactaataaataaattcagcaaggctataggatacaagatcaatatatgaaaatcaattgtaattctatatggtagtaatgaacaatctgaaaataaaattaagaaaacaattcaattcgtaatagcatcaaagagaataaaataattataaatttaacaaaagtataagacttgtacactaaaaactacaaaacatagttgggagaaattaatgtagacttaaataagtggaaggacatcccatgttcatggattgtaagacaatattcttcagatggcaatactccccaaattgacctacagattcaatgcaatccctatcaaaattctagctggcttttgttgttgttgttgcacaaattgacaagctgttcctaaaattcgtgtgaaaatgaaagggacctggaacaaccaaaacagtcttgaaaaagaagtacaaagttggaggactcacatttcctgacttcaaaacttactacaaagctacagtaactaagactgtgtggtaatggcataaaaatagacctataaatcaacagaataaaggtgagagtccagaaataaacccacacctccatggtcactcaatttttgtccagagtgtcataataatctaatggggaaagaatactctcttcaacaaatagtgctgggacaagcagatagcctcaaacaaaggaacacatttggatttgtacctcgtaccacatataaaaatgaattccaatggatcaaagacataaatgcaagacctaaaactataaaactcttagaagaaaacaagtgtaaatctttgtgaccttgcattaggcaatagtttcgtaaatatgacaccaaaagcatgtgcagtcaaattttaaaagagataaattggacttgatccaatttgaaaaacttgtgcttcaaaggacactatcaagaagaaatgggaaacactaccctcagaatgggagaaaatatttgcatgccatatatgttatagggtctagtatccagaatatatgaagaactcttacaattcaatgataaaaagatagcccagttaaaaacgggcaaaggccctcatggacatttctctaaagaagatgtacaaatggccaataggcacattaaaatttctcaaaattattagttattaggatttcaaatgcaaatcaaaaccacaaggagacactatctactggggtggatataatagaaaagacagtaataacaagtgttactgaggatgctgagaaactgaaactctcatactttgctggtaaggatgtaaaattgtgcaatctattcagaaaatgatcggtatagttccttaaattgttaaacagagttatcataggacccaacaattccgctccttgtattccacaaaatatttaaaaacctctgtccacacaaaaacttgtgcacaaatgttcacagcagcattcttcatattagccacaaagtggaaacaacccaaatatccattaactaatgagtgtggtttatccatatgatggaatattacacagcaataagaaggaatgaaataccaacatgctacaacactgaagaacttgagaacagtatgctaagagaaggaaatctgacaaaaaaggccatgttgcatgattccacttattcaaatatccagaataggcaaattcatagagtcataaaatagattagtggttaccagaagctggtgggttggggaaggggcagtttgagggataattaagaagttctgggctgggcgtggtggctcacacctataatcccagcactttgggaggcctaggcagacagatcacctgaggtcaggagttcaagaccagtctggccaacatggtgaaaccccgtctctactaaaactacaaaaaaattagccagccatggtggcacacacctgtaatcccagcactttgggaggctgaggtgggaggatcacttgagctcaggagtttgagaccagcctgagcaatatagtaagaccccccatttctatttataaaaaataagattaaaaaaaaaaaaaaaacatggccgagtgtggtagctcatgcctataatcccagcactttgggaggctgaggcgggtggatcacttgaggtgaggagttcgagaccagcctgacaaacatggtgaaaccccgtctctactaaaaatacaaaaattagctgggcatggtggcacatgcctgtaatcccagctacttgggaggctgagcccagagactcgcttgaacctgggtgacagaggttgcagtgagccgagatggcactactgcgctccagcctgggcaacagaatgagactatgagactcggtctttaaaaaaaaaaaaaaaaaaaaaaagaggttctggaattagagatgatggttccatttgtgaatacactaaaacccactaaatcatgcactttaaaagggtaaaatttaagttatgtgaattatatatttcaatttcttagaagaaaagatgacgatgaccaacatcccactaccaggacagcactcgatgaccctcacaggcaccacaatctaacaggtgagaatggtctcactgcaggcttaatttgtattttgttcattatgaatgacagtgagctaataaggcatttttttttcttgaatggtgtgtttggggtttcccctttattcaactagtctgtagatttttttcttattcatttttctttggcctgagtttaaggctaggtaatggtattcattcatccaataactgtatcttgagggcttagggttgcctcgccctgttctaggcagtggaatatggtcataaacatgacccacagagtcctgggcctcatgaagcataaatggtcaaggggagacacaaatactaaacagggaaacacacaccagccggcaacaagtgctgtggaaaaaactagagcaggtggggagagccaggagtggatgggggctctgttggtgataatatgggccagctggagaaggctcctcagatgaggtgacttctcacccacatgaagcaatccacgtagggaagaactgaccccagaggaaacagacactccaggcaacagaggaaagcataaaaagcaattgtaagggagagagacctggtcacctgtgtccatctgaggagcaggacgccatggctgagaatcaaccagactctaagaacagtagccaagacctgtagccatctcctcactgccccacacccacaccactgccagctcccacctgctgctgtgctacccacttcccacgtctgaccatctgtatgtccatcctccctggtaagccctcatccaagtggccatccactctccaatgcagggttgcagggcccccactccaccccagctaaccatgctcttctgagtcacggtcctgggggaagggggttctgttggcctcagcttctgaaagcacttccgtggctccaagaaggaagacagtgctggtgatttggccagcaaggcccagcctcaccctctctccccattgctgttggctggctctgctcccccaggcacacagcggtgcagggtcctgcccaggccagctgacatcactgccaagatgggactgaaatgtcagtgtctgcacacagctcgggccagcaaggcatcctggaccctggctggccctggggcttcctgttccccttgcctgccaagcagggccaactctgtgtccctcagaaggagccagctgggaaggcctgtggtcaggaggaggtgggccccagagtgtcccccaatcctcagagtccaaaacagaggatgttcctgcccccaccaccggcccccacgccaggaagctgctgcagccaccagggtctgatgctgcctaatcagggaaggtgctcctgcagggactttcacgtgtgtttaaaagcaagatttaaaagcaagattattcagtgctctccctcggggaaagtcccctggggagagggcacagtgctcacagcagggtccagcggccagggcaagcacaccacctctgtgtctcccaccgagggagctggcaaaagcccttcacctttctgaacttcagtttccacttctagaaaatgtggtgaatgccatgcacctgaaggaccggtgcagctccctgcgaggcaccttctctggcactgtgtacccttggccaatgcgcagtctcggagctatggaggagcgctgcctgggagccagctgcccggacactggtttcactacagctggggagaggagggccacctggaatgggggaatggggagagcacctgtcatggacacacctgagcagctatgacggtttccctgtcgggggacgcagagaccacctcccaggtccatatgccatcaccagccataggacacagtcgtcccagctgacccaggacagtgccaattccgcctgttgcttgacataagtcactctcagaaagtgccccaccccacccaagacgactgctagaaacagattcctgggctccgcccccaggccgagtgaatcagagtctgggggtgtggctctgaggttggaatcttctgccagctcagtgggagaccccagcacacagccagacttgagaagccccaagtgtggggtgtgccgaaggggaaggggggggtcaggcaccctagagggttccttccatgctccattccacagaggctccttgcttacatctgcccctcacctagccccaaggtcaggtcaaatgtcaaaagcacatgaggggcattgtggctccgctgttttcccacctgtcacctggtcaatggcggcttcccagctggaaggggcagagagggctggaggcttgggagtggtggtcctggggaacaaggctcaatggacccaggcactgacccgcaaccctgctgaagccagagacacctgggtggaggtggagacgtgcaggcaggagctgcccagggccaggcagaggctccagcagcgagcctcacagctgaagggaatgtgtgaggaggggcctgggccttgctctagggagcacctctgaggctgcagggcgtggaaggaagtgcctattccctgatggaggccgggaaggtgccagaaacccagaaatccaacaggaagggctgcaggaagaggcctgctctgctggctgggccctgatggcactcttctgcaacccaacctctgagactcagttttccttcctgccgcagtcccagcatgcagcactgatcagccagcggcagccgcctggggccctcatgaaaagcaccctgtgggttcggcaccaggtccctaatatccccccaatatgaggactgtgtgcttcccatctgcaccccgctgctgcctgaagcgtcttgtggggcccctcaccgtgctaggatttgcacctcagctggagtcccctaggaggcacaaaggctggagcaggaacagtgtggcttccagaacacactcacgcatgcccaggaaagaaaaagccacacagattgatttactgcttctgctttgccactgagcacaaggtgtcagtgtgcatgatggacgccagccgctgtgaaaattgagatgtcagcccagagcccacagcccacaccacctcacctccagacgcagtcaggggtggcacagtcctgttaattgcgagccctgagcagactgcgaaacgtgcttgttgagcgctacctggggagctcaccctgtccagacggttgggaatccacactctctggctcacgggacacctctgcttctgcctccctgtgcacagccacccctccaggactgtgagggggaccaggccttcgtctggcccagcactggtgtggaccagacccctgaccctcacaagtaccagttctctccttgctgttgtcaggttcggaagggacaggtgaaggtgctgtgccacagggagtctccccaacaagacggacccctggtgatgcaggagcaggcagacagggaggccctgctggatggtagcggcaccctgaggacacacagggtggtgtcgagctcccacctggccctggccatgaggagtgttgtcagagggtgaggacgcagagggcacctgtcgccattgatgctgggatgaccaaggacagtgcctggggcaggcccccagaagcagagggggcttgggggaatagagggctgacccaggcactcctgtgtgtgcacggtactgccacccacccacatgggtgtgcatacacaggcacactccacatcgtggacacatctttagtttcaagggtgtcagcaggtgggacacagagcagtgcaccccagaaggagcagacagaccagcacacccacctctccacagccaggactaggtgggcaggggaaccaggccaggagtcaagggcctggccaggcacttggagttggaaggcagggaggaaggggtgggctacggggctgcgggacaggccggggctcggcatccagcagctctttctagtaggcaggcctgcctgggaaggaagggcagggcattaatgggtagtcagtgactctgtcttccaaacccaactgcctggccaggcccttgacttctgcttagccatggactcccaggaagggaggggacgtgactgtgaggcagacacagtgcactttcttttctgaaggtctgatttcccctcacatgtcctaagctcaggggctttttagcacagacagaggacccggtttcagggctcggctgccaaactcacctgactcccactggcaatagagcccctccacagaggcttgcaggctccctctgctgcacacccagtgactggctcgcggcgggaggcagcacccgagagaggaccctgtgcctcctgctcaccctcgacacagacccactgggactaaccgctcccctgcaccctggcactcatcgtccgcaccccactggaacccacaatctgctgccaacaaccccagctctcctcacagagcaccgcaccccacgccttcaggaccagcgagttcaaaggagcccatcgtgggcaaacccccatggtctcctctgtccatgccccagacaaaggggctgtgcacacccagcccagggagggcccacaggcgggggtgcccccacacacttccacgcccaccgtagcaaggccacctgcaggaggggcctggccaggtccagccttcctgacacccaccccacaccccccaccacctcatcctgatgtgttcagcgggtgccacaacctccaaactaccccgtgtgtggatttgaggtccttgtagctccccagactgtaaactcccaaatccccggggagggctgccttgctcacctcatgtgagggattaggctctcaagagtgggtatggcccccaaatatgcccacagcctgatctccagaacctgggaatgttcccgtattcggcaaaagggactctgtaggtgtaattaggcagaggctcttaaggctgctgggagattctcctgggtgggcccattgtattcacaagtccttaaagttgaagaatctttccccgctgcagtcagagaaagtgtgaggacaagacagggtcagggagatggtggcgtcaggggacccaacacctgtggctggctcggagctgtagggagcctcacacaaggcccagagggggctctaggggccctcaggggccaacatcccacaggggacggggacctcaaggaatgagattctaccaacagacacctgcgtgaccacgattctgcctggagcctccgaagaggcaggccggccagcgccttgacctcagcccctaagacccgacccagcctctgacctactggccgagataagaagcatgtggtgcggaagcagctccatctgtgggacttttttgcagcagcaataagaggcaggggcagcccaccctgctttgagcaccagccggctggccacaggcacagaccacaggggcaggacccctctagggctcacccggcagtgcccctaagctgggcctggggcaggcctgcctccccatggggtctggcaccatcctccccaccctcaggcccacagagggcagacggagactcacatgccaggcccagtgctcggtggatggcctcccaccagggctgtgctctgtgaccccagctgtgcaaggaagtgggctgcaggaaaatatcccctgcaggaaaccctggagccaggacacttcagggagggcgggagacaaacagagggggccttcagggtcctcttgggaactgcaatgtgccagtggcaccaggacagctgtggggccatggagggctgcaaggggccatgtaggtagacccccccagtgctggcggcctccacttgttgcccccttagatctgtgtggtggggcactggccctcctgctgagggcacgggtttcctaacaggcacctatccttcaagctccttgggcctggcccagaccttccagccctgtgggctgtgctcttcctgctggtcctgcctgccctctccacctcgggcctcacggctgcaccgctaacccccgcccccggacctggtctactgttgcagggcccggaactgacaccttcacactcaggtcacagcgcagtgacacccggcctctgggcctcagctgctggcagaaggctgggtgggggctaggtgggggctgggagtccataaggctgtgctccctgagcaagtctctgtggtcacaggcaaggatggaaaccgctgctgtagctcagaggtaaaacgggtctctgtgggatgagctccaagcaggggtccaagcaggggctcctcctagggtccccagaataatccctgactaaagggagggaacaaaggagacagtccctttatggcacacaagcaatgacaccagtgactccattgggtctgacattgggacctccttgtgtagctggtagccccagggcccactggaggcccctctatccccgcactcctgacacactcggctgggaacactggggactttcctcctgggcagaggctccccattcccaggcatctggagaggaaaccgggaagtgtggggtttccagcacctccgggaagccccagccaccacctggtctctgcctggcagagtccagccccaccagcccagcccctccagccggtgtcgggcttggctgcagtgggaatgcccagcaggaaggacagcaggatccaggaaatctcccaaagtcactatgctgcacggccccacccaggccccagcgccctccaggcccctcacaccacctaggccaagccgcccagccctgcccgcctaggctgcccactcagcatcgctccttcctgccccacccactgccatctgggcctggacggctccaggatatcctggacagtggggcaggctgaggtgagagagctgaccactgtcctgacccagccccagggctgcaccctcatccaaaggctggggacagctgcccccacctcctcttaggctgcaagctctgggggcaggcacactcctcactccttgtctcacagccctgcccagagcctgcacctggagcaggacaggaacatcacagctctgccatgtaccctctgcagccaccactctgaggaggtgaggagtgtcactggcatttcatagcagcacagactgaggccagaaaccggaagtgtctgtccaaggacacaggacactggtcagggccagagttaaaaccaaaacccagactcccatgtcaggggaaccctggagccagggctgggggtgctggggtgggagtaggcacaagtgttggctcaggaccaccaggtggtgggtgtgtggccattcctgggcacctgtcacccttggcttctctgggctggctcctggcgctgtctgcccactggcaccccactcccccagaggagcaccagtctagagtgggggtgcagtgtggtctgggcttctccgatgccctccttcctcccctggttgccaacaatgctaaagctgcacgcctgtgatcagggaggccctctcagcttgactgctctctcctgccccctagagctaccatagtgtttagacagaggccatccccagcctagggggagcactgtgcaggaggaggcccccaggggacccagagtgaactgactttagggagcccatgctaatgactgtcctggccacactgtgccccacaagccacaggtggagtgaggatgctgagggggcctggagccaggacaaggcaagccaggcgggggcaggtgcggcaggtgctgctggagtcccccaacccctacccagaacacacagcagcctgcatccaggcagccagtgcggagcttggttcttgatccggctgtgactggctgtgtcctccctggaccatgtgctcagagatgggacaagggctgagcggcttgtcacaggcagaaagaagaacaggaacaggaacctcagggaaagaaagggctggttgggggtggagggggtggtgaatcaatagccaagggaggtgggtgaagaaagtgaggtgcagcaggtcaaatacgcagaccagagtggcctctccaggatccctgcccacattgtaatgcatgggctacctctctcggcttccagggcactgcacactcagtgcgactctggacctcagccgcttcccccacacagtctcccgtccctggttctctccacgttggggctgaggatgtgtctggtgtggaccagcgcacaccacagccacagagcagtgcccccactcgcgccatctgcacacagacacagatgagccgtgaaggtggcatgaaaccccgggcctctgttccccgactttcttgccattccctggttgccggcaggagtccatcttggggcccagctgtttcctctacaaccggaaacccccttcctcccttcatggttttgcccaaacctggccttcccagggtggctgccttcatcgctccctcctggcacctctccctccttccagaatcattaggctcatttctgtctatttttaggttgtgtctgcactcccagagtctgggccatgcctggcgtgcatggcctgcagtgggtgaggttgtgatccgacatctctccccaggtcaactttccactctccaatggttctgcctgagtccatctctcaggtgggggtgagggtgagcagcaccttgcagaatccctcacatggctccagaggtcacagcaagagggaggagccatgaggcctgggttcacaccctggactggccacttctcgttatcagcaccagcaggactcttgacccctccaagcctcgctgacacactggtgatgatttgcatgcccaccctgggcccacttgtgtctagacacccctcaccaggtgggcagctcatcagccacatggggccttgcccagcgagtcccacccatgcagtgtttggtggggaaggaggagcacaggtcccgcccaggaggcaggattctgggactgggcctgcctctgccgcctgggggcctctcctccacacctcagtcccatctggcctgcaggcaggttccagcaagctacattctccttcctaggagggtggggatgttctcagaccccgtagtgccctgcgcttcccccgggcctccccagggggtagtgactgcacacagcgatgggcaacaacagggtccagggtcccgtcagcggtgccctccccattctaaagcaggcctgggactcacattctccagagccagccctggccctgcattatgctgcactgaccattttcacatgtgctgtataatgtctggttgaggccaggggttctcccctgggctcccacagggctgcatggctgtccccactagccagggaaaggtgtgtcccctaggactgacagacactcctcccaccatccaggcagccagtgctctggccgaggcagacagctgcagcctggagaggacagacagggcgaggcaggggaaggcagctgcctgggccaggacatgagggcctccagtgttacatttacaggaggctcagaaaacaactaggctgggcaggtttccagtgggcatctggggtgaactccttccccattcaggatctcaggcgaaagctgcctctatactaggtggctcacagcttcggggaggggtaccctcatggaggtctgcctgctggagcccccagaaccctgcgccagtcaactcttcattgaaagatagggaggcgcagtttcgtttaactcaattttgcagcctccatcatctgagtgggtgggtatggagtgtctcatcttgaggtgagggattctgtgagcgggaggaccccatggctggcctggcctctcaggaggctgaggtgagggggctgtggaaggtgaagtcgcccctcctaatatggcagcaggagggtgaagtctagcctcggtcaccacttcccctgccccatgccacctgccctcctctttcatggccaacccagtgccccacctacctcagggccatctgccactctgcgcttgacaccagaggacaagtgcatttccttggggcaaagctgcaggccacagcaggcggctggccccttgggacgaggagagcagctcagttttggtgggccgaggggcaccaccagcagggagcctcagagagcctagcaggcttgggtgagctactgagctgcaggcttgctggatggatgccccacaggccagcccctaggagcaggactgcctctgtctcctctttgtgccacccacacccaccatccacccactcagcacagcctcttcatgcctggtgggctctcagggcagctcatgtgctgccacctgggctggccctcctggcaagctggaagagctcactgggcacatgggcctcctgaccaccaggcccgggaaggacagctgggggccagagtggagagaaggctgcagcaggggctgatgtgcaggccccagactccccggccagtgctccccaccctgcactgccttcactggcctggggctggccctggtctctggttcccccatctctggcccatgcagcctgagcccagagttgacaacatgaccatcagtcagtccttccctggacaaacagacaaagctcctcatgccagcacaacacttggtcccagggctggcagccaggagcacagagaagaacccacagacactcacagtgaccccaggaagacagatatccatgcagtgtggcagtgctgtgggatgcaggagcaggctggacctgaggttgcattctgagcaccccagggaccagctgagggcctgcaagcacagcgggtagcctcttttctgggggtagtagcagtggcccctgggacttgcagctgggccctacccagactcccccagggctgtgcagcagtcatccacacttgcagccttctgcagaagactggagtgccagcatccaagggccgagcagtgcaggggcctgactccaactcccctgcctcagagggaggctagctgtggggtcagttgacactccggagtccccatggaatcaggctagacttccgctacaactgcacttctgtccagcctcctcctctccctgcatggtgcttgtccttcccacacagatgtctcctgagagcataccctctctaaaccccttctatcagaatccccagcccatgcactgagtcatagccctcacaggcaggaacgagatgagagggcacagaacaagcactcagaagccaggtgccaccgctgcacgttcaggggctcaataggccagaggaggggggcgtcctcacctccaggaggtggaggtgctccccactggggccatccagctgagccccaaggtgggagtgtgcattcaggaggcacacaggcaggggaaaccactcacaaaggcaggaagggggatggccagctcaggagctggacggaggggcagggcggggacggcaggaaggctcggagagatgaagggaggcaccagagaaccacaccacctgctaacatgctccctagagcacgggagcgacctggcctcaacctctgcctctgcccctctctgcagaccccagaggctcactggcaaaatcagtgtaatgatgctggcatcaaaaagaggcacattaagtcacatgtcagtgaaacgcccagcagagcccttggacagtaggctggtcaggggccctcccagcatctgggtataaatgcacacacccagaatgaatgtgtacacccagagcccccaggcacatgactgtacaccacacccaggcctgggcaccggcagggtggaccgagggcaccagcctccccacacctgctgctccttcctctccactctgcaacctgggccctgcctggcactggtgctgtcctggagatcccctcctgtgtcttcccctgacagcgtccccggttgcctcacataagacagctctgcactcggtgcaccaccggatgcatctggcgtcctgcccagggctgagaacactgtgctgccctggagtccaaccctgggtgctatggcaggccagagagccactgtggaaccctggtccccacgggcagggccaagtggctccccagacccagaccccacggagaagctagggtccgcccccctctcaggaccccagcaggcagactcccgtgcccataggaggcctggccactgtcccgccccctcccacctttcccactgcgggagccaaggaaggcacctgggtgtggacttctcctgtacaactgggctctccagacgtcagcaggcagcagggcatgtagccctcgacggccgtgatccacagcgctcagcattctatttttatcatttaaccccaaactttctattccattgtttctttgacccatcattcaaacatgtgtttcaaattttctaaatatacaactcttttagagttatctattttgttatcactttctctcttaattgcactgtagtcggaacacttggcccgaatagcagcttctttgacatttgtgcgggcatctccgagccagcactgactgctcagcctgtgcgcacccaccaggcttggtgggtgcctggtgaccgcagctgtgggtctcccctccaggccccacccatgtgggagcgccctccccctcggccccgccccctctgggaagtggttctggctgccgtggcctttccatgaagaacagctgggacccctggccatacttgccagcacagtttactatcagccctctccaccaccaccactccccgcagggcagttgatctggcccaggtacctgcaggtcacctcacagcaggtctaactcactccagcttggtcaaggtaagcccagctcccagaaacacctaggccagaggaggaaggggcacggggcatagaaggccctgtccccgtagcggggctgagcaggaagggccctgcctgcaatggacagtgtgggcaggacttgggctctcccaggtgccaccaatgctcacctggcctggcctcgccagtgggggactccactcctcatccagccacccactgctaacagcaataataaaatgaataattgatgcagccccctgcctgctctgagtaattaactcatgaaagcatcagggcacccccagaactcccaacctcatccaagccccatcctcccagctggtccactcaccctgcctccagcccacccttcctcccccagctctgagggcagaggcttgggtcctagcaactggggccaaccctcctctcctcagccagcaaagccggggctgcccagctctcacccagagcctggctcggggctgcacattaccttcatccagaccacagccctgggagaagcagggctcacagggcatgctcagagcaccggccagaaaaagctgggcacagaactagcctacagagaagtccaggcaggagaaatctggaccttggagtctgcgtctgtacagggacaaagtgcagatcctcatcctgggaagtacctggtgctgtggctgggcatgtctccccaggccccaaggaggaggcctgccccagtgccccagctgtggctggggtccaggacacacccggatgcactcaaggctgcctgacattcacatttggcgggtctgggtaccagagacctggagagccccatgggcagagagagtgggggagggtccaccagatttgggcagccttggtgggggtggggaaacaagccctgctgataaaccatcagaacgcgccccctctcctctcccagctcccgccagcctcctccacggaagctactctttgttaacagcgttgccatggcaaccagatccagggagaactctctcttcaaggtagagtctgagggtgacacttggagaaacagaagtggtggtgacaacaaacagggtgctggcctcccagccccaccccccaggattccttcctggtccaggaccccagacaccagccccccagactgtcccagagctctcaggtctgcttccctctcctctcctctccctggcgtgggtgcagcaacgtggcccaggccaggcacctctgccacaccatgcacggtggctcaggcacttccatgcacctcccacggatgttcgctgaatctgccagcatagccactgtctcgtggctgggctccaacaggcctggtgcagactagaccccaggggatcatagacaagtacacccaaggcggctgctgcagagcagccccgggccccctgcacagcaggaaagttcaggaaggcacccaaggaaggctgggagcctcctggcaggagggagacccagcagaagccatgccctgagtaggggaacagactgctgggtaaggaggccactgcaaatgtcctggccaggggatggtggcccggcccacagaggtggcagtgagcagggagaggcagaaggggcagaagagaggtctagagtggggtgtgctagactggctgacaactccaggcaaagggaagctggcagagggggtgagggagagccagctgcctacctgctcagatggggaacctggggcaggcaaggttcaggggcgtgatgatgtgcatcgtcacccgggaggcgtccagcaggctcacacactgacagaacccagaggacaggtgggggctgatgagagctggaaccggatcagcacggaggagggaacagatgctgtggctgggtagagggtttgagcccaggtcttgaggaacagggactttgagtgtcccaggatgggaggaggagaaccaggggccggccaagcccaggaaatgggtgtctgggaacaaggcagtggacatccacggcctctcaagaagacatccctggactgaaggaggtgtgtgcagattggcgtgggtgggagtgagtgggaagtgaggattcagagtgagcagagaacatgtcttcaaagtcagcccgcacaggcgaccagggtgcggacggctgagcaagtttcgttgtttttaaaaaaggaaaagcacctgtcaaccggacagccacatctttgcatcccacgtatgaagtgcccaccctgggctgttctgtctagagtcccagcccaggcctctcttcttcaagctggtgctggcctctgctccctgaattcacaaagaaccccacagccagctcacaagagacaagcaggtctcggagcccctgctggctgccctgggcagcacaggccggcagctcagcccctaccccagcccgggcagtgcccagggcagggcgggcaaccacaggtggggagaagcttcccagaacaggatcactgggtgtcgtcctgagttgtgcccaaaggcacccatgtgcttcctgggaggtgctgcagcagagccgggacaaccggactactctccctgcctggcttccctctccatggtccaccgggcaggggtggccacagcagcagtcacacccccaccccgtccatcacagcacaggccccgcttgagtcctcacacctgtccactcctggccggtcacccctcacagccctctgtcatggtgcctggagcagcctctaccagcctgtcccaggtggtgagccctgaggccagagcccctctcccactctgagcaggccaggaccccgaggggctttcgggcttcccttcacacagtgcccgccaagccactgctggccataccagctgaccttcccaaaccctgctcccgggctgctagctggggaattcctggtgtcccagcgcgcagggacattctgcatgggttcctggcagctcgccactctgggccggcccagagcccactctcacatacccacagccccaggctctgtgcccaaaaagtggcgacagggatacacccaaaaagtgggcagtgagccctctctggacccccgcaggtcaggctgacagccataggggagggcctctgacacccccagcaatccaccagtgggtatcagaggccctcctctatggctgtcagcccaccagtgccacttcagtcccctccctccgcacatcacacccttgctaggtaaacactcatcctccccagcagggagtgggcaggggagggcagaggagccgggaggcaggctggagtgggtgggagttacaggaggcagattggaagctccaacagaaaagcagccagagtgccggacccaagcagatggcctcaggagaaaaagggggaaggggagggagggtccgtcaaggggcagcagggaggggtgggggagaatgccttgagtctcctccccatctgctatctgctatgcccctggcacctacccccagcagcccagcgcccctcccctggggtgggccatgcagagaagagcatccctccaccagcccctctcctgaggacagtgggggggccaaaccccctgcccccatccctgccttggcacagcaccttcacttgacctatttgacaaatagggcttctgtgaaacccacggttctattgccaaaaaccaaaggccaaccaaagctgtcccatcctgcccctggcatcattctacaggtggggaccggcgtgctcaggggctcctggccacactgtgtcccagtgcccactcgctctcctccctggctggcccctcccaccgctgggggccactgtgtgcgtggctctccccaccgcagccactgtccagcacaaatgccatttctccctcctcctcctcctcccctgcctgcagttgctaagttacaccaaaaaacccctctgctctgtgtgaactgttccatttccacgatttgccaggtggaagggagccatccggctggcagctcgaagatgcctcccagagaaaaacaaactcactggctggccttcaggccaaggcacacctgggatacctgcttggttcacaaacccaggggcatgtgcaggaggacacagcttctctacttcactagagagcctgggggatccacacagctcatgcccttctcaggagcagggagtgtgggcctgctgcacccgcctcgctgggtcactaccacccacagccctaaggacacacactggctggaggggcagagaacccacccacgtgtccctggccatccagccaaggtcctccatgtccccctgctccggatctccccttcctgggctggggtcctgaggttccaaagcaaagtgtcactggacatcagggtggaaatgtcctcagaggtcatcaaaaccgtgtcagtctacagatggggaaactgagtctcagaagcctgcagcctgcccgtggttcacgaatcaagacctgtagcctttcggctggaggccccctagagccgcttagagtccagggcaccgaggtggacaggctgggctggcaagactgcatccggagggggcgggagaaccctggggggacagagggaaccaaggcctctgggaggctcccctgcacccagcctgactcctgtgtttcaggatcctgcggccgacggccatcggggcccttcctgcgcaggacagtgggagaagagtggcagtggtggggagggtgaaccagggagaagctcactgctctgagcagggagggagggagccccggccaccaccaggtctctgcccccaggtggctcccaagaggcaggcagcggcctctctgtaaatatccaccaggtccagcacccagaggcagccagaaatgcagggcacaggaacctgccagcgcgtccctccacacacagcaggggactcccgcccccacctctcactcaccgaccctcggaccagaaccagctgcacctgccccgttcctggggccggcaaggcctggggcaaagagagcgtggtccttcaaatgacccttgcccagcagggagagggagacacctggcatggccctggacctctcccccaaatgcagagctcaagccccaattcctcgccaaacagcaagggcgtgagataccacggcggggcccagaatgcagaagagcaaatggaaacttccaactgcgcagccctgagctcctccgattccccagcccccacccccacgccaggccccgggcagcgaacctgcccgcagtgcccacgcccgcccgccgcgtgcgctcctgccacgcccggcccggcccggcccggcccgccaggtgccctgaaggggcggagggtgcagggggtcctggcgccgtccagcccggggcggagttctcagcaactccgcgcgccgggatcccggccgccctccccgcgcgcgtcccccgccccgcgcccggagcccgcgccccggccccacgacggccgcgccgggagggaccccgggcccgcgcacgccgcgccctgcccgcgccggcgaccggagggcacggccccaggcgcgggcgggggccccgaggcactgagggtccgcggccgctgcctacctcggtccgggccagcgtcgctcccgcgccgccctcgcgccgcagtcgggccccgagcagcgcgcggccggcgcc

SEQ ID NO: 1562 - DNA, 11216 bp, Homo sapiens
aaaaagtttaaatcagcattttataaaaactagaaacaaaataattgctttcacaatgtagtacttgaaactaaagttctccagctatcaacagatgtgactccagcatcaagggcctagcaggaaaattctgaatggtttacaacagtgcacataagttgcaggtggctggggccgtgtgtctatttgatgcttcccagaatgtgtgctgctagtcaccatttccaccattcacatatttaacatttttattagacttttatttagcctcatcataagaatataagggagatcatagatttgatgtatgaaatttttaaattcacactaaaatacattacgattaaaatgaattatcttcaaccacccgttttgctatcttttgctgagtaatctgtgccagtcattgtgaaaaagtctttattttaagaaaaaaatttagttaacaaaaaatttaacaagtttcacttagcaaaatacacccaaaaggaaatcacagtacaaagaaagttttaagtcaaggcctcaccaattcctacagtattagtattgtgtctcaattctcaaaactaacttttaaaaagcttaaacttaacctaaaggattttaaatgaaaatataaactagaatgaacaaacatgagaaatatttctttgaatcagggagctagcacctttgagttttccaaaaaagcacgtctccccagtgtgttcactgtgatgtggtgtaaaagatccacatttaacatacttaaactacttaaacttagataacatcactctgaagtatactaccaaaatgttaattgagaaaagctgaaaatagttttagtttactcattatcacatgctagaagaaaattttgcatgagaaaacactgaagaggtaattttttaatccagatttttcacaaactcatggtgcaaaatgggtcccccagcttcctctattataactgctcttaattgcttgttggctgcctgtgaaaatgattgaagtaactcaaatgttcctaacaaaactagtcatagccacccatgctgttctgcccactgtagccggccccgtaacagccactcactgactggctctccaggccactgtaagtggcctgggcagcagacacccccatgccttgcatcacctggctgctatacgccccattgctggcccctgttgttgaattcaagaagagttctatatatctgtgctgcatattggccctgtctttggacatagctgccacagcttcttcatgagtagcaaactcaacatctgcttcacccgtcactcttccatctgggccaatctcaatatggactctcacagggttgagaggagagaagaagttgtaaatgtcgttctcggtcgctttgtacggcaggcccctcatgtggacacagtggcctgtggtgctctgcactgtgaactcactgtcgccgtatctgtggtcatacattccggagagacagtagctgaggtctctcccgaacaggtcggtggtgaagccgtagccatcactgaggccactgtactcctcgtagcccccgtagcctgtgctgtaggcaccaggcctcatcctttccaggcctgcctgcttcacgatgccaatgtacctcctggcagtcccgggccggtcatagggccctggccgctgcacggacatgaacttcagagggggatctgagtatgacctaacttcctcctggctgctcttaaacacctcaatgtacctgtgccctatcctctccttgtgtttccctagagccttctcagctaactcctgcgaggcaaactgcacgaacgcttcccctgtaatcttgccttcggggtccacaggcaatgtgatcccgtttggcacaatttccaaccctgagaagaactgaacaatttcttcctttgtgcatccaaatgggagtcctcgaagccgcacgaagccatcgttggcgctgtcggcactgttgggaccactgtgcttcaacacccaatccatctcggttctgtgggacttgaacacctcaatgtaccggtgtcccatgctttccctgtcttttttcagggccatttttacatcatcttctgatccaagttcaacaaaagcctcaccactctgcctgccctctctagtgtagatgaaatggacacctgcggccccatcatgaatcgtgcagtcagagaggaagttctgcacgtcctcaacagagcaggaccagggcaggccacggagcttgaccacaaagccttcacctccctcagggcccagcatcatggacacttgtcagggtgggtgtcaggtgatcttgggtgtggcttttttgtggctggaaaaaaaaaaaagaaaaatttatttagtatgcaacagaaattttccccattttacagacgagagaggtagcaagacattaagaaatataccaaatacaattgagagctaagagttaactccaggtctctcaaaaaattacattatcagtcacaggcagtttgaaaaacaaatcaggagtttacaagacaggacgatgcatgtgaatgtggtgccttgaacacagagaaatgtaagtttcagtcagtttagagcaagggcatttccttgttatatttattccacatatttgtcatgataatatgtggcagttcacctataagagctcctgagttgttcctcctaaactatacgccttacatttggtaaaatagtaaatttagtaaatctgcttgtctatggtaggatacttttactttcatgagtaaaaataagggatgggaacatagcaggctgtttttaaaccacaacatagggtaagattttctagtgttctcatcagcagtaatgttgccaggatacaagacagcaatggcttccactgtctatggagttatgattttgctcctaaattgtcaattcaaactaaataccagtcaagtatgaggccaaactgatgacatatacagacaagcagacaaattcaccagcagacttagttatgtgcactgcaaataaatggagaaaccagatcagatgattcacaggttcacataaaatatagcagaattgctgccttgtgctgaagatctggaagagggcatcgggaagaaagggcaatcgcaagagggctgagaaatgcccttcccaccagggtggtacatggcacctgaagtccaaactcagagtaaggccaaccacacactggaaggcagtcttctgagaaagaggagcagctgacctagacagcagggtctataacatagtcacaagcaagaaaaacactgcagtatcatggggccaaagacgtatttttatatgaacactgtcaagggtgacgctcaaaaagagcataggagtatatggaatttttttttttttttttttttttgagacaagagtctcactgtcgcccaggctggagtgcagtggtgctgtctcggctcactgcaacctccgcctcctgggttcacgaaattctcctgtctcagcctcctgagtagctgggattacatgcaccagccgccacgcacggctaattttttatacttttaggagatacgggatttcaccatgttggcgaggttggtcttgaactcctgacctcaggtgatccgcccacctcagctgcccaaagtgctggaattactggcgtgagccaccatgcacagctggaaatcgaatgtttcaaagtgtcattttacatcaagcataatagatatagctggtggccttttcaagaaatatgggctcatcatgtggggaaaaaagctccataagaaaaccccacaatttaaaaaacagacaaaaagtaaaggtaagtgtaatttaagaaaaggaaaagcaaattcatactaaataaatgctcaactgcactagcttcagggaaaattagtaattttaaagtttgatgtagccattgcagataatgacatattatcatacagtgcttcatcatttcaaattgacaacgtctaaaaggataattgtgtaaatctttcaaatttacctgtgtctacaccagattataaagataacaagatgtgtctcctctcccaataacaagcataatggcacaaatgaaacagaacagtatgtgatatcctgaacacatcaccaagaccaaacactcggcatttactcacgaactgtgatttggaatgcaagggctttcaaagtatacagcctaactaaaagatgtcacccttgctaatgagagtggaacatggaagcctctgggaagagagtcaaggggagcctaacctggattgctcattgcccacctcaaattattgactatgtacataaactccatcaacttttataaaataatcctgaacggcaaatgattgggcataaataatcctatccccaattctcaaactgtgctttgggtctgcaacaaaccctggggtttagcctccaccttagaaagtaatggtctccgcctccccagggccttatctaaatcccctgcatatggccactgcaacatgctgatctggcagagcaaggtcacagcagattcttcctctcctgtccacggagggaattctgtgctaacagttcagaagctcctccttggagagtcagggcaagtttgtattgtgtctcttgggataatgggtctgggacagctcaattacaggtgggggcttcttatgcaattccattcccaacactgggtcaggctaggcaccgcctgtccttttgtctttgaccataccctggtcttgctcctcactcatgaaaagtatctgaaggcctccctcgagttctgttcctagccttaggtccagccatcgttccgggtaggggagatgaagccataatccactaaccattttctcctggactcctacctccaatgatttcaccattccctgcaggaaaccccacctaatcacatcctactccctccaccacaactgctatccccctcctttgtagagaccttggcttccttatccacacagcctctttctctcctcattcttcataatccagcttagagcaagtatcattttacattccttcctcacaatacatggaattcattcaatgaacttcttaactgtacgcgcccagtaaaaccagagctctggaagattccaaacaaatatctgactactccatggatgtactgagtggctcagctgcacacagccaggcgaaacggtgcctctaagctacaatttctcagcctcaggactactgacattttggaccagacagttctttgtgttgtggaggcaggcccaggcactgtaggatgtttagctgcatccctggtctctgcccactagatgccagtagcaccctccacctccagttctgacaaccgaatgtctccagacattcccaaatgttctctggtggctaatgctgcccccaagttgtgaaatactgtagaaatcagggtgaggccaggcacagtggctcccacctataatcctagcactttgggaggccgaggtgggtgggaccacttgagatcatgagttccaatagacaaaacctctgtctcgactaaaaatacaaaaaactagccgggcgtgatggtgggcacctgtagtcccagctacttgggaggctgaggcaggagcatcgcttgaacctgggaggcagaggttgcagtaagccaagatcgcaccactgcactccagcctgggcgacagtgcaagactctgtctcaaaaaaaaaaaaaaaattacctggacgtggtggtgggcgcctgtagtcccagccactacggaggctgaggcaagagaatcacctgaacccaggaagcggagttttcagtgagtggagatcgcaccattgtactccagcccgggtgacggagcgagactaactccaaaaaaaaacccaccacacaagaaaaaaaaaagaaaatcagagtgaacagccatagagtaagcgggccctcaatatcgcccactgtcctaccccagcaccctgcttgtccaaagcccttcagatgtctggggcagccttacagactctcacctcctctccagctggttgacattactcttggaagtggactttgtgaagtcaagtcagagtccaggagtttgtaagcacgtagtgggccccttacagcggacatcgtgaacaacagctctgctctgggtccaacctcacataccccggagccatgctttcttctttttttccttttcccctttctccactgagccctgtctacttggtaattaaacatgctcagttctacccaatcatgtcatacctcccctgtgccaactttgcctctagctacttgttgatttgttcagcaaaatcttgtcaaaaggcctctactgtcacttccactcccctccattaaaactgcatgatcaaggccacgtgtggtggctcaccgcctgtaatcccagcactttaggaggtcaaggagggtggataaccggagccaggagttcaagaccagcctgaccaacatggtgaaatcccgcctctaccaaaaatacaaaaattagccgagcatagtggtggacacctaggttgagcgcagtggctcacgcctgtaatcccagcactttgggtggccaaggcaggcagatcatttgaggtcaggagttccagaccagcctagccaacatagtgaaaccctgtctctactaaaaatacagaaaaattggccgggcacagtgcctcacacctgtaatcccagcactttgggaggctgaggcaggtggatcatgaggtcaggagatcgagaccatcctggctaacatggtgaaaccccgtctctactaaaaatacaaaaattagccaggcgtcgtggcgggcgccagtaatcccagctactccagacgctgggacaggagaatcgcttggacctggaaggcagaggttgcagtgagctgagatcgtgccactgcactccagcctaggcgacagagactcgtctcaaaaacaaaaacaaacaaaaaaactgcatgatcctactatacagatctccatggcaagaaaaagagcaaatgtttttatcttcatcttacttaaccattctttcctggaaatcctctccctttcactcctgttggcaattactgttggttttccagttaattccttagacagtctctgagtccttccttaaccattaactgtagggaatcaggcttgggcccaagtcctcttctcagtggactcacctgctcccagggtctccataatcatctccagggtcaggagatacacaaacccccagtcttcggctccctgaagcctagacgggtagacacaactccactccacaggttctcctctgtgccacaactaaacctcacattctctcttctgtcacactccaatagcaacatgactgcccctacctgcacccagaggctctagaaggaaactggagtaatccttgaccttctcccaagccctcaaatccaatcaactcaactcccttgggtgatcccattctccacagtatcctcatccctaaatcctattcaactcttccatttcctcagcaataaaggtgcctcacagctctaccctgttcctaacacgttgaatggcagcctatgaactcagtaattcttttctttgtaatgggagttatcaaattgtcattttctttctgtacctcatattgttatttctcctattctaattcctgtatgtacaaacagccaattccagattaccgatatatcttttaaataagtccaagcataggccgggcgcagtggctcatgcctgtaatcctagcactttgggaggctgaggcgggcaggtcacctgaagtcaggagttcaagaccagcctgaccaacatggagaaactccgtttctactaaaaatacaaaattagccaggcgtggtggcgcatgcctataatcccagctactcaggaaggctgaggcaggagaatcgcttgaacctgggaggcagaggttgcggtgagccaatgtcgcgtcactgcactccagcctaggcaacaggagcaaaactccatctcaaaaaaaaaaaaaagttttccaagcacagtggctaggccttactgcaatcccatctacggctcacgtgtacttttaaaactcattactgtcctgcatccaagtcctcagtggtttcccactgacctcagaacaaggaccacaggcccaatggggtccctcaggccttgcaacttttgcctgcaacactcttctacctaagctcacatcacttccttttttctcctggaatgtggcaagctctctgccccttcagggatgtgacgcacatagttgacactcatggttaattctctccccaaatatactctgttcaaccttctgtctacctaaatcccactaatccttaaggtctaagctcaaatacaccacctttctcaaaggtcttctcattatccaaattaagtctcatgctctacactaaccacagcactcttgtgttgttaaaggggtcttaaacccacaataggagcctactggggagaaacttgtgcctgttttgttggccaccatgaccccatcctcagcacagacttgacccagctggtccaagattagccaggattaactgttgcccatgtgtaggggggtcaacaccttcctcaagaaggcagtggcctggctaggctgaaaaagacatacaagcagcataaaaaataaaaacatttcatagaagaattacttaaaatgcctaatcttttacatgtcataagtgttttgcatcaggaaatgtttcagaagcaaaattacttcctctctgaaggcaaggcgaagagaccattcctttccaaaacacatgtgtacacttaaaacacttactgcttatttttactccagaattggttttctgttccatttctcagaagtcctaaggcttttcattaactaaaactcaagctgaaaagagccctgtggtgtcctgctcaaggttaatgttagggacaaaacttttttcactccaggctgctaaacaaatttgagtataacaaatataaatactgcagctgaaaaggggctcttcttaaaatagcttaccttaaaaacaaccacggatgccttcagtgggagacacttctggatggtaatgaaatgtcctaaaaaaaaaacagagcgatattggctgtgtggtctcagatcctaggcactggctctgggatcagaactccaggtaaggacagaaacagctgggaagccctttatatagcccgtgggtttaaattaaatctcacaccccatccacctaacagcattttggaagtattatcttttcacagggcaatacagagcacaacaaaagggaaacgccttattgatcttgatgagatttactcttgatgagattctcctgcctcagtacctggtattacaggcgtgcaccaccccacccagcgaatttttgtatttttagtagaaatgggatttcaatatgttggccaggctggtcccaaactcctgacctcaggtgatccgcccgcctctgcccaattctaagtttgtacactgaggaccctaagtgctgggaggaaatttaaatatcgggggcagggcacttgggagggagatgggtgggggagaagtgacaaccacaggggacttgaccttaagacccctctttcactgggatagcatgggcaaggagcaagggtgcttgctagaaattgttcagtctgatttataggaacccctctgtaagcagtgtggagacacatccaaaagacactttcagttttattgggtaacttctttgaaatatgcttcactagaacatacatcataatcactagatcaccaacatcccagtaaaaacgctgccccaaaggactaggacacgggctgagggctatggaattctgagaactaagctgcttgagttttggaaatgtggaattagtaaaaccagctaattatgctgaacctgttgtcttaacatgaagataatcaaatctgccttgtcttgcaaacttccagtgattattacttaagacactattgggggggtgtacaaatggaaagcattacatttattaggaaacctattcaggggtgaaacagtttcaagtactctggaatcaggttttcaaaaggcttcaacaatccgacttgttcaaggatctaaagggtggaacccagtcatcttaatgatctgatccacttatgcccttgtttatccctgcgtgatccacagaccaacaccctgaggcgtctctggggacatgcacaagctggcaaccagacccacgtacacccatttaccccaatggaccagccgctgtaagcctgtagaccacggccactgcgcaccgccaacgcacgcagaggaagagtctggtctccccgtccgcagcgccaagaaagcgctgggggcggggagggctgctcagctcccccaggtgactggacccggaggttttcagatcgagcttgcacgggggccacctagataattaaaacaccaaccctaaaacagatctgggtgggggctaagaatctgcatttccaaaaagcgctcccgaacgagctcttcgcagtgatacaggttggacgggattaacgcttgccttcaggcagagccaatcaagataaatagggcgcgccggagtcctaccagttcggctatctgcagagtaaacagggccgttcaagcaccacccacctcgttttcttttgttcaggacaggactcgaggaaggatcctggcctcccctcctagacacactcccgtgcccccgggaaaccgggcagcactctcgccaggaggctgggagcgcgtctggccgcgccgcccccattactcacttagttccactctcaaaccaaagtccacccggccgggcccgcggactttcatgctctagacttaccacggaggcgagcaggactggtttctgttgctaccaggcaagcgcggctggcagccaagagccccgaaattccaccgaagctcaaccacgcagagggctccggggaaactccaggtgcatgtttttgttctcaacctgcaacagaaatccaagtggtggtggggtcccttccgcaaggtgggaggcccgggcgcgcggtaaacgtgttttggcgggaagcagcgccgaggccccgagacaaggtgacggcgacgttcccgcggcctgctcacggcactccagcagcctcggaccgcccggcccggcaggaaggtcggccccagggcctgcgcgggctcgggcgggagcttccgggcggggggcggagcgagcggcg

SEQ ID NO: 1563 - DNA, 4693 bp, Homo sapiens
gatccgttctctgcgctgccagctcaggtgagccctcgccaaggtgacctcgcaggtgagcaggcgtccactttggggctgctgggtgaagggggtgggtgcccaagaattctgagtaatgaggagcctgttgaggggtctgaggacagatatggctgcagcagccgcttgaaggcctcctgctttgcacccactatcatatggatggtgggttgggggttggaggaaacagaagccagcccttggctaaagaatatatgagctggtggggtatacctctggtcccaactgcttgagatactcaggtgaggagatcacctgagccaagagagttcaaggctgcagtgagccgagatcacgccactgctctccatcctgggtaacagagcaagaccctgtctcaaaaaaaaaaaaaatagtaataataataataataaaataaaaaatgtgacctagagttgagaccctcgtattccaggaactccaggttggtgaaggtagagagaccagtgaaggctgggggaagccagctttggagactgctcctagcccaagaaccgatgttcagaagcagtgcctaacagtctctccctccagtgcctccctcccactgcagaaggaccatgtgtttatttatggatgtatttatttatttattttgagatggagtctccctctgttgcccaggctggagtgcagtgccaggatctcggctcactgcaacctccaccttccaggtttaagtgattctcctgcctcagcttcccaagtagctgggaatacaggcgcctgtcaccacactcagctaatttttgtatttttagtatagatggggttttgccatgttggccaggctgatcttgaactcctgacctcaggtgatccacccgcctcagcctcccaaagtgctgggattataggtgtgagccactgcgcccggcctatggatgtatttattgtaacaggtttttagtgcttactgtgtgctaggcatagttcttaggcttgacaaatagtagttcacgtaattccatcgctataaccttatgaggttgctactattctgatgatcctccttttacaggacactggtgaaggagcagtgaggaacctgcagagtcacacagttggtaagttgctaagaagggacccagcccagacagctggccctggatctgtgatctcatcaggaggccagagctgggtacagcagatgatgacaatggcttcagtattgaaaacttgaccacactaggctaacaatatgcagagggctgggagggggcctgcgctcaaagactcagcctccctaaggacaagtaaatggggtcctggctacttccaacctgagggggaaatgtcataccacaggaggtctatactctgagagcagaatctgggtctgctggagtagggtcccctgccagggctggcaggggaggtcctggctgctgcagtcatctcatcccaggactcagcactccctccctcctccacacccttgcttttgtggaggctctctgggaattcagactgagggtgctggactctggccaccccaggcccagacctttgggaacaatagcctggggcctgataacaatgccctttgtgtggggttaggaaggcaggctccagaccctgacttagaatagcagccacctgaccctgggcatctgattacacctctctaagctccatttttttttttcttctctgaaatagagacaataatagtatcttcctcatggggaggagtagggggtgggtttgtcgcatggattttaacaacgccttctacagcacttactctgtgcaggcacagttttgagctcttagcttgtgcttactcaatccacacaactcccccaggccaccaccatctctagatgggaagacagaaagtagttactttcccaagatctccccacaagcaagtgtatccttggggtttgtacacctactttcaccatggggctctgcctgcccccgcccctgcctcctctcgctgaccaattgagctgtgagcctggagcagatccgtgggctgcagacccccgccccagtgcctctccccctgcagccctgcccctcgaactgtgacatggagagagtgaccctggcccttctcctactggcaggtgagtcctcccagtctcctgggaccctcttgcattcaccccacccacaaaggcagcaaaagccagacaacatctcctttgggagtctggtgttcaatcagcatgctttatttaaactgccaatttagagagaaacatgaaggaaatgacagtacaggtaggatgagaatattgcaaaaaggtcctaatagctccagaggaattgaaccatggaaaacattaaccacctgtggcttgaagacaaaagcagggtggcacagcggctcaggcctgtaatcccagtgttttgggaggccaaggtgggaggatcacttgagcctgggaggatcacttgagcctgggaggtcgaggttgcagtgagctaggattgcaccattgcactccagcctgggtgacagagagaggttccgactcataaaaaagacaagcattccctgtttcttcagggggcagagacataacaaaccatcccagtcagcatgcacacaggagcatcaggaagcctgggacagcagggcttgggcggggccacaccctgaggctgtgtggggctggggagggcgtgaggaagggaactggtggctccagggtcaccccacaacctccgggctggggtcctgctgtctggcttacttggacaccagtgtcatgaattcccacacattttctctgctcctcccacacaggcctgactgccttggaagccaatgacccatttggtgagtgaggcccccaaacagcctgcccactctgcccacatctcccctctgacacccacatcctgtctcctggttctggttctgaagtctttttgccccactttttctagccaataaagacgatcccttctactatggtaagagctgatattcccacccccaccctacccttgcctatcctggacctctttgctagacaagttggtgaggggtagtgtggacctagtgtagacaaagtgggatgggggattaaacctggtctctgtgagagcgtcgctccaacaaggggagggtggccacaggatgcttaggaaccctcctggagaagggctggtgcctgggtggttaggcaccccgataaatcacccctaccctcttgccttcactcaccctcaccctccctttccctagtccccagccctcaggcagtcctcctctcctcctctcccctgggcctcagctccaggacagctttccttgatcatccttcaaagccctttctttgcgcatgtccacttctttttttttttttttttttttttgagacagattctgactctgtcgcctaggctggagtacagtggcatgatctcgggtcactgcaacctccatctcccgggttcaagcaattctcctgtctcagcctctcgagtagctgggactacaggcgcctgccgccacgcctagctaatttttgtatttttagtagagatggggtttcaccatattggtcatgctggtctcgaacttctgacctcaggtgatctgcccgcctcggcctcccaaagtgatgggattacagatgtgagccaccgcacccagcctcactttttttcttcttagtgtttccccacgagacgcagaatgatgcctctgttgctggcttgtctttatgtatatggcagcggctggcacaagcaggggctcaggagtgtcttttgaatgaatgactgaggccccaggctggtgcaagctcactctctgtacccaccccagactggaaaaacctgcagctgagcggactgatctgcggagggctcctggccattgctgggatcgcggcagttctgagtgagtggcaggacaggtggggctggaggacagggtggggctggcggacagggtggggcagaaagagagagtgctctcattccagcactgaccctggcgctgacccctctctctctcccaggtggcaaatgcaaatgcaagagcagccagaagcagcacaggtgagcctgaccctatggtgccctcctccttcggggcagaactacggggggacagtcctgacctggagagtggacagcatcctggccactcgctgggcttgcagctggctttgttattcagatagtcaaccctgaagggccccagtcaggaaagctctgacctcggtattgtgggaagtgaccatggaaggagagcaaggacttgcactcctggggccgggcagcaagagtctgggatataggggagaaggtcctccaggctaacctgatactactctgatgtggtcctttctctagtcctgtacctgagaaggccatcccactcatcactccaggtgagacgggcttctgtgggctgagggggtgtctgtgtaaggactgtgtctgatggcctgcccgccactctccgcaggctctgccactacttgctgagcacaggactggcctccagggatggcctgaagcctaacactggcccccagcacctcctcccctgggaggccttatcctcaaggaaggacttctctccaagggcaggctgttaggcccctttctgatcaggaggcttctttatgaattaaactcgccccaccaccccctc

SEQ ID NO: 1564 - DNA, 22236 bp, Homo sapiens
aaaaagtttaaatcagcattttataaaaactagaaacaaaataattgctttcacaatgtagtacttgaaactaaagttctccagctatcaacagatgtgactccagcatcaagggcctagcaggaaaattctgaatggtttacaacagtgcacataagttgcaggtggctggggccgtgtgtctatttgatgcttcccagaatgtgtgctgctagtcaccatttccaccattcacatatttaacatttttattagacttttatttagcctcatcataagaatataagggagatcatagatttgatgtatgaaatttttaaattcacactaaaatacattacgattaaaatgaattatcttcaaccacccgttttgctatcttttgctgagtaatctgtgccagtcattgtgaaaaagtctttattttaagaaaaaaatttagttaacaaaaaatttaacaagtttcacttagcaaaatacacccaaaaggaaatcacagtacaaagaaagttttaagtcaaggcctcaccaattcctacagtattagtattgtgtctcaattctcaaaactaacttttaaaaagcttaaacttaacctaaaggattttaaatgaaaatataaactagaatgaacaaacatgagaaatatttctttgaatcagggagctagcacctttgagttttccaaaaaagcacgtctccccagtgtgttcactgtgatgtggtgtaaaagatccacatttaacatacttaaactacttaaacttagataacatcactctgaagtatactaccaaaatgttaattgagaaaagctgaaaatagttttagtttactcattatcacatgctagaagaaaattttgcatgagaaaacactgaagaggtaattttttaatccagatttttcacaaactcatggtgcaaaatgggtcccccagcttcctctattataactgctcttaattgcttgttggctgcctgtgaaaatgattgaagtaactcaaatgttcctaacaaaactagtcatagccacccatgctgttctgcccactgtagccggccccgtaacagccactcactgactggctctccaggccactgtaagtggcctgggcagcagacacccccatgccttgcatcacctggctgctatacgccccattgctggcccctgttgttgaattcaagaagagttctatatatctgtgctgcatattggccctgtctttggacatagctgccacagcttcttcatgagtagcaaactcaacatctgcttcacccgtcactcttccatctgggccaatctcaatatggactctcacagggttgagaggagagaagaagttgtaaatgtcgttctcggtcgctttgtacggcaggcccctcatgtggacacagtggcctgtggtgctctgcactgtgaactcactgtcgccgtatctgtggtcatacattccggagagacagtagctgaggtctctcccgaacaggtcggtggtgaagccgtagccatcactgaggccactgtactcctcgtagcccccgtagcctgtgctgtaggcaccaggcctcatcctttccaggcctgcctgcttcacgatgccaatgtacctcctggcagtcccgggccggtcatagggccctggccgctgcacggacatgaacttcagagggggatctgagtatgacctaacttcctcctggctgctcttaaacacctcaatgtacctgtgccctatcctctccttgtgtttccctagagccttctcagctaactcctgcgaggcaaactgcacgaacgcttcccctgtaatcttgccttcggggtccacaggcaatgtgatcccgtttggcacaatttccaaccctgagaagaactgaacaatttcttcctttgtgcatccaaatgggagtcctcgaagccgcacgaagccatcgttggcgctgtcggcactgttgggaccactgtgcttcaacacccaatccatctcggttctgtgggacttgaacacctcaatgtaccggtgtcccatgctttccctgtcttttttcagggccatttttacatcatcttctgatccaagttcaacaaaagcctcaccactctgcctgccctctctagtgtagatgaaatggacacctgcggccccatcatgaatcgtgcagtcagagaggaagttctgcacgtcctcaacagagcaggaccagggcaggccacggagcttgaccacaaagccttcacctccctcagggcccagcatcatggacacttgtcagggtgggtgtcaggtgatcttgggtgtggcttttttgtggctggaaaaaaaaaaaagaaaaatttatttagtatgcaacagaaattttccccattttacagacgagagaggtagcaagacattaagaaatataccaaatacaattgagagctaagagttaactccaggtctctcaaaaaattacattatcagtcacaggcagtttgaaaaacaaatcaggagtttacaagacaggacgatgcatgtgaatgtggtgccttgaacacagagaaatgtaagtttcagtcagtttagagcaagggcatttccttgttatatttattccacatatttgtcatgataatatgtggcagttcacctataagagctcctgagttgttcctcctaaactatacgccttacatttggtaaaatagtaaatttagtaaatctgcttgtctatggtaggatacttttactttcatgagtaaaaataagggatgggaacatagcaggctgtttttaaaccacaacatagggtaagattttctagtgttctcatcagcagtaatgttgccaggatacaagacagcaatggcttccactgtctatggagttatgattttgctcctaaattgtcaattcaaactaaataccagtcaagtatgaggccaaactgatgacatatacagacaagcagacaaattcaccagcagacttagttatgtgcactgcaaataaatggagaaaccagatcagatgattcacaggttcacataaaatatagcagaattgctgccttgtgctgaagatctggaagagggcatcgggaagaaagggcaatcgcaagagggctgagaaatgcccttcccaccagggtggtacatggcacctgaagtccaaactcagagtaaggccaaccacacactggaaggcagtcttctgagaaagaggagcagctgacctagacagcagggtctataacatagtcacaagcaagaaaaacactgcagtatcatggggccaaagacgtatttttatatgaacactgtcaagggtgacgctcaaaaagagcataggagtatatggaatttttttttttttttttttttttgagacaagagtctcactgtcgcccaggctggagtgcagtggtgctgtctcggctcactgcaacctccgcctcctgggttcacgaaattctcctgtctcagcctcctgagtagctgggattacatgcaccagccgccacgcacggctaattttttatacttttaggagatacgggatttcaccatgttggcgaggttggtcttgaactcctgacctcaggtgatccgcccacctcagctgcccaaagtgctggaattactggcgtgagccaccatgcacagctggaaatcgaatgtttcaaagtgtcattttacatcaagcataatagatatagctggtggccttttcaagaaatatgggctcatcatgtggggaaaaaagctccataagaaaaccccacaatttaaaaaacagacaaaaagtaaaggtaagtgtaatttaagaaaaggaaaagcaaattcatactaaataaatgctcaactgcactagcttcagggaaaattagtaattttaaagtttgatgtagccattgcagataatgacatattatcatacagtgcttcatcatttcaaattgacaacgtctaaaaggataattgtgtaaatctttcaaatttacctgtgtctacaccagattataaagataacaagatgtgtctcctctcccaataacaagcataatggcacaaatgaaacagaacagtatgtgatatcctgaacacatcaccaagaccaaacactcggcatttactcacgaactgtgatttggaatgcaagggctttcaaagtatacagcctaactaaaagatgtcacccttgctaatgagagtggaacatggaagcctctgggaagagagtcaaggggagcctaacctggattgctcattgcccacctcaaattattgactatgtacataaactccatcaacttttataaaataatcctgaacggcaaatgattgggcataaataatcctatccccaattctcaaactgtgctttgggtctgcaacaaaccctggggtttagcctccaccttagaaagtaatggtctccgcctccccagggccttatctaaatcccctgcatatggccactgcaacatgctgatctggcagagcaaggtcacagcagattcttcctctcctgtccacggagggaattctgtgctaacagttcagaagctcctccttggagagtcagggcaagtttgtattgtgtctcttgggataatgggtctgggacagctcaattacaggtgggggcttcttatgcaattccattcccaacactgggtcaggctaggcaccgcctgtccttttgtctttgaccataccctggtcttgctcctcactcatgaaaagtatctgaaggcctccctcgagttctgttcctagccttaggtccagccatcgttccgggtaggggagatgaagccataatccactaaccattttctcctggactcctacctccaatgatttcaccattccctgcaggaaaccccacctaatcacatcctactccctccaccacaactgctatccccctcctttgtagagaccttggcttccttatccacacagcctctttctctcctcattcttcataatccagcttagagcaagtatcattttacattccttcctcacaatacatggaattcattcaatgaacttcttaactgtacgcgcccagtaaaaccagagctctggaagattccaaacaaatatctgactactccatggatgtactgagtggctcagctgcacacagccaggcgaaacggtgcctctaagctacaatttctcagcctcaggactactgacattttggaccagacagttctttgtgttgtggaggcaggcccaggcactgtaggatgtttagctgcatccctggtctctgcccactagatgccagtagcaccctccacctccagttctgacaaccgaatgtctccagacattcccaaatgttctctggtggctaatgctgcccccaagttgtgaaatactgtagaaatcagggtgaggccaggcacagtggctcccacctataatcctagcactttgggaggccgaggtgggtgggaccacttgagatcatgagttccaatagacaaaacctctgtctcgactaaaaatacaaaaaactagccgggcgtgatggtgggcacctgtagtcccagctacttgggaggctgaggcaggagcatcgcttgaacctgggaggcagaggttgcagtaagccaagatcgcaccactgcactccagcctgggcgacagtgcaagactctgtctcaaaaaaaaaaaaaaaattacctggacgtggtggtgggcgcctgtagtcccagccactacggaggctgaggcaagagaatcacctgaacccaggaagcggagttttcagtgagtggagatcgcaccattgtactccagcccgggtgacggagcgagactaactccaaaaaaaaacccaccacacaagaaaaaaaaaagaaaatcagagtgaacagccatagagtaagcgggccctcaatatcgcccactgtcctaccccagcaccctgcttgtccaaagcccttcagatgtctggggcagccttacagactctcacctcctctccagctggttgacattactcttggaagtggactttgtgaagtcaagtcagagtccaggagtttgtaagcacgtagtgggccccttacagcggacatcgtgaacaacagctctgctctgggtccaacctcacataccccggagccatgctttcttctttttttccttttcccctttctccactgagccctgtctacttggtaattaaacatgctcagttctacccaatcatgtcatacctcccctgtgccaactttgcctctagctacttgttgatttgttcagcaaaatcttgtcaaaaggcctctactgtcacttccactcccctccattaaaactgcatgatcaaggccacgtgtggtggctcaccgcctgtaatcccagcactttaggaggtcaaggagggtggataaccggagccaggagttcaagaccagcctgaccaacatggtgaaatcccgcctctaccaaaaatacaaaaattagccgagcatagtggtggacacctaggttgagcgcagtggctcacgcctgtaatcccagcactttgggtggccaaggcaggcagatcatttgaggtcaggagttccagaccagcctagccaacatagtgaaaccctgtctctactaaaaatacagaaaaattggccgggcacagtgcctcacacctgtaatcccagcactttgggaggctgaggcaggtggatcatgaggtcaggagatcgagaccatcctggctaacatggtgaaaccccgtctctactaaaaatacaaaaattagccaggcgtcgtggcgggcgccagtaatcccagctactccagacgctgggacaggagaatcgcttggacctggaaggcagaggttgcagtgagctgagatcgtgccactgcactccagcctaggcgacagagactcgtctcaaaaacaaaaacaaacaaaaaaactgcatgatcctactatacagatctccatggcaagaaaaagagcaaatgtttttatcttcatcttacttaaccattctttcctggaaatcctctccctttcactcctgttggcaattactgttggttttccagttaattccttagacagtctctgagtccttccttaaccattaactgtagggaatcaggcttgggcccaagtcctcttctcagtggactcacctgctcccagggtctccataatcatctccagggtcaggagatacacaaacccccagtcttcggctccctgaagcctagacgggtagacacaactccactccacaggttctcctctgtgccacaactaaacctcacattctctcttctgtcacactccaatagcaacatgactgcccctacctgcacccagaggctctagaaggaaactggagtaatccttgaccttctcccaagccctcaaatccaatcaactcaactcccttgggtgatcccattctccacagtatcctcatccctaaatcctattcaactcttccatttcctcagcaataaaggtgcctcacagctctaccctgttcctaacacgttgaatggcagcctatgaactcagtaattcttttctttgtaatgggagttatcaaattgtcattttctttctgtacctcatattgttatttctcctattctaattcctgtatgtacaaacagccaattccagattaccgatatatcttttaaataagtccaagcataggccgggcgcagtggctcatgcctgtaatcctagcactttgggaggctgaggcgggcaggtcacctgaagtcaggagttcaagaccagcctgaccaacatggagaaactccgtttctactaaaaatacaaaattagccaggcgtggtggcgcatgcctataatcccagctactcaggaaggctgaggcaggagaatcgcttgaacctgggaggcagaggttgcggtgagccaatgtcgcgtcactgcactccagcctaggcaacaggagcaaaactccatctcaaaaaaaaaaaaaagttttccaagcacagtggctaggccttactgcaatcccatctacggctcacgtgtacttttaaaactcattactgtcctgcatccaagtcctcagtggtttcccactgacctcagaacaaggaccacaggcccaatggggtccctcaggccttgcaacttttgcctgcaacactcttctacctaagctcacatcacttccttttttctcctggaatgtggcaagctctctgccccttcagggatgtgacgcacatagttgacactcatggttaattctctccccaaatatactctgttcaaccttctgtctacctaaatcccactaatccttaaggtctaagctcaaatacaccacctttctcaaaggtcttctcattatccaaattaagtctcatgctctacactaaccacagcactcttgtgttgttaaaggggtcttaaacccacaataggagcctactggggagaaacttgtgcctgttttgttggccaccatgaccccatcctcagcacagacttgacccagctggtccaagattagccaggattaactgttgcccatgtgtaggggggtcaacaccttcctcaagaaggcagtggcctggctaggctgaaaaagacatacaagcagcataaaaaataaaaacatttcatagaagaattacttaaaatgcctaatcttttacatgtcataagtgttttgcatcaggaaatgtttcagaagcaaaattacttcctctctgaaggcaaggcgaagagaccattcctttccaaaacacatgtgtacacttaaaacacttactgcttatttttactccagaattggttttctgttccatttctcagaagtcctaaggcttttcattaactaaaactcaagctgaaaagagccctgtggtgtcctgctcaaggttaatgttagggacaaaacttttttcactccaggctgctaaacaaatttgagtataacaaatataaatactgcagctgaaaaggggctcttcttaaaatagcttaccttaaaaacaaccacggatgccttcagtgggagacacttctggatggtaatgaaatgtcctaaaaaaaaaacagagcgatattggctgtgtggtctcagatcctaggcactggctctgggatcagaactccaggtaaggacagaaacagctgggaagccctttatatagcccgtgggtttaaattaaatctcacaccccatccacctaacagcattttggaagtattatcttttcacagggcaatacagagcacaacaaaagggaaacgccttattgatcttgatgagatttactcttgatgagattctcctgcctcagtacctggtattacaggcgtgcaccaccccacccagcgaatttttgtatttttagtagaaatgggatttcaatatgttggccaggctggtcccaaactcctgacctcaggtgatccgcccgcctctgcccaattctaagtttgtacactgaggaccctaagtgctgggaggaaatttaaatatcgggggcagggcacttgggagggagatgggtgggggagaagtgacaaccacaggggacttgaccttaagacccctctttcactgggatagcatgggcaaggagcaagggtgcttgctagaaattgttcagtctgatttataggaacccctctgtaagcagtgtggagacacatccaaaagacactttcagttttattgggtaacttctttgaaatatgcttcactagaacatacatcataatcactagatcaccaacatcccagtaaaaacgctgccccaaaggactaggacacgggctgagggctatggaattctgagaactaagctgcttgagttttggaaatgtggaattagtaaaaccagctaattatgctgaacctgttgtcttaacatgaagataatcaaatctgccttgtcttgcaaacttccagtgattattacttaagacactattgggggggtgtacaaatggaaagcattacatttattaggaaacctattcaggggtgaaacagtttcaagtactctggaatcaggttttcaaaaggcttcaacaatccgacttgttcaaggatctaaagggtggaacccagtcatcttaatgatctgatccacttatgcccttgtttatccctgcgtgatccacagaccaacaccctgaggcgtctctggggacatgcacaagctggcaaccagacccacgtacacccatttaccccaatggaccagccgctgtaagcctgtagaccacggccactgcgcaccgccaacgcacgcagaggaagagtctggtctccccgtccgcagcgccaagaaagcgctgggggcggggagggctgctcagctcccccaggtgactggacccggaggttttcagatcgagcttgcacgggggccacctagataattaaaacaccaaccctaaaacagatctgggtgggggctaagaatctgcatttccaaaaagcgctcccgaacgagctcttcgcagtgatacaggttggacgggattaacgcttgccttcaggcagagccaatcaagataaatagggcgcgccggagtcctaccagttcggctatctgcagagtaaacagggccgttcaagcaccacccacctcgttttcttttgttcaggacaggactcgaggaaggatcctggcctcccctcctagacacactcccgtgcccccgggaaaccgggcagcactctcgccaggaggctgggagcgcgtctggccgcgccgcccccattactcacttagttccactctcaaaccaaagtccacccggccgggcccgcggactttcatgctctagacttaccacggaggcgagcaggactggtttctgttgctaccaggcaagcgcggctggcagccaagagccccgaaattccaccgaagctcaaccacgcagagggctccggggaaactccaggtgcatgtttttgttctcaacctgcaacagaaatccaagtggtggtggggtcccttccgcaaggtgggaggcccgggcgcgcggtaaacgtgttttggcgggaagcagcgccgaggccccgagacaaggtgacggcgacgttcccgcggcctgctcacggcactccagcagcctcggaccgcccggcccggcaggaaggtcggccccagggcctgcgcgggctcgggcgggagcttccgggcggggggcggagcgagcggcgcagcggggagagtgggggcagggacgggagggttcccggagggaagggcgcctcgcgggagggggaggggaggggaggggaggggagggggcccctggcgggcttccggggccctgagggcgagagcgagggcgacggcaaggtggggtgggggctgctccccggcccgccaagctagcgctgcctaggcgggagctcggggacccgcgggccgagcgcggctgaagggagggaagggaagaggcgctcgtaggtctgcgtccgtctccgagcgaccggggcggcggaaagggacctggggggggcggccgggactggagtggcggggccggggcgcccgcgcggcggctcaccacgccagggactggcccgtcggccccgaggaggcgcggggtccggagtccgggaagcggaggcctcgtgatccaagaccggcagccggacgtgggtcacggggtgcagaggaggaagtgccattgccgggcccgccaagatgtcaccaatgggaaacgcgtgcctgcaggtgcggccccgtggcccgcgcgctgggcccaggcaggaagtgggggaaggagagagtcagggcggcgggaagacatttctccgagttctcccgaagggagccaggcgcgagcgcgacctggggaaagtccagagtgccagccacggggaagggcgggcagtgcagagtggaagagaagccagcaagttagacacagcccctctctgggaggccgcctctaaaatggaactagcggacgtaccttggtttgtacatttgaccatggacacacgtaaagattttgaaaaaaaatctttgaaaaaaaatttttttaacgcaattcctaaacttttaactaacgcaattttgtggacctctgaatcttaattcaaatgaactggagaacaactataaagcaatttcgataatatgatcagtgacattttatattgcagaattgtaaattttgttgtcattatactgtaattttatttctttaaaagaccctttttagagccacaaatatttgcagatgatacctgatttcttgaatgtttcagattacgtggaaagtggaaatatacatgaaacaagatgtgctatgaactagtaatttttattaaagctcctgatgtatacatagagtttcattacacttgtttctacttttgtgtatgtttgactgttttgtttgtttggttggttttttttgagacacagttttcactctgtcacccaggctggagtgcagtggcatgatcttggctcactgcaacctctgcctcctgggttaaggcgattctcctgcctcagcctcccgagtagctgggactataggcccatgccactatacccagctagtttttgtttttagtagagatgtggtttcaccgtgttggctaggctggtctcgatatcttgacctcgtgatccccctgcctcggcctcccaaagtactgggattataggtgcgagccccatgcccggcctgtttggagtttgttgttgttgtttttttttttttttgagagacagtcttgctctgttgcccgggctggagtgcaatggcacgatctcggctcactgcaacctcccctcccaggttcaagcgattctcctggcctcaacctcctgagtagctgggattataggcgtgcgctaccacaccctggctaatttttgtatttttagtagagacagggtttcaccatgttggtcaggctggtctcaactcctgaccttgtgatccacccacttcagcctctcaaagtgctgggattacaggtgtgagccaccgcgcccggcctgttttacgtttttaacagaattattattattttgagacagggtctggctcagctgcccaggctggaatgcagtggcacgatcatggcaatgcagcctcaacctcccaggctcaagcaagcctccaacctcagcctcctgagtagctgggaccactggcatgcaaccacacccggctaatacaactgtttgtaaaactgagagaaagcaagtctttagaatgcacttactaaataacacgaattacagggaacagtaacatactgcatatagtgatgtagactgtgggaaactacaaggacaaatgagccagtcctacctcagaatagttccagccagataaaagaacccacagaattatggttatgttataaaataaagcaattaagttttagaaatccatcttgaaatatttgtgatggcttggatttgtttgaagttgtccacaaagtagtaggtggggagatggagaataactgtccatgattagtaactgttgaatctgtgtgacaggcacattagcctcaacctcctgggctcaaatgatcctcccacctttagcctccccaacgtagctgggaccacaggtgcatgccaccaagccgggctaattttttttttaattttttagtagaggcaaggtctctctatgatgcccagactggtctgtaactcctgggctcaactgatccaccttggcctcccaaagtgctaggattataggtataagccactgtgcctggcccaaggcaagttttaattattgatcagtcaccatagggttcctgcctgtgagggaacaatgtgtgcagaagacttgagccaggggttgtattgtgcaactgcagctaggtctgagatcaatggtaggagatgacatagccttaaaggcctggtttggtgttcaaaggccagtgggaaggcatttaatggaatgtggtgtgaaaggagttttgctttttaacacaacagtctagatgctatctggaaaatgaatggtgggaagagatacatggagacaagatgggaaggaatgaaacaagtctaggaagactggtgggagaagaatgtgaaagaatgtgtaatgtagagaaaaatgactgagtctggagactgactgactcaccaagaaatactacgcacctaaaagatacaggaactgtagtggtaaagagacacagttcctgccttggtgggtccagtaacagtggagtaggaaatcaagaaatgtacaaatatatgatgacaaattttagaatgaacgaaaaacagaaaataggcattagctcagattggggttctgaggaagtgacatttaaacagacaggagcatgggtgagtgggaacactgagtgatgaatttcatgtagaaagaagggaaattcttttttccttgataaatagctgaggtttaaagtagaagctggccaggagcagtggctcaagcctgtaactccagcactttgggaggccgaggtgggaggatcacttgagcccaagagagttcgagaccagcctgcgcagtatagtgagactcccatctctatataggaaaaagataaaaactgagggaaaaaaaagaagttaaaagcccattattcttttttccttctgtacattatctcccctctggacacttgttcaaattatttatattttttaccaaagccctttactgggatacattttggtgctggatgctttgtattcatattcttatttcgtggtgaatcctttagattgaagaaattttaggacacagcttctgctgctcgtgtctgttcaccacatgagaagcacaagatgcatcttgggggcaaaaattccccatcatggtatatagtatgtgagcagatcatagaccatatttgttatggatgttttccttttctgttggaaatattgaaaattgggtttaatggcctcaaaagtatcttccaacccagcaattttataaaattcctattcagtcactcttaagtacttcctgctgtcatgaactcaagaattatgatacaagacactaattccatttaaaaaaatgcaccaacgcacacatttgtacttaacttttcaggggcacatgtatctgaagtgtgagaattctaacccaattcacacaacgtgccaaattcaatacacagagctatcctaaaagctattaaggactgagaagtggccaggcacagtggctcatgcctgtaatcccagcactttgggaggccgaggcgggtggatcacgaggtcaggagggctaatacggtgaaacctcgtctctactaaaaatacaaaaattagccaaacgtggtggcaggcacctgtagtcccagctactcaggaggctgaggcaggagaatggtgtgaacccgggaggcggaacttgcagggagcccagatcgcaccactgcactccagcctgggcgatagagcgagactccgtctcaaaaaaaaaaaagactgagaagctgcagatggagcatatattaacattttaaatgtttactccattattactacatttatatccaccaaaggggatctgtcctgatctgcatgcaacaggaaagctgttttccattaccatctatcaggtcctttcacttacttgctgtagctaagtctggggggataacacactgcttccctcagcgttcatttctcaaaagctgtgttactaaaaagcatcaagagtagtataatgtaatgttagataaattttatctatactgtttgtactgaaattaatataagggacaaattctgaccgatcataaaacaagcaaccattgctgtttgatattgactgcattttgcaaatgcccaagaatcatgatatctaaggtaaatgttccttaaaacgttaataaaaagcaaaactgctactagacttctgttcctaaaaataaaatctgttcttaactgagggcaaatatcattatttggattagctggagtaactggaaataatatccaaagaaatgggtgtgtatagattccgctaaacaaaaatacaattgataggaagatcaattttgtttttcccagaccacctcctgtacctctctcccttgagcaagcagcccctaaataggtgcatagtcaaaccctggagctggagagaaaggaggcctgtggggtatcctcagccccctgaggaaggtacattccttgggatgggaattcttcctgaagcctccatggaaacatgacaccttagtcaggttccaagcagcaggccctgagctgagactgctggccctgagctgtgctgcccaggggaccactgcattctgccttgggggaattgtgcagaacagagagatggaaggaggaaaggaacatgacaatttacagaagaggggctccggcacccagaaataacataccacacctcaggtttcagggaacaagaagtgctagacaaaaaccataatgattttaacaggaaaaaaagagcaacttcagataccactccattacaaaacttaaaaaaaaaaactttctggaactaaaactgagttttaaatttaaaagttagtaatgaattcaaagaaaggaaaacgaagtagaataaacatcaaaacagaaacaatgggggagaagataagagatttggaggacatactttttccaaagcagtttcctctatactttaggagttttaccaacacacgcctgtgctgtgtcttttcaaaatatcctaatgggaactacagggatcttaagccaggaaaattcacttctaatcctttatcgcttctcttgctgcctccatctgtgtctttttctccttctggaattcctactattcacattatttctcctgcctgaaaagaaaccaaccctatcaacaccctcatcttaagacttctagcctccataaccgtgagaaaatttgttactagtctgtattactttgcatggcagccctagcatactaatacaacgtgttaccaaaccagacaaaaacatcacaagaaaactaacttctgaattctatgtactttaagaggatcgtatatggtatctaacaccaacttaaattagaaaagatatgtatttgtcataaacatcataattctattagatggcactattctaatcaaataacttatgatggatttatcgggatataacagtaagtaagagtatctgtatttgtattaggtgaagcattttgtctaacaggaggcataccgttaggataaatctaataggagtcttaatctgtcatgccttttcttaattatgatggctttttttttttaaacggggtcttgctttcttgctcagggtggtatgcagtactgcaatcacaactcactgcatcctctatgtctttacaagtgttcgctatcatacctggctaattaaaaattctgtttttgaaaagatagggtcttgccatcttgcccaggcttatcttgaactcctgagctcaaaccatcattccactctcggttcactgcaacctccacctcctgagttcaagcaattctcctgcctcagcctgggattacagatgcacaccaccacacctggcaaatttttgtatttttagtagagatggggtttcgccacattggccaggctggtcttggactcctggcctcaagcaatccgcctgccttggccctgctgggattaaaggtgtgaaccaccccgcccagcctgtgtcattttcaagagatctttttcctagccccagcccatatagttatctgaacttacaaagcgttgatgttcttctctaaatttttacacttacatctacaatgaacttggaattgattttttcatttccaaaagagttttacaattaatcaagtatcacaggctaatttcactcaagaactcagatgcaaaagtccaaaccaagtatcagtcaacctaatccagcaatatataaagcgatattatgaccaagttggatttcaggaatgcaagtgtagttgatcatttcaaactcaatcactgcaatttctcatactgatgtatcaatggagacaaagtatagaggtacttttttaatgttttatgagaaatgctaagctgaatttatgtcaaggaagaactgaggccatatatagtggctcacacctgtaatcccagcactttgggaggccgaggtgggcagatcacttgagctcaggagaccaccctgggcgacatggcaaaaccccttctctacaaaaaatacaaaaaaaaatagctgggcatgtggcacacacctgtaatcccagctacttggggggatgaggcaggattgcctgagcccaggaggttgaggctgcagtgagctctgtccacaccagggcactccagtgtgggcatcaaagtgaaaccctttctcgaaaaaaaaaaatgtggagggctgggcgtggtgggtgactcacgcctgtaatcccagcactttgggaggccaaggcaggtggatcacttgaggtcaggagtttgagaccagcctggccaacatggtgaaaccccccaccccctgccactccaccatctctactattagatgggcgtggtggtgctgcacacctgtaatcccagctgctcacgagcctgagaatcgcctgaacccaggaggcggaggctgcagtgagcctggatcctgccactgcactccagcctgggtgacagagtgagaatccgtctataaaaaaaaaaaaaaaggaaaacaaaaacaaaagtacatcttagagcgatcacatgaaaaagtattcctgctaataaatgaaaaggaatcgattattaaaatatcactaatttgaaaaccatttaagaaaataatggatctacataatgatcattaatagctgctgtaacatgacaaaagagaagataccaaccaatatgtgcctccggttggagcacagcacctcaagtaagttttctttccaaaaactctcatctgaatcaaaactacctccagactgggtgcggtggctcacaccagtaatcccagcactttgggaggctgaggcgggtggatcacctgaggtcaggaggttgagaccagcctgaccaacaagttgatactccgtctctactaaaaatacccctgtaatcccagttactcaggaggctgaggcaagagaattgcttgaacccaggaggcagtgagacaagatcacaccattgcactccagcctgggcaacaaaaccaaaactccgtctcaaaaacaaaaataaaaccaaaaccaaaaactacctctagaggtaactatcactttacaggaaatataaagaacagacactcaaagaccaccacggaaaaacaatcagaaaaatgcgaagtgtggggaaggaatgctgcaagacagcccgacaaatataacgggggatggagccttttaagaaaggggaacctctagatgatcacttacacagcatccattcaccacgcttgaaatgtgtaagtgtaaaactcacactggattttgacaagttcacaggattttgtttttaattattttagtcaagatcatggagaaatgaaaaagtgttttaaaattacatgcaaaatagtagtggatatatattaggttaaattattaatacaatgaatcatgtttccttttaccactaaagaatataagattacatttatagcatacattatatttctattggacagtgctgctctgaatttaaaaagttatctacaaaatataaggtgtgactttggatcctgactcaaaccaaccagctgtttaaaatatttaatacatgccgggcgcggtggctcacgcctgtaatcccagcactttgggaggccgaggccggcggatcacgaggtcaggagatcgagaccatccctgctaacatgatgaaaccccgcctctactaaaaatacaaaaaattagccgggcatggtggcggccgcctgtagtcccagcaactcgggaggctgaggcaggagaatggcattaacccgggagatggagtttgcagtgagctgagattgtgccactgcactccagcctgggtgacaagagcaagattccgtctcggaaaaaaaaaaaaatttaatacagaaacacttaaaccctggatacttgatattttggaatgtatttttaggcatgacagcagtatcatggttaggttttaaaagttcttagaaatactgcggatttatttattaataaagaccttattggtctgggatttgctgtaaaataagccagggcggtcttggctgagctcagttctccctctgcccaccctgttgccctccacaagaaccgtagctcagggcaactaagacagggcaagggccctggcaggggaggggtgtcccggtccaacttgggacccagttgggactgggtcccaagtcccaattgtgtccctggacacatgacttctcccaacctccattttctcatctgaaacatggggctaatagcaagcccttctggagtagtcctgagcatgtaattagaaaatggagtaaaacttctaggacctagtaagagtcaactaatgtggttctcccgaagagcagagaaccagagctcagtgggggagagggaattagagaagtcacctccaaggaaagggcctgtcacatttctgcagcccctgcaggcatctacccccaccgggctctcatttgcctccaggctttccaaggttctggccacgtgggagaagtaactttctatttactcagtcttttcccttaaataaattccattttttacctgaataaagctttataacgctacccttaacagaaaacttggcagtttacaaaaaagtggccgggcacgatggctcacgcctgtaatcccagcactttgggaggcagaggcgtgagaatcgcttgagcacaaaagtttgaaaatcaatctgggcaacataaggagaccccatctctacaaaaaatacaaaaatttgccgggcgtgctggagagtgcccgtggtcccagatactcggcggctgaggtgggaggatccgttgagcacaggaggatctcggcagcgagccgagatcacaccattgcactccagcctgggcaacaaagtgagaccctgtctcaaaaaataatacatatttttttatagagacggggtaggtctctggggcccaagcgatcctcccacacctcggcctccctaaatgctgggattacaggcgtgagccacctcgcccggccgataatgactctaatctacagaatgcacaccggaatgtaatacctacaagggaaaagatcttcttgcttaggaataaagcaatctctctcttaatattcattaaagtagtaatgtcttattttatagtttataaattctgtgagagcaacgagtcactttgcaggaatagcacttaaggtatctttcacctacctggagaacccaagaaattttcatcttactaggaattcagagacaaccacgtatttaacttttaaaaatataactaagtagaaagaattatatgcgtgtatttttggaagaattaagatgacttttgggacggaacgactgaaaactacgctttcagaactccctgccgcctgaggctgtggccctgaccccggcgcagggcccgccccgcgcggttccgggaagccgccgccgccgcccgttgcccttcgcgcgcagccgccagcgcgcgcctcgcgtcccgccacgcagatggccggcccgagcccccagcgcccgcgagcagtttcgagaactaaagaggcgcgtcagctcgtccccgggccgcccgcgggcaatggccgagctcggctctccttccaccctccgccgggacacacgcggagccgagcgggggtcccaggcgcctagggggaggggttcccgcgcccggggcggccttggggggagggcgagtcgggtgccttgctcctcaaaaccctggtccacgactctgcggttgggggagccgggcagccggcgcagcaggagccgggccccgtccacaagtttcctacgagcagggcggaatcgacgaaaatacttaatacaaacaaacaaaaggaaaaaaaaaaggacgactaagctgaagagcgcgcacgagtcagattttcaccccaaatacaaacacgatacctctaggagcaggagaccaatacagggaccgcgctccgaggacacgcggcgcagccgaggaggaaaaagggcccggggccgagagctaaggctacgggaaccgggcgtgggaggagggcggagccaactccccac

SEQ ID NO: 1565 - DNA, 23269 bp, Homo sapiens
aaaaagtttaaatcagcattttataaaaactagaaacaaaataattgctttcacaatgtagtacttgaaactaaagttctccagctatcaacagatgtgactccagcatcaagggcctagcaggaaaattctgaatggtttacaacagtgcacataagttgcaggtggctggggccgtgtgtctatttgatgcttcccagaatgtgtgctgctagtcaccatttccaccattcacatatttaacatttttattagacttttatttagcctcatcataagaatataagggagatcatagatttgatgtatgaaatttttaaattcacactaaaatacattacgattaaaatgaattatcttcaaccacccgttttgctatcttttgctgagtaatctgtgccagtcattgtgaaaaagtctttattttaagaaaaaaatttagttaacaaaaaatttaacaagtttcacttagcaaaatacacccaaaaggaaatcacagtacaaagaaagttttaagtcaaggcctcaccaattcctacagtattagtattgtgtctcaattctcaaaactaacttttaaaaagcttaaacttaacctaaaggattttaaatgaaaatataaactagaatgaacaaacatgagaaatatttctttgaatcagggagctagcacctttgagttttccaaaaaagcacgtctccccagtgtgttcactgtgatgtggtgtaaaagatccacatttaacatacttaaactacttaaacttagataacatcactctgaagtatactaccaaaatgttaattgagaaaagctgaaaatagttttagtttactcattatcacatgctagaagaaaattttgcatgagaaaacactgaagaggtaattttttaatccagatttttcacaaactcatggtgcaaaatgggtcccccagcttcctctattataactgctcttaattgcttgttggctgcctgtgaaaatgattgaagtaactcaaatgttcctaacaaaactagtcatagccacccatgctgttctgcccactgtagccggccccgtaacagccactcactgactggctctccaggccactgtaagtggcctgggcagcagacacccccatgccttgcatcacctggctgctatacgccccattgctggcccctgttgttgaattcaagaagagttctatatatctgtgctgcatattggccctgtctttggacatagctgccacagcttcttcatgagtagcaaactcaacatctgcttcacccgtcactcttccatctgggccaatctcaatatggactctcacagggttgagaggagagaagaagttgtaaatgtcgttctcggtcgctttgtacggcaggcccctcatgtggacacagtggcctgtggtgctctgcactgtgaactcactgtcgccgtatctgtggtcatacattccggagagacagtagctgaggtctctcccgaacaggtcggtggtgaagccgtagccatcactgaggccactgtactcctcgtagcccccgtagcctgtgctgtaggcaccaggcctcatcctttccaggcctgcctgcttcacgatgccaatgtacctcctggcagtcccgggccggtcatagggccctggccgctgcacggacatgaacttcagagggggatctgagtatgacctaacttcctcctggctgctcttaaacacctcaatgtacctgtgccctatcctctccttgtgtttccctagagccttctcagctaactcctgcgaggcaaactgcacgaacgcttcccctgtaatcttgccttcggggtccacaggcaatgtgatcccgtttggcacaatttccaaccctgagaagaactgaacaatttcttcctttgtgcatccaaatgggagtcctcgaagccgcacgaagccatcgttggcgctgtcggcactgttgggaccactgtgcttcaacacccaatccatctcggttctgtgggacttgaacacctcaatgtaccggtgtcccatgctttccctgtcttttttcagggccatttttacatcatcttctgatccaagttcaacaaaagcctcaccactctgcctgccctctctagtgtagatgaaatggacacctgcggccccatcatgaatcgtgcagtcagagaggaagttctgcacgtcctcaacagagcaggaccagggcaggccacggagcttgaccacaaagccttcacctccctcagggcccagcatcatggacacttgtcagggtgggtgtcaggtgatcttgggtgtggcttttttgtggctggaaaaaaaaaaaagaaaaatttatttagtatgcaacagaaattttccccattttacagacgagagaggtagcaagacattaagaaatataccaaatacaattgagagctaagagttaactccaggtctctcaaaaaattacattatcagtcacaggcagtttgaaaaacaaatcaggagtttacaagacaggacgatgcatgtgaatgtggtgccttgaacacagagaaatgtaagtttcagtcagtttagagcaagggcatttccttgttatatttattccacatatttgtcatgataatatgtggcagttcacctataagagctcctgagttgttcctcctaaactatacgccttacatttggtaaaatagtaaatttagtaaatctgcttgtctatggtaggatacttttactttcatgagtaaaaataagggatgggaacatagcaggctgtttttaaaccacaacatagggtaagattttctagtgttctcatcagcagtaatgttgccaggatacaagacagcaatggcttccactgtctatggagttatgattttgctcctaaattgtcaattcaaactaaataccagtcaagtatgaggccaaactgatgacatatacagacaagcagacaaattcaccagcagacttagttatgtgcactgcaaataaatggagaaaccagatcagatgattcacaggttcacataaaatatagcagaattgctgccttgtgctgaagatctggaagagggcatcgggaagaaagggcaatcgcaagagggctgagaaatgcccttcccaccagggtggtacatggcacctgaagtccaaactcagagtaaggccaaccacacactggaaggcagtcttctgagaaagaggagcagctgacctagacagcagggtctataacatagtcacaagcaagaaaaacactgcagtatcatggggccaaagacgtatttttatatgaacactgtcaagggtgacgctcaaaaagagcataggagtatatggaatttttttttttttttttttttttgagacaagagtctcactgtcgcccaggctggagtgcagtggtgctgtctcggctcactgcaacctccgcctcctgggttcacgaaattctcctgtctcagcctcctgagtagctgggattacatgcaccagccgccacgcacggctaattttttatacttttaggagatacgggatttcaccatgttggcgaggttggtcttgaactcctgacctcaggtgatccgcccacctcagctgcccaaagtgctggaattactggcgtgagccaccatgcacagctggaaatcgaatgtttcaaagtgtcattttacatcaagcataatagatatagctggtggccttttcaagaaatatgggctcatcatgtggggaaaaaagctccataagaaaaccccacaatttaaaaaacagacaaaaagtaaaggtaagtgtaatttaagaaaaggaaaagcaaattcatactaaataaatgctcaactgcactagcttcagggaaaattagtaattttaaagtttgatgtagccattgcagataatgacatattatcatacagtgcttcatcatttcaaattgacaacgtctaaaaggataattgtgtaaatctttcaaatttacctgtgtctacaccagattataaagataacaagatgtgtctcctctcccaataacaagcataatggcacaaatgaaacagaacagtatgtgatatcctgaacacatcaccaagaccaaacactcggcatttactcacgaactgtgatttggaatgcaagggctttcaaagtatacagcctaactaaaagatgtcacccttgctaatgagagtggaacatggaagcctctgggaagagagtcaaggggagcctaacctggattgctcattgcccacctcaaattattgactatgtacataaactccatcaacttttataaaataatcctgaacggcaaatgattgggcataaataatcctatccccaattctcaaactgtgctttgggtctgcaacaaaccctggggtttagcctccaccttagaaagtaatggtctccgcctccccagggccttatctaaatcccctgcatatggccactgcaacatgctgatctggcagagcaaggtcacagcagattcttcctctcctgtccacggagggaattctgtgctaacagttcagaagctcctccttggagagtcagggcaagtttgtattgtgtctcttgggataatgggtctgggacagctcaattacaggtgggggcttcttatgcaattccattcccaacactgggtcaggctaggcaccgcctgtccttttgtctttgaccataccctggtcttgctcctcactcatgaaaagtatctgaaggcctccctcgagttctgttcctagccttaggtccagccatcgttccgggtaggggagatgaagccataatccactaaccattttctcctggactcctacctccaatgatttcaccattccctgcaggaaaccccacctaatcacatcctactccctccaccacaactgctatccccctcctttgtagagaccttggcttccttatccacacagcctctttctctcctcattcttcataatccagcttagagcaagtatcattttacattccttcctcacaatacatggaattcattcaatgaacttcttaactgtacgcgcccagtaaaaccagagctctggaagattccaaacaaatatctgactactccatggatgtactgagtggctcagctgcacacagccaggcgaaacggtgcctctaagctacaatttctcagcctcaggactactgacattttggaccagacagttctttgtgttgtggaggcaggcccaggcactgtaggatgtttagctgcatccctggtctctgcccactagatgccagtagcaccctccacctccagttctgacaaccgaatgtctccagacattcccaaatgttctctggtggctaatgctgcccccaagttgtgaaatactgtagaaatcagggtgaggccaggcacagtggctcccacctataatcctagcactttgggaggccgaggtgggtgggaccacttgagatcatgagttccaatagacaaaacctctgtctcgactaaaaatacaaaaaactagccgggcgtgatggtgggcacctgtagtcccagctacttgggaggctgaggcaggagcatcgcttgaacctgggaggcagaggttgcagtaagccaagatcgcaccactgcactccagcctgggcgacagtgcaagactctgtctcaaaaaaaaaaaaaaaattacctggacgtggtggtgggcgcctgtagtcccagccactacggaggctgaggcaagagaatcacctgaacccaggaagcggagttttcagtgagtggagatcgcaccattgtactccagcccgggtgacggagcgagactaactccaaaaaaaaacccaccacacaagaaaaaaaaaagaaaatcagagtgaacagccatagagtaagcgggccctcaatatcgcccactgtcctaccccagcaccctgcttgtccaaagcccttcagatgtctggggcagccttacagactctcacctcctctccagctggttgacattactcttggaagtggactttgtgaagtcaagtcagagtccaggagtttgtaagcacgtagtgggccccttacagcggacatcgtgaacaacagctctgctctgggtccaacctcacataccccggagccatgctttcttctttttttccttttcccctttctccactgagccctgtctacttggtaattaaacatgctcagttctacccaatcatgtcatacctcccctgtgccaactttgcctctagctacttgttgatttgttcagcaaaatcttgtcaaaaggcctctactgtcacttccactcccctccattaaaactgcatgatcaaggccacgtgtggtggctcaccgcctgtaatcccagcactttaggaggtcaaggagggtggataaccggagccaggagttcaagaccagcctgaccaacatggtgaaatcccgcctctaccaaaaatacaaaaattagccgagcatagtggtggacacctaggttgagcgcagtggctcacgcctgtaatcccagcactttgggtggccaaggcaggcagatcatttgaggtcaggagttccagaccagcctagccaacatagtgaaaccctgtctctactaaaaatacagaaaaattggccgggcacagtgcctcacacctgtaatcccagcactttgggaggctgaggcaggtggatcatgaggtcaggagatcgagaccatcctggctaacatggtgaaaccccgtctctactaaaaatacaaaaattagccaggcgtcgtggcgggcgccagtaatcccagctactccagacgctgggacaggagaatcgcttggacctggaaggcagaggttgcagtgagctgagatcgtgccactgcactccagcctaggcgacagagactcgtctcaaaaacaaaaacaaacaaaaaaactgcatgatcctactatacagatctccatggcaagaaaaagagcaaatgtttttatcttcatcttacttaaccattctttcctggaaatcctctccctttcactcctgttggcaattactgttggttttccagttaattccttagacagtctctgagtccttccttaaccattaactgtagggaatcaggcttgggcccaagtcctcttctcagtggactcacctgctcccagggtctccataatcatctccagggtcaggagatacacaaacccccagtcttcggctccctgaagcctagacgggtagacacaactccactccacaggttctcctctgtgccacaactaaacctcacattctctcttctgtcacactccaatagcaacatgactgcccctacctgcacccagaggctctagaaggaaactggagtaatccttgaccttctcccaagccctcaaatccaatcaactcaactcccttgggtgatcccattctccacagtatcctcatccctaaatcctattcaactcttccatttcctcagcaataaaggtgcctcacagctctaccctgttcctaacacgttgaatggcagcctatgaactcagtaattcttttctttgtaatgggagttatcaaattgtcattttctttctgtacctcatattgttatttctcctattctaattcctgtatgtacaaacagccaattccagattaccgatatatcttttaaataagtccaagcataggccgggcgcagtggctcatgcctgtaatcctagcactttgggaggctgaggcgggcaggtcacctgaagtcaggagttcaagaccagcctgaccaacatggagaaactccgtttctactaaaaatacaaaattagccaggcgtggtggcgcatgcctataatcccagctactcaggaaggctgaggcaggagaatcgcttgaacctgggaggcagaggttgcggtgagccaatgtcgcgtcactgcactccagcctaggcaacaggagcaaaactccatctcaaaaaaaaaaaaaagttttccaagcacagtggctaggccttactgcaatcccatctacggctcacgtgtacttttaaaactcattactgtcctgcatccaagtcctcagtggtttcccactgacctcagaacaaggaccacaggcccaatggggtccctcaggccttgcaacttttgcctgcaacactcttctacctaagctcacatcacttccttttttctcctggaatgtggcaagctctctgccccttcagggatgtgacgcacatagttgacactcatggttaattctctccccaaatatactctgttcaaccttctgtctacctaaatcccactaatccttaaggtctaagctcaaatacaccacctttctcaaaggtcttctcattatccaaattaagtctcatgctctacactaaccacagcactcttgtgttgttaaaggggtcttaaacccacaataggagcctactggggagaaacttgtgcctgttttgttggccaccatgaccccatcctcagcacagacttgacccagctggtccaagattagccaggattaactgttgcccatgtgtaggggggtcaacaccttcctcaagaaggcagtggcctggctaggctgaaaaagacatacaagcagcataaaaaataaaaacatttcatagaagaattacttaaaatgcctaatcttttacatgtcataagtgttttgcatcaggaaatgtttcagaagcaaaattacttcctctctgaaggcaaggcgaagagaccattcctttccaaaacacatgtgtacacttaaaacacttactgcttatttttactccagaattggttttctgttccatttctcagaagtcctaaggcttttcattaactaaaactcaagctgaaaagagccctgtggtgtcctgctcaaggttaatgttagggacaaaacttttttcactccaggctgctaaacaaatttgagtataacaaatataaatactgcagctgaaaaggggctcttcttaaaatagcttaccttaaaaacaaccacggatgccttcagtgggagacacttctggatggtaatgaaatgtcctaaaaaaaaaacagagcgatattggctgtgtggtctcagatcctaggcactggctctgggatcagaactccaggtaaggacagaaacagctgggaagccctttatatagcccgtgggtttaaattaaatctcacaccccatccacctaacagcattttggaagtattatcttttcacagggcaatacagagcacaacaaaagggaaacgccttattgatcttgatgagatttactcttgatgagattctcctgcctcagtacctggtattacaggcgtgcaccaccccacccagcgaatttttgtatttttagtagaaatgggatttcaatatgttggccaggctggtcccaaactcctgacctcaggtgatccgcccgcctctgcccaattctaagtttgtacactgaggaccctaagtgctgggaggaaatttaaatatcgggggcagggcacttgggagggagatgggtgggggagaagtgacaaccacaggggacttgaccttaagacccctctttcactgggatagcatgggcaaggagcaagggtgcttgctagaaattgttcagtctgatttataggaacccctctgtaagcagtgtggagacacatccaaaagacactttcagttttattgggtaacttctttgaaatatgcttcactagaacatacatcataatcactagatcaccaacatcccagtaaaaacgctgccccaaaggactaggacacgggctgagggctatggaattctgagaactaagctgcttgagttttggaaatgtggaattagtaaaaccagctaattatgctgaacctgttgtcttaacatgaagataatcaaatctgccttgtcttgcaaacttccagtgattattacttaagacactattgggggggtgtacaaatggaaagcattacatttattaggaaacctattcaggggtgaaacagtttcaagtactctggaatcaggttttcaaaaggcttcaacaatccgacttgttcaaggatctaaagggtggaacccagtcatcttaatgatctgatccacttatgcccttgtttatccctgcgtgatccacagaccaacaccctgaggcgtctctggggacatgcacaagctggcaaccagacccacgtacacccatttaccccaatggaccagccgctgtaagcctgtagaccacggccactgcgcaccgccaacgcacgcagaggaagagtctggtctccccgtccgcagcgccaagaaagcgctgggggcggggagggctgctcagctcccccaggtgactggacccggaggttttcagatcgagcttgcacgggggccacctagataattaaaacaccaaccctaaaacagatctgggtgggggctaagaatctgcatttccaaaaagcgctcccgaacgagctcttcgcagtgatacaggttggacgggattaacgcttgccttcaggcagagccaatcaagataaatagggcgcgccggagtcctaccagttcggctatctgcagagtaaacagggccgttcaagcaccacccacctcgttttcttttgttcaggacaggactcgaggaaggatcctggcctcccctcctagacacactcccgtgcccccgggaaaccgggcagcactctcgccaggaggctgggagcgcgtctggccgcgccgcccccattactcacttagttccactctcaaaccaaagtccacccggccgggcccgcggactttcatgctctagacttaccacggaggcgagcaggactggtttctgttgctaccaggcaagcgcggctggcagccaagagccccgaaattccaccgaagctcaaccacgcagagggctccggggaaactccaggtgcatgtttttgttctcaacctgcaacagaaatccaagtggtggtggggtcccttccgcaaggtgggaggcccgggcgcgcggtaaacgtgttttggcgggaagcagcgccgaggccccgagacaaggtgacggcgacgttcccgcggcctgctcacggcactccagcagcctcggaccgcccggcccggcaggaaggtcggccccagggcctgcgcgggctcgggcgggagcttccgggcggggggcggagcgagcggcgcagcggggagagtgggggcagggacgggagggttcccggagggaagggcgcctcgcgggagggggaggggaggggaggggaggggagggggcccctggcgggcttccggggccctgagggcgagagcgagggcgacggcaaggtggggtgggggctgctccccggcccgccaagctagcgctgcctaggcgggagctcggggacccgcgggccgagcgcggctgaagggagggaagggaagaggcgctcgtaggtctgcgtccgtctccgagcgaccggggcggcggaaagggacctggggggggcggccgggactggagtggcggggccggggcgcccgcgcggcggctcaccacgccagggactggcccgtcggccccgaggaggcgcggggtccggagtccgggaagcggaggcctcgtgatccaagaccggcagccggacgtgggtcacggggtgcagaggaggaagtgccattgccgggcccgccaagatgtcaccaatgggaaacgcgtgcctgcaggtgcggccccgtggcccgcgcgctgggcccaggcaggaagtgggggaaggagagagtcagggcggcgggaagacatttctccgagttctcccgaagggagccaggcgcgagcgcgacctggggaaagtccagagtgccagccacggggaagggcgggcagtgcagagtggaagagaagccagcaagttagacacagcccctctctgggaggccgcctctaaaatggaactagcggacgtaccttggtttgtacatttgaccatggacacacgtaaagattttgaaaaaaaatctttgaaaaaaaatttttttaacgcaattcctaaacttttaactaacgcaattttgtggacctctgaatcttaattcaaatgaactggagaacaactataaagcaatttcgataatatgatcagtgacattttatattgcagaattgtaaattttgttgtcattatactgtaattttatttctttaaaagaccctttttagagccacaaatatttgcagatgatacctgatttcttgaatgtttcagattacgtggaaagtggaaatatacatgaaacaagatgtgctatgaactagtaatttttattaaagctcctgatgtatacatagagtttcattacacttgtttctacttttgtgtatgtttgactgttttgtttgtttggttggttttttttgagacacagttttcactctgtcacccaggctggagtgcagtggcatgatcttggctcactgcaacctctgcctcctgggttaaggcgattctcctgcctcagcctcccgagtagctgggactataggcccatgccactatacccagctagtttttgtttttagtagagatgtggtttcaccgtgttggctaggctggtctcgatatcttgacctcgtgatccccctgcctcggcctcccaaagtactgggattataggtgcgagccccatgcccggcctgtttggagtttgttgttgttgtttttttttttttttgagagacagtcttgctctgttgcccgggctggagtgcaatggcacgatctcggctcactgcaacctcccctcccaggttcaagcgattctcctggcctcaacctcctgagtagctgggattataggcgtgcgctaccacaccctggctaatttttgtatttttagtagagacagggtttcaccatgttggtcaggctggtctcaactcctgaccttgtgatccacccacttcagcctctcaaagtgctgggattacaggtgtgagccaccgcgcccggcctgttttacgtttttaacagaattattattattttgagacagggtctggctcagctgcccaggctggaatgcagtggcacgatcatggcaatgcagcctcaacctcccaggctcaagcaagcctccaacctcagcctcctgagtagctgggaccactggcatgcaaccacacccggctaatacaactgtttgtaaaactgagagaaagcaagtctttagaatgcacttactaaataacacgaattacagggaacagtaacatactgcatatagtgatgtagactgtgggaaactacaaggacaaatgagccagtcctacctcagaatagttccagccagataaaagaacccacagaattatggttatgttataaaataaagcaattaagttttagaaatccatcttgaaatatttgtgatggcttggatttgtttgaagttgtccacaaagtagtaggtggggagatggagaataactgtccatgattagtaactgttgaatctgtgtgacaggcacattagcctcaacctcctgggctcaaatgatcctcccacctttagcctccccaacgtagctgggaccacaggtgcatgccaccaagccgggctaattttttttttaattttttagtagaggcaaggtctctctatgatgcccagactggtctgtaactcctgggctcaactgatccaccttggcctcccaaagtgctaggattataggtataagccactgtgcctggcccaaggcaagttttaattattgatcagtcaccatagggttcctgcctgtgagggaacaatgtgtgcagaagacttgagccaggggttgtattgtgcaactgcagctaggtctgagatcaatggtaggagatgacatagccttaaaggcctggtttggtgttcaaaggccagtgggaaggcatttaatggaatgtggtgtgaaaggagttttgctttttaacacaacagtctagatgctatctggaaaatgaatggtgggaagagatacatggagacaagatgggaaggaatgaaacaagtctaggaagactggtgggagaagaatgtgaaagaatgtgtaatgtagagaaaaatgactgagtctggagactgactgactcaccaagaaatactacgcacctaaaagatacaggaactgtagtggtaaagagacacagttcctgccttggtgggtccagtaacagtggagtaggaaatcaagaaatgtacaaatatatgatgacaaattttagaatgaacgaaaaacagaaaataggcattagctcagattggggttctgaggaagtgacatttaaacagacaggagcatgggtgagtgggaacactgagtgatgaatttcatgtagaaagaagggaaattcttttttccttgataaatagctgaggtttaaagtagaagctggccaggagcagtggctcaagcctgtaactccagcactttgggaggccgaggtgggaggatcacttgagcccaagagagttcgagaccagcctgcgcagtatagtgagactcccatctctatataggaaaaagataaaaactgagggaaaaaaaagaagttaaaagcccattattcttttttccttctgtacattatctcccctctggacacttgttcaaattatttatattttttaccaaagccctttactgggatacattttggtgctggatgctttgtattcatattcttatttcgtggtgaatcctttagattgaagaaattttaggacacagcttctgctgctcgtgtctgttcaccacatgagaagcacaagatgcatcttgggggcaaaaattccccatcatggtatatagtatgtgagcagatcatagaccatatttgttatggatgttttccttttctgttggaaatattgaaaattgggtttaatggcctcaaaagtatcttccaacccagcaattttataaaattcctattcagtcactcttaagtacttcctgctgtcatgaactcaagaattatgatacaagacactaattccatttaaaaaaatgcaccaacgcacacatttgtacttaacttttcaggggcacatgtatctgaagtgtgagaattctaacccaattcacacaacgtgccaaattcaatacacagagctatcctaaaagctattaaggactgagaagtggccaggcacagtggctcatgcctgtaatcccagcactttgggaggccgaggcgggtggatcacgaggtcaggagggctaatacggtgaaacctcgtctctactaaaaatacaaaaattagccaaacgtggtggcaggcacctgtagtcccagctactcaggaggctgaggcaggagaatggtgtgaacccgggaggcggaacttgcagggagcccagatcgcaccactgcactccagcctgggcgatagagcgagactccgtctcaaaaaaaaaaaagactgagaagctgcagatggagcatatattaacattttaaatgtttactccattattactacatttatatccaccaaaggggatctgtcctgatctgcatgcaacaggaaagctgttttccattaccatctatcaggtcctttcacttacttgctgtagctaagtctggggggataacacactgcttccctcagcgttcatttctcaaaagctgtgttactaaaaagcatcaagagtagtataatgtaatgttagataaattttatctatactgtttgtactgaaattaatataagggacaaattctgaccgatcataaaacaagcaaccattgctgtttgatattgactgcattttgcaaatgcccaagaatcatgatatctaaggtaaatgttccttaaaacgttaataaaaagcaaaactgctactagacttctgttcctaaaaataaaatctgttcttaactgagggcaaatatcattatttggattagctggagtaactggaaataatatccaaagaaatgggtgtgtatagattccgctaaacaaaaatacaattgataggaagatcaattttgtttttcccagaccacctcctgtacctctctcccttgagcaagcagcccctaaataggtgcatagtcaaaccctggagctggagagaaaggaggcctgtggggtatcctcagccccctgaggaaggtacattccttgggatgggaattcttcctgaagcctccatggaaacatgacaccttagtcaggttccaagcagcaggccctgagctgagactgctggccctgagctgtgctgcccaggggaccactgcattctgccttgggggaattgtgcagaacagagagatggaaggaggaaaggaacatgacaatttacagaagaggggctccggcacccagaaataacataccacacctcaggtttcagggaacaagaagtgctagacaaaaaccataatgattttaacaggaaaaaaagagcaacttcagataccactccattacaaaacttaaaaaaaaaaactttctggaactaaaactgagttttaaatttaaaagttagtaatgaattcaaagaaaggaaaacgaagtagaataaacatcaaaacagaaacaatgggggagaagataagagatttggaggacatactttttccaaagcagtttcctctatactttaggagttttaccaacacacgcctgtgctgtgtcttttcaaaatatcctaatgggaactacagggatcttaagccaggaaaattcacttctaatcctttatcgcttctcttgctgcctccatctgtgtctttttctccttctggaattcctactattcacattatttctcctgcctgaaaagaaaccaaccctatcaacaccctcatcttaagacttctagcctccataaccgtgagaaaatttgttactagtctgtattactttgcatggcagccctagcatactaatacaacgtgttaccaaaccagacaaaaacatcacaagaaaactaacttctgaattctatgtactttaagaggatcgtatatggtatctaacaccaacttaaattagaaaagatatgtatttgtcataaacatcataattctattagatggcactattctaatcaaataacttatgatggatttatcgggatataacagtaagtaagagtatctgtatttgtattaggtgaagcattttgtctaacaggaggcataccgttaggataaatctaataggagtcttaatctgtcatgccttttcttaattatgatggctttttttttttaaacggggtcttgctttcttgctcagggtggtatgcagtactgcaatcacaactcactgcatcctctatgtctttacaagtgttcgctatcatacctggctaattaaaaattctgtttttgaaaagatagggtcttgccatcttgcccaggcttatcttgaactcctgagctcaaaccatcattccactctcggttcactgcaacctccacctcctgagttcaagcaattctcctgcctcagcctgggattacagatgcacaccaccacacctggcaaatttttgtatttttagtagagatggggtttcgccacattggccaggctggtcttggactcctggcctcaagcaatccgcctgccttggccctgctgggattaaaggtgtgaaccaccccgcccagcctgtgtcattttcaagagatctttttcctagccccagcccatatagttatctgaacttacaaagcgttgatgttcttctctaaatttttacacttacatctacaatgaacttggaattgattttttcatttccaaaagagttttacaattaatcaagtatcacaggctaatttcactcaagaactcagatgcaaaagtccaaaccaagtatcagtcaacctaatccagcaatatataaagcgatattatgaccaagttggatttcaggaatgcaagtgtagttgatcatttcaaactcaatcactgcaatttctcatactgatgtatcaatggagacaaagtatagaggtacttttttaatgttttatgagaaatgctaagctgaatttatgtcaaggaagaactgaggccatatatagtggctcacacctgtaatcccagcactttgggaggccgaggtgggcagatcacttgagctcaggagaccaccctgggcgacatggcaaaaccccttctctacaaaaaatacaaaaaaaaatagctgggcatgtggcacacacctgtaatcccagctacttggggggatgaggcaggattgcctgagcccaggaggttgaggctgcagtgagctctgtccacaccagggcactccagtgtgggcatcaaagtgaaaccctttctcgaaaaaaaaaaatgtggagggctgggcgtggtgggtgactcacgcctgtaatcccagcactttgggaggccaaggcaggtggatcacttgaggtcaggagtttgagaccagcctggccaacatggtgaaaccccccaccccctgccactccaccatctctactattagatgggcgtggtggtgctgcacacctgtaatcccagctgctcacgagcctgagaatcgcctgaacccaggaggcggaggctgcagtgagcctggatcctgccactgcactccagcctgggtgacagagtgagaatccgtctataaaaaaaaaaaaaaaggaaaacaaaaacaaaagtacatcttagagcgatcacatgaaaaagtattcctgctaataaatgaaaaggaatcgattattaaaatatcactaatttgaaaaccatttaagaaaataatggatctacataatgatcattaatagctgctgtaacatgacaaaagagaagataccaaccaatatgtgcctccggttggagcacagcacctcaagtaagttttctttccaaaaactctcatctgaatcaaaactacctccagactgggtgcggtggctcacaccagtaatcccagcactttgggaggctgaggcgggtggatcacctgaggtcaggaggttgagaccagcctgaccaacaagttgatactccgtctctactaaaaatacccctgtaatcccagttactcaggaggctgaggcaagagaattgcttgaacccaggaggcagtgagacaagatcacaccattgcactccagcctgggcaacaaaaccaaaactccgtctcaaaaacaaaaataaaaccaaaaccaaaaactacctctagaggtaactatcactttacaggaaatataaagaacagacactcaaagaccaccacggaaaaacaatcagaaaaatgcgaagtgtggggaaggaatgctgcaagacagcccgacaaatataacgggggatggagccttttaagaaaggggaacctctagatgatcacttacacagcatccattcaccacgcttgaaatgtgtaagtgtaaaactcacactggattttgacaagttcacaggattttgtttttaattattttagtcaagatcatggagaaatgaaaaagtgttttaaaattacatgcaaaatagtagtggatatatattaggttaaattattaatacaatgaatcatgtttccttttaccactaaagaatataagattacatttatagcatacattatatttctattggacagtgctgctctgaatttaaaaagttatctacaaaatataaggtgtgactttggatcctgactcaaaccaaccagctgtttaaaatatttaatacatgccgggcgcggtggctcacgcctgtaatcccagcactttgggaggccgaggccggcggatcacgaggtcaggagatcgagaccatccctgctaacatgatgaaaccccgcctctactaaaaatacaaaaaattagccgggcatggtggcggccgcctgtagtcccagcaactcgggaggctgaggcaggagaatggcattaacccgggagatggagtttgcagtgagctgagattgtgccactgcactccagcctgggtgacaagagcaagattccgtctcggaaaaaaaaaaaaatttaatacagaaacacttaaaccctggatacttgatattttggaatgtatttttaggcatgacagcagtatcatggttaggttttaaaagttcttagaaatactgcggatttatttattaataaagaccttattggtctgggatttgctgtaaaataagccagggcggtcttggctgagctcagttctccctctgcccaccctgttgccctccacaagaaccgtagctcagggcaactaagacagggcaagggccctggcaggggaggggtgtcccggtccaacttgggacccagttgggactgggtcccaagtcccaattgtgtccctggacacatgacttctcccaacctccattttctcatctgaaacatggggctaatagcaagcccttctggagtagtcctgagcatgtaattagaaaatggagtaaaacttctaggacctagtaagagtcaactaatgtggttctcccgaagagcagagaaccagagctcagtgggggagagggaattagagaagtcacctccaaggaaagggcctgtcacatttctgcagcccctgcaggcatctacccccaccgggctctcatttgcctccaggctttccaaggttctggccacgtgggagaagtaactttctatttactcagtcttttcccttaaataaattccattttttacctgaataaagctttataacgctacccttaacagaaaacttggcagtttacaaaaaagtggccgggcacgatggctcacgcctgtaatcccagcactttgggaggcagaggcgtgagaatcgcttgagcacaaaagtttgaaaatcaatctgggcaacataaggagaccccatctctacaaaaaatacaaaaatttgccgggcgtgctggagagtgcccgtggtcccagatactcggcggctgaggtgggaggatccgttgagcacaggaggatctcggcagcgagccgagatcacaccattgcactccagcctgggcaacaaagtgagaccctgtctcaaaaaataatacatatttttttatagagacggggtaggtctctggggcccaagcgatcctcccacacctcggcctccctaaatgctgggattacaggcgtgagccacctcgcccggccgataatgactctaatctacagaatgcacaccggaatgtaatacctacaagggaaaagatcttcttgcttaggaataaagcaatctctctcttaatattcattaaagtagtaatgtcttattttatagtttataaattctgtgagagcaacgagtcactttgcaggaatagcacttaaggtatctttcacctacctggagaacccaagaaattttcatcttactaggaattcagagacaaccacgtatttaacttttaaaaatataactaagtagaaagaattatatgcgtgtatttttggaagaattaagatgacttttgggacggaacgactgaaaactacgctttcagaactccctgccgcctgaggctgtggccctgaccccggcgcagggcccgccccgcgcggttccgggaagccgccgccgccgcccgttgcccttcgcgcgcagccgccagcgcgcgcctcgcgtcccgccacgcagatggccggcccgagcccccagcgcccgcgagcagtttcgagaactaaagaggcgcgtcagctcgtccccgggccgcccgcgggcaatggccgagctcggctctccttccaccctccgccgggacacacgcggagccgagcgggggtcccaggcgcctagggggaggggttcccgcgcccggggcggccttggggggagggcgagtcgggtgccttgctcctcaaaaccctggtccacgactctgcggttgggggagccgggcagccggcgcagcaggagccgggccccgtccacaagtttcctacgagcagggcggaatcgacgaaaatacttaatacaaacaaacaaaaggaaaaaaaaaaggacgactaagctgaagagcgcgcacgagtcagattttcaccccaaatacaaacacgatacctctaggagcaggagaccaatacagggaccgcgctccgaggacacgcggcgcagccgaggaggaaaaagggcccggggccgagagctaaggctacgggaaccgggcgtgggaggagggcggagccaactccccacaaggaagtcttgtgcaactctcaggcgcctgcagccacgtgagcgcgcggctttcattttactcaggtattattactattattacttcttttgagacaaggtctcatttccgtcgcccggctggaatgcagtggcacaatcactgtcactgcagcctcgacctcagagcaagcgaccctcccgcctcagcctcccgagtagctgggacaacaggcgcgcgccaccacacgtggctaatttttttttctttacttttcagtagagacagtctatgttgcccaggcttgtcgggaactcctgggctcaagagatcctcccggctgggcctcccactgcgccaggcctgttctcactttcagagccctccggcagtcgccagctccccgccagggggccggactaacgcacccggccgtccgtgccttccccgcgctttcctgactccaaaatctcagcccgcggtgctcaccgcgtgggaccactgtctgggcgtgcggctctcgacctccgacgctgcgtctcccgatcccagtgggtccagttcttgccggtcccacgtacgggcccctcgacctcgaatcccgtcacccaaatctcagcgccacggcccctcattatgtgcagtcctcgctcggtcccaggtttgcggcgcttaaactcagatcgctcttccctgatcccaaatcccagccccagcccaacgatccccaccccaataggcccagtccccaggtagtccgggtacggggccctggacttcggatagtctccctaatctcaaatcccaccccccgtccccacccccagggggacccggtccccgctaggtcccgggtgtgcggccttcgacctcggagacttcggccgcccctcacctcggcctccgagtctctacactcccgctctcatatcaggcaccccggtggtcccttggagcacctagaggagggtgggacgcggggaacttggcagttgtagcagaggcagttgaggcttgttgaccatcaccatggaaacccccgcctgcgagcac

SEQ ID NO: 1566 - DNA, 23633 bp, Homo sapiens
aaaaagtttaaatcagcattttataaaaactagaaacaaaataattgctttcacaatgtagtacttgaaactaaagttctccagctatcaacagatgtgactccagcatcaagggcctagcaggaaaattctgaatggtttacaacagtgcacataagttgcaggtggctggggccgtgtgtctatttgatgcttcccagaatgtgtgctgctagtcaccatttccaccattcacatatttaacatttttattagacttttatttagcctcatcataagaatataagggagatcatagatttgatgtatgaaatttttaaattcacactaaaatacattacgattaaaatgaattatcttcaaccacccgttttgctatcttttgctgagtaatctgtgccagtcattgtgaaaaagtctttattttaagaaaaaaatttagttaacaaaaaatttaacaagtttcacttagcaaaatacacccaaaaggaaatcacagtacaaagaaagttttaagtcaaggcctcaccaattcctacagtattagtattgtgtctcaattctcaaaactaacttttaaaaagcttaaacttaacctaaaggattttaaatgaaaatataaactagaatgaacaaacatgagaaatatttctttgaatcagggagctagcacctttgagttttccaaaaaagcacgtctccccagtgtgttcactgtgatgtggtgtaaaagatccacatttaacatacttaaactacttaaacttagataacatcactctgaagtatactaccaaaatgttaattgagaaaagctgaaaatagttttagtttactcattatcacatgctagaagaaaattttgcatgagaaaacactgaagaggtaattttttaatccagatttttcacaaactcatggtgcaaaatgggtcccccagcttcctctattataactgctcttaattgcttgttggctgcctgtgaaaatgattgaagtaactcaaatgttcctaacaaaactagtcatagccacccatgctgttctgcccactgtagccggccccgtaacagccactcactgactggctctccaggccactgtaagtggcctgggcagcagacacccccatgccttgcatcacctggctgctatacgccccattgctggcccctgttgttgaattcaagaagagttctatatatctgtgctgcatattggccctgtctttggacatagctgccacagcttcttcatgagtagcaaactcaacatctgcttcacccgtcactcttccatctgggccaatctcaatatggactctcacagggttgagaggagagaagaagttgtaaatgtcgttctcggtcgctttgtacggcaggcccctcatgtggacacagtggcctgtggtgctctgcactgtgaactcactgtcgccgtatctgtggtcatacattccggagagacagtagctgaggtctctcccgaacaggtcggtggtgaagccgtagccatcactgaggccactgtactcctcgtagcccccgtagcctgtgctgtaggcaccaggcctcatcctttccaggcctgcctgcttcacgatgccaatgtacctcctggcagtcccgggccggtcatagggccctggccgctgcacggacatgaacttcagagggggatctgagtatgacctaacttcctcctggctgctcttaaacacctcaatgtacctgtgccctatcctctccttgtgtttccctagagccttctcagctaactcctgcgaggcaaactgcacgaacgcttcccctgtaatcttgccttcggggtccacaggcaatgtgatcccgtttggcacaatttccaaccctgagaagaactgaacaatttcttcctttgtgcatccaaatgggagtcctcgaagccgcacgaagccatcgttggcgctgtcggcactgttgggaccactgtgcttcaacacccaatccatctcggttctgtgggacttgaacacctcaatgtaccggtgtcccatgctttccctgtcttttttcagggccatttttacatcatcttctgatccaagttcaacaaaagcctcaccactctgcctgccctctctagtgtagatgaaatggacacctgcggccccatcatgaatcgtgcagtcagagaggaagttctgcacgtcctcaacagagcaggaccagggcaggccacggagcttgaccacaaagccttcacctccctcagggcccagcatcatggacacttgtcagggtgggtgtcaggtgatcttgggtgtggcttttttgtggctggaaaaaaaaaaaagaaaaatttatttagtatgcaacagaaattttccccattttacagacgagagaggtagcaagacattaagaaatataccaaatacaattgagagctaagagttaactccaggtctctcaaaaaattacattatcagtcacaggcagtttgaaaaacaaatcaggagtttacaagacaggacgatgcatgtgaatgtggtgccttgaacacagagaaatgtaagtttcagtcagtttagagcaagggcatttccttgttatatttattccacatatttgtcatgataatatgtggcagttcacctataagagctcctgagttgttcctcctaaactatacgccttacatttggtaaaatagtaaatttagtaaatctgcttgtctatggtaggatacttttactttcatgagtaaaaataagggatgggaacatagcaggctgtttttaaaccacaacatagggtaagattttctagtgttctcatcagcagtaatgttgccaggatacaagacagcaatggcttccactgtctatggagttatgattttgctcctaaattgtcaattcaaactaaataccagtcaagtatgaggccaaactgatgacatatacagacaagcagacaaattcaccagcagacttagttatgtgcactgcaaataaatggagaaaccagatcagatgattcacaggttcacataaaatatagcagaattgctgccttgtgctgaagatctggaagagggcatcgggaagaaagggcaatcgcaagagggctgagaaatgcccttcccaccagggtggtacatggcacctgaagtccaaactcagagtaaggccaaccacacactggaaggcagtcttctgagaaagaggagcagctgacctagacagcagggtctataacatagtcacaagcaagaaaaacactgcagtatcatggggccaaagacgtatttttatatgaacactgtcaagggtgacgctcaaaaagagcataggagtatatggaatttttttttttttttttttttttgagacaagagtctcactgtcgcccaggctggagtgcagtggtgctgtctcggctcactgcaacctccgcctcctgggttcacgaaattctcctgtctcagcctcctgagtagctgggattacatgcaccagccgccacgcacggctaattttttatacttttaggagatacgggatttcaccatgttggcgaggttggtcttgaactcctgacctcaggtgatccgcccacctcagctgcccaaagtgctggaattactggcgtgagccaccatgcacagctggaaatcgaatgtttcaaagtgtcattttacatcaagcataatagatatagctggtggccttttcaagaaatatgggctcatcatgtggggaaaaaagctccataagaaaaccccacaatttaaaaaacagacaaaaagtaaaggtaagtgtaatttaagaaaaggaaaagcaaattcatactaaataaatgctcaactgcactagcttcagggaaaattagtaattttaaagtttgatgtagccattgcagataatgacatattatcatacagtgcttcatcatttcaaattgacaacgtctaaaaggataattgtgtaaatctttcaaatttacctgtgtctacaccagattataaagataacaagatgtgtctcctctcccaataacaagcataatggcacaaatgaaacagaacagtatgtgatatcctgaacacatcaccaagaccaaacactcggcatttactcacgaactgtgatttggaatgcaagggctttcaaagtatacagcctaactaaaagatgtcacccttgctaatgagagtggaacatggaagcctctgggaagagagtcaaggggagcctaacctggattgctcattgcccacctcaaattattgactatgtacataaactccatcaacttttataaaataatcctgaacggcaaatgattgggcataaataatcctatccccaattctcaaactgtgctttgggtctgcaacaaaccctggggtttagcctccaccttagaaagtaatggtctccgcctccccagggccttatctaaatcccctgcatatggccactgcaacatgctgatctggcagagcaaggtcacagcagattcttcctctcctgtccacggagggaattctgtgctaacagttcagaagctcctccttggagagtcagggcaagtttgtattgtgtctcttgggataatgggtctgggacagctcaattacaggtgggggcttcttatgcaattccattcccaacactgggtcaggctaggcaccgcctgtccttttgtctttgaccataccctggtcttgctcctcactcatgaaaagtatctgaaggcctccctcgagttctgttcctagccttaggtccagccatcgttccgggtaggggagatgaagccataatccactaaccattttctcctggactcctacctccaatgatttcaccattccctgcaggaaaccccacctaatcacatcctactccctccaccacaactgctatccccctcctttgtagagaccttggcttccttatccacacagcctctttctctcctcattcttcataatccagcttagagcaagtatcattttacattccttcctcacaatacatggaattcattcaatgaacttcttaactgtacgcgcccagtaaaaccagagctctggaagattccaaacaaatatctgactactccatggatgtactgagtggctcagctgcacacagccaggcgaaacggtgcctctaagctacaatttctcagcctcaggactactgacattttggaccagacagttctttgtgttgtggaggcaggcccaggcactgtaggatgtttagctgcatccctggtctctgcccactagatgccagtagcaccctccacctccagttctgacaaccgaatgtctccagacattcccaaatgttctctggtggctaatgctgcccccaagttgtgaaatactgtagaaatcagggtgaggccaggcacagtggctcccacctataatcctagcactttgggaggccgaggtgggtgggaccacttgagatcatgagttccaatagacaaaacctctgtctcgactaaaaatacaaaaaactagccgggcgtgatggtgggcacctgtagtcccagctacttgggaggctgaggcaggagcatcgcttgaacctgggaggcagaggttgcagtaagccaagatcgcaccactgcactccagcctgggcgacagtgcaagactctgtctcaaaaaaaaaaaaaaaattacctggacgtggtggtgggcgcctgtagtcccagccactacggaggctgaggcaagagaatcacctgaacccaggaagcggagttttcagtgagtggagatcgcaccattgtactccagcccgggtgacggagcgagactaactccaaaaaaaaacccaccacacaagaaaaaaaaaagaaaatcagagtgaacagccatagagtaagcgggccctcaatatcgcccactgtcctaccccagcaccctgcttgtccaaagcccttcagatgtctggggcagccttacagactctcacctcctctccagctggttgacattactcttggaagtggactttgtgaagtcaagtcagagtccaggagtttgtaagcacgtagtgggccccttacagcggacatcgtgaacaacagctctgctctgggtccaacctcacataccccggagccatgctttcttctttttttccttttcccctttctccactgagccctgtctacttggtaattaaacatgctcagttctacccaatcatgtcatacctcccctgtgccaactttgcctctagctacttgttgatttgttcagcaaaatcttgtcaaaaggcctctactgtcacttccactcccctccattaaaactgcatgatcaaggccacgtgtggtggctcaccgcctgtaatcccagcactttaggaggtcaaggagggtggataaccggagccaggagttcaagaccagcctgaccaacatggtgaaatcccgcctctaccaaaaatacaaaaattagccgagcatagtggtggacacctaggttgagcgcagtggctcacgcctgtaatcccagcactttgggtggccaaggcaggcagatcatttgaggtcaggagttccagaccagcctagccaacatagtgaaaccctgtctctactaaaaatacagaaaaattggccgggcacagtgcctcacacctgtaatcccagcactttgggaggctgaggcaggtggatcatgaggtcaggagatcgagaccatcctggctaacatggtgaaaccccgtctctactaaaaatacaaaaattagccaggcgtcgtggcgggcgccagtaatcccagctactccagacgctgggacaggagaatcgcttggacctggaaggcagaggttgcagtgagctgagatcgtgccactgcactccagcctaggcgacagagactcgtctcaaaaacaaaaacaaacaaaaaaactgcatgatcctactatacagatctccatggcaagaaaaagagcaaatgtttttatcttcatcttacttaaccattctttcctggaaatcctctccctttcactcctgttggcaattactgttggttttccagttaattccttagacagtctctgagtccttccttaaccattaactgtagggaatcaggcttgggcccaagtcctcttctcagtggactcacctgctcccagggtctccataatcatctccagggtcaggagatacacaaacccccagtcttcggctccctgaagcctagacgggtagacacaactccactccacaggttctcctctgtgccacaactaaacctcacattctctcttctgtcacactccaatagcaacatgactgcccctacctgcacccagaggctctagaaggaaactggagtaatccttgaccttctcccaagccctcaaatccaatcaactcaactcccttgggtgatcccattctccacagtatcctcatccctaaatcctattcaactcttccatttcctcagcaataaaggtgcctcacagctctaccctgttcctaacacgttgaatggcagcctatgaactcagtaattcttttctttgtaatgggagttatcaaattgtcattttctttctgtacctcatattgttatttctcctattctaattcctgtatgtacaaacagccaattccagattaccgatatatcttttaaataagtccaagcataggccgggcgcagtggctcatgcctgtaatcctagcactttgggaggctgaggcgggcaggtcacctgaagtcaggagttcaagaccagcctgaccaacatggagaaactccgtttctactaaaaatacaaaattagccaggcgtggtggcgcatgcctataatcccagctactcaggaaggctgaggcaggagaatcgcttgaacctgggaggcagaggttgcggtgagccaatgtcgcgtcactgcactccagcctaggcaacaggagcaaaactccatctcaaaaaaaaaaaaaagttttccaagcacagtggctaggccttactgcaatcccatctacggctcacgtgtacttttaaaactcattactgtcctgcatccaagtcctcagtggtttcccactgacctcagaacaaggaccacaggcccaatggggtccctcaggccttgcaacttttgcctgcaacactcttctacctaagctcacatcacttccttttttctcctggaatgtggcaagctctctgccccttcagggatgtgacgcacatagttgacactcatggttaattctctccccaaatatactctgttcaaccttctgtctacctaaatcccactaatccttaaggtctaagctcaaatacaccacctttctcaaaggtcttctcattatccaaattaagtctcatgctctacactaaccacagcactcttgtgttgttaaaggggtcttaaacccacaataggagcctactggggagaaacttgtgcctgttttgttggccaccatgaccccatcctcagcacagacttgacccagctggtccaagattagccaggattaactgttgcccatgtgtaggggggtcaacaccttcctcaagaaggcagtggcctggctaggctgaaaaagacatacaagcagcataaaaaataaaaacatttcatagaagaattacttaaaatgcctaatcttttacatgtcataagtgttttgcatcaggaaatgtttcagaagcaaaattacttcctctctgaaggcaaggcgaagagaccattcctttccaaaacacatgtgtacacttaaaacacttactgcttatttttactccagaattggttttctgttccatttctcagaagtcctaaggcttttcattaactaaaactcaagctgaaaagagccctgtggtgtcctgctcaaggttaatgttagggacaaaacttttttcactccaggctgctaaacaaatttgagtataacaaatataaatactgcagctgaaaaggggctcttcttaaaatagcttaccttaaaaacaaccacggatgccttcagtgggagacacttctggatggtaatgaaatgtcctaaaaaaaaaacagagcgatattggctgtgtggtctcagatcctaggcactggctctgggatcagaactccaggtaaggacagaaacagctgggaagccctttatatagcccgtgggtttaaattaaatctcacaccccatccacctaacagcattttggaagtattatcttttcacagggcaatacagagcacaacaaaagggaaacgccttattgatcttgatgagatttactcttgatgagattctcctgcctcagtacctggtattacaggcgtgcaccaccccacccagcgaatttttgtatttttagtagaaatgggatttcaatatgttggccaggctggtcccaaactcctgacctcaggtgatccgcccgcctctgcccaattctaagtttgtacactgaggaccctaagtgctgggaggaaatttaaatatcgggggcagggcacttgggagggagatgggtgggggagaagtgacaaccacaggggacttgaccttaagacccctctttcactgggatagcatgggcaaggagcaagggtgcttgctagaaattgttcagtctgatttataggaacccctctgtaagcagtgtggagacacatccaaaagacactttcagttttattgggtaacttctttgaaatatgcttcactagaacatacatcataatcactagatcaccaacatcccagtaaaaacgctgccccaaaggactaggacacgggctgagggctatggaattctgagaactaagctgcttgagttttggaaatgtggaattagtaaaaccagctaattatgctgaacctgttgtcttaacatgaagataatcaaatctgccttgtcttgcaaacttccagtgattattacttaagacactattgggggggtgtacaaatggaaagcattacatttattaggaaacctattcaggggtgaaacagtttcaagtactctggaatcaggttttcaaaaggcttcaacaatccgacttgttcaaggatctaaagggtggaacccagtcatcttaatgatctgatccacttatgcccttgtttatccctgcgtgatccacagaccaacaccctgaggcgtctctggggacatgcacaagctggcaaccagacccacgtacacccatttaccccaatggaccagccgctgtaagcctgtagaccacggccactgcgcaccgccaacgcacgcagaggaagagtctggtctccccgtccgcagcgccaagaaagcgctgggggcggggagggctgctcagctcccccaggtgactggacccggaggttttcagatcgagcttgcacgggggccacctagataattaaaacaccaaccctaaaacagatctgggtgggggctaagaatctgcatttccaaaaagcgctcccgaacgagctcttcgcagtgatacaggttggacgggattaacgcttgccttcaggcagagccaatcaagataaatagggcgcgccggagtcctaccagttcggctatctgcagagtaaacagggccgttcaagcaccacccacctcgttttcttttgttcaggacaggactcgaggaaggatcctggcctcccctcctagacacactcccgtgcccccgggaaaccgggcagcactctcgccaggaggctgggagcgcgtctggccgcgccgcccccattactcacttagttccactctcaaaccaaagtccacccggccgggcccgcggactttcatgctctagacttaccacggaggcgagcaggactggtttctgttgctaccaggcaagcgcggctggcagccaagagccccgaaattccaccgaagctcaaccacgcagagggctccggggaaactccaggtgcatgtttttgttctcaacctgcaacagaaatccaagtggtggtggggtcccttccgcaaggtgggaggcccgggcgcgcggtaaacgtgttttggcgggaagcagcgccgaggccccgagacaaggtgacggcgacgttcccgcggcctgctcacggcactccagcagcctcggaccgcccggcccggcaggaaggtcggccccagggcctgcgcgggctcgggcgggagcttccgggcggggggcggagcgagcggcgcagcggggagagtgggggcagggacgggagggttcccggagggaagggcgcctcgcgggagggggaggggaggggaggggaggggagggggcccctggcgggcttccggggccctgagggcgagagcgagggcgacggcaaggtggggtgggggctgctccccggcccgccaagctagcgctgcctaggcgggagctcggggacccgcgggccgagcgcggctgaagggagggaagggaagaggcgctcgtaggtctgcgtccgtctccgagcgaccggggcggcggaaagggacctggggggggcggccgggactggagtggcggggccggggcgcccgcgcggcggctcaccacgccagggactggcccgtcggccccgaggaggcgcggggtccggagtccgggaagcggaggcctcgtgatccaagaccggcagccggacgtgggtcacggggtgcagaggaggaagtgccattgccgggcccgccaagatgtcaccaatgggaaacgcgtgcctgcaggtgcggccccgtggcccgcgcgctgggcccaggcaggaagtgggggaaggagagagtcagggcggcgggaagacatttctccgagttctcccgaagggagccaggcgcgagcgcgacctggggaaagtccagagtgccagccacggggaagggcgggcagtgcagagtggaagagaagccagcaagttagacacagcccctctctgggaggccgcctctaaaatggaactagcggacgtaccttggtttgtacatttgaccatggacacacgtaaagattttgaaaaaaaatctttgaaaaaaaatttttttaacgcaattcctaaacttttaactaacgcaattttgtggacctctgaatcttaattcaaatgaactggagaacaactataaagcaatttcgataatatgatcagtgacattttatattgcagaattgtaaattttgttgtcattatactgtaattttatttctttaaaagaccctttttagagccacaaatatttgcagatgatacctgatttcttgaatgtttcagattacgtggaaagtggaaatatacatgaaacaagatgtgctatgaactagtaatttttattaaagctcctgatgtatacatagagtttcattacacttgtttctacttttgtgtatgtttgactgttttgtttgtttggttggttttttttgagacacagttttcactctgtcacccaggctggagtgcagtggcatgatcttggctcactgcaacctctgcctcctgggttaaggcgattctcctgcctcagcctcccgagtagctgggactataggcccatgccactatacccagctagtttttgtttttagtagagatgtggtttcaccgtgttggctaggctggtctcgatatcttgacctcgtgatccccctgcctcggcctcccaaagtactgggattataggtgcgagccccatgcccggcctgtttggagtttgttgttgttgtttttttttttttttgagagacagtcttgctctgttgcccgggctggagtgcaatggcacgatctcggctcactgcaacctcccctcccaggttcaagcgattctcctggcctcaacctcctgagtagctgggattataggcgtgcgctaccacaccctggctaatttttgtatttttagtagagacagggtttcaccatgttggtcaggctggtctcaactcctgaccttgtgatccacccacttcagcctctcaaagtgctgggattacaggtgtgagccaccgcgcccggcctgttttacgtttttaacagaattattattattttgagacagggtctggctcagctgcccaggctggaatgcagtggcacgatcatggcaatgcagcctcaacctcccaggctcaagcaagcctccaacctcagcctcctgagtagctgggaccactggcatgcaaccacacccggctaatacaactgtttgtaaaactgagagaaagcaagtctttagaatgcacttactaaataacacgaattacagggaacagtaacatactgcatatagtgatgtagactgtgggaaactacaaggacaaatgagccagtcctacctcagaatagttccagccagataaaagaacccacagaattatggttatgttataaaataaagcaattaagttttagaaatccatcttgaaatatttgtgatggcttggatttgtttgaagttgtccacaaagtagtaggtggggagatggagaataactgtccatgattagtaactgttgaatctgtgtgacaggcacattagcctcaacctcctgggctcaaatgatcctcccacctttagcctccccaacgtagctgggaccacaggtgcatgccaccaagccgggctaattttttttttaattttttagtagaggcaaggtctctctatgatgcccagactggtctgtaactcctgggctcaactgatccaccttggcctcccaaagtgctaggattataggtataagccactgtgcctggcccaaggcaagttttaattattgatcagtcaccatagggttcctgcctgtgagggaacaatgtgtgcagaagacttgagccaggggttgtattgtgcaactgcagctaggtctgagatcaatggtaggagatgacatagccttaaaggcctggtttggtgttcaaaggccagtgggaaggcatttaatggaatgtggtgtgaaaggagttttgctttttaacacaacagtctagatgctatctggaaaatgaatggtgggaagagatacatggagacaagatgggaaggaatgaaacaagtctaggaagactggtgggagaagaatgtgaaagaatgtgtaatgtagagaaaaatgactgagtctggagactgactgactcaccaagaaatactacgcacctaaaagatacaggaactgtagtggtaaagagacacagttcctgccttggtgggtccagtaacagtggagtaggaaatcaagaaatgtacaaatatatgatgacaaattttagaatgaacgaaaaacagaaaataggcattagctcagattggggttctgaggaagtgacatttaaacagacaggagcatgggtgagtgggaacactgagtgatgaatttcatgtagaaagaagggaaattcttttttccttgataaatagctgaggtttaaagtagaagctggccaggagcagtggctcaagcctgtaactccagcactttgggaggccgaggtgggaggatcacttgagcccaagagagttcgagaccagcctgcgcagtatagtgagactcccatctctatataggaaaaagataaaaactgagggaaaaaaaagaagttaaaagcccattattcttttttccttctgtacattatctcccctctggacacttgttcaaattatttatattttttaccaaagccctttactgggatacattttggtgctggatgctttgtattcatattcttatttcgtggtgaatcctttagattgaagaaattttaggacacagcttctgctgctcgtgtctgttcaccacatgagaagcacaagatgcatcttgggggcaaaaattccccatcatggtatatagtatgtgagcagatcatagaccatatttgttatggatgttttccttttctgttggaaatattgaaaattgggtttaatggcctcaaaagtatcttccaacccagcaattttataaaattcctattcagtcactcttaagtacttcctgctgtcatgaactcaagaattatgatacaagacactaattccatttaaaaaaatgcaccaacgcacacatttgtacttaacttttcaggggcacatgtatctgaagtgtgagaattctaacccaattcacacaacgtgccaaattcaatacacagagctatcctaaaagctattaaggactgagaagtggccaggcacagtggctcatgcctgtaatcccagcactttgggaggccgaggcgggtggatcacgaggtcaggagggctaatacggtgaaacctcgtctctactaaaaatacaaaaattagccaaacgtggtggcaggcacctgtagtcccagctactcaggaggctgaggcaggagaatggtgtgaacccgggaggcggaacttgcagggagcccagatcgcaccactgcactccagcctgggcgatagagcgagactccgtctcaaaaaaaaaaaagactgagaagctgcagatggagcatatattaacattttaaatgtttactccattattactacatttatatccaccaaaggggatctgtcctgatctgcatgcaacaggaaagctgttttccattaccatctatcaggtcctttcacttacttgctgtagctaagtctggggggataacacactgcttccctcagcgttcatttctcaaaagctgtgttactaaaaagcatcaagagtagtataatgtaatgttagataaattttatctatactgtttgtactgaaattaatataagggacaaattctgaccgatcataaaacaagcaaccattgctgtttgatattgactgcattttgcaaatgcccaagaatcatgatatctaaggtaaatgttccttaaaacgttaataaaaagcaaaactgctactagacttctgttcctaaaaataaaatctgttcttaactgagggcaaatatcattatttggattagctggagtaactggaaataatatccaaagaaatgggtgtgtatagattccgctaaacaaaaatacaattgataggaagatcaattttgtttttcccagaccacctcctgtacctctctcccttgagcaagcagcccctaaataggtgcatagtcaaaccctggagctggagagaaaggaggcctgtggggtatcctcagccccctgaggaaggtacattccttgggatgggaattcttcctgaagcctccatggaaacatgacaccttagtcaggttccaagcagcaggccctgagctgagactgctggccctgagctgtgctgcccaggggaccactgcattctgccttgggggaattgtgcagaacagagagatggaaggaggaaaggaacatgacaatttacagaagaggggctccggcacccagaaataacataccacacctcaggtttcagggaacaagaagtgctagacaaaaaccataatgattttaacaggaaaaaaagagcaacttcagataccactccattacaaaacttaaaaaaaaaaactttctggaactaaaactgagttttaaatttaaaagttagtaatgaattcaaagaaaggaaaacgaagtagaataaacatcaaaacagaaacaatgggggagaagataagagatttggaggacatactttttccaaagcagtttcctctatactttaggagttttaccaacacacgcctgtgctgtgtcttttcaaaatatcctaatgggaactacagggatcttaagccaggaaaattcacttctaatcctttatcgcttctcttgctgcctccatctgtgtctttttctccttctggaattcctactattcacattatttctcctgcctgaaaagaaaccaaccctatcaacaccctcatcttaagacttctagcctccataaccgtgagaaaatttgttactagtctgtattactttgcatggcagccctagcatactaatacaacgtgttaccaaaccagacaaaaacatcacaagaaaactaacttctgaattctatgtactttaagaggatcgtatatggtatctaacaccaacttaaattagaaaagatatgtatttgtcataaacatcataattctattagatggcactattctaatcaaataacttatgatggatttatcgggatataacagtaagtaagagtatctgtatttgtattaggtgaagcattttgtctaacaggaggcataccgttaggataaatctaataggagtcttaatctgtcatgccttttcttaattatgatggctttttttttttaaacggggtcttgctttcttgctcagggtggtatgcagtactgcaatcacaactcactgcatcctctatgtctttacaagtgttcgctatcatacctggctaattaaaaattctgtttttgaaaagatagggtcttgccatcttgcccaggcttatcttgaactcctgagctcaaaccatcattccactctcggttcactgcaacctccacctcctgagttcaagcaattctcctgcctcagcctgggattacagatgcacaccaccacacctggcaaatttttgtatttttagtagagatggggtttcgccacattggccaggctggtcttggactcctggcctcaagcaatccgcctgccttggccctgctgggattaaaggtgtgaaccaccccgcccagcctgtgtcattttcaagagatctttttcctagccccagcccatatagttatctgaacttacaaagcgttgatgttcttctctaaatttttacacttacatctacaatgaacttggaattgattttttcatttccaaaagagttttacaattaatcaagtatcacaggctaatttcactcaagaactcagatgcaaaagtccaaaccaagtatcagtcaacctaatccagcaatatataaagcgatattatgaccaagttggatttcaggaatgcaagtgtagttgatcatttcaaactcaatcactgcaatttctcatactgatgtatcaatggagacaaagtatagaggtacttttttaatgttttatgagaaatgctaagctgaatttatgtcaaggaagaactgaggccatatatagtggctcacacctgtaatcccagcactttgggaggccgaggtgggcagatcacttgagctcaggagaccaccctgggcgacatggcaaaaccccttctctacaaaaaatacaaaaaaaaatagctgggcatgtggcacacacctgtaatcccagctacttggggggatgaggcaggattgcctgagcccaggaggttgaggctgcagtgagctctgtccacaccagggcactccagtgtgggcatcaaagtgaaaccctttctcgaaaaaaaaaaatgtggagggctgggcgtggtgggtgactcacgcctgtaatcccagcactttgggaggccaaggcaggtggatcacttgaggtcaggagtttgagaccagcctggccaacatggtgaaaccccccaccccctgccactccaccatctctactattagatgggcgtggtggtgctgcacacctgtaatcccagctgctcacgagcctgagaatcgcctgaacccaggaggcggaggctgcagtgagcctggatcctgccactgcactccagcctgggtgacagagtgagaatccgtctataaaaaaaaaaaaaaaggaaaacaaaaacaaaagtacatcttagagcgatcacatgaaaaagtattcctgctaataaatgaaaaggaatcgattattaaaatatcactaatttgaaaaccatttaagaaaataatggatctacataatgatcattaatagctgctgtaacatgacaaaagagaagataccaaccaatatgtgcctccggttggagcacagcacctcaagtaagttttctttccaaaaactctcatctgaatcaaaactacctccagactgggtgcggtggctcacaccagtaatcccagcactttgggaggctgaggcgggtggatcacctgaggtcaggaggttgagaccagcctgaccaacaagttgatactccgtctctactaaaaatacccctgtaatcccagttactcaggaggctgaggcaagagaattgcttgaacccaggaggcagtgagacaagatcacaccattgcactccagcctgggcaacaaaaccaaaactccgtctcaaaaacaaaaataaaaccaaaaccaaaaactacctctagaggtaactatcactttacaggaaatataaagaacagacactcaaagaccaccacggaaaaacaatcagaaaaatgcgaagtgtggggaaggaatgctgcaagacagcccgacaaatataacgggggatggagccttttaagaaaggggaacctctagatgatcacttacacagcatccattcaccacgcttgaaatgtgtaagtgtaaaactcacactggattttgacaagttcacaggattttgtttttaattattttagtcaagatcatggagaaatgaaaaagtgttttaaaattacatgcaaaatagtagtggatatatattaggttaaattattaatacaatgaatcatgtttccttttaccactaaagaatataagattacatttatagcatacattatatttctattggacagtgctgctctgaatttaaaaagttatctacaaaatataaggtgtgactttggatcctgactcaaaccaaccagctgtttaaaatatttaatacatgccgggcgcggtggctcacgcctgtaatcccagcactttgggaggccgaggccggcggatcacgaggtcaggagatcgagaccatccctgctaacatgatgaaaccccgcctctactaaaaatacaaaaaattagccgggcatggtggcggccgcctgtagtcccagcaactcgggaggctgaggcaggagaatggcattaacccgggagatggagtttgcagtgagctgagattgtgccactgcactccagcctgggtgacaagagcaagattccgtctcggaaaaaaaaaaaaatttaatacagaaacacttaaaccctggatacttgatattttggaatgtatttttaggcatgacagcagtatcatggttaggttttaaaagttcttagaaatactgcggatttatttattaataaagaccttattggtctgggatttgctgtaaaataagccagggcggtcttggctgagctcagttctccctctgcccaccctgttgccctccacaagaaccgtagctcagggcaactaagacagggcaagggccctggcaggggaggggtgtcccggtccaacttgggacccagttgggactgggtcccaagtcccaattgtgtccctggacacatgacttctcccaacctccattttctcatctgaaacatggggctaatagcaagcccttctggagtagtcctgagcatgtaattagaaaatggagtaaaacttctaggacctagtaagagtcaactaatgtggttctcccgaagagcagagaaccagagctcagtgggggagagggaattagagaagtcacctccaaggaaagggcctgtcacatttctgcagcccctgcaggcatctacccccaccgggctctcatttgcctccaggctttccaaggttctggccacgtgggagaagtaactttctatttactcagtcttttcccttaaataaattccattttttacctgaataaagctttataacgctacccttaacagaaaacttggcagtttacaaaaaagtggccgggcacgatggctcacgcctgtaatcccagcactttgggaggcagaggcgtgagaatcgcttgagcacaaaagtttgaaaatcaatctgggcaacataaggagaccccatctctacaaaaaatacaaaaatttgccgggcgtgctggagagtgcccgtggtcccagatactcggcggctgaggtgggaggatccgttgagcacaggaggatctcggcagcgagccgagatcacaccattgcactccagcctgggcaacaaagtgagaccctgtctcaaaaaataatacatatttttttatagagacggggtaggtctctggggcccaagcgatcctcccacacctcggcctccctaaatgctgggattacaggcgtgagccacctcgcccggccgataatgactctaatctacagaatgcacaccggaatgtaatacctacaagggaaaagatcttcttgcttaggaataaagcaatctctctcttaatattcattaaagtagtaatgtcttattttatagtttataaattctgtgagagcaacgagtcactttgcaggaatagcacttaaggtatctttcacctacctggagaacccaagaaattttcatcttactaggaattcagagacaaccacgtatttaacttttaaaaatataactaagtagaaagaattatatgcgtgtatttttggaagaattaagatgacttttgggacggaacgactgaaaactacgctttcagaactccctgccgcctgaggctgtggccctgaccccggcgcagggcccgccccgcgcggttccgggaagccgccgccgccgcccgttgcccttcgcgcgcagccgccagcgcgcgcctcgcgtcccgccacgcagatggccggcccgagcccccagcgcccgcgagcagtttcgagaactaaagaggcgcgtcagctcgtccccgggccgcccgcgggcaatggccgagctcggctctccttccaccctccgccgggacacacgcggagccgagcgggggtcccaggcgcctagggggaggggttcccgcgcccggggcggccttggggggagggcgagtcgggtgccttgctcctcaaaaccctggtccacgactctgcggttgggggagccgggcagccggcgcagcaggagccgggccccgtccacaagtttcctacgagcagggcggaatcgacgaaaatacttaatacaaacaaacaaaaggaaaaaaaaaaggacgactaagctgaagagcgcgcacgagtcagattttcaccccaaatacaaacacgatacctctaggagcaggagaccaatacagggaccgcgctccgaggacacgcggcgcagccgaggaggaaaaagggcccggggccgagagctaaggctacgggaaccgggcgtgggaggagggcggagccaactccccacaaggaagtcttgtgcaactctcaggcgcctgcagccacgtgagcgcgcggctttcattttactcaggtattattactattattacttcttttgagacaaggtctcatttccgtcgcccggctggaatgcagtggcacaatcactgtcactgcagcctcgacctcagagcaagcgaccctcccgcctcagcctcccgagtagctgggacaacaggcgcgcgccaccacacgtggctaatttttttttctttacttttcagtagagacagtctatgttgcccaggcttgtcgggaactcctgggctcaagagatcctcccggctgggcctcccactgcgccaggcctgttctcactttcagagccctccggcagtcgccagctccccgccagggggccggactaacgcacccggccgtccgtgccttccccgcgctttcctgactccaaaatctcagcccgcggtgctcaccgcgtgggaccactgtctgggcgtgcggctctcgacctccgacgctgcgtctcccgatcccagtgggtccagttcttgccggtcccacgtacgggcccctcgacctcgaatcccgtcacccaaatctcagcgccacggcccctcattatgtgcagtcctcgctcggtcccaggtttgcggcgcttaaactcagatcgctcttccctgatcccaaatcccagccccagcccaacgatccccaccccaataggcccagtccccaggtagtccgggtacggggccctggacttcggatagtctccctaatctcaaatcccaccccccgtccccacccccagggggacccggtccccgctaggtcccgggtgtgcggccttcgacctcggagacttcggccgcccctcacctcggcctccgagtctctacactcccgctctcatatcaggcaccccggtggtcccttggagcacctagaggagggtgggacgcggggaacttggcagttgtagcagaggcagttgaggcttgttgaccatcaccatggaaacccccgcctgcgagcacggggcggagcctacgaggggcggggtcaggcgcgctgccggccccaatcctcagcgcctgcccgtcgagcgcacgcggctttgccggaagccctcctgctcccggcgagccaggccccgactaggccctactgcccggctcagccctttgccctggacaccaggaaacagaagcccaaggagcccgcgtccccaccccctgctacctgccggcgtgacagcgattcggtggccccccgaaccccaccttgaggaagacgcggcgcagtcctgcttccacgacggagccggaaggacgcaaggaccgcggcagggcggagtttctgcgtccggcgtccgggggcggggccgcgacggcgcattgt

SEQ ID NO: 1567 - DNA, 11731 bp, Homo sapiens
aaaaagtttaaatcagcattttataaaaactagaaacaaaataattgctttcacaatgtagtacttgaaactaaagttctccagctatcaacagatgtgactccagcatcaagggcctagcaggaaaattctgaatggtttacaacagtgcacataagttgcaggtggctggggccgtgtgtctatttgatgcttcccagaatgtgtgctgctagtcaccatttccaccattcacatatttaacatttttattagacttttatttagcctcatcataagaatataagggagatcatagatttgatgtatgaaatttttaaattcacactaaaatacattacgattaaaatgaattatcttcaaccacccgttttgctatcttttgctgagtaatctgtgccagtcattgtgaaaaagtctttattttaagaaaaaaatttagttaacaaaaaatttaacaagtttcacttagcaaaatacacccaaaaggaaatcacagtacaaagaaagttttaagtcaaggcctcaccaattcctacagtattagtattgtgtctcaattctcaaaactaacttttaaaaagcttaaacttaacctaaaggattttaaatgaaaatataaactagaatgaacaaacatgagaaatatttctttgaatcagggagctagcacctttgagttttccaaaaaagcacgtctccccagtgtgttcactgtgatgtggtgtaaaagatccacatttaacatacttaaactacttaaacttagataacatcactctgaagtatactaccaaaatgttaattgagaaaagctgaaaatagttttagtttactcattatcacatgctagaagaaaattttgcatgagaaaacactgaagaggtaattttttaatccagatttttcacaaactcatggtgcaaaatgggtcccccagcttcctctattataactgctcttaattgcttgttggctgcctgtgaaaatgattgaagtaactcaaatgttcctaacaaaactagtcatagccacccatgctgttctgcccactgtagccggccccgtaacagccactcactgactggctctccaggccactgtaagtggcctgggcagcagacacccccatgccttgcatcacctggctgctatacgccccattgctggcccctgttgttgaattcaagaagagttctatatatctgtgctgcatattggccctgtctttggacatagctgccacagcttcttcatgagtagcaaactcaacatctgcttcacccgtcactcttccatctgggccaatctcaatatggactctcacagggttgagaggagagaagaagttgtaaatgtcgttctcggtcgctttgtacggcaggcccctcatgtggacacagtggcctgtggtgctctgcactgtgaactcactgtcgccgtatctgtggtcatacattccggagagacagtagctgaggtctctcccgaacaggtcggtggtgaagccgtagccatcactgaggccactgtactcctcgtagcccccgtagcctgtgctgtaggcaccaggcctcatcctttccaggcctgcctgcttcacgatgccaatgtacctcctggcagtcccgggccggtcatagggccctggccgctgcacggacatgaacttcagagggggatctgagtatgacctaacttcctcctggctgctcttaaacacctcaatgtacctgtgccctatcctctccttgtgtttccctagagccttctcagctaactcctgcgaggcaaactgcacgaacgcttcccctgtaatcttgccttcggggtccacaggcaatgtgatcccgtttggcacaatttccaaccctgagaagaactgaacaatttcttcctttgtgcatccaaatgggagtcctcgaagccgcacgaagccatcgttggcgctgtcggcactgttgggaccactgtgcttcaacacccaatccatctcggttctgtgggacttgaacacctcaatgtaccggtgtcccatgctttccctgtcttttttcagggccatttttacatcatcttctgatccaagttcaacaaaagcctcaccactctgcctgccctctctagtgtagatgaaatggacacctgcggccccatcatgaatcgtgcagtcagagaggaagttctgcacgtcctcaacagagcaggaccagggcaggccacggagcttgaccacaaagccttcacctccctcagggcccagcatcatggacacttgtcagggtgggtgtcaggtgatcttgggtgtggcttttttgtggctggaaaaaaaaaaaagaaaaatttatttagtatgcaacagaaattttccccattttacagacgagagaggtagcaagacattaagaaatataccaaatacaattgagagctaagagttaactccaggtctctcaaaaaattacattatcagtcacaggcagtttgaaaaacaaatcaggagtttacaagacaggacgatgcatgtgaatgtggtgccttgaacacagagaaatgtaagtttcagtcagtttagagcaagggcatttccttgttatatttattccacatatttgtcatgataatatgtggcagttcacctataagagctcctgagttgttcctcctaaactatacgccttacatttggtaaaatagtaaatttagtaaatctgcttgtctatggtaggatacttttactttcatgagtaaaaataagggatgggaacatagcaggctgtttttaaaccacaacatagggtaagattttctagtgttctcatcagcagtaatgttgccaggatacaagacagcaatggcttccactgtctatggagttatgattttgctcctaaattgtcaattcaaactaaataccagtcaagtatgaggccaaactgatgacatatacagacaagcagacaaattcaccagcagacttagttatgtgcactgcaaataaatggagaaaccagatcagatgattcacaggttcacataaaatatagcagaattgctgccttgtgctgaagatctggaagagggcatcgggaagaaagggcaatcgcaagagggctgagaaatgcccttcccaccagggtggtacatggcacctgaagtccaaactcagagtaaggccaaccacacactggaaggcagtcttctgagaaagaggagcagctgacctagacagcagggtctataacatagtcacaagcaagaaaaacactgcagtatcatggggccaaagacgtatttttatatgaacactgtcaagggtgacgctcaaaaagagcataggagtatatggaatttttttttttttttttttttttgagacaagagtctcactgtcgcccaggctggagtgcagtggtgctgtctcggctcactgcaacctccgcctcctgggttcacgaaattctcctgtctcagcctcctgagtagctgggattacatgcaccagccgccacgcacggctaattttttatacttttaggagatacgggatttcaccatgttggcgaggttggtcttgaactcctgacctcaggtgatccgcccacctcagctgcccaaagtgctggaattactggcgtgagccaccatgcacagctggaaatcgaatgtttcaaagtgtcattttacatcaagcataatagatatagctggtggccttttcaagaaatatgggctcatcatgtggggaaaaaagctccataagaaaaccccacaatttaaaaaacagacaaaaagtaaaggtaagtgtaatttaagaaaaggaaaagcaaattcatactaaataaatgctcaactgcactagcttcagggaaaattagtaattttaaagtttgatgtagccattgcagataatgacatattatcatacagtgcttcatcatttcaaattgacaacgtctaaaaggataattgtgtaaatctttcaaatttacctgtgtctacaccagattataaagataacaagatgtgtctcctctcccaataacaagcataatggcacaaatgaaacagaacagtatgtgatatcctgaacacatcaccaagaccaaacactcggcatttactcacgaactgtgatttggaatgcaagggctttcaaagtatacagcctaactaaaagatgtcacccttgctaatgagagtggaacatggaagcctctgggaagagagtcaaggggagcctaacctggattgctcattgcccacctcaaattattgactatgtacataaactccatcaacttttataaaataatcctgaacggcaaatgattgggcataaataatcctatccccaattctcaaactgtgctttgggtctgcaacaaaccctggggtttagcctccaccttagaaagtaatggtctccgcctccccagggccttatctaaatcccctgcatatggccactgcaacatgctgatctggcagagcaaggtcacagcagattcttcctctcctgtccacggagggaattctgtgctaacagttcagaagctcctccttggagagtcagggcaagtttgtattgtgtctcttgggataatgggtctgggacagctcaattacaggtgggggcttcttatgcaattccattcccaacactgggtcaggctaggcaccgcctgtccttttgtctttgaccataccctggtcttgctcctcactcatgaaaagtatctgaaggcctccctcgagttctgttcctagccttaggtccagccatcgttccgggtaggggagatgaagccataatccactaaccattttctcctggactcctacctccaatgatttcaccattccctgcaggaaaccccacctaatcacatcctactccctccaccacaactgctatccccctcctttgtagagaccttggcttccttatccacacagcctctttctctcctcattcttcataatccagcttagagcaagtatcattttacattccttcctcacaatacatggaattcattcaatgaacttcttaactgtacgcgcccagtaaaaccagagctctggaagattccaaacaaatatctgactactccatggatgtactgagtggctcagctgcacacagccaggcgaaacggtgcctctaagctacaatttctcagcctcaggactactgacattttggaccagacagttctttgtgttgtggaggcaggcccaggcactgtaggatgtttagctgcatccctggtctctgcccactagatgccagtagcaccctccacctccagttctgacaaccgaatgtctccagacattcccaaatgttctctggtggctaatgctgcccccaagttgtgaaatactgtagaaatcagggtgaggccaggcacagtggctcccacctataatcctagcactttgggaggccgaggtgggtgggaccacttgagatcatgagttccaatagacaaaacctctgtctcgactaaaaatacaaaaaactagccgggcgtgatggtgggcacctgtagtcccagctacttgggaggctgaggcaggagcatcgcttgaacctgggaggcagaggttgcagtaagccaagatcgcaccactgcactccagcctgggcgacagtgcaagactctgtctcaaaaaaaaaaaaaaaattacctggacgtggtggtgggcgcctgtagtcccagccactacggaggctgaggcaagagaatcacctgaacccaggaagcggagttttcagtgagtggagatcgcaccattgtactccagcccgggtgacggagcgagactaactccaaaaaaaaacccaccacacaagaaaaaaaaaagaaaatcagagtgaacagccatagagtaagcgggccctcaatatcgcccactgtcctaccccagcaccctgcttgtccaaagcccttcagatgtctggggcagccttacagactctcacctcctctccagctggttgacattactcttggaagtggactttgtgaagtcaagtcagagtccaggagtttgtaagcacgtagtgggccccttacagcggacatcgtgaacaacagctctgctctgggtccaacctcacataccccggagccatgctttcttctttttttccttttcccctttctccactgagccctgtctacttggtaattaaacatgctcagttctacccaatcatgtcatacctcccctgtgccaactttgcctctagctacttgttgatttgttcagcaaaatcttgtcaaaaggcctctactgtcacttccactcccctccattaaaactgcatgatcaaggccacgtgtggtggctcaccgcctgtaatcccagcactttaggaggtcaaggagggtggataaccggagccaggagttcaagaccagcctgaccaacatggtgaaatcccgcctctaccaaaaatacaaaaattagccgagcatagtggtggacacctaggttgagcgcagtggctcacgcctgtaatcccagcactttgggtggccaaggcaggcagatcatttgaggtcaggagttccagaccagcctagccaacatagtgaaaccctgtctctactaaaaatacagaaaaattggccgggcacagtgcctcacacctgtaatcccagcactttgggaggctgaggcaggtggatcatgaggtcaggagatcgagaccatcctggctaacatggtgaaaccccgtctctactaaaaatacaaaaattagccaggcgtcgtggcgggcgccagtaatcccagctactccagacgctgggacaggagaatcgcttggacctggaaggcagaggttgcagtgagctgagatcgtgccactgcactccagcctaggcgacagagactcgtctcaaaaacaaaaacaaacaaaaaaactgcatgatcctactatacagatctccatggcaagaaaaagagcaaatgtttttatcttcatcttacttaaccattctttcctggaaatcctctccctttcactcctgttggcaattactgttggttttccagttaattccttagacagtctctgagtccttccttaaccattaactgtagggaatcaggcttgggcccaagtcctcttctcagtggactcacctgctcccagggtctccataatcatctccagggtcaggagatacacaaacccccagtcttcggctccctgaagcctagacgggtagacacaactccactccacaggttctcctctgtgccacaactaaacctcacattctctcttctgtcacactccaatagcaacatgactgcccctacctgcacccagaggctctagaaggaaactggagtaatccttgaccttctcccaagccctcaaatccaatcaactcaactcccttgggtgatcccattctccacagtatcctcatccctaaatcctattcaactcttccatttcctcagcaataaaggtgcctcacagctctaccctgttcctaacacgttgaatggcagcctatgaactcagtaattcttttctttgtaatgggagttatcaaattgtcattttctttctgtacctcatattgttatttctcctattctaattcctgtatgtacaaacagccaattccagattaccgatatatcttttaaataagtccaagcataggccgggcgcagtggctcatgcctgtaatcctagcactttgggaggctgaggcgggcaggtcacctgaagtcaggagttcaagaccagcctgaccaacatggagaaactccgtttctactaaaaatacaaaattagccaggcgtggtggcgcatgcctataatcccagctactcaggaaggctgaggcaggagaatcgcttgaacctgggaggcagaggttgcggtgagccaatgtcgcgtcactgcactccagcctaggcaacaggagcaaaactccatctcaaaaaaaaaaaaaagttttccaagcacagtggctaggccttactgcaatcccatctacggctcacgtgtacttttaaaactcattactgtcctgcatccaagtcctcagtggtttcccactgacctcagaacaaggaccacaggcccaatggggtccctcaggccttgcaacttttgcctgcaacactcttctacctaagctcacatcacttccttttttctcctggaatgtggcaagctctctgccccttcagggatgtgacgcacatagttgacactcatggttaattctctccccaaatatactctgttcaaccttctgtctacctaaatcccactaatccttaaggtctaagctcaaatacaccacctttctcaaaggtcttctcattatccaaattaagtctcatgctctacactaaccacagcactcttgtgttgttaaaggggtcttaaacccacaataggagcctactggggagaaacttgtgcctgttttgttggccaccatgaccccatcctcagcacagacttgacccagctggtccaagattagccaggattaactgttgcccatgtgtaggggggtcaacaccttcctcaagaaggcagtggcctggctaggctgaaaaagacatacaagcagcataaaaaataaaaacatttcatagaagaattacttaaaatgcctaatcttttacatgtcataagtgttttgcatcaggaaatgtttcagaagcaaaattacttcctctctgaaggcaaggcgaagagaccattcctttccaaaacacatgtgtacacttaaaacacttactgcttatttttactccagaattggttttctgttccatttctcagaagtcctaaggcttttcattaactaaaactcaagctgaaaagagccctgtggtgtcctgctcaaggttaatgttagggacaaaacttttttcactccaggctgctaaacaaatttgagtataacaaatataaatactgcagctgaaaaggggctcttcttaaaatagcttaccttaaaaacaaccacggatgccttcagtgggagacacttctggatggtaatgaaatgtcctaaaaaaaaaacagagcgatattggctgtgtggtctcagatcctaggcactggctctgggatcagaactccaggtaaggacagaaacagctgggaagccctttatatagcccgtgggtttaaattaaatctcacaccccatccacctaacagcattttggaagtattatcttttcacagggcaatacagagcacaacaaaagggaaacgccttattgatcttgatgagatttactcttgatgagattctcctgcctcagtacctggtattacaggcgtgcaccaccccacccagcgaatttttgtatttttagtagaaatgggatttcaatatgttggccaggctggtcccaaactcctgacctcaggtgatccgcccgcctctgcccaattctaagtttgtacactgaggaccctaagtgctgggaggaaatttaaatatcgggggcagggcacttgggagggagatgggtgggggagaagtgacaaccacaggggacttgaccttaagacccctctttcactgggatagcatgggcaaggagcaagggtgcttgctagaaattgttcagtctgatttataggaacccctctgtaagcagtgtggagacacatccaaaagacactttcagttttattgggtaacttctttgaaatatgcttcactagaacatacatcataatcactagatcaccaacatcccagtaaaaacgctgccccaaaggactaggacacgggctgagggctatggaattctgagaactaagctgcttgagttttggaaatgtggaattagtaaaaccagctaattatgctgaacctgttgtcttaacatgaagataatcaaatctgccttgtcttgcaaacttccagtgattattacttaagacactattgggggggtgtacaaatggaaagcattacatttattaggaaacctattcaggggtgaaacagtttcaagtactctggaatcaggttttcaaaaggcttcaacaatccgacttgttcaaggatctaaagggtggaacccagtcatcttaatgatctgatccacttatgcccttgtttatccctgcgtgatccacagaccaacaccctgaggcgtctctggggacatgcacaagctggcaaccagacccacgtacacccatttaccccaatggaccagccgctgtaagcctgtagaccacggccactgcgcaccgccaacgcacgcagaggaagagtctggtctccccgtccgcagcgccaagaaagcgctgggggcggggagggctgctcagctcccccaggtgactggacccggaggttttcagatcgagcttgcacgggggccacctagataattaaaacaccaaccctaaaacagatctgggtgggggctaagaatctgcatttccaaaaagcgctcccgaacgagctcttcgcagtgatacaggttggacgggattaacgcttgccttcaggcagagccaatcaagataaatagggcgcgccggagtcctaccagttcggctatctgcagagtaaacagggccgttcaagcaccacccacctcgttttcttttgttcaggacaggactcgaggaaggatcctggcctcccctcctagacacactcccgtgcccccgggaaaccgggcagcactctcgccaggaggctgggagcgcgtctggccgcgccgcccccattactcacttagttccactctcaaaccaaagtccacccggccgggcccgcggactttcatgctctagacttaccacggaggcgagcaggactggtttctgttgctaccaggcaagcgcggctggcagccaagagccccgaaattccaccgaagctcaaccacgcagagggctccggggaaactccaggtgcatgtttttgttctcaacctgcaacagaaatccaagtggtggtggggtcccttccgcaaggtgggaggcccgggcgcgcggtaaacgtgttttggcgggaagcagcgccgaggccccgagacaaggtgacggcgacgttcccgcggcctgctcacggcactccagcagcctcggaccgcccggcccggcaggaaggtcggccccagggcctgcgcgggctcgggcgggagcttccgggcggggggcggagcgagcggcgcagcggggagagtgggggcagggacgggagggttcccggagggaagggcgcctcgcgggagggggaggggaggggaggggaggggagggggcccctggcgggcttccggggccctgagggcgagagcgagggcgacggcaaggtggggtgggggctgctccccggcccgccaagctagcgctgcctaggcgggagctcggggacccgcgggccgagcgcggctgaagggagggaagggaagaggcgctcgtaggtctgcgtccgtctccgagcgaccggggcggcggaaagggacctggggggggcggccgggactggagtggcggggccggggcgcccgcgcggcggctcaccacgccagggactggcccgtcggccccgaggaggcgcggggtccggagtccgggaagcggaggcctcgtgatccaagaccggcagccggacgtgggtcacggggtgcagaggaggaagtgccattgccgggcccgccaagatgtcaccaatgggaaacgcgt

SEQ ID NO: 1568 - DNA, 23593 bp, Homo sapiens
aaaaagtttaaatcagcattttataaaaactagaaacaaaataattgctttcacaatgtagtacttgaaactaaagttctccagctatcaacagatgtgactccagcatcaagggcctagcaggaaaattctgaatggtttacaacagtgcacataagttgcaggtggctggggccgtgtgtctatttgatgcttcccagaatgtgtgctgctagtcaccatttccaccattcacatatttaacatttttattagacttttatttagcctcatcataagaatataagggagatcatagatttgatgtatgaaatttttaaattcacactaaaatacattacgattaaaatgaattatcttcaaccacccgttttgctatcttttgctgagtaatctgtgccagtcattgtgaaaaagtctttattttaagaaaaaaatttagttaacaaaaaatttaacaagtttcacttagcaaaatacacccaaaaggaaatcacagtacaaagaaagttttaagtcaaggcctcaccaattcctacagtattagtattgtgtctcaattctcaaaactaacttttaaaaagcttaaacttaacctaaaggattttaaatgaaaatataaactagaatgaacaaacatgagaaatatttctttgaatcagggagctagcacctttgagttttccaaaaaagcacgtctccccagtgtgttcactgtgatgtggtgtaaaagatccacatttaacatacttaaactacttaaacttagataacatcactctgaagtatactaccaaaatgttaattgagaaaagctgaaaatagttttagtttactcattatcacatgctagaagaaaattttgcatgagaaaacactgaagaggtaattttttaatccagatttttcacaaactcatggtgcaaaatgggtcccccagcttcctctattataactgctcttaattgcttgttggctgcctgtgaaaatgattgaagtaactcaaatgttcctaacaaaactagtcatagccacccatgctgttctgcccactgtagccggccccgtaacagccactcactgactggctctccaggccactgtaagtggcctgggcagcagacacccccatgccttgcatcacctggctgctatacgccccattgctggcccctgttgttgaattcaagaagagttctatatatctgtgctgcatattggccctgtctttggacatagctgccacagcttcttcatgagtagcaaactcaacatctgcttcacccgtcactcttccatctgggccaatctcaatatggactctcacagggttgagaggagagaagaagttgtaaatgtcgttctcggtcgctttgtacggcaggcccctcatgtggacacagtggcctgtggtgctctgcactgtgaactcactgtcgccgtatctgtggtcatacattccggagagacagtagctgaggtctctcccgaacaggtcggtggtgaagccgtagccatcactgaggccactgtactcctcgtagcccccgtagcctgtgctgtaggcaccaggcctcatcctttccaggcctgcctgcttcacgatgccaatgtacctcctggcagtcccgggccggtcatagggccctggccgctgcacggacatgaacttcagagggggatctgagtatgacctaacttcctcctggctgctcttaaacacctcaatgtacctgtgccctatcctctccttgtgtttccctagagccttctcagctaactcctgcgaggcaaactgcacgaacgcttcccctgtaatcttgccttcggggtccacaggcaatgtgatcccgtttggcacaatttccaaccctgagaagaactgaacaatttcttcctttgtgcatccaaatgggagtcctcgaagccgcacgaagccatcgttggcgctgtcggcactgttgggaccactgtgcttcaacacccaatccatctcggttctgtgggacttgaacacctcaatgtaccggtgtcccatgctttccctgtcttttttcagggccatttttacatcatcttctgatccaagttcaacaaaagcctcaccactctgcctgccctctctagtgtagatgaaatggacacctgcggccccatcatgaatcgtgcagtcagagaggaagttctgcacgtcctcaacagagcaggaccagggcaggccacggagcttgaccacaaagccttcacctccctcagggcccagcatcatggacacttgtcagggtgggtgtcaggtgatcttgggtgtggcttttttgtggctggaaaaaaaaaaaagaaaaatttatttagtatgcaacagaaattttccccattttacagacgagagaggtagcaagacattaagaaatataccaaatacaattgagagctaagagttaactccaggtctctcaaaaaattacattatcagtcacaggcagtttgaaaaacaaatcaggagtttacaagacaggacgatgcatgtgaatgtggtgccttgaacacagagaaatgtaagtttcagtcagtttagagcaagggcatttccttgttatatttattccacatatttgtcatgataatatgtggcagttcacctataagagctcctgagttgttcctcctaaactatacgccttacatttggtaaaatagtaaatttagtaaatctgcttgtctatggtaggatacttttactttcatgagtaaaaataagggatgggaacatagcaggctgtttttaaaccacaacatagggtaagattttctagtgttctcatcagcagtaatgttgccaggatacaagacagcaatggcttccactgtctatggagttatgattttgctcctaaattgtcaattcaaactaaataccagtcaagtatgaggccaaactgatgacatatacagacaagcagacaaattcaccagcagacttagttatgtgcactgcaaataaatggagaaaccagatcagatgattcacaggttcacataaaatatagcagaattgctgccttgtgctgaagatctggaagagggcatcgggaagaaagggcaatcgcaagagggctgagaaatgcccttcccaccagggtggtacatggcacctgaagtccaaactcagagtaaggccaaccacacactggaaggcagtcttctgagaaagaggagcagctgacctagacagcagggtctataacatagtcacaagcaagaaaaacactgcagtatcatggggccaaagacgtatttttatatgaacactgtcaagggtgacgctcaaaaagagcataggagtatatggaatttttttttttttttttttttttgagacaagagtctcactgtcgcccaggctggagtgcagtggtgctgtctcggctcactgcaacctccgcctcctgggttcacgaaattctcctgtctcagcctcctgagtagctgggattacatgcaccagccgccacgcacggctaattttttatacttttaggagatacgggatttcaccatgttggcgaggttggtcttgaactcctgacctcaggtgatccgcccacctcagctgcccaaagtgctggaattactggcgtgagccaccatgcacagctggaaatcgaatgtttcaaagtgtcattttacatcaagcataatagatatagctggtggccttttcaagaaatatgggctcatcatgtggggaaaaaagctccataagaaaaccccacaatttaaaaaacagacaaaaagtaaaggtaagtgtaatttaagaaaaggaaaagcaaattcatactaaataaatgctcaactgcactagcttcagggaaaattagtaattttaaagtttgatgtagccattgcagataatgacatattatcatacagtgcttcatcatttcaaattgacaacgtctaaaaggataattgtgtaaatctttcaaatttacctgtgtctacaccagattataaagataacaagatgtgtctcctctcccaataacaagcataatggcacaaatgaaacagaacagtatgtgatatcctgaacacatcaccaagaccaaacactcggcatttactcacgaactgtgatttggaatgcaagggctttcaaagtatacagcctaactaaaagatgtcacccttgctaatgagagtggaacatggaagcctctgggaagagagtcaaggggagcctaacctggattgctcattgcccacctcaaattattgactatgtacataaactccatcaacttttataaaataatcctgaacggcaaatgattgggcataaataatcctatccccaattctcaaactgtgctttgggtctgcaacaaaccctggggtttagcctccaccttagaaagtaatggtctccgcctccccagggccttatctaaatcccctgcatatggccactgcaacatgctgatctggcagagcaaggtcacagcagattcttcctctcctgtccacggagggaattctgtgctaacagttcagaagctcctccttggagagtcagggcaagtttgtattgtgtctcttgggataatgggtctgggacagctcaattacaggtgggggcttcttatgcaattccattcccaacactgggtcaggctaggcaccgcctgtccttttgtctttgaccataccctggtcttgctcctcactcatgaaaagtatctgaaggcctccctcgagttctgttcctagccttaggtccagccatcgttccgggtaggggagatgaagccataatccactaaccattttctcctggactcctacctccaatgatttcaccattccctgcaggaaaccccacctaatcacatcctactccctccaccacaactgctatccccctcctttgtagagaccttggcttccttatccacacagcctctttctctcctcattcttcataatccagcttagagcaagtatcattttacattccttcctcacaatacatggaattcattcaatgaacttcttaactgtacgcgcccagtaaaaccagagctctggaagattccaaacaaatatctgactactccatggatgtactgagtggctcagctgcacacagccaggcgaaacggtgcctctaagctacaatttctcagcctcaggactactgacattttggaccagacagttctttgtgttgtggaggcaggcccaggcactgtaggatgtttagctgcatccctggtctctgcccactagatgccagtagcaccctccacctccagttctgacaaccgaatgtctccagacattcccaaatgttctctggtggctaatgctgcccccaagttgtgaaatactgtagaaatcagggtgaggccaggcacagtggctcccacctataatcctagcactttgggaggccgaggtgggtgggaccacttgagatcatgagttccaatagacaaaacctctgtctcgactaaaaatacaaaaaactagccgggcgtgatggtgggcacctgtagtcccagctacttgggaggctgaggcaggagcatcgcttgaacctgggaggcagaggttgcagtaagccaagatcgcaccactgcactccagcctgggcgacagtgcaagactctgtctcaaaaaaaaaaaaaaaattacctggacgtggtggtgggcgcctgtagtcccagccactacggaggctgaggcaagagaatcacctgaacccaggaagcggagttttcagtgagtggagatcgcaccattgtactccagcccgggtgacggagcgagactaactccaaaaaaaaacccaccacacaagaaaaaaaaaagaaaatcagagtgaacagccatagagtaagcgggccctcaatatcgcccactgtcctaccccagcaccctgcttgtccaaagcccttcagatgtctggggcagccttacagactctcacctcctctccagctggttgacattactcttggaagtggactttgtgaagtcaagtcagagtccaggagtttgtaagcacgtagtgggccccttacagcggacatcgtgaacaacagctctgctctgggtccaacctcacataccccggagccatgctttcttctttttttccttttcccctttctccactgagccctgtctacttggtaattaaacatgctcagttctacccaatcatgtcatacctcccctgtgccaactttgcctctagctacttgttgatttgttcagcaaaatcttgtcaaaaggcctctactgtcacttccactcccctccattaaaactgcatgatcaaggccacgtgtggtggctcaccgcctgtaatcccagcactttaggaggtcaaggagggtggataaccggagccaggagttcaagaccagcctgaccaacatggtgaaatcccgcctctaccaaaaatacaaaaattagccgagcatagtggtggacacctaggttgagcgcagtggctcacgcctgtaatcccagcactttgggtggccaaggcaggcagatcatttgaggtcaggagttccagaccagcctagccaacatagtgaaaccctgtctctactaaaaatacagaaaaattggccgggcacagtgcctcacacctgtaatcccagcactttgggaggctgaggcaggtggatcatgaggtcaggagatcgagaccatcctggctaacatggtgaaaccccgtctctactaaaaatacaaaaattagccaggcgtcgtggcgggcgccagtaatcccagctactccagacgctgggacaggagaatcgcttggacctggaaggcagaggttgcagtgagctgagatcgtgccactgcactccagcctaggcgacagagactcgtctcaaaaacaaaaacaaacaaaaaaactgcatgatcctactatacagatctccatggcaagaaaaagagcaaatgtttttatcttcatcttacttaaccattctttcctggaaatcctctccctttcactcctgttggcaattactgttggttttccagttaattccttagacagtctctgagtccttccttaaccattaactgtagggaatcaggcttgggcccaagtcctcttctcagtggactcacctgctcccagggtctccataatcatctccagggtcaggagatacacaaacccccagtcttcggctccctgaagcctagacgggtagacacaactccactccacaggttctcctctgtgccacaactaaacctcacattctctcttctgtcacactccaatagcaacatgactgcccctacctgcacccagaggctctagaaggaaactggagtaatccttgaccttctcccaagccctcaaatccaatcaactcaactcccttgggtgatcccattctccacagtatcctcatccctaaatcctattcaactcttccatttcctcagcaataaaggtgcctcacagctctaccctgttcctaacacgttgaatggcagcctatgaactcagtaattcttttctttgtaatgggagttatcaaattgtcattttctttctgtacctcatattgttatttctcctattctaattcctgtatgtacaaacagccaattccagattaccgatatatcttttaaataagtccaagcataggccgggcgcagtggctcatgcctgtaatcctagcactttgggaggctgaggcgggcaggtcacctgaagtcaggagttcaagaccagcctgaccaacatggagaaactccgtttctactaaaaatacaaaattagccaggcgtggtggcgcatgcctataatcccagctactcaggaaggctgaggcaggagaatcgcttgaacctgggaggcagaggttgcggtgagccaatgtcgcgtcactgcactccagcctaggcaacaggagcaaaactccatctcaaaaaaaaaaaaaagttttccaagcacagtggctaggccttactgcaatcccatctacggctcacgtgtacttttaaaactcattactgtcctgcatccaagtcctcagtggtttcccactgacctcagaacaaggaccacaggcccaatggggtccctcaggccttgcaacttttgcctgcaacactcttctacctaagctcacatcacttccttttttctcctggaatgtggcaagctctctgccccttcagggatgtgacgcacatagttgacactcatggttaattctctccccaaatatactctgttcaaccttctgtctacctaaatcccactaatccttaaggtctaagctcaaatacaccacctttctcaaaggtcttctcattatccaaattaagtctcatgctctacactaaccacagcactcttgtgttgttaaaggggtcttaaacccacaataggagcctactggggagaaacttgtgcctgttttgttggccaccatgaccccatcctcagcacagacttgacccagctggtccaagattagccaggattaactgttgcccatgtgtaggggggtcaacaccttcctcaagaaggcagtggcctggctaggctgaaaaagacatacaagcagcataaaaaataaaaacatttcatagaagaattacttaaaatgcctaatcttttacatgtcataagtgttttgcatcaggaaatgtttcagaagcaaaattacttcctctctgaaggcaaggcgaagagaccattcctttccaaaacacatgtgtacacttaaaacacttactgcttatttttactccagaattggttttctgttccatttctcagaagtcctaaggcttttcattaactaaaactcaagctgaaaagagccctgtggtgtcctgctcaaggttaatgttagggacaaaacttttttcactccaggctgctaaacaaatttgagtataacaaatataaatactgcagctgaaaaggggctcttcttaaaatagcttaccttaaaaacaaccacggatgccttcagtgggagacacttctggatggtaatgaaatgtcctaaaaaaaaaacagagcgatattggctgtgtggtctcagatcctaggcactggctctgggatcagaactccaggtaaggacagaaacagctgggaagccctttatatagcccgtgggtttaaattaaatctcacaccccatccacctaacagcattttggaagtattatcttttcacagggcaatacagagcacaacaaaagggaaacgccttattgatcttgatgagatttactcttgatgagattctcctgcctcagtacctggtattacaggcgtgcaccaccccacccagcgaatttttgtatttttagtagaaatgggatttcaatatgttggccaggctggtcccaaactcctgacctcaggtgatccgcccgcctctgcccaattctaagtttgtacactgaggaccctaagtgctgggaggaaatttaaatatcgggggcagggcacttgggagggagatgggtgggggagaagtgacaaccacaggggacttgaccttaagacccctctttcactgggatagcatgggcaaggagcaagggtgcttgctagaaattgttcagtctgatttataggaacccctctgtaagcagtgtggagacacatccaaaagacactttcagttttattgggtaacttctttgaaatatgcttcactagaacatacatcataatcactagatcaccaacatcccagtaaaaacgctgccccaaaggactaggacacgggctgagggctatggaattctgagaactaagctgcttgagttttggaaatgtggaattagtaaaaccagctaattatgctgaacctgttgtcttaacatgaagataatcaaatctgccttgtcttgcaaacttccagtgattattacttaagacactattgggggggtgtacaaatggaaagcattacatttattaggaaacctattcaggggtgaaacagtttcaagtactctggaatcaggttttcaaaaggcttcaacaatccgacttgttcaaggatctaaagggtggaacccagtcatcttaatgatctgatccacttatgcccttgtttatccctgcgtgatccacagaccaacaccctgaggcgtctctggggacatgcacaagctggcaaccagacccacgtacacccatttaccccaatggaccagccgctgtaagcctgtagaccacggccactgcgcaccgccaacgcacgcagaggaagagtctggtctccccgtccgcagcgccaagaaagcgctgggggcggggagggctgctcagctcccccaggtgactggacccggaggttttcagatcgagcttgcacgggggccacctagataattaaaacaccaaccctaaaacagatctgggtgggggctaagaatctgcatttccaaaaagcgctcccgaacgagctcttcgcagtgatacaggttggacgggattaacgcttgccttcaggcagagccaatcaagataaatagggcgcgccggagtcctaccagttcggctatctgcagagtaaacagggccgttcaagcaccacccacctcgttttcttttgttcaggacaggactcgaggaaggatcctggcctcccctcctagacacactcccgtgcccccgggaaaccgggcagcactctcgccaggaggctgggagcgcgtctggccgcgccgcccccattactcacttagttccactctcaaaccaaagtccacccggccgggcccgcggactttcatgctctagacttaccacggaggcgagcaggactggtttctgttgctaccaggcaagcgcggctggcagccaagagccccgaaattccaccgaagctcaaccacgcagagggctccggggaaactccaggtgcatgtttttgttctcaacctgcaacagaaatccaagtggtggtggggtcccttccgcaaggtgggaggcccgggcgcgcggtaaacgtgttttggcgggaagcagcgccgaggccccgagacaaggtgacggcgacgttcccgcggcctgctcacggcactccagcagcctcggaccgcccggcccggcaggaaggtcggccccagggcctgcgcgggctcgggcgggagcttccgggcggggggcggagcgagcggcgcagcggggagagtgggggcagggacgggagggttcccggagggaagggcgcctcgcgggagggggaggggaggggaggggaggggagggggcccctggcgggcttccggggccctgagggcgagagcgagggcgacggcaaggtggggtgggggctgctccccggcccgccaagctagcgctgcctaggcgggagctcggggacccgcgggccgagcgcggctgaagggagggaagggaagaggcgctcgtaggtctgcgtccgtctccgagcgaccggggcggcggaaagggacctggggggggcggccgggactggagtggcggggccggggcgcccgcgcggcggctcaccacgccagggactggcccgtcggccccgaggaggcgcggggtccggagtccgggaagcggaggcctcgtgatccaagaccggcagccggacgtgggtcacggggtgcagaggaggaagtgccattgccgggcccgccaagatgtcaccaatgggaaacgcgtgcctgcaggtgcggccccgtggcccgcgcgctgggcccaggcaggaagtgggggaaggagagagtcagggcggcgggaagacatttctccgagttctcccgaagggagccaggcgcgagcgcgacctggggaaagtccagagtgccagccacggggaagggcgggcagtgcagagtggaagagaagccagcaagttagacacagcccctctctgggaggccgcctctaaaatggaactagcggacgtaccttggtttgtacatttgaccatggacacacgtaaagattttgaaaaaaaatctttgaaaaaaaatttttttaacgcaattcctaaacttttaactaacgcaattttgtggacctctgaatcttaattcaaatgaactggagaacaactataaagcaatttcgataatatgatcagtgacattttatattgcagaattgtaaattttgttgtcattatactgtaattttatttctttaaaagaccctttttagagccacaaatatttgcagatgatacctgatttcttgaatgtttcagattacgtggaaagtggaaatatacatgaaacaagatgtgctatgaactagtaatttttattaaagctcctgatgtatacatagagtttcattacacttgtttctacttttgtgtatgtttgactgttttgtttgtttggttggttttttttgagacacagttttcactctgtcacccaggctggagtgcagtggcatgatcttggctcactgcaacctctgcctcctgggttaaggcgattctcctgcctcagcctcccgagtagctgggactataggcccatgccactatacccagctagtttttgtttttagtagagatgtggtttcaccgtgttggctaggctggtctcgatatcttgacctcgtgatccccctgcctcggcctcccaaagtactgggattataggtgcgagccccatgcccggcctgtttggagtttgttgttgttgtttttttttttttttgagagacagtcttgctctgttgcccgggctggagtgcaatggcacgatctcggctcactgcaacctcccctcccaggttcaagcgattctcctggcctcaacctcctgagtagctgggattataggcgtgcgctaccacaccctggctaatttttgtatttttagtagagacagggtttcaccatgttggtcaggctggtctcaactcctgaccttgtgatccacccacttcagcctctcaaagtgctgggattacaggtgtgagccaccgcgcccggcctgttttacgtttttaacagaattattattattttgagacagggtctggctcagctgcccaggctggaatgcagtggcacgatcatggcaatgcagcctcaacctcccaggctcaagcaagcctccaacctcagcctcctgagtagctgggaccactggcatgcaaccacacccggctaatacaactgtttgtaaaactgagagaaagcaagtctttagaatgcacttactaaataacacgaattacagggaacagtaacatactgcatatagtgatgtagactgtgggaaactacaaggacaaatgagccagtcctacctcagaatagttccagccagataaaagaacccacagaattatggttatgttataaaataaagcaattaagttttagaaatccatcttgaaatatttgtgatggcttggatttgtttgaagttgtccacaaagtagtaggtggggagatggagaataactgtccatgattagtaactgttgaatctgtgtgacaggcacattagcctcaacctcctgggctcaaatgatcctcccacctttagcctccccaacgtagctgggaccacaggtgcatgccaccaagccgggctaattttttttttaattttttagtagaggcaaggtctctctatgatgcccagactggtctgtaactcctgggctcaactgatccaccttggcctcccaaagtgctaggattataggtataagccactgtgcctggcccaaggcaagttttaattattgatcagtcaccatagggttcctgcctgtgagggaacaatgtgtgcagaagacttgagccaggggttgtattgtgcaactgcagctaggtctgagatcaatggtaggagatgacatagccttaaaggcctggtttggtgttcaaaggccagtgggaaggcatttaatggaatgtggtgtgaaaggagttttgctttttaacacaacagtctagatgctatctggaaaatgaatggtgggaagagatacatggagacaagatgggaaggaatgaaacaagtctaggaagactggtgggagaagaatgtgaaagaatgtgtaatgtagagaaaaatgactgagtctggagactgactgactcaccaagaaatactacgcacctaaaagatacaggaactgtagtggtaaagagacacagttcctgccttggtgggtccagtaacagtggagtaggaaatcaagaaatgtacaaatatatgatgacaaattttagaatgaacgaaaaacagaaaataggcattagctcagattggggttctgaggaagtgacatttaaacagacaggagcatgggtgagtgggaacactgagtgatgaatttcatgtagaaagaagggaaattcttttttccttgataaatagctgaggtttaaagtagaagctggccaggagcagtggctcaagcctgtaactccagcactttgggaggccgaggtgggaggatcacttgagcccaagagagttcgagaccagcctgcgcagtatagtgagactcccatctctatataggaaaaagataaaaactgagggaaaaaaaagaagttaaaagcccattattcttttttccttctgtacattatctcccctctggacacttgttcaaattatttatattttttaccaaagccctttactgggatacattttggtgctggatgctttgtattcatattcttatttcgtggtgaatcctttagattgaagaaattttaggacacagcttctgctgctcgtgtctgttcaccacatgagaagcacaagatgcatcttgggggcaaaaattccccatcatggtatatagtatgtgagcagatcatagaccatatttgttatggatgttttccttttctgttggaaatattgaaaattgggtttaatggcctcaaaagtatcttccaacccagcaattttataaaattcctattcagtcactcttaagtacttcctgctgtcatgaactcaagaattatgatacaagacactaattccatttaaaaaaatgcaccaacgcacacatttgtacttaacttttcaggggcacatgtatctgaagtgtgagaattctaacccaattcacacaacgtgccaaattcaatacacagagctatcctaaaagctattaaggactgagaagtggccaggcacagtggctcatgcctgtaatcccagcactttgggaggccgaggcgggtggatcacgaggtcaggagggctaatacggtgaaacctcgtctctactaaaaatacaaaaattagccaaacgtggtggcaggcacctgtagtcccagctactcaggaggctgaggcaggagaatggtgtgaacccgggaggcggaacttgcagggagcccagatcgcaccactgcactccagcctgggcgatagagcgagactccgtctcaaaaaaaaaaaagactgagaagctgcagatggagcatatattaacattttaaatgtttactccattattactacatttatatccaccaaaggggatctgtcctgatctgcatgcaacaggaaagctgttttccattaccatctatcaggtcctttcacttacttgctgtagctaagtctggggggataacacactgcttccctcagcgttcatttctcaaaagctgtgttactaaaaagcatcaagagtagtataatgtaatgttagataaattttatctatactgtttgtactgaaattaatataagggacaaattctgaccgatcataaaacaagcaaccattgctgtttgatattgactgcattttgcaaatgcccaagaatcatgatatctaaggtaaatgttccttaaaacgttaataaaaagcaaaactgctactagacttctgttcctaaaaataaaatctgttcttaactgagggcaaatatcattatttggattagctggagtaactggaaataatatccaaagaaatgggtgtgtatagattccgctaaacaaaaatacaattgataggaagatcaattttgtttttcccagaccacctcctgtacctctctcccttgagcaagcagcccctaaataggtgcatagtcaaaccctggagctggagagaaaggaggcctgtggggtatcctcagccccctgaggaaggtacattccttgggatgggaattcttcctgaagcctccatggaaacatgacaccttagtcaggttccaagcagcaggccctgagctgagactgctggccctgagctgtgctgcccaggggaccactgcattctgccttgggggaattgtgcagaacagagagatggaaggaggaaaggaacatgacaatttacagaagaggggctccggcacccagaaataacataccacacctcaggtttcagggaacaagaagtgctagacaaaaaccataatgattttaacaggaaaaaaagagcaacttcagataccactccattacaaaacttaaaaaaaaaaactttctggaactaaaactgagttttaaatttaaaagttagtaatgaattcaaagaaaggaaaacgaagtagaataaacatcaaaacagaaacaatgggggagaagataagagatttggaggacatactttttccaaagcagtttcctctatactttaggagttttaccaacacacgcctgtgctgtgtcttttcaaaatatcctaatgggaactacagggatcttaagccaggaaaattcacttctaatcctttatcgcttctcttgctgcctccatctgtgtctttttctccttctggaattcctactattcacattatttctcctgcctgaaaagaaaccaaccctatcaacaccctcatcttaagacttctagcctccataaccgtgagaaaatttgttactagtctgtattactttgcatggcagccctagcatactaatacaacgtgttaccaaaccagacaaaaacatcacaagaaaactaacttctgaattctatgtactttaagaggatcgtatatggtatctaacaccaacttaaattagaaaagatatgtatttgtcataaacatcataattctattagatggcactattctaatcaaataacttatgatggatttatcgggatataacagtaagtaagagtatctgtatttgtattaggtgaagcattttgtctaacaggaggcataccgttaggataaatctaataggagtcttaatctgtcatgccttttcttaattatgatggctttttttttttaaacggggtcttgctttcttgctcagggtggtatgcagtactgcaatcacaactcactgcatcctctatgtctttacaagtgttcgctatcatacctggctaattaaaaattctgtttttgaaaagatagggtcttgccatcttgcccaggcttatcttgaactcctgagctcaaaccatcattccactctcggttcactgcaacctccacctcctgagttcaagcaattctcctgcctcagcctgggattacagatgcacaccaccacacctggcaaatttttgtatttttagtagagatggggtttcgccacattggccaggctggtcttggactcctggcctcaagcaatccgcctgccttggccctgctgggattaaaggtgtgaaccaccccgcccagcctgtgtcattttcaagagatctttttcctagccccagcccatatagttatctgaacttacaaagcgttgatgttcttctctaaatttttacacttacatctacaatgaacttggaattgattttttcatttccaaaagagttttacaattaatcaagtatcacaggctaatttcactcaagaactcagatgcaaaagtccaaaccaagtatcagtcaacctaatccagcaatatataaagcgatattatgaccaagttggatttcaggaatgcaagtgtagttgatcatttcaaactcaatcactgcaatttctcatactgatgtatcaatggagacaaagtatagaggtacttttttaatgttttatgagaaatgctaagctgaatttatgtcaaggaagaactgaggccatatatagtggctcacacctgtaatcccagcactttgggaggccgaggtgggcagatcacttgagctcaggagaccaccctgggcgacatggcaaaaccccttctctacaaaaaatacaaaaaaaaatagctgggcatgtggcacacacctgtaatcccagctacttggggggatgaggcaggattgcctgagcccaggaggttgaggctgcagtgagctctgtccacaccagggcactccagtgtgggcatcaaagtgaaaccctttctcgaaaaaaaaaaatgtggagggctgggcgtggtgggtgactcacgcctgtaatcccagcactttgggaggccaaggcaggtggatcacttgaggtcaggagtttgagaccagcctggccaacatggtgaaaccccccaccccctgccactccaccatctctactattagatgggcgtggtggtgctgcacacctgtaatcccagctgctcacgagcctgagaatcgcctgaacccaggaggcggaggctgcagtgagcctggatcctgccactgcactccagcctgggtgacagagtgagaatccgtctataaaaaaaaaaaaaaaggaaaacaaaaacaaaagtacatcttagagcgatcacatgaaaaagtattcctgctaataaatgaaaaggaatcgattattaaaatatcactaatttgaaaaccatttaagaaaataatggatctacataatgatcattaatagctgctgtaacatgacaaaagagaagataccaaccaatatgtgcctccggttggagcacagcacctcaagtaagttttctttccaaaaactctcatctgaatcaaaactacctccagactgggtgcggtggctcacaccagtaatcccagcactttgggaggctgaggcgggtggatcacctgaggtcaggaggttgagaccagcctgaccaacaagttgatactccgtctctactaaaaatacccctgtaatcccagttactcaggaggctgaggcaagagaattgcttgaacccaggaggcagtgagacaagatcacaccattgcactccagcctgggcaacaaaaccaaaactccgtctcaaaaacaaaaataaaaccaaaaccaaaaactacctctagaggtaactatcactttacaggaaatataaagaacagacactcaaagaccaccacggaaaaacaatcagaaaaatgcgaagtgtggggaaggaatgctgcaagacagcccgacaaatataacgggggatggagccttttaagaaaggggaacctctagatgatcacttacacagcatccattcaccacgcttgaaatgtgtaagtgtaaaactcacactggattttgacaagttcacaggattttgtttttaattattttagtcaagatcatggagaaatgaaaaagtgttttaaaattacatgcaaaatagtagtggatatatattaggttaaattattaatacaatgaatcatgtttccttttaccactaaagaatataagattacatttatagcatacattatatttctattggacagtgctgctctgaatttaaaaagttatctacaaaatataaggtgtgactttggatcctgactcaaaccaaccagctgtttaaaatatttaatacatgccgggcgcggtggctcacgcctgtaatcccagcactttgggaggccgaggccggcggatcacgaggtcaggagatcgagaccatccctgctaacatgatgaaaccccgcctctactaaaaatacaaaaaattagccgggcatggtggcggccgcctgtagtcccagcaactcgggaggctgaggcaggagaatggcattaacccgggagatggagtttgcagtgagctgagattgtgccactgcactccagcctgggtgacaagagcaagattccgtctcggaaaaaaaaaaaaatttaatacagaaacacttaaaccctggatacttgatattttggaatgtatttttaggcatgacagcagtatcatggttaggttttaaaagttcttagaaatactgcggatttatttattaataaagaccttattggtctgggatttgctgtaaaataagccagggcggtcttggctgagctcagttctccctctgcccaccctgttgccctccacaagaaccgtagctcagggcaactaagacagggcaagggccctggcaggggaggggtgtcccggtccaacttgggacccagttgggactgggtcccaagtcccaattgtgtccctggacacatgacttctcccaacctccattttctcatctgaaacatggggctaatagcaagcccttctggagtagtcctgagcatgtaattagaaaatggagtaaaacttctaggacctagtaagagtcaactaatgtggttctcccgaagagcagagaaccagagctcagtgggggagagggaattagagaagtcacctccaaggaaagggcctgtcacatttctgcagcccctgcaggcatctacccccaccgggctctcatttgcctccaggctttccaaggttctggccacgtgggagaagtaactttctatttactcagtcttttcccttaaataaattccattttttacctgaataaagctttataacgctacccttaacagaaaacttggcagtttacaaaaaagtggccgggcacgatggctcacgcctgtaatcccagcactttgggaggcagaggcgtgagaatcgcttgagcacaaaagtttgaaaatcaatctgggcaacataaggagaccccatctctacaaaaaatacaaaaatttgccgggcgtgctggagagtgcccgtggtcccagatactcggcggctgaggtgggaggatccgttgagcacaggaggatctcggcagcgagccgagatcacaccattgcactccagcctgggcaacaaagtgagaccctgtctcaaaaaataatacatatttttttatagagacggggtaggtctctggggcccaagcgatcctcccacacctcggcctccctaaatgctgggattacaggcgtgagccacctcgcccggccgataatgactctaatctacagaatgcacaccggaatgtaatacctacaagggaaaagatcttcttgcttaggaataaagcaatctctctcttaatattcattaaagtagtaatgtcttattttatagtttataaattctgtgagagcaacgagtcactttgcaggaatagcacttaaggtatctttcacctacctggagaacccaagaaattttcatcttactaggaattcagagacaaccacgtatttaacttttaaaaatataactaagtagaaagaattatatgcgtgtatttttggaagaattaagatgacttttgggacggaacgactgaaaactacgctttcagaactccctgccgcctgaggctgtggccctgaccccggcgcagggcccgccccgcgcggttccgggaagccgccgccgccgcccgttgcccttcgcgcgcagccgccagcgcgcgcctcgcgtcccgccacgcagatggccggcccgagcccccagcgcccgcgagcagtttcgagaactaaagaggcgcgtcagctcgtccccgggccgcccgcgggcaatggccgagctcggctctccttccaccctccgccgggacacacgcggagccgagcgggggtcccaggcgcctagggggaggggttcccgcgcccggggcggccttggggggagggcgagtcgggtgccttgctcctcaaaaccctggtccacgactctgcggttgggggagccgggcagccggcgcagcaggagccgggccccgtccacaagtttcctacgagcagggcggaatcgacgaaaatacttaatacaaacaaacaaaaggaaaaaaaaaaggacgactaagctgaagagcgcgcacgagtcagattttcaccccaaatacaaacacgatacctctaggagcaggagaccaatacagggaccgcgctccgaggacacgcggcgcagccgaggaggaaaaagggcccggggccgagagctaaggctacgggaaccgggcgtgggaggagggcggagccaactccccacaaggaagtcttgtgcaactctcaggcgcctgcagccacgtgagcgcgcggctttcattttactcaggtattattactattattacttcttttgagacaaggtctcatttccgtcgcccggctggaatgcagtggcacaatcactgtcactgcagcctcgacctcagagcaagcgaccctcccgcctcagcctcccgagtagctgggacaacaggcgcgcgccaccacacgtggctaatttttttttctttacttttcagtagagacagtctatgttgcccaggcttgtcgggaactcctgggctcaagagatcctcccggctgggcctcccactgcgccaggcctgttctcactttcagagccctccggcagtcgccagctccccgccagggggccggactaacgcacccggccgtccgtgccttccccgcgctttcctgactccaaaatctcagcccgcggtgctcaccgcgtgggaccactgtctgggcgtgcggctctcgacctccgacgctgcgtctcccgatcccagtgggtccagttcttgccggtcccacgtacgggcccctcgacctcgaatcccgtcacccaaatctcagcgccacggcccctcattatgtgcagtcctcgctcggtcccaggtttgcggcgcttaaactcagatcgctcttccctgatcccaaatcccagccccagcccaacgatccccaccccaataggcccagtccccaggtagtccgggtacggggccctggacttcggatagtctccctaatctcaaatcccaccccccgtccccacccccagggggacccggtccccgctaggtcccgggtgtgcggccttcgacctcggagacttcggccgcccctcacctcggcctccgagtctctacactcccgctctcatatcaggcaccccggtggtcccttggagcacctagaggagggtgggacgcggggaacttggcagttgtagcagaggcagttgaggcttgttgaccatcaccatggaaacccccgcctgcgagcacggggcggagcctacgaggggcggggtcaggcgcgctgccggccccaatcctcagcgcctgcccgtcgagcgcacgcggctttgccggaagccctcctgctcccggcgagccaggccccgactaggccctactgcccggctcagccctttgccctggacaccaggaaacagaagcccaaggagcccgcgtccccaccccctgctacctgccggcgtgacagcgattcggtggccccccgaaccccaccttgaggaagacgcggcgcagtcctgcttccacgacggagccggaaggacgcaaggaccgcggcagggcggagtttct

SEQ ID NO: 1569 - DNA, 4693 bp, Homo sapiens; identical to SEQ ID NO: 1563

SEQ ID NO: 1570 - DNA, 36181 bp, Homo sapiens
atacaagtgtgagaaattcctcaagattttaatgttaatatgaaaaagattacttcacatgtgaaatccacaggtgtcattctattatttttgaatatttaacattcacaccaaaataaaagattctgaatgaaaacttaagttgagctgtaagtatgtaataaaaaatttaacattctccacttaccattaactcttctaaaagtttaatttctaagacatatcttctaactaattttatattttccacacattgtgttaattttgtttttttttgagatgaagtctcgctctgtcatcaggctggaatgcagtggtgcgatctcagctcactgcaacctctgcctcctgggttcaagcgattctcctgcctcagcctcctgaatggctaggtcaacaggtgcatgccaccatgcccagctaatttttgtatttttagtagagatggggtttcaccatattggccaggaaggtctcaatctcttgacttagtgattctcccacctcagcctcccaaagtgctgggattacaggcgtgagccaccacacacagactgtgttaaaatttaataaaagtttggttttacaaagacaagaaattctgactgatttattcctctcacctgtgaacaccggatgccttttatctcaattaacggatctgaaagttacattgacaaacttctcatcagaacctacaaagtactgtgtgaaatgacatggcacaaaacaaacagcaataaaaatgtagccataacacaaagaagaaaaagaagggctgtgatgcatacacagttgggataaacataagtagacacaaaaacaaaactaaagataatcagaaaataagaagaatgtctctttaaattcagaaagagtcagttttgcagcataagaacaacgtcctctccacatacagaatcgattttatttcttcaccacgcatatttctttatctttacttggagctacaaactaactccagcagaaatatttatggccaataatggtgcctctattacagcaagcattgtgtttgctacatttacatatcaaaatatctttgtgacttatgaagcctccccagtatttacttaaacaaattggctgaatgaataaattcacctatgtcaattataaagagtaaaaggaacaataaggaaacttagcttacacaggtttctccaattaaaataacaaaatgggatgttctaactaaatgaaatataagttggtcagatgcagtggctcacgcctgtaatcccagcaccttgggaggatgaggtgtgtggaccacgaggtcaggagttcaaggccactctggccagtatagtgaaacacagtctctactaaaaatacaaaaacattagctgggcatggtggcacatgcctgtagtcccagctacttaggaggctgaggctagagaattgcttgaacccagcaggtggagggtgtagtgagctgagatcccaccattgcactctagcctgggtgacagagcaagacaccatctcaaaaaaaaaaaaaagaaaaaagaaagcaacaaaagaaatataagttaatacactcattgtgaaataacattgaaaaattattttgcatgcattactaaattttataaaaattcttagaatatctgagcaactcacataatgaatacttaataaattataaacacaaaaaatatgaaaaaaaaaatcagtctaccatgagtaccaggcaaatgaaagaaagaatttgcatggaaagattcggaaacacagtccataagacttcacagtaattaattaaataaaatgcagagaatacagatattattcaaaatcactgaggtttctggttttctagtaaatgatttgtccactttattaaagtgatattttgttccaatattgcttgtcttctgaaaataggtactctcacacacaattacttgccccacaattttcttacacctaatgtttatcttaagagtaatatatttgtatatttagcatcatgtaagtaaaaactaacagtctgcatgagtttacaggcagagagtccacttgttcaaaatatatatgacaaatttttaaaaatattcattcaggacttagaaatgtgagatttattatactactatgtaattattatcaagacgataaaaaacctctgtagcaagtaataatttacttgtacatttttagataactaaaaatgtttaaatggattgtctgtaatacaaaaaaaatgcattaggtaatgaatacctcatttactctgatgtgattacaaattgtatgcctgtatgaaaatattctatatatgccataaataggtaaacaatattatgttcctacaaaaatttaaaaagttaaacaaatgtacattttacccattgaaacaatactgttaaacttttcagtttaatgccacaggcaaaagagattgctagagaggtcattctactatgttaccatcttttatctacatctttaatacagtgggatacgttaaagttggtgacataacactttactaaatgcacgtcttaaaaagtttaaaaccatttcgtttaatttaaaagttaagttatcacagtcttataaaagaattttaaaattccctacattttattacataaaagtacaattggtaaaacaatttactactaaaactcaaagttttcctctcactataatgcagaatattactctaaacacataactcatgcatcacatgaacaatgttaaaagtcagccataaagagcctctccaatcagattttcattatcatcttacattttaatatccttactcttccatggaaaaattaatgaatgatgcctacctaataagaaaggaatctctcagatttctgatgcaacagaaattgatgacatgcttttacacaaacaacaggaaaaaaggaacagcatgaagcaattttacagttgaattacctacttgcttttcaaaaaacttacacttttttcaaggaaaaacgtataccttgaatgtaattttaactctccaaaaaataaccttccactcctcttaaacttatatacaaataaattatccaacagttttagctttggattactttctttacagaacattctgatttagtgtaacgtcttaagtgccagtgccttagttctccctaccgtgaattttctaaagtttacaaagacttaattttgactaaatatttttacatatgtattccatctgcaaaaatattttttattataaactgtgtggtgttttgtaagctgtagtttctgaacaaatgtttttccacacttattacatttgtacggtttccttcaacataaattctctgatgccaaacaagtttgagtaattcctttagagttttcttctagtgtaaaatctgtacattatatagggcaagtaaaggtattacaaccctctttatatttgtaatgtttgtctccagaatactcttttttattttaagggtttatattttccaaggtctttgaacagtaattacatttataataattttattaagtatgaacttcctgatgttgactatgatgtgagcagatagaaatggcttttccacactctgtataatttttcaagtataaacgcttttatgtgccataaagtatgagcatgttagaagttttgacacattctttgtttgtagagattttctccactatcaattattttacctacagtaagatgtgacaaccatttaaagggcttgccacattgttcagttttctgaggtttctcactgatatttctccaaggcttaggaaagtttgaggtgtattcataagctttgccaaacttccttaggttcataggcataatctttagtatgaattatggctggatatatttgagcaatacttaaaagattttgccacagtcttccaatttgtatgatttttttccagtatgaattctcataagtttagtaaggcttaaggactggttaaaggctttcccacattctttacatttgtgggatttctcttcagtatgaactctcttatgttgagtaaacttgaggaacaagaaaaagttttgccacattcttgacatttgtagggtatctctccaatatgaactctcttatgtttagtaaagcttaaagaccagtaaaaggttttgcaacattcttcacatttctggattcctctccagtatgaattctcttatgtatagtaaggcctgaagactgcttaaaaagctttgccgcatgcttcacatttgtagggtttctctccagtatgatttctcttatgttcattcggttttgaggagtgtttaaagactctgatacattcttcacatttacagggtttctcttcagtatgaattctctgatgtatagtaagttcagaggaccacttaaaagctttgccacattcttcacatttgtatggtttctcttcagtatgaactatcttatgcttagtaaggcttgaggaacagtaaaagcctttgccacattcttcacatttgtaagattcctctccactatgagttatcttatgttcattcaggtttgaggattgtttaaagcctttgccacattcttcacatttgtaggattcctctccactatgagttatcttacgttcattcaggtttgaggattgtttaaagactgccacattcttcatatctgtagggtttctctccactatgaattatcttatgtacattaaggtctaaagacttcttaaaagctttgccacattcttgacatttgtagtgtttctcttcagtatgaactatgttatgttgaataaggtgtgaggaacagtaaaaggctttgccacatttttcacaattgtagggtttctctccagtatgaattctcttatgtatagtaaggtttgaagacgcttaaaagctttgacgtattcttgacatttgtagtgcttctctccagtatgaactatcttacgtttagtaaagcttaaggaccagtaaaaggctttatcacattcttcacatttgtagggtttctcttcattatgaattctcttttgtatagtaaggcccaaagactgcttacaagctttgccacattcttcacatttgcagggtttctctcccgtatgaattctcttgtgtatagtaaggtttgaagaccacttaaaagctttgccacattcttgacatttgtagggtttctctcccctatcaattatgtttagtaaagcttaacaaccaataaaaggctttaccacattcttcgaatttgtaagggttctctccagtatgaattctcttatgtagagtaaggcctgaaggttgcttaaaagctttgctacattcttcgcatttgtaggatttctctccagtatgagttctcatatgttcattcagttttgaggattgtttaaaggctttgccacattcttcacatttctagggtttctctccactatgaattctctgatgtatagtaaggtctgaaaaccacttaaaaattttgccacaatctttatatttgtagggtttgtctccagtatgaactatgttatgttgagtaaggcctgaggaacagtaaaaagctttgccacattcttcatatttatagggtttctctcaagtatgaattcttttatgttctttcagttttgaggatattctaaaggctttgccacattcatcacatttgtagggtttctctcccatatgaataatcttacgcatagtcaggtttgaagactacttcaaagctttgccacagtcttcacatttgtagggtttgtcttcagtatgaactatgttatgttgagtaacggttgaggaataggaaaaggctttgccacattcttcacatttgtaggttgtatctccagtataaattttcttatgtttattcagttttgaagattgtttaaaggctttgtcacattcttcacacttgtagggtctctctttagtatgaattctctcatgtatagtaagacctgaagactgcttaaaatctttgccacattcttcatgttggtagggtttctcttcagtatgaattatctcatgttgtcttaggtgtgagaacctgtgaaagaattggccacattctttacatttgaaaggtttctctccagtatgtcttctcctaagtctatttgaatttgaaaatttcctaaagactttcacacatgtattacattgaagtattttgctctgagtaaccgacaaacattggttaagtccattataacctccttcctgcaacttagatgcattcaaacttttacagccttttcttatttgtaaattctcatgtctagatttctcatatcttctcagtatcactttttgaaatgaattttttatgttctgatctagccaaaggtcttgggtgaaatgagaacacagctgaaagaaataaaaataaattatctcagtaggcccatgtgaatatacaaatctattgtttacaaatctaatacataaaattatacaaagtacattagcaacatggcataacaaaaataccacaggtcctaattcttttatagagttataacaaaactctactgaccaaaatgtccttatggaaaatctagaaatgagttaagtgtgttcagtgtaccaggtgagcaaaatgccacaagccatactgaatggatagaaaagtttgttacatttgcccaacacctttcctcctccataatgcagcatggcacttttagaagtaaactgcaatgtctggcatcttcctcaatatagaaaaaaaaaaaaactggctcatgtatttttacttctggcttctggacacttttacagagacttgtttctgtctccaatgacaaaatgtgctgaaagaaattatggtatactttgaaataacagcttgagtctgctgagaccaaaggtaaatgttacagcaaccaactacagtaccacagacatgaaatatgtataggaagtaattacagactgtttaagaaacacaggcaaacccctttaactgagtaatcaacacaaaattccacacatgacaaatcataacatatttgataggctcccagaatctctagttgagacacttggtttcagactatgttaggacaacaccgcattataaagattgtgacacatagctgtttgttaatgtccaaatctcaaccaaagagtacaatacatacaaaatattacagtgacatggcctaagtaaaaaaaaaaacttaaaactgtcagaaaacaaccatgaaaataaagatgtacacattagttttaaaaatttaacctaaatgggaacacaggtaactaaataaaatcagaaaaaaacagactatcaaggaaaagatgaaaaatataatagaaattatggaagtagaaaatacagatagaaataatgactgaggccaggtgtggtggctcatgtctgtagtcccagcactttgggagtttgaggcaggcagatcacttgaacctagggagttcaagtttaaacagggaaacatggcaatacttctcctctataaaaattaaaattagtcaggtgtattggcacacacctgtggtaccagtaaacaggaggctgaggtaggaggatcacgtaagcctagggaatccaaggctgcagtaagctgcaatcatgccactgtactcaaacctgggtgacagagcaagacactgtctcaaaaagttaagaatacctgagaaattctcaaaagtaagaaaataaggttgtaaaaatgaagaagctcaacatactaaaactaggaaacacacagatccataacaagacatgcaaagcaaagttcccaaaatcacagacaaaaagagaatctcgaatgctggaaaatacataattatggttctatgatataaccagtgactctttcaacaaaaaccttgcaggctagaaggaaattatgtgctatagtcaaagccaagtgaaaaatagcttctgtgtaagaataatataaccagaaaaactgtgctacaaaatgaagaaaaagtaaagacctctgaagataaccaaatgtggaaaaattatatcaacactacatacgccctacaaaaaatgctgagaagagtcctactactaaaattatatgatgctaaaaaacaaaactatcatataaaaatagatagctttctgggaaaaatataaagatatgcaaatattatacaaaaaaatcctgtagcattatcataataccaaaaaatgttttatttaattattctctaaaatttaaagataaaagctaaaaataataatgaacatctggtataaatatataacataaatagatatgtttagtgacatcaataactaagttgaggacagatgtaataagaaataatttgtgcatgaacccgaatttaaatttcaccacttcaaaatatattgttgaaattttaagagatttttatataatcctgaaggcacccacaaagaaaatgtctgtatagatacaaaaaaggaagtaagaaagaagtgacagcctatccatacaaaaatcaaaaagacacaaaggaagatagaatgagaaacagacatgcaagaatcattaaacaataaaataacaataatctttgtcttcagaaaataaatattttaaaaacagactttccaatcaatacacatatattgaatagagggattatataaaattttatgtaccaagatccaacttgcctttcttcaagagtcacttgagatctagtagtgaaatcggcctgaaagtggcaagtggaagaagacatttcaggcaaacattaaccaaatgtgaggagaagacatcaaaattgtattatacaaaatacatcgtaagtaaacaactctcttattttataaaatatactttatgtcaaaattcacaagagaaaaaaggtcattaaacaataataaagacatcatttattgaaaacgtatgacaaatatgtgcatacatatatttatatgtttgtgtgtgtatgtgtatttctcacattaggtttccaaaaatacaaatcaaaaattgacagaattaaagcaacaaatagagagaaatataattataataagatattttaatacttcaatttctgcaatgaacaataaaacaaaacaatattaataatagaaaagagggccaggtacggtggctcatgcctgtaatcccagcactttgggaggccgaggcaggccatcatggggtcaggagatcaagaccatcctggctaacacaatgaaacccagtctctactaaaaatacaaaaaattagcagggcgtggtggtaggtgcctgtaatctcaggtactcaggaggctgaggcaggagaatggcatgaacccaggaggcggagcttgcagtgagacgagatcgcaccactgcactccagcctgggcgagagcgagactctgtccccaaaaaaaaaaaaaaaaaaaaaaaaggaaaagagaaactgaaagcagtacagatggggacaagtggctcatgcttgtaattctaacactttgggaggccagggaggacagatcacctgaggtaaggagtttaagaccagcctggccaacatggcgaaaccccatccctactaaaaccccatctctactaaaaatagccatgtacagtagcaggcgcctgtaattccagctactcaggaggctaaggcaggagaattgcttgaaccagggaggcggggtttgcaatgagtcgagattgcggcactgcagtccagcctcggtgacagaccaagactctatctcaaaaagaaaaaaaataccaagaaagcagtataaaacaatattatgcctaacaaagaacaccccttaataatagcagggtacaaccattctcaatagctcacatacattctctttgaaaaactgcctgttagtccattataaaaaaaaaacttactaaatctttaaaaattgaaattgatagattactttttatgaccaaaatggaatgagagtagaaatcaacaaaaacaaaactaaaaaatttataaatacatgaaaattaaacaacacactcttcagcatgctcaaagggtaaaataattaatattcagcatgatcaaagggtaaaataattaatattgtgaagatgcccatactgctcagtgtaatctacagatttaatgcaatccctttcaaatatctaattttattttagcagaaatagaaaaagcaaccccaaaattacatgaaattttaagaaacaatgaaacacccaataatcttcaaagagaggaacaacgttggaggcatcacaactccctgatttcaaaacacattatacagacttaaaacaatttggtttggttataaaaagtgaactagaccaaataaacagaatgtagtataaactctcacacatatactcataggaagagttatttgcacatccataattttttttttttagatggaatctcactctgttgcccaggctggagtgcagtggcacaatctaggctcactgcaacctccacctcccaggttcatgccattctcctgcctcagcctcccaagaagctgcgactgtaggcgcccaccaccacgcccggctaatttttttgtatttttagtggagacggggtttcactgtgttagccaggatggtctcgatctcctgacttcatgatccgcccaccttggcctcccaaagtgctggtattacaggcgtgagccaccgcacccggctgcacatccataatttttacagcattgttattgacaggcaataggtgaaagcaatgcaaatttttctccccagattactggataaatataatttgaaacataaaaataatggaatattactcagtgtttaaaaacaggaaatacaggccgggcacactgcctcacacctgtaatcccagcagtttgggaggccaaggtgggttaatcaactgaatttgggagtttgagaccagcctgaacaacatagaaaaaccctgcctctactaaaatacaaaaattagccaggcatggtggtgcatgtctgtaaccccagcctcctctcaggaggctgaggaaggagaatggcttggaatttgggaggcggagattgcggtgagctgagatcactgcactgcactccagcctgggcaacaagggcgaaactccatctaaaaaaagaaaggaaatattctaacaaccataataaactttcattaaattatgcaaaatagcatatgtcagccacaaaaaaatgctgtatgaatccacttacatgagatatttaaagcagttagactcaaaaacaggaaaatagaattgtttgtaaagggccagaaaatgggagaaatgagtagttgtttaatgtgtattcagttttagttttgcaagacaaaaacattctagagatatgttgtataataatgtcaatataattaatataaactacatatttttaaattaagattctaaattttatgttcttgataattaaaaataaacagtaataatacctaaaaatgggacaaaattgacagtttttaaaattaccttcaaatcaaaaaagtatttctcccacacaaaaatagattcccaaatagatattagaagtaggagaatttttatgactactcagataaaacgaccattgatcactcacaaacatacaagtcataagcaatatagaaataatatgcgtatacacaaacacagaaattattatattgggaatagacatatgactgattcatatttaactttggctccacgctgtcttaaagtgcacagagttgaatattgacattcacaattaccatacaaagtaaaaactaaaaacacaattaactgatgtgaggtggcatactctaaaatatgaaacaaaaaaaaataaaattggctgggcatggtagctcatgcctgtaatcccagcactttgggagactgaggcgggtggatcacgaggtcaggagatcgagaccatcctgcctaacagggtgaaaccccgtctctactaaaaaatacaaaaaaattggctgggcgtagtggtgggcgcctgtagtcccagctactcgggaggctgaggcaggagaatggcgtgaacctgggaggtggagcttgcagtgagccgagatcacaccactgcactccagcctgggtgacagagcaagtctccatctcaaaaaataaaataaaataaaataaaataaagtaaaatgaaataaaataaaactgcaaaacaaaatgaaaacatggaatgttaaacatactgaacaccattaagtagattactacatttggaaaagaaatcttagaagacaaatgtagggaaaaagtattagaggggttatatgaagataaaagaggatgaaaactttccaaatttttatgtgataaaagaaaaactaataccaatcaatactgtttgctttgaaattatttggaattactctggaattaaaaataaggaaacaataaagaacttacaaaataaacaaaaggtgaaggtatttatcaccactagcatggtcccacaagaaatgctacatggtagccaggcaccagtggctcatgtctgtaatcccagagtcttgggaggccaaggcaggcagattagttgaggctaagagttcaagatgagcctgaggaacatagtgagatgctgtttattttttttaatgccaaaaagagtccatatgttgaaaaatataatgatgctgaacagccttaaaaaactacatgaaactataaagctttctgttaaatgtaaatatataaacacatatacaattgtttaccaccataatcatgaagcaaaatctcttaaaattctgctataaaatttgaacaaaaaatctgcataaatctgttaatagatacacaatataaaataatatttgtaataataaaaaactacaggatgtaagcccgggcgcaatggctcatgactgtaatcccagcactttgagaggccgagatgggtggatcacaaagtcaggagttcaagaccagcttggctaagatggtgaaaccccgtctctactaaaaatataaaaacttagccagtcatggtggtgggtgcctgtaatctcagctactcgggaggctgaggagcattgcttgaacctgggaggtggaggttgcagtgagccaagatcacaccactgcactccagcctgggtgacagagcaagactccatctcaaaaacaaaacaaaacaaacaaaaaaaaaaccactacaggatgtaaagaggtatagtttttgtattcaactgaagttatgacatattaatattgttataactttaaaatgttttacataatctccaattaccaagataattacaagtttatagaaagtatgcaatacaaaatgagaaaggaaacaaagcataacactacaaaatcaaaaaaacaaaaattaagacagtaaaataggaaatgatggaaaacatctctacaagaaacacagaaaataacaacaatcaaaatggtaatagtaacttcatttctctaaggaatcattttaaatataaattgattaaactaataataagaaattaaatggctgaatggaataagaacaaacaaaatcatacaatatgcaacaaattacacaatattcttgtttgaacttggtgtactctgttaggacacataataagccttattaagtttaagaagactaatcaggtgtggtggctcatgcctgcagccccagcactttgggaggccaggactggaagattgcttgagaccaggatttcaggagagtcactttaactttgagtcaaacaggttgaaagaaacagaatgaaaaaacatattccatgcaaacagtatccacagttaagtgaggtggtcataattatattagacaaaatacactgtaaatcaaaaactagcatgaggtaataaagattgttactatataatgataacattggtcatttaccaggaatctataactattatatctatttaaaagatcagggttccaaaatatataaagctaatattgacagaagtgaagcaaaaaatacatagcaacataataattacagacattaagaccccactttaataatgagtgaaagtttagataaaacatcaataagagaacaaaacctggatgacattataaattgtattaattcattttgtattgcaataaatacctaagactgtgtaatttataaagaaaaaagatttattttcttcatagttatgcacaatgtacaataagtatggtgtcagcatctgcatctggtgagggtctaagtaagcttacaatcatggtaaaggcaaagagaaaccagacatattgcatggggagagagggagcaagcatgaaaagaaagtgccaggttctttaaacacgcagctctcacatgaattaatagagtgagaactcattgatcaccaaggggatggtgtgaagtcatttacaagagatttgcccccatgacccaaacacatcacgcaaagatccatatgctacattgggaatcccatttcaacacgagatttgaagggtacaaacatccaaatcatatcatagaccaactacacattaaaaatatgtacaggaccctccagtaaaaaggaacagattacacaatattctttacacaatattcttgtttgaacttggtgcattctgttaggacacataacaaatcttattaagtttaagaagactggccaggtgtggtggctcatgcctgtagcccccagcactttgggaggccaaggcgggaagaccgcttgagaccaggatttcaaaaccagcctgggcaatatagtgagaacccacatttctacaaaaaatcaaaaaactagccaggcgtgacagtacacgtatgtagtctcaactacttgggatgctgaggtgggaggattatttgagccttggaggttgaggctgcagtgagccaagattgtaccactgcgctccagcctgagtggcacagtgagaatctgtctctcaacaacaatacgaataaataaataaatttaagatgaccaaaattatacagttatgttttctgactaaaataaaatgaaactagacatcaaaatcaagagataaactggcaaattcaaaaatatatggaaataaaacacactctgtaatatattcttgctcaaggtccagataatttaatcaaatgtgaaaacaactcacggtggtgaagaaattccaatggtacattgttgaccagaaatattgtttaaaaatttttaaattgattatgagctaaaactagccaaacacccatgagaaagaacaaagaggcattatatttcctgatttcaaaatatattaaaaagctacaataaacaaaagcaatgtggtactaacagagacaaacagatgatggaacaaaatagctcagaaatgaacccttctttatataatcaaataatcttccacaaagttgccatgactacacaatagagaaaagaaaatctcttcaacaaatgatgttgaaaactgagtatctacactcaaaaaaataaagttggattattttcttgcacattttaaataaaataatgaaactaaaaaacatataactaatacaactcttagaagaaaaaaatagggaaaatacagaacactggttttggcacctttttgtagatatgacatcatacttatgaaaaacataaaaacccccataatttaactacactaaacttcaaattttctgcataccaaagaaaatatttagcagaatgacaatgccaccgaagaaatgggtgaaaatattcgcaaattacatgtgatgagttaatattcagaattataaacaactaaaactaaacaacaaacattgaataaattgatttagaaatggacaaagaattgaatggatgtttaatcaaaaatatatatataagtagaaaaaagcacttaaaataatgcaaaaaaagtaccaattgtagagaaatacaaaacaaaatttcaatccaaaacaaaaccacctcatacccattagaatggccatgataaatttttaaaatgccaaatctgttgaggatgtaaagaaattaaaactcatgtgaattgttggtggggaaaaaaggatgcaatcatcatattatgaatgtttcttaaaaattaaattacataattcaggaattccacttataaacctatattgaaacataaatcatattatttgactggaatataaaatatatttttatatattaatatatttataaatggaatccaagaattccacttataaatctatattcaaacataaatataaacgtatattccaaatataaatctatattcaaagaacctggaagatatatttgaatatatatttgaaatattggtataatatattataccaatatttatatatttaatatatataacatttacatattaaatatataaatactggtaaaatatatttattataccaatatattatatataaatatatacatatatatttatagatgtactatatatatataaagatattataccaatatttacaaaagccaaaaggcagaagtaacccagatatcccatgactgataaacaaattaaaaatgtaacatatacacatacagtggaatattattcagccttaaaatagtaaatcttgtcacattcttacataaacgttgataatattatgtcaactgaaataagatagtaacaaactgacagatactatatgattccatgatgtgagtcatcgtaagtggtcaaataaaaacagaaaggagaatggtgttactcaaggtctaaagagagggtaaaatgggcagttgttacttaatgggtattaagttttaattttagaagacgtaaaaattctagaggtctttatataacaatgtaaatacttttaatgactaaaatgtacaccttttttaaggcaggttctactctgtcccgcaggctggaatgaagtcacataatcatagctcactgcagcctcaacctcccatgcacaagtgattctcctgccacggcctcacaaggagctaggaccacaggtggacaaacctggctaattttaaaatttttgtagggatgggctctctatatgctgaccaggctggtctcaagttcctgggcttaagcaatacttctgcctcactttcccaaaatgctggcattataggcatcagcctccaccacactcagtactgaaatatagacttaaaaagctttaagatggtaaattttatgttatgtgttttcacaattttttttgaaaacaaataaaagtgatatacgtctttctatgaatcacaaaatatataaatatataaatataaatcacctccaaatcacaaaagtgtttctctcacacaaaggaaatatatatatcattaaacacctggtgaatataccactatttctatgactactcaccttcacataataagacaactattgaaaatcagccaagaaggctgggcatggtggctcactcctgtaattccagaactttgggaggtcaaggcaggcagatcacctaaggtcagaagttagagatcagcctggccaatatggtgaaacccagtctctactaaaaatacaaaaaaattagccaggcatggtggcaggcacctatagtcccagctacttgggaggccgaggcaggagaattgcttgaaccagggaggcggaggttgcaatgagcaaagattgtgccactgcactccagctgggcctctactgtggcctgcagaccttggcctctactgtggcccctgaaggagttcagtgactcagtttcagctgtctttgccacagttcacagcaattcctgccaacacaggaacccacacagtgatgtggaaaaaaacttccaaatactcagtggtggccacacttaccacatcccgatataagttccaccatatgcagacccaactgcagaaatctgtcctagtttctgccctataaataaaagtcctgaaggaaatccagcctgcccagacattagatgggaatcacaacaaccaaagcccctggtaaaaagccacttgaaggtggagtccactgcatacccagcagccttgtgacacagttacaaactcttccctattacaagctcatagggcatcccattaccctggggacccaacaaaagaagatctgtacctcctgaaaccagtttataaaaaattaaagagctgtttgcttcttcaaatttatagacaccagggtaaggctacatggttccattgccaatgtttctattttaacatagcagtgaaagtactttgcagaagaattagtcaagaaaatgaccgtaaaaatgacattcaaattgaggaaaaaaaaattaaaatgttgctgtttgtaggtgacatgatcttatatatagaaaaccataaacagtatatcaaaaactaacaaatgccctcagaaaattagcaatatataacattaacatataattatcagttatgattccatatgctaacaacaaaccatctgataaaaaaggaagaaaacaatctcatttccaatagaattaaaataataaatttctgaaaaataaatttaacaaagaaggcaaaagatctttacactgaaacatatattgatgaaagaaattgaagaagtcacaaataaatgcaaaaagatttcatgtttatgaactgcaagaataaatattataaagtgccatatgattcaaagtgatctacggtttcaatgaactccctattaaaaatccagtgacatttttcatggtaatggaaattacaattctaaaatttacatgaaactacaataggctttgaaaaaccaaagcaatctagaggaaaaaggacaaagcaaccaaacttcatactttatgatttcaaactatattttaagattgtagtaaaaaaaaacaagaggatacatgcaaaatatggacacaagaaaccaatggaacagaacagagcccagaaataaacccgggcatataaattgtactaatctttgacaagtgcatcaaaaatacacaatgaacaaagtatagtctttttaatatttggttctgaaaaaactggataccaccaggcaaaagaataaaattagcttatttttcttacaccatgctaaaagttaaattacagagttaaatatgaatccttaaaaaacctgaaaaacaaatacatggaaaacccacatgatatggtcttaacaataatttattagacataataccaaaagtacagcaacaaaagcaaacataaacaagctggactgcatcaaactaaaaaccttctgcacagaaaagggaacaataaaattaaaaaatttgtagaatgggaaaaaatatttgcaaaccatacatctgatgaaagattgatatacaaaatatataagaaatacaagcagattaaaagcaaaaacaacagtaacccagttcaaaataggcacaaaactaaactgatatttgtccaatgaagacatacaaatggccaacagataaaccataaagtactcaatatcaccaaatatcaggcaattgcaaatcaaaaccatgatgagtatcatttcaaacatgtcagaatggataatgtaaaaagaagaaacataacaagtgttgacaacactttgaagaaaaaaaattctgtacattcttggagagttaaaaattgatggagtcattacaaaaaccaagaggttatttgaaatacagaactactacacaatctagcaatcccacttctgtgtatataacaaaaggaaatgaaataagtaacttgaagacatatctgtaccaccatatttgttgcagcattattcacatttgccaagatgtaaaaaacctaaatgtttgtggatgctgaataaagaaaagctggtataaataaacaatagaatattatttagcctgaaaaataacaaaatcttgccattgcaacaacatgggtagaactggaagacattatgccaagggaaataagccagacacagaaagagaaatactgctcattctcacttatatggggaatctaagaaagctgaactcacagaagcagagactacaatggtagttgtcagggactagatatgggagaaaatgaaaagatgttgaaaagacacaaattttctgttatgagtaagtttttcgaatgtaatgtatagcttcatgatacagttaacactaattttttgtaagcttaaaatttggtgtcagcagattttagatgttttcattacaaaaaaggtacctatgtgaggacaggtgatagaaatggtcataaacataattgtgctaatcattttacaatctacacatgcagtaagtcactacattgtacacaataaatatataattatacaatttttacttgtaaaaaaatccacaatacacacctacatatatatacacacatataaattacagttctggtaaactttatcctaaacaagataaaattacaaaatagtaattaaaaaaacaaggaaagaagtgggagcttaacatatgctcagtaatgttctaagttccctgacatagtgaattgaagaaatgtaggaaatatatacattatattacagttgagaaattaagacagagttgaaattaccaacctcagttagtactaaaacaataaaaatttcaattcaaataacattagatattcttaaagatacttaatattctgattaaattaccgagtatgaatttctgtagaaacacatttgaaacctccataaaataagaaactataaagcagaaaacatacaacatatgtttgttgtatttctgggatttctgaaccaaatctcaatatcactacttttacatatttcagacacaatgcagaaagagaacttaaaaatggttaaacacagagtttctaaaaaatatgcagctatatgtatatccccaaaagcaataaaagtagtcagattgtgcactcctttataagccataaagagaactttggctctcactgcaaatctgaagaaaaattattgaagaaaaagtagagtcgttagagagcatgggacagaagatgcccctatgtgagaacaagtgaaaaaacccaggcttctcagaaacgatttccactgaagcacagcttcccaaatcacatgtaaaagtctgggttcctccttggcctttggatctctcatctatgtcatcctcttcttcattcgctttcacctacctggatgcttcatactccatggctttttcctttgctccagacaggtgaccaggtctggcttagagaagacaatacgtgttttattttaaaaagcagcaagagcatgacttttcctgggattcgccatttaccaacctaatactgtgctaagtagagaaaagaggacataatagaagattctagaaaattaattccaaaataatttttactgacagaacctttagcatattcagaaagtacattaaatatgtgggtcctcagtttcactccccagtattactgaatcaaaaattggtggtggcaattgaattttaaggtctggacaacattattttatgccactaaatttctgaaattaccacttatctagagtgaataatatagataagctcaggaaaggggaaaattcaggtcaaaatgaaacatcttgaagaatttattttccacaccaaaaaatcctcaagattgtcttgaaagtgaactcccattcacaattgcttcaaagagaataaaatacctaggaatccaacttacaagggatgtgaaggacctcttcaaggagaactacaaaccactgctcaatgaaataaaagaggatacaaacaaatggaagaacattccatgctcatgggtaggaagaatcagtatcgtgaaaatggtcatactgcccaaggtaatttatagattcaatgccatctccatcaagctaccaaagactttcttcacagaattggaaaaaaactactttaaagttcatatggaaccaaaaaacagcctgcatcaccaagtcaatcataagccaaaagaacaaagctggaggcatcacgctacctgacttcaaattacactacaaggctacagtaaccaaaacagcatggtattggtaccaaaacagagatatagatcaatggaacggaacagagccctcagaaataacaccgcatatctacaactatctgatctttgacaaacctgagaaaaacaagcaatggggaaaggattccctatttaataaatggtgctgggaaaactggctagccatatgtagaaagctgaaactggatccctcccttacatcttctacaaaaattaattcaagatggattaaagacttaaatgttagacataaaaccataaaaaccctagaagaaaacctaggcattatcattcaggacataggcatgggcaaggacttcctgtctaaaacaccaaaagcaatggcaacaaaagccaaaattgacaaatgggatctaattaaactcaagagcttctgcacatcaaaagaaaataccatcagagtgaacaggcaacctacaaaatgggagaaaattttcgcaacctactcatctgacaaagggctaatatccagaatttacaatgaactcaaacaaatttacaagaaaaaaacaaacaacaccatcaaaaagtgggcgaaggacataaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtggaactgtaaactagttcaaccattgtggaagtcagtgtggcgattcctcagggatctagaactagaaataccatttgacccagccatcccattactgggtatatacccaaaggattataaatcatgctgctataaagacacatgcacacgtatgtttattgtggcactattcacaatagcaaacacttggaaccaacccaaatgtccaacaatgatagactggattaagaaaatgtggcacatatacaccatggaatactatgcagccataaaaaaggatgagttcatgtcctttgtagggacatggatgaaattggaaatcatcattctcagtaaactatcacaaggacaaaaaaccaaacaccatatgttctcactcataggtgggaattgaacaatgagaacacatggacacaagaaggggaacatcacactctggggactgttgcggggtagggggaggggggagggatagcattaggagatatacctaatgctaaatgacgagttaatgggtgcagcacaccagcatggcacatgtatacatatgtaactaacctgcacattgtgcacatgtaccctaaaacttaaagtataataataataaaataaaataagattgtcttgaaaacagggatctgaaattcactcatgcaaagcagaaattaccaaaacacatcctacaaaggaagaaaatgaaacatttagggtaaattaggaattctatattgaagttatcctcaaccaagaagaccgggtttctgtggttctctaacatcacatcgttatacaaattctgctgagcagcatccaggtattgatactcctccggacagaattctatgtggctacatccctgaatatcagcagtccctgaaaacacacacacacacttcaagtggccatgggcagaattcttaaattgtctcaagattaaatgagtgaagagaactgattctgacttatactactgaaattgtcctataaaataattcccaacgaagaaatattctgtgttgtattctctatctctgagaaaagagagcataagattcacaacaccagtgtagtgtattgatgatattttttgaatgataaaagtacaaaattaacaacaggaacatagacatgtacatttttgagtgctcaatttaatcatacagtataagttgtatatttctcagattaaaaagtcaggcttagttataaagtacctctcaaattttaatgtgtacaacaataaactggagatctttttatgcagattttgtttcaagaaacctgaggtaaaacttgagtttctgaatttctaacaagctcacaagtaacaccaatctttctggcccaagataaatcttttgtcaaacattcattaagtggcagagcctgggtttttatgaccagtaaacaaagatgagagacttcactttttaaagaaagatatatgcaaagagaatctaagaagaaaagagagtttccagattacatgtgatgctttatgcacatcagctggtaaatgtccccaaggtactcaataataaagagaaaaatatctctacagtggaaaaaaattctcagagaactatttaactaagcgaatcaaattaacaccattgtaacagaacaaattttcatcatgcgctgatgctcacagaaggacacaatatcactgctgtgatactggcccccgccaaagaagcaaattataattcaaatttaatcataaagaaacaagttttatgcaaaatgcaagctacagtaatcgctcatgttgtgtaatctctaatagagtatttaggcagactttccttagcattctagaaagcgagtatctcctcattatttttttcaaaactttctgaattattctgggtaataaatgccatcctgttcaaatgtgcatattttaatcctgttccgcatggagttgatggagcacacagacagaacttcaacattacatattcccctttttcatgaatatctaagaaccccacctcttccccagtaggaatcttgggtatccatacctttccatgtgcaccagcaccagcaacaaagggtatttttctttttttttttttttcctttggagatggagtctctctctgttgcccaggctggagtgcagtggcacgatgtcggctcactgcaacctctgcaacctccacctcctgggttcaagtgattctcttgccccagcctcccgagtagctgggattacaggcacctgccactacacccagctgttttttgtatttttagtagtgacagggtttcaccatgttggccaggctggtctcgaactcctgacctcaggtcatccacccacatcggtctcccaaagtgctgggataataggcatgaaccaccgtgcccagcaaaagggaatatttttaatattacgagtcgtaaattaatgatgagaattcttcatggcggagaagaagccaagatgaagagaatgtcgagaaggctctagtatatagaaaaaaaatattttttcagagttccttgactatcatgagaagaaaaaatgtttaaataaacatatagggagaaacagcataaagtcaagaagtacaggtttgtaagttctaaacatacggcattccaggaggcaaagtgaacacagcgcctgatctgagacacagtcacctgagaaagagccatttttctcttcatcatcctcctctaggatttcttctcaggtgatattctctggacaagtcacacctgcatcttgggaatatgcctttaaaggaatcagcacaatcccttcacctgctaccaccacaaacacaggcagaaagatccaggcatgcagaaaatgtccacccatttatgttgtttataacaggtgagattcaaggacagtgaactcctccacgaagatcaaaatttatctttctcttttcctgccctcaggtgccctcccctgccacagacactgcaatttctgctacagcaatgggaatatgggccacactaacttgtccctaccaaatccaaccatagcaggccctgtgacctccctttggaataaagtttgaactcaactctcatgaatgtattttgaattcctcatatttggccctggcctcaacctggagtcacgtgaggcacttaattatatcaacaaggatgcttccacccagaacaatatacagagcctgcggtaagggcacaagtgaaaatatttctgcaacctggccatggaatcttaattagaagcctgggccaagaaccacttagctaagtattgcctctcaagcttcaatgtgcatataaatcatttggtaaccctggccccacactatgtaatgtgattctgcaggttttaagagggtccatgaaagtgcattttaaacacatctcctgtcaatgccgatgtagcttccccagacccatcattagtagcatttagctagaaaaagcaggcatggaacagactcttacactcatcacttatcacaacacaaatacttctcatcaaataaacaatcaatctctatcctgaaagaccacattctttgctagctctttaaagtttacagagacaggagaaggcagcaatgtctgcgtgtctgcattgaaaaacaacatgcacacatatacttatgcaatgcttattaaacaggtactatgtgctcaggagtctgttacagagcactctgctgggaacatcacattatgtgatttaatcttcgtaacaacttgagagttgggtactaagtgttcaataattctcagaatttagatgaaggggccagcattgttttcttctcctgtttatcttttttgaaatggagtttcgctcttgttgcccaggctggaagtgcaatggcacgatctcagctcaccacaacctccacctcccgggttcaagcgattctcctgcctcagcctcccgagtagttgggattacaggcatgcaccatgacactgagctaagtttgtatttttagtagagacggggtttctccatgttggtcaggctggtctcgaactcccgacctcaagtgatctgcccacctcggcctcccaaagtactaggattacaggcatgagccacagagcccggcctctcactgatttttttaaaaatgtatagcataagagataaatatagacagatgggagggatacagaaaggaaagggttaagtgtagttcagagggattttttattgtgtttctatttactttcttgtgactagtggagtaactactggaatggaatgtctctacaagcactggttttaattaaaaagaaagaagttaagacctcaaaatatatagtttattgctctaatttatctgcttttgggttgaatactgtgagcgtaagttctggaaaggcagcaggagccaactcccaaatctctggtctcctctaatgagttctgtgaggacagactccagggtgggaccagacctgaaggaggctcagaaaagggtgaatctggacagagctggggtggagaaacggtcctatgttgaattatgatctctatgctgctggagtacttcttgttctgtctttcctaagcctgtccaagagaaacttaagagtttgtataattttaatccatttagccactactctattttataacatataataacaatttaaccaaaatttttagggctttctaagataattttattagaaaatacgtattcttagcaaggtaaaagcaataaaaatacaaatagctctcctgtttgagatcttcaggtggtgacatcagaagtcacaacaacataagagccatcgccaaagtccccttaacaccccactttattgtactgactatatgatgcttaattaaaccatttatccagttgctctacactgaaagtttttgaatgacagggaccatgactgcttcatctatttttctaaagaccatatgaaatggaggcaatttgtttatcagtctgagtctccagaactcctgaattttttgccaaggaaactggagaaactctcatctgggtaccaaccacggagaatctttctacaaaagaaggaacagacactgaatgactcatttcccttcctctaacatggaagcagaattagacactcctgccagcctgacccaagtctgcacaggacatcctgaaatgtcttaaagattcccgggtgactgtgagaggattcctagtgaccatggactgatgaccctatgttgatccaggcaggaaagactcaagctgattctaaatagaaaatggaactgccctggtagagctccagaacctggatctacgtgtgatatcacctgttctgattagctagctcttaggtaatactcaagaatactctattccagtgtcacattttacaaataggtaaacttatgtcattgctctgggtattttgtggctttgatctctccttgctgacatgcatgtttacacttacagattgtgcaaccagattctatttacaccagcagcctctcacttaaccatagcaggtcactggaaaagatctggaaagctcaaagggatacactctgaaagaagggctttaagatttctatgctgacatctcacagatcagaaaatgtctcctatgggttttctgtacattctcaaaccaaaatctggctctctcctgtgaatcccaggcagagctcagctcttacgtgcagattacaggtaagatcaacctgactcttcattctttggtgttacagcaaggagagttaaaaaaaaaaaaaaaagtttccatcataaagtctgctctagcacatgatatgtcagcctaaaaagaaaaggctaaggcaacactcatttaagtagagagtttatttgggccaagcctgaggattgaaacctgggagcatagattcaagttgccttgaatgtacactttaattagcagcagttacaagtgcatttacaaaggcaaaagagagggacggggagtggactgaaacaaagttatttgtcagaaattcttcttgttctacagaaataacattgatgactaattggctatataatttaagctataaggtattgcttataacatctagtgtggcattattaggttaatttatatctacttgtagcaatagcaaacagtttcaagaggtaaaaacgtagctcaaaggaggcagaagaacataattatgttctcatttttatgtctctccgggcctgataaaactaaaaggacttgcactcctcagatcaaagttattctttttcctctaatctcaagaccgagattcagaatttggtactgtagatttaggtcctggatgggtggagaaatggcaggtgttaactgcacatttatgggaattttgggaggaggagaaagaggaacgctgagatactcacgtttactcaatgcacacgtcaccctaattgttcttctgggcctaacagtctccaattcagtttcaggtctgaagacactatggtcactgaaagaggtgaaatggctgattactgtcctgtgaattttgtcaaccacttgtagaaaggcttgacctctctacaagtggttgtagaggactatagatgtgaaataggcagagacacaattctgcttgcatactctgggggcagtgtgcactttgaagcaaaactgactgggttgactggaagcctgagagggaaagccttctccaaagtgaagattggtgggcaccttatacgtatatacaatgtctggtaattgtggacagtgtttgacaaatataattaaaaggaaaagacagaaaataaaaagaaagaataaaaaagaaaaagaaaacctttgccaaatcaaaagcaaaagcaaaataatggttctcaggtcctagacaaagacaatctggtagggaatgagacagaaaaagcatttatttctatgtaaaataattaagcctcttattcctaaattgtattttcttgtacaacagccagaactataggcatggttttgaacttttggacatctgaattttagtatgcactggatttaggcacctaaggggtggttctgaacacaccgtgtgcacatgaaagaaagactgtggggcaaaaagtagaagagagaggccgggagtagcggctcacacctgtaatcccagcactttgggaggctgagtcgggtgcatcgcctgacatggggagttggagaccagcctgaacaatatggagaaaccccgtctctactaaaaatacaaaattagcctcattacacattactgaggcaggagaatcacttgaacctgggaggcggaggttgcggtgagctgagattgcaccattgcactccagcctgagcaacaagagtgaaattccgtctagaaaaaaaaaagtagacgagagaaaggagcttccaaaaatttatgagtcggggaagaataaaagatagctggaaggactggtttgaattaaagatgtggcccaggagggactgtactatgaattttttgtgttcatgcaggcaggtgagattatgaacaggtagtccagaatcctaggttgatggagagaatgggttgctgctgcagattcagtgtctgagggcagaaataagctaggagtcctataggtacttgtgtaggtttctggcaagaaactctagcagcaaaggcactgtgatggaattcctgaggttggtgcctagtcctgggaggcgcatggccacattaatacctcctagtgggtatgttcatgagtaggtaaaaaccaagtgatggcagctgtaggggaagaaggtttgttctgagaactccttttctctaagtttccattcccctctcaccctgggagaactggaatcacaggagaatgtgcagtgtgactgctcatgtgcaggagaacacacagggtctgatccctagcccctgtgatgtctttcttctgacatcacatggctcaggcccggtgacgtctttcttctgacacctaatttgtagaatttcctgaatatccagcaattctccaacatcaaccagttgtttaacattttatctcacactactcaaaatcagtgcagatcccacaagtccagagtttagtcccacaatactgtccttactgcagatgcccgtcacaagtcccaggtgctcatctgtacttctgagtgactgtctagagcagctactttaaatggttcaaattattgaacccctcctggaattgaataatgtgattaaactactcacagaactcggcaaaacactatacttgtgtttaccagtttgttctataagatacaatgcaggaacagtcaaatggaagaggtgtatagaaaaaaggaaagtggtgtgaaaagatgggggcacacagaaaattttggtaaataactgtgattaataaaaatttctcatctattgtgttctccaggagcagcttaatgaaaataaacaactttcccattgtgacttagatgatgcttgcttttttcacctatcacatagccagacacagactctacaaattttcatcattttcccataaagaatcagctgaacaattgtctttagtgatcataacaacatactttttaatccaactttgcttaagtttctctccttccccagactcctgaactttgacccaatctcagtctgagcaaacatacaacctcatgttatgtccctgctaaaaagatactgacttcagggtaaaatattctctgatctagagtctgattttgccacccttcatcctgccctcccctcccatctcctttctaatcttgtttgcttctccctaggaaagacagcccttgtatgcctaacctttgaggtcctcaaagatcttatagtctgtactaccccctcttgtaatactcctttggaaattcaaaactttttacttaaatctgactttttttatttgacagagtctagaaacaaccccaggtcaataaaaatttcatcctcagaaagaccctcccaatgcccttccatcccaaccccagctgcatctgcctatggatccccagctcgcctgggctctgtagcttctctcagtagaaaggattcttccatggctggggtgagcgggctgggacacctgcaggaaaggctcctcaggaagaaataactggaccttcaataacctttttttgcagtctcaatattggccttagcttggagtcactgggctcaggcttcaattcccagtcagagttattcacttggctttttaatactaagtgtttgaaaaattcagcaaaattgctcaaacacagagtttatataagggaagaaaattttaggccgggcatggtggctcatgcctgtaatcccagcactttgggtggccaaggcgggtggatcacgaggtcaggagttccagaccagcctgaccaacatggtgaaaccccgtctctaataaaaatacaaaaattaaccagacatggtggtgcacacctgtaatcccagctactcaggaggctgaggcaggagaattgcttgagcccaggaggcggagtttgcagtgagcctagatcatgccactgcactccagcctggaagacagagcgagactccatctcaaaaaaaaaagaaaaaaaaaaaaaagaagaaaattttaaagtgcttacttacattccatgacttaacaaaaaaagcaaaactatccctttcagacaataaacatgtcattaaattattttataacaaatcatttagtaaacaattagtcacttgggaacactgctaggaggtggcaagtcccatctcataaaatttagcatttatactcaaaaatcaagataacaggatatagagcagagatagccactgtcacaattcaccctacaaaaatcggaactgttttgatgaatctacacatttcaccaactgatctatcatattttcttgtagaaatatattcattatctatagccataatggaataaacattttttcctattctttttcccagtagcactcccaaagctaagccctgggattttgtttgaatcttccctctcttaaaaaaaaaaaacacttgacaacctttctacactcactctggggaacaaaaaggcaaataagaatttttaacaaatggaatgtatgactaaatatttaattttttcctgaaacctacctttttcatgtcctttgtatattttcttaacctttcaagctctactgataaaatgtaatttacagttaaaaaactaataagtgaacaaatatcttcgaggtgaaaaacctagaaattcaaatgctcattggaatacagatgtgtttgattcatgtgtcaagtcaggccatccaacaaatgagagatcctcccaccctcatcctgatcgcttaagtgctcaatgaccatgctccaggagaaactatgctatgccccagtgagggcctcaagtgcattttactttgcaggttcttgcaccatctcactgggttgggtagtttttgttttttggactattttctttccttcacaaatctgaaagaatcaagggcaaaaattatttctctcttttaacctcagtaccagcatctgattagctgaccagcaatatgtctccaagaaatggaagctgggttggatgaaggcaaacttaatgtctcaaggggttagctttttagaggaagggtacaccaggagatgtctctctgacccagggcatccacctgctcccttgagaggctacattctttaactcaggttgtcttctggaaggaaaatgactcagaagctgatattcatgggacactctagcagacatggccaaggtgagtattttgggttatccctagacagtatgaaacccaggaccaagataaaactggatcatatctgaggacacatcaccttgtaaaaattccaaaggcaaccccaactcaaagacattctgggccaggcatggtggctcacgcctataatcccagcactttgggaggctgaggtgggtggatcacttaaggtaaggagttcgagaacagcctgaccaatatggtgaaacctggtctctactaaaaatacaaaaattagccgggcatggtagcacaggcctgtaatcccagctgctccggaggctgaggcaagaaaatcatttgaacctgggaggtgaggatgcagtgggccaagatcacaccactgcactccagcctgggcgacagagtgagactctgtcgcaaaagaaaaaaaaagacattctgataagatatctgtgcctagggaagataaaaggaggcacgaaggttttttttgtatttttttttgtatacttttaagttctagggtacatgtgcacaacgtgcaggtttgttacatatgtatacatgtgccatgttggtgtgctgcacccattaactcgtcatttacattaggtatatctcctaatgctattcctctcccctccccccaactcaggacaggcccgggtgtgtgatgttccccttcctgtgtccaagtgttctcattgttcaattcccacctatgagtagagaacataagaggcacaaaggtcttttacaattaagtatcagaagacaactgtgcttttttctcacgtgaaatggttacgaacagaaaacaaatctttctaaaagtgttatccaatgctttgtgaaaaaatgattaattaaaatactgtgtctgaaatgtacagtaaagtagaaataacggtaatgttgtgaaccatggaggggaagttagcatttgagaatgtcagaaagaactggaaagttagtattttactacaagagagggttaggctggaggaacggtgacggggaggtagacttgagaccctgcttgagccatatttggaaaatgcaagggaaaactagtccccagtggagtgtgaagataattagatagcaggcaattagaccaaggtggctctggtgccctgagttcctaagtttaaaaaaatttaactcaaaggcacttctagtaaatttctgccttgcggtaaacaaaattcaggcttaagcaaccacaaacctccaataaacctctgattacataaccaaaactttcccacctgcatcgtacaaataaggcgactacattactgtatccaaccaattattgaattcgatttgcttcctcactgcctctcgtaaaagcgtttccttcgggcgggcgcagtggctcactcctgcaatcccagcactttgggaggccgaggcgggtgggtcacctgaggtcaggagttcgagaccagcctggctaacctggtgaaaccctccattaaaaatacaaaaaaattagccgggcatggtggcgggcgcctgtaatcccagctactcgggaggctgaggcaggagaatcacatgaacccgggaagcggaggttgcagtgagccgagattgcgccattgcactccagcctgggagacagagcgagactctgtctccaaaaaaaaaaaaaccgcatttccttcaagccctcacaatggacaactaaaaacaatagttgggtgctctacgattcttgaatcgctctttgccgaaatttttaaatatttttgcagtgaccccctcactttttttttttttttttttttttttttttttttttttgtgagacggagtctcgctctgtcctccaggctggagtgcagtggcgtgatctaggctcactgcaagctccgcctcccgggttcacgccattctcctgcctcagcccacaccccccccacccggagtagctgaggctgcaggcgcccgccaccacgctcgttttttgtttgtttgtttctttgtattttcagtacagacggggtttcaccatgttagccacgatggtctcgagctcctgacctcgagatccgcccgcctgggcctcccaaagtgctgggattacaggcatgagctaccgcgcccggcccccaccctccccgttacatttttaacaggagaaaagagggaccggggaccccacaaatacacctctttgcatccacaaatcctgctcaccgagtcgagattctcccgtgatgacgctccaatcatccccgcacacgctggggaagacgcgtggctgtgggagccgagtggcacagggagggctccagactggggagccggtgtcgccacacaggcaggggactggagcccggggtcccagcttccagtccagccgacatttgtggccgagctgggccaggagggactcgggtccacaaacctagaagacgactgcagggaggcccagtcacgctaccgccgcttcggcagcggagcctagcctgccccccatctcttgggatgtcgagccggcactcaccatttctctgcttccaggaaatcctggcgtcttagctacgggtctgccagtccctgcaggtcgcacagccacagcagctgggcctgtaggagcagagtacgggggagcagttggggggcagttctctgtgaactgaagactagatctgcagccccagctgcggcaggagacaaatgcccccgccaacacccggaagccgcccttgtcctctccagctgcagcctgattgc

SEQ ID NO: 1571 - DNA, 19848 bp, Homo sapiens
ggatatctagttaaataagtcattataaatagttgctccgtgggctttccgcatttcaccctgctccaggcagcgtggtctgtatggctccgccctgggcaggaggagaaagaagagggccaggcaccacgtgcctgcactctccctggatgctggaggctgctccgccgtgggcaggaggagaaggaagagaactgggtgccgcctgcctgcactctctccggatgctggaggctggaggcagtgaggcagcaacagcgcgagggcgaggcgactttggagctgcctcatgcagcgacctcgccttccgctgcgcctcctcccagaacccaagaagcctggaacctgtggcgtccagccctgaaaggaggagacggcaacccagccgcgcgtgagtccgggagtctgggataccggcggcagaggaaggacaggcaggagtctcggcctctcggggagcgacgtgccgggaaaggcaggagggccccagcggtgggggcgggggttgcgcgccggggagggcggcctcaggctgggagcctggcagatcgtctgactctccccgagccccatcccaggccgagccaggacccctctgatgcacaggcgtctcaggagcccgtttctttcttgaatccggggcccagtgcggcttgaacctagcccccgacctcctcctcgccctctcagagtccgctggggtgggcgctgaaggagcccgggtcggagaggagccctccccttctctcctgcgtggaagccctgcagcctccgtttcttttgggactggggtccggggccttctgcctgacccggggtgagaaagggagccctgatcaggacccggtgagagggcgctggagcccgggagcggcaggagccttgagcggcagcccgggaagaggatggggtcaccttctgccccaggtcccccactgccaggatctctgtcaccttctgggggtcctgtcccctggggtcccaccccccgggctgcctgtgggtatctctcatctggaactggaaataaccctcttcatagtacggcttagcaaatatttattcgcccatgcaccccccttttttttccttcatagtgttctttttgtcttggatcatttgtgtttttcctacattgatgtgaagcatttttaaagacactttagagattagtcctttattggttcatttctattgtaggttgttgtttcctactctggtctttgttgtttaatttcagttttaatttcttgcttggtttagttcatgtaacaatatttttcttagaatatttgtatctgtgtttgtgaaacagaacatctattatttctgggttttttattgtctgatcagattgtgtattaatgtaatgctggcttctcgaaacaaattgaaaaaccatccctttcgtctttctctttgagagagagtgagcagtgtcaatatttttttcttccttaaatatttggaacattttcaaagtctgatcctggtgttttccttgtggagcattattgttgatttgttggatttttaaaattagttagttaattttgtttaatatatataggagtgttcttattttatgctatttttgtgccagttttagtaagttgggttcagcatctgttgcgatctctgttgtcagacttttgatcatatgtatttcacaaaattctctgattatcttgttataatactgttatgtagagttgttgttttgattctgatactggtcacttgtgttctttcatcttttttccttaatcagttttgcctgcactctccctggatgctggaggctggaggcagtgacgcagcaacagcgcgaggcgactttggagcggcctcatatagcgacctcgccttccgctgcgcgtcctcccagagcccaagaagcccggaacctgtggcatccatctctgaaaggagaagacggcaacccagccgagggtgagtccgggagtctggggtgccggcagcggaggaaggacaagcaggagtctcggcctcccggggagaatttcacaaaattctctgattatcttgttataatactgttacgtaggctgttgttttgattctgatactggtctcttgtgttctttaatcttttttccttaatcagttttgctagtggtttattaactatgttgtttataaaaacaacttttagccttggtttatttgtgttatgtttttttttccatttcattgatgtttgttatctttattattgccttcatcctgtattctttgcacttgatttttctttcttgattcttgagaaaaaagttgaggtgccgggcacgttggcttacgcctgtaatcccaacactttgggatgccaaggtgggtggtcaggagttccagaccagcctggccaacatagtgaaacccccatctatactaaaaatacaaaaattagcagggcgtggtggcagacacctgtaatcccagctactcgggaggctgaggcatgagaatcgcttgaacctgggaggtagaggttgcagtgagccgagatcgccccattgcactccagcctgggcaaccgaacaaaacttcttctcaagaaaaaaaaaagaagttgaggtgattgattttcagtgtttctggactcctgccctgcagagatcctcttgctgtaacctgtttcatgtgaggtagagtttagaaaatatttattggcctctgtgccttacttttcttcatatactcttcttattttgttgatttatctttagggatttttttccttatgttaaattgaaggacttattgttaaaatctgtaagttagccctttattggcttatttttgtcataggttcttgttctctagtttgatttttgttgtttcatttctttgtgttcatagttgtatatagtaatctggttgataatgatcttgtatgcagtagctttgcttaatttatttattaattgtaacactttatgtcatgttaggctgtgctgagtgcttctgggagcagccaggtttccatgaactcccagtttactctaaatactctagcagcccacatgtgcacacactggataatggtcatgcatgtagagcaatgatgctggggaggcaccgactctgtcattctgtgaatccaccgcacaatcacaaacattagcattaaaataaaatggactgttaggcaactgcaaaggactaatgcacctatgtggcacaaatgtgtctttccgtattcaaagtacttgtaagagcttcaagttcctcatactcagccactgacctcagggttcttggtacacaggcatacatgtgcagacacacatacaggcacacatatacacatgaatgcacatatgtgcacacatatttacaggcacatgcagatgtgcacacacagacctgggtgagaaagtcagatgtacatggaacagcccctgctttgtaagctgtctggctttgtagggagaaagaggtgaaacaacacacttgttatcttggaagaggagatgaagggagctgagctggatatgtccagtggggagaaagccaggagccactccaccgaaaatcgaggtctccacatggatgatacccacaaaacattggcaggaaggacacagccagcaccacatcagtggtgactttcatgagtgtcaactgtggccatccaaattaaaggcctggcaatgggataagttagcaactgaactttctgtatgttaccttattaactttctgtatattagcttattaactttctgcaatcaaatgctgattaagcattttctgagccaaaagctttgtgtaatttgaatctagtgaaaaaatgttatgcgtttaacactataacttgagatctaaaaacaaaaaaacaattgcataagaattggtcagataccttgtctttgaaacatactgaagtcttcaaaattaatctgatagctctgcagttggtatgtggcataagaaaatatttggcatgaaggggagtaacacaccacatgaattcattcattatgaagaaattcattatgaatatatgtgggcaaattattaacaaccctcccaaaagcagaaagctcagactcaggaagatccatttaaatggagtgatttgggagatgatttcaagcgcaactctgcattgactcagcatttattaagtcatacagcaggctactggaggcctcactgcagcctgggctggtattcagtgtcctcctccttccttctcagtagacttccttggccttgataataatacgtgttaacaaacacaaatctcaaaatacacataatgtttcttcccccacaagccagggtatcagctctgcaaatcagatgaccccaaggtcagtggggttgaccagggacaccattctgcattcctcctcagcttccagatcctgaggagctctggggccttccttctggacagggaacatgtctgcctggcttcctcagccaggtacgggaggctttggggacctgtgtctgtctctgggaaggaggaaggagcctgtggcatcttccttaagcaaaagcacatccagcccatggccaaacttcagagtggggcgaggggcccagcacagctcctccgttcctgcagcagagcccagaaaacacatctgatgttgtggctgcctcaaacctacaaacaccatgggtttgaagtgtcctgttgacatggccatggccactttccccgtggaccgtggcaagtttttgtttttggtttttgttgtttgtttgagacaaggtctcactttgtggcccaggctagagtgcagtggtgcaaactcggctcattacagcctccacctcctgggctcaagcaatccttccacctcagcctcccaaagtgctagaattccgggcttgagccaccgtgccaggccttgtgtagaagtattatacattatctttaaaatgtagtttagtgctaataatctaaaattgtgttgccatttactattaatatgccctttgtggtgcatctaataaaatgctttgcttcataacctgaaacaaaaaaactttcactatatttacttgatcagatcaacaactatagaagtcttagaataatgatattcttactcaaaagaaaagcaacaactcatctttaatgaaactgtttctgtgttttattagtggttgagaaataacacattccttcagcagtggcagcagtcagataccatatgaattttttatttttttttactttgataaatcctgaggctctgttgaggaagaagcttccacagtaggccctaggagagctgcagccaccatgtccacactgtgttatgcacaaatgggaatgtagtttcccagagaaaacaacttctgtgggtagatttgtgatcgaagtttgtgaatagctttaaaaaatccttatgaaggccaggcacagtggctcacgcctgtaatctcagcactttgggaggctgaggcaggcagatcacctgaggtcagttcgagaccagcttgaccaacatggagaaaccccatctctactaaaaatacaaaaattaaccaggcatagtggcacatgcctggaatcccagctacttgggaggcagaggcaggagaattgcttgaacctgggaggcagaggttgcagtgagctgagatcgcaccattgcacacaagcctgggcaacaacagcgaaactctatcttaaaaaaaaaaaagaaaagaaaagaaaaaaaaaggctgggcatgatgactcatgcctgtaatcccagcactttgggaggctgaagcgagcagatcacctgaggttgggagttcaagaccagcctgatcaatgtggagaaaccccgtctccactaaaaatacaaacaattagttgggcgtcgtggcacatgcctgtaatcccagctactcaggaggctgaggcatgagaatcgcttgaatctggcaggcggaagttgcggtgagccaagatcgcgttactgcgctccagcctgggcaacaaaagtgaaactccatctcaaaaaaaaaaaaaaaaaatcctcaggaagattatttacttataatctcctccttccttaattagcagtctcagcatttctgcaataaccaagtctcagcatccagtgaagcagcctgcaacatgcgggagctcagggcattgccactgcacatggggcacctggtgggactttggcaaggattttgtcattaacactgagcaaaactctacgaagacagaggcattcttttagattaaaaactaacaacataaggcgggacatggtggctcacacttgtaatcccaacacttcgggaggtcaagggggacagatcacttgagctgaggagctcaacaccatcctggacaacatggcgaaacccgtctctactaaaaatacaaaaattagctgagcgtcatggtgcacacctataatcccagctattcaggaggctgaggtgggagaatcgcttgaacccaagagcagaggtagcagtgagctgagattgtgccaccacactccagcctgggcaacagagtgagacgcttacagaaaatctttaatttctatagaaaatcttcagtcttctatagaagaaaattaaatattacaaaattgaagattagaaaattacatagagagccgggcatggtggctcacacctgtattcccagcactttgggaggccagggtgggtggatcacccaaggtcaggcgttcgtgaccagcctggccaacatggtgaagccccgtctctattaaaaatacaaaaaattagccaggtgtagtggcgggtgcctgtaatcccagctactcaggagactgaggcaggagaatcacttgaacccaggatgcggaggttgcagagagcagagattgcgccactgcactccaggctgggtgacaagagctaaactctatctcaaaattagagagaaagagagagagagacagagagaaagaaaagaaaagaaaaagagagaaagaaaagaaaaaagaaaagaatgattgattccatagagaaacaggtatttatcaatcttcttgattctggtgctcatcacaaggctgcaagttactcagttccaccgtcttttgcatctgtggttgtggttgaaaggaatggcctgaatcatgcacctcataactcacagagtggccccatgccttccagttttctttttttttcactgaggttctgaattacccatgtagtttaaggagttttgttgttcttcacaattctgtctgtggctaatcttatgtccatgggattcatttgagtctggaacatgtcccagatggcaagatgcagcatgccatgatattttcaaaatccatgaacatggttgtttggcagttccacagtaaatatgtatttggagccttaagctatttctttcatgatatatgctcaggtactgatagcgacactgttgaattctacttgagccctgaggcactgggaaactgtgatggttaaagaaatccccaccttgtgttcctgccttaccgcaaagaattccccttccccgttgacttagctaagactcacggatccccctcaaaggatgtcccacctatgacaaggtcagacacagacccccccaaatgctgtccttgtttcatgaaagtttagctgaactgcttgtccccacagattcatcaggatataatgctaattaactcagctttgatatgggctttaccatgtccttcaggacctgcttattagttagagaccccttggactgcataacttcttcaaagacattttattttatgcttaatcatatagaaatataatgatttgatagattaaccaatgtggttttcctcccttgttctccagtttcccactatttctctcccatttagtctaaaccttggcatctcctctttcaaaggggaagttttaacaaaaggacaaagagaaagaaaagagtagacactcacattttgaattttaataaacttggaagaatgatgacacaagagtgagtttgtcccatcccagagcagatgaggagcttctgaatgagagtgggggaagggattgtgctgttgacactcgatggcaattacactgatgcagacagggaccttgagtggtggggggctgagagtgctgagtgcacctccccgggcagacaagaagaaacttgcaagtgcaggcacaagatgaggaatcacagtgaaacttaccacaacattcagcctctattcaggagatacttcacaacacttgccaggtacttttctaggcactggacataccgcaaataataaagccataaaaaaaaatatgtccctgtggaacttgcaattttgtgcagaagagcaaatagttcactaaagaactaagcacaactggccatgcatggtggctcacacctgtaatcccagcacttagggaggctgaattgggtgaatcatgaggtcagtagatcaagaccatcctggctaccatggtgaaaccccgtctctactaaaaaatacaaaaaaattagctgggcgtggtggcgggcacatgtagtcccagctactcaggaggctgaggcaggagaacggcgtgaatctgggaggcagagcttgcagtgagccgagatcacaatactgcactccagcctgggcgacagagtgagacttcgtccaaaaaaaaaaaaaaaaaaatagaaaagcacaaccatacaatgtgggaaggtgtcaaaagttatggaacaaaatgaaggaaaggggatagggactgctgaggggtgggctacaatctgaattgggggttaggaggggatggagtgagaatgttctatttgatcacagccttgattcatgtgagagatcctggaggagaaagtgggcaaaagccgcccaagtggctgtagcaggctgggtgctgcattacatagggcacattaagtgaaatgtgatggctattttgtgtaatcctttaaaatcccaatagaaataggactttgtgggaggactacattttgaaataattattttcaaaaatagttatttcaaaaaaagcacagcagttgcatcctattgaatagtgggaacactggatgataagttaaagtatcattttgtgttaaaatattgaagcaaatatggcttggtgtggtggctcacacctgtaatcccagcactttgggaggccaaggagggtggatcacttgaggtcaggagttcgagatcagcctggccaatagggtggaatcccgtctctactaaaagtacaaaaattagccagttttgttggtgagtgcctgtaatccaagctactgaggaggctgaggcaagagaattgcttgaacccaggcggcagaggctgcagtgagctgggattgtgccattgcactccagcctgggtgacagagcaagactccattaaaaaaaataataataatattaaagctacccattaaaaaaatttgaaagtcccagaaatgtggcaagacaaacaaccctattaatggccctaatgaagccctatagatttctcagaggatcctccatgtgttagaaccatacctagggctgcagctggctaagacattctccatcagcctctgggatcaaaggcggggtgtggaggttgtctggatgggaccatgagcctccctctcagtaaaacacaagcacaagggcgacatccctcttggtttttcgtaatgtaggaacacaggcagagcttagtgttctcagagcctctgagatcccgggcaaagcgtttggtaagatgctgcagatatttccttctaaaaataaaaactcccttggtaaatgctcaggcatctcaatggccacaccagccctcatatgtgtacccaactcccttcatttgcctctgttcccactgaaattttccatgtgaaatctgggaagggatgggacagcttgcataacttagttgatgactctcccacaatcttatagacttcactaatctttgaggctcttcactgactcatgtgacaaagtcacttaattctgtaaatttgggccagttcattttgctagctctcagtttgctcatctgtatgcaagaagtttagtgtaggtaaaccaaggacgccaatatgcctgtctctccagaaggtcaataacagaaaatctgagctggggggtgcagttccaagtcccaattccatgcctcaaagatcagctggttgtctttattcatcaccaggcacacatctccttgatactctcaatatctaggcataaaatgtgacaagacagattatctctgtgttatttttttctccattcctcatcacttgtatttccttaactcattgaaatcagttttccacattttttgaaggagagtcttttggcaaagatgtgaattatctacaagcagctgagagaaatggctactgccctcagtgtgctggttataagtttccaagtgatgaataaaagatttcctaaggcatcagtttccgtgatggtgtgttcttttttttctcttgggcacaagggaatgagcagagcaggtacacctctgggtttgttttgtttgtttttagcttatgtacaaaatcaagctctgtttttcattgaaatatctttttttcttgtatcagagaagagttgtaaaagactcattgtgggttcagggaagaatgttttaacatgcaaggaaatgttgcaaaattggaaagaggacataattccacaaaactaaatacaactgggggaatttttaggatactctgagttaatcttattatttgcatcctgctaaccccaatcaaataataatttagaattgtttaatttactaaactgcacattcaattgactaaactgtagaggatgagcaagtgtcaacaataattaccctccttatgggctaacacaacaggctccagtgagtcataatacacacattcagaggtggtccaatgcagtcccaccatagaaatccttcccatgcttagccactgttgtcattaatctctccaaactcaaaccatggttcaaacacagttgtcccttggtatccagaggattggttccaggacccactttggacacccaaatctgctgggaacaggccctaagcctgtcataaacaggccttaaagaaactggccataaacaggatttctgcagtaatgtgacgtgctcatgatggctatgacacacactgctagaagatattggtttattggagcagggcaaggaacacctggcctacccagagtggaaaactgctcaaaccacaaacaacagcatgagcggcctgttccataacaacatgtttttgctgcagatgatcatccagggactgtttctctgctcctcactaagaatgtttgtttcctgtaaagaatgcttttagctaatctataacctatagaaacaatgcttatcactggcttattgtcaataaatatgtgggtcaaactctgttcgtggctctcagctctgaaggctgttatccccctgattcccactttgcactttatttctgtgtgtttgtcttcattcctctagcactactgggttggggtctccacgaccgagctggtctcatcaagtggcgtccaacaaggggctcaaacccgggttgaggggttgctggagcgacggagaacgtggaactacactggaggacaccagagtactcttaagcaatcccttggtaagtaagacggggagcttggaagcatcagggtaacaatgggacaagggtcgagcaggcatgagtcttatttgagtctgttttggcagctcctcagaaaagggggaaggaaggttagtactagccgacttatgcagctttgtagtgtggtagagaaatattgcccctggtttctggaccaaggaactatgaatatagagatctgggaaaaggtagccagagcactgaaaaaggcatatagggatggtgctgaggatattcctataaatatctggtcagtgtgggctctggttcatcccaccttggagcctttccacacagatcatgatgaggaggaatcagaggaagaaggagagtataatgaagtaacaaaagaggtgacagagcagttttgcttgccagctaaagcagcaaaggagggaggtttgtccctccccctctgtaccccctcatcattttgaagaaaaagagtggcctgaccctccgaatctttcttttctggaggacgctgggcgaaaagtagttgcctcagtgactgttcaagcagcacctcaagcgaccactctcagttctattcaggcatggatccagcaagctggatgagagggtgatatggatgcttggcagttccctgttagaatacacccacctgatcaacaggggaatattatagctatgtttgaggcttttccttttaaaatacttaaataatttaaacatgctattaatcaatatggaccaggttctccttttgtaatgggactgttaaggaatgttgctgtctctagtcagatgattcctactgactgggatgcttttactcgagctagtctgactctggctcagttcttacaatttaaaacttggtgggcagatgaagcttccattcagtctgctcgcaacaccaaggcccaacctcaaattaatataactgcagaccaacttttgggggtttgtggctgggcttgtttagatagatgcacaagtggccatgcaggatgatgccatagagcagcttagaggagtgtgcattagaggttgggaaaaaaatcacttcaggaggagaacaatacccttcttttagtgctgtcaagcaggggcctaaagaaccttatgcagattttatagccaggttacagaaatctcttaaaaaggtaattacagattcgcctgctaaggatatagtgttttggttattagctttcgacaatgccaatcctgagtgccaagctgctctgtgacctattagaggaaaagcacatttggttgactatattaaagcttgtgatggtatcgtaggtaatctgcataaagctactctgctggcccaggcaatggcaagaatgagagtgggcaaaggaaatactccatttcctggagtttgttgtgggaagcatggtcatactaagaaagaatgtagaaaaaaatcagtgagtcagactgccagttgggggaaaatagaaaactgctgagcctgaaatatgtcgaaaatgcaaaaaacgaaaacactgggctaatcagtgtcagtctaagtttgagacagatgggaacctgattttgggaaatgccatgaggtgcctgtcccaggccccattccaaaccagggaatttccagctcaggccactccctcaccccgtacaatgcctgtcccccgccacagccagtagtgccacagtagatttatgctgcacaaaagctgtgagccttctgcatggggaacccccacaaaaagtgccaacaggagtctgtggacccttgccagcagggacggtaggattacttctaggtagttctagtttaaatttaaaaggagtgcaagtacatacaggagtcattaattcaggttacaatggggaaatacaaattgttatatctacttctgttctctggaaagcagagccaggagagcatatagcacagctcctggttgtgctgtatgtggaagtggggaaaagtgaaactaaatgtacaggaggattttgaagcacaaataaataaaccaaagcagcttattgggtgaatcaaattactggtaaacatcctacctgtgaaataactattcagggcaaaaaatttaaaggattgttagatacacgatcagacatttcaatcatttctctacagcactggccgtctacatggccaattcaacccactcgatttaacacagttgaagttggtaaagcctctgaagtatatcaaagcagtgatattttgcatcatgaaggactcgatggacaatctgggactattcaaccaattgtaacttctgtacctgtaaatttatggggaagagatttattacagcaatggggagcacaaatgttaattccagaacaattatatagctctcagagtcagcatatgatgcaagagatggtgtatgtgcctggcatgggattaagaaaaaatttacaagggttaaagaaaccccttcaagtgaaaggacagaattctcatcagagttaggatatcatttttgatggaggccattgttaagcctccagaacctatgcctttaaaatggttaacagataagccagcttggttagaaaaatggcctctgagtaaagaaaaactggaggctttagaggacttagttactgaacaattagaaaaaggacacatagttccaacattttccccctggaattctccagtccttgttattaagaaaaaatcacataaatggagaatgttggcagatcttagagccgttaattcagttatacaacctactggggcattgcagcccaggttgccttctcctgctatgattccaaaaaattggcctttaatagtcatagatttaaaagactgtttcattactaactccttagctgagcaagactgtgaatggtttgcatttataattcctgcagtaaacaacacgcagcctgctaagcattttcactggaaagtgttgccacaaggcatgttaaacagtccaacaatttgtcagacttatgtaggacaagcaattgaacttactcataaaagatttgtcacagtgttaaattattcattatatggacaatattctttgtgctgcccccactcgggaaatattactccaatgttatgatcacttgcaaaacccgatttctcctgccagtttaattgtagctcctgacaaaattcagactactactccttacttctacttagggaccttagtaaatgacactaccattgtgccacagaaagtaaccatacgtaggcctcaattgaaaactttgagtgactttcaaaaattactaggggacattaattggacacgacctgctctaggcattcctatctatgccatgagtaatctattttctatccttacaggaaatcctagtctcactagccctcagcaattaacaacagagactgaggcagagatacagctgattgagaagcaagtgcataaggctcaaataaatagaatagatccagaaaagactttagacttattgatttttccaactcagcattcacctactggtggtgttgtccaagagcaggacttggtagaatggctttttcttccacatagtaattcatggactctaactccttatttagatcaaattgctactctgataggaaatgggagaactcaaattgttaaattgcatggatatgaccctggaaaaattattgtccctcttacaaaggcacaaatacaacaggcctttataaatactcttaattggcaaacccatttagctgatttcatgggtgttcttcataatcactttccgaaaacaaagttatttcaatttttgaaattaactaattggattctccctagaataactaaatttaaaccaattgaatgttctgaaaatgtttttacaggtaggtctagtaatggtaaagcttcttattccagatcaaaaaataaagttttccagacatcctatacttcagctcaaaaagcggagcttgtagctgtaattgaggtgctgactgcttttgagatgcctgtcaatgtaatttctgattctgcatacatggctcattccacacaattaattgaaatgctcagttatgatttcatacagatgaacaactgatgactttatttacccagttacaaactgcagttaggaatataatgcaccctttttacattactcatattagagcttatacaccccttccaggacctttaactacagggaatccagtggctaaccacttagttgccacggcattatctaatgctaaacactttcacactttgactcatgtaaatgcctctggtcttacacaaagatataatattacttggaaagaggctaaagccattattcaacaatgcccaacctgtcaaatgattcattctctgtcctttactgggggtgttaacccctgtggattgcaaccaaactgtctttgacaaatggatgtcactcatgttccttcttttagtaaattggcctatgtgcatgtatgtgtaggtaacaatttctcactttgtttggcctatctgtcaaatgggaatcttctgcctgtgttaaattgcatcttctgcaatgcttcacagtcatgggtattccagctttggttaaaatggacaatgccccaggatatactagtcaaactatggctacatttttctgtcaatggaatattaaacatatcactggcatcccgtataattcacaaggacaagccattgtgaaatgaatgaatatctccctaaaatgacaattgaataaacagaaagagggagacaatgactacgggactccacatatgcaattgaatctagcattattgtctttaaattttttgagcctgcctaaaggccagatgcaatcagcagctgaacagcatctacagaaaccggctgcagacagaagcagagcaactggtttggtggagagatccgataacagaaagttgggaaataggtaaaaataacatgggtagaggttatgcttgtgtttctccaggccaaaaccagcaactgatttggataccatcaagacacctgaaatcttgtcatgagccagatactgaggaagagattttgggaagaacccaaggaccccccagttgcagccatgtcaagactgacaataaggaagacatcagtcccagcaagcaacattcatcgggcacagccacccatgtggggccagatcaagaagttgacacagatggcggaagaaaatctgaagaaagcggatgaccagctacaatgagtaatctaatggtagctatgatggctgtgctcaccattgccatgagtattcccccagcacctgctgaaacaaaaaacattatacttattgggcatatattccttttccaccagtttcatggccagtgacatggttagaccccccagtggaggtatacactaatgatagcttttggatacctggttctacagatgatagaggcccatctcacccccaaaaggagggaacaattatgaatatttcgttgggatttgagcatttaactacttgcttgggaaaagccaacaggtgcttacctcccagtcatcaatcttggctggcaatagtgcctgaaggtaacatctctgtggcacaattacatatgctttctgaccttagtatttattacaatgattatgcccctgtaaccaaagtttaccgccctcaaaaacctatctgtatagtggattgaacatgttcagaaaaaaatgaagatatttacttgggaagattgtattgcagggcaagcaaaggtgttgtgtaatgattcatatggagtcactattgattggtcccctaaaggggcatttataaggctcacttctcaatctgtaggtaatggtcaccctgcatctaaagaaaatgatcagatggtagacactataaaaaatacaacaaaagttcctattatttggacatatggtgatatggtggaacctcgaccccaaatgatacgacctgctgtaggagctaaacataaggaattgtggaaaatattaatggcactgaaaaagataaaagatttgggaagggaaatatactaagccatcccaatataatcctaattacatgttagaattggctcacaatgattcagtctggatacatagttgtgtctgtcctccctttctgcttgtagtgagtgatttaaaacttgatctccctaatcatcatgtgactgtcaagaatgtagattgttttcttgtgtgaattcttccttgtataatactgatcattctatcttagtggtaagagcccgagaaggagtatggatacctgtaaagctttcccgtccttgagaagcctctccttctgtgcatattattactgaaattcttcaaaagattttgaggcactctcagggtttcattgctactttaatcattatgggattgattgctgtcacagctactgccacggtagctggagttgctttaccaacacagtacaaacagcagattatgtaaataattggcagaaaaattctactttgctgtggaattcccaaactaatatacaccagaaattaaccaatcagattaatgatctccgacaaactatcgtatggttgggagatcatgtagttagtttaaaatatagaatgcagttaacaatgtgattgaaatacttctgatttttgcattactcctcacctgtataatgaaacagagcatgagtgggaaagagttaagagacatttaaaggatcatactggaaatttatctttggatattgcaaaactgaaggaacacatatttcaagcctctcaggcacatctgacattaatgacaggaactaaagtgcttgaaggagctgcagatggattagcagctattcacccatacaagtggatcaagacacttggagactttgtgatttcaatgatgattgtgcctttaatctgtattgtttgtctttgtgtagtctgcagatgtggatcccgaatcctgcgagaagtagcccaccatgacgaagctgcctttgcttttatcgctttgcaaaaacagaaaaggggacatgctgggaacaggccctaagcctgtcataaacaggccttaaactgaccatgaacaggatttctgcacgaatgtgacgtgctcctgatggctatgacgcccactgctagaagttgttagtttactggagcagggtagggaacacctggcccacccggagcggaaaactgctcaaaccacaaacaacagcatgagtggcctgagccttaacaacatgtttttgctgcagataatcggccagagactgtttctctactcctctctaagtatgctttgtttttcgtaaggaatgcttttagctaatctgtaacctatagaaacaatgcttatcactggcttgctgtcaataaacatgtgggtcaaactctgtttgtggctctcagctctcaaggctgttttccccctgattcccactttgcactttatttctgtgtgtttgtcttcattcctctagcaccactgggttggggtctccttgaccaagctggtctcggcacatatgcatgtatgcccaggtcctgaaatcagccttgtggagcctgtgggtaggaaaagtcaaccctctgtgcatgtaggcctggaacctgaccaatactgtattttcctaccacgtttggtttcaaatgtggaaactgcccatacggacctactgcatttgtttttaaaaatcctctgtaagtggacctgcacagttcaggcccagattgttccaggatcaaccctacagtagaaatcaagtatctttttcattgtctcttgggatctgccttttcaccaataaaatatgagggctgttgggagcaggcccccccaaatctggccataaactgtccccaaaactggccataaacaaaatctctgcagcactataacatgttcataatggccataacgcccaagttggaaggttgtggatttacaggaatgagggcaaggaacacctggcctgcccagggtggaaaaccacttaaaggcattcttaagccacaaacaatagcatgagtgatctgtgccttaagaacatgctcctgctgcagttaactagcccaacatattcctttaattcagtccatcccttcgtttcccataagggatacttttagttaatttaatatctatagaaagaatgctaatgactggtttgctgttaataaatacgtgggtaaatctctgtttggggctctcaactctgaaggctgtgagacccctgatttcccacttgacacctcta
